United States Patent 10,760,091 (GENES AND USES FOR PLANT ENHANCEMENT) - sequence listing, part 2

SEQ ID NO: 3000 - protein, 304 aa, Streptococcus didelphis
EPGAEEKYKEVQEAYETLSDEQKRAAYDQYGAAGANGGFGGGAGGFGGFGGGAAGFGGFEDIFSSFFGGGGSSRNPNAPRQGDDLQYRVNLTFEEAIFGTEKEVKYNREASCRTCNGSGAKPGTSPVTCGRCHGSGVINVDTQTPLGMMRRQVTCDVCHGRGQEIKDPCATCHGTGHEKQAHSVHVKIPAGVETGQQIRLAGQGEAGFNGGPYGDLYVVVSVEASDKFEREGTTIFYTLNLNFVQAALGDTVDIPTVHGDVELVIPEGTQTGKRFRLRGKGAPSLRGGAVGDQFVTVNVVTPTG

SEQ ID NO: 3001 - protein, 77 aa, Arabidopsis thaliana
  misc_feature (32)..(34): Xaa can be any naturally occurring amino acid
  misc_feature (38)..(38): Xaa can be any naturally occurring amino acid
  misc_feature (40)..(43): Xaa can be any naturally occurring amino acid
  misc_feature (46)..(46): Xaa can be any naturally occurring amino acid
  misc_feature (48)..(49): Xaa can be any naturally occurring amino acid
  misc_feature (51)..(52): Xaa can be any naturally occurring amino acid
  misc_feature (54)..(54): Xaa can be any naturally occurring amino acid
MASSMLSSATMVASPAQATMVAPFNGLKSSAXXXATRXAXXXXTFXTXXVXXIXLPCLSPFFYVFFFPPPSFFFLSL

SEQ ID NO: 3002 - protein, 317 aa, Streptococcus dysgalactiae
KYHPDINKEAGAEQKYKDVQEAYETLSDSQKRAAYDQYGAAGANGGFGGGAGGFGGFDGGGFGGFEDIFSSFFGGGGMRNPNAPRQGDDLQYRVNLSFEEAVFGVEKEVSYNREATCGTCSGSGAKPGTSPVTCHKCHGSGVMTVDTQTPLGMMRRQVTCDVCHGTGQEIKEPCPTCHGTGHEKKVHKVSVKIPAGVETGQQIRLQGQGEAGFNGGPYGDLFVILNVLPSKKFERNGSTIYYSLDISFTQAALGDTVDIPTVHGDVEMAIPAGTQTGKTFRLKGKGAPKLRGGGQGDQHVTVNIVTPTKLNDAQKEA

SEQ ID NO: 3003 - protein, 610 aa, Parentucellia viscosa
SGKPFYAIIHRVTASLIVDFEPVKPHEVPMTAAGALQSYKLASKAISRLQSLPSGSMERLCETMVQEVFELTGYDRVMIYKFHDDDHGEVLTEITKPGLEPYVGLHYPATDIPQAARFLFMRNKVRMICDCRANHVRVIQDQNLPLDLTLCGSTLRAPHSCHLQYMENMNSIASLVMSVVVNEGNEEAGPDELSQHLKRRLWGLVVCHNTSPRFVPFPLRYACEFLAQVFAIHVNKELELENQMLEKNILRTQTLLCDMLLRDAPLGIVSQSPNVMDLVKCDGAILLHKDQKHRLGITPSDFQIRDIVSWLDEYHRDSTGLSTDSLYDAGFPGALALGDIVCGMAAVRITDRDWLFWFRSHTASEIRWGGAKHELGERDDGRKMHPRSSFKAFLEVVKTRSLPWKDFEMDAIHSLQLILRNASSKEMEERKDLEGVEIQARLNELQIDGVQELEAVTSEMVRLIETASVPILAVGVDGLVNGWDTKIADLTGLPVDKAIGVHFLSLVEESSTEAVGKMLELALEGKEEQNVHFEIKNHGPNSDSSPISLIVNACSSRDVRENVVGVCFIAQDITTQKSVMDKFTRIEGDYRAIVQNPNPVIPPIFGTDEF

SEQ ID NO: 3004 - protein, 129 aa, Zea mays
  misc_feature (33)..(33): Xaa can be any naturally occurring amino acid
MATGPRSLHALLGGGAVADLLLWRRRNASAAAXVGATTVWFVFERAGYSFPSVLSNALLLLVAILFFWAKSASLLNRPLPPLPNLEVSDAIVEKAANHALVWINRLLAVGHDIAIKRDRKVFIKVCVFL

SEQ ID NO: 3005 - protein, 335 aa, Streptococcus infantarius
PDINKEPGAEEKYKEIQEAYETLGDEQKRAAYDQYGPAGANGGFGGGAGGFGGFDGAGFGGFEDIFSSFFGGGGGMRNPNAPRQGDDLQYRVNLTFEEAVFGVEKEVVYNRESTCSTCHGSGAKPGTSPVTCSRCHGSGVINVDTQTPLGMMRRQVTCDVCHGKGKEIKEPCHTCHGTGHEKKTHKVSVKIPAGVETGQQIRLQGQGEAGFNGGPYGDLFVIINVLPSNKFERNGSTIYYTMNISFVQAALGDTVEVPTVHGDVEMTIPAGTQTGKTFRLRGKGAPKLHGGGQGDQHVTVNIVTPTKLNDAQVKALNNLRKQVATKLEIQRKKAS

SEQ ID NO: 3006 - protein, 607 aa, Paulownia tomentosa
SGKPFYAIIHRVTGSLIVDFEPVKPHEVPMTAAGALQSYKLAAKAITRLQSLPSGSMERLCDTMVQEVFELTGYDRVMIYKFHDDDHGEVFTEITKPGLEPYAGLHYPATDIPQAARFLSMKNKVRMICDCRANHVKVVQDENLPFDLTLCGSTLRAPHSCHLQYMENMNSIASLVMSAVVNEGDEEGSDSSHPEKRKRLWGLVVCHNTTPRFVPFPLRYACEFLAQVFAIHVNKELELENQMLEKNILRTQTLLCDMLLRDAPLGIVSQSPNVMDLVKCDGAALLYKNKKYRLGLTPSDFQIRDIVSWLDEYHRDSTGLSTDSLYDAGFPGALALGDAVCGMAAVRITDKDWLFWFRSHTAAEIRWGGAKHEPGGKDDGRKMHPRSSFKAFLEVVKTRSLPWKDYEMDAIHSLQLILRNAFKEAEDTDLGSKAIHTRLNDLQIEGIQELEAVTSEMVRLIETASVPILAVDVDGLVNGWNTKIADLTGLPVDKAIGRHFLALVEDSSADTVSKMLELALQGKEERNVQFEIKTHGPRSESGPISLVVNACASRDVKENVVGVCFIAQDITAQKSMMDKFTRIEGDYRAIVQNPNPLIPPIFGTDEF

SEQ ID NO: 3007 - protein, 612 aa, Pedicularis densispica
SGKPFYAIVHRVTGSLIVDFEPVKPHDVPMTAAGALQSYKLAAKAITRLQALSSGSLERLCDTMSQEVFELTGYDRVMIYKFHEDDHGEVLSEITKPGLEPYLGLHYPATDIPQAARFLFMKNKVRMICDCRANHVRVIQDDNLHFDLTLCGSTLRAPHSCHLQYMENMNSIASLVMSVVINEGNEDEPESSSSSSHPDKRKRLWGLVVCHNTTPRFVPFPLRYACEFLVQVFAIHVSKEIELENQTLEKNILRTQTLLCDLLLRDAPLGIVSKSPNVMDLVKCNGAILIHKTKKYRLGMTPSDFQIRDIVSWLDEYHRDSTGLSTDSLYDAGFPGALALGDAVCGMAAVRITDKDWLFWFRSHTASEIRWGGAKHEPDDKDDGRKMHPRSSFKAFLEVVKTRSLPWKDFEMDAIHSLQLILRNASNKEAEASDVKGKEIHARLNGLQLDGMQELDAVTSEMVRLIETASVPIFAVGADGLVNGWNTKIADLTGLPVDRATGSHFVSLVDDSSVEAVKKMLELALQGNEEQNVQFEFKTHGPRSESGPVSLVVNACASRDLKENIVGVCFIAQDITTQKSMMDKFTRIEGDYRAIVQNPNQLIPPIFGSDEF

SEQ ID NO: 3008 - protein, 611 aa, Pedicularis foliosa
SGKPFYAIIHRVTGSLIVDFEPVKPHEVPMTAAGALQSYKLAAKAITRLQALPSGSLERLCDTMVQEVFELTGYDRVMIYKFHDDDHGEVLSEITKPGLEPYVGLHYPATDIPQAARFLFMKNKVRMICDCRANHVRVIQDDNLPFDLTLCGSTLRAPHSCHLQYMENMNSIASLVMSVVVNEGNEDGPDSSSSSHPDKKKRLWGLVVCHNTSPRFVPFPLRYACEFLAQVFAIHVNKEFELENQTLEKNILRTQTLLCDMLLRDAPLGIVSKSPNVMDLVKCNGAILIHKTKKYRLGMTPSDFQIRDIVSWLDEYHRDSTGLSTDSLYDAGLPGALALGDAVCGMAAVRITDEDWLFWFRSHTAAEIRWGGAKHEPGEKDDGRKMHPRSSFKAFLEVVKTRSLPWKDFEMDAIHSLQLVLRNASNKEAEERDTNGKEIHAGLNDLQLDGIQELEAVTSEMVRLIETASVPIFAVGVDGLVNGWNTKIADLTGLPVDKAMGSHFVALVDDSSAEAVNRMLELALQGNEEQNVQFEFKTHGPRSESGPVSLVVNACASRDVKENIVGVCFIAQDITTQKSMMDKFTRIEGDYRAIVQNPNQLIPPIFGTDEF

SEQ ID NO: 3009 - protein, 612 aa, Pedicularis gyrorhyncha
SGKPFYAIVHRVTGSLIVDFEPVKPHDVPMTAAGALQSYKLAAKAITRLQALSSGSLERLCDTMAQEVFELTGYDRVMIYKFHEDDHGEVLSEITKPGLEPYVGLHYPATDIPQAARFLFMKNKVRMICDCRANHVRVIQDDNLHFDLTLCGSTLRAPHSCHLQYMENTNSIASLVMSVVINEGNEDGPESSSSSSHPDKKKRLWGLVVCHNTSPRFVPFPLRYACEFLVQVFAIHVNKEIELENQTLEKNILRTQTLLCDLLLRDAPLGIVSRSPNVMDLVKCNGAILIHKTKKYRLGTTPSDFQIRDIVSWLDEYHRDSTGLSTDSLYDAGFPGALALGDAVCGMAAVRITDKDWLFWFRSHTASEIRWGGAKHEPDEKDDGRKMHPRSSFKAFLEVVKTRSLPWKDFEMDAIHSLQLILRNASNKEAEASDVNGKEIHARLNVLQLDGMQELDAVTSEMVRLIETASVPIFAVGADGLVNGWNTKIADLTGLPVDTATGSHFVSLVDDSSAEAVKKMLELALQGNEEQNVQFEFKTHGPRSESGPVSLVVNACASRDVKENIVGVCFIAQDITTQKSMMDKFTRIEGDYRAIVQNPNQLIPPIFGSDEF

SEQ ID NO: 3010 - protein, 278 aa, Oryza sativa
  misc_feature (91)..(91): Xaa can be any naturally occurring amino acid
  misc_feature (242)..(242): Xaa can be any naturally occurring amino acid
MDREALRMVCSREFWRMAVLWTVSLLYSYILLFFLRRGAPVPRLRPMPEPDDDAARRRRRRPVCVITGATSGLGKAAAAALAREGYHVILXTVQQIRDQQPDAHLEAFQIDLSSYKSIKKFETSLNQWIKDSNMEHSIQLLVNNAGILAKSYRITEDGLDEMIQANYIGPFVLTNILLPLLKNSSTPSRVVNLTSFTHRCVSEINLSEKGLSGVRFGHWPARRSYLLASTYEYTKFCLLMFXSYELHRQLHLSSGVSVMYVPSILVACIFFSFAYFLC

SEQ ID NO: 3011 - protein, 371 aa, Bacillus anthracis str. A2012
  misc_feature (20)..(20): Xaa can be any naturally occurring amino acid
  misc_feature (103)..(103): Xaa can be any naturally occurring amino acid
  misc_feature (111)..(111): Xaa can be any naturally occurring amino acid
MSKRDYYEVLGLSKGASKDXIKKAYRRLAKKYHPDVSKEENAIEKFKEVQEAYEVLSDDQKRAQYDQFGHAGANQGFGGFGGGGDFGGGFGFEDIFSSFFGGXGGRRRDPXAPRQGADLQYQVTLEFEEAIFGKELNVEIPVEDPCDTCKGSGAKPGTSKETCKHCSGSGQVSVEQNTPFGRIVNRQACSHCSGTGQMIKEKCTTCHGSGKVRKRKKINVKIPAGIDNGQQIRVSGKGEAGVNGGPAGDLYVVVHVRSHEFFEREGDHIICEMPLTFAQMALGAEVEVPTVHGKVKLKIPAGTQTGTEFRLKGKGAPNVRGYGQGDQYVVVRVVVPTKLTSHQKDLLREFAGQEEQDDSLFGKLKRAFKGE

SEQ ID NO: 3012 - protein, 480 aa, Kineococcus radiotolerans SRS30216
MAHPHGKKHDTSTDDGGGLTGAVVVVALVSAISGLLYGYDTGIISGALLQIGDEFEIGNGWEQLIAASILAGAVVGALTCSRLSERRGRRGTLLVVAVVFVVGTLGAAFAPNPELLSLARLVLGFAVGGATQTAPVYVAELAPTKYRGRLVLFFQIAIGVGILTATIVGASEAVDWRVSIGAAAVPAAIMLVLMLRLPESPRWLLKSDQQDRARQSLERVRPRGADVAGELHEIDALVREESSAGTRGWRGLREAWVRPALVVGCGLAIATQLSGIEMIVYYSPTILTDNGFADSTALQVSVGLGATYLITQLIGLAIIDRVGRRRLTLITLPGAALALIVLGTFFVTGNDGKEQVPYIIATLIAFMAFTAGGIQLMGWLTGSEIYPLATRSAGAAAQSASLWGTNLLITLTLLSIIDTIGTGQTFWLYAAFNVLAFVFLYKRMPELTGHSLEEIEGRLHEGRFRPADFAKEPAERAASR

SEQ ID NO: 3013 - protein, 692 aa, Gloeobacter violaceus PCC 7421
MPTDTLAKTLCPYCGVGCGLEVTADARVRGDRAHPSTLGMVCVKGATVLESIGKDRLLYPMVRARLDEPFRQASWEEALALVVGRLRAASPESLCFYGSGQFVTEDYYVAQKLFKGCLGSNHIDANSRLCMSSAVSGYLQSLGSDGPPACYDDLDLTDCAFLVGTNTAECHPVLFNRLLKHRKQDLNSRLVVVDPRATPTAKAADLHLAIRPGSDIDLFNGIAHLILQWDRADQRFIGAHTQGFAAMAEVVRHYPPEAVARRCGITTAALELAARLWVNSARVLSLWSMGINQSIEGTAKVRALINLHLLTAQIGRPGSGPFSLTGQPNAMGGREAGGLSQLLPGYRSVADPDHRRQVEEHWQLPSGSIAARPGRTAWEMIEALEAGAVEVFWIAATNPAVSLPDLERTKAALLRSPFTVYQDCYYPTETARYAHVLLPATQWSEKTGTMTNSERRVTLCPAFHPPPGEARDDWQIFAEVGRRLGFAEQFAFADAAAVFAEFAALTRGRPCEMTGISHARLEREGPLQWPCPAGSAGTARLYTDWRFATPDARARFAACHARGLAEPPDPEYPFVLINGRLYGHWHTLTRTGRIEKLLNLYPEPFIEIHPRDAGKLGLGEGDWVEVRSRRGAIRLPARLTLAVAPGTVFVPMHWGALWAEAAEVNALTHPESDPISGQPEVKSCAVQLSALP

SEQ ID NO: 3014 - protein, 756 aa, Nocardia farcinica IFM 10152
MSQAEAPESADDLHTSPSSPSRDRLRGILRHDLPSSVVVFLVALPLSLGIAIASDAPIMAGLIAAVIGGIVAGAVGGSPMLASGPAAGLTVVVAELVAKFGWQVTCAITVAAGALQILFGLSRIARAALAISPVVVHAMLAGIGITIALQQVHVLLGGTSRSSVWQNLSQLPAQLTRLHWGDLTIGLIVIVTLLSWKKVPGALGRIPGALVAVVAATAVSLVVPLGVERIVMNGSLFDAIALPALPDGKWLAVATGVLTVALIASVESLLSAVAVDKMHSGARTDLNRELIGQGTANIASGMLGGLPITGVIVRSATNVAAGAKSKASTILHGVWILLFSVLLAGVVQQIPKAALAGLLIVIGIQLVKLAHIRLAHRTGDLWVYLITVAGVMFLNLLEGVLIGLIVAIALFVWRAARADIHAEPVGDLDSLRWRVVIEGSCSFLSLPKLSSTLDSVPEGADVTIELTVDFIDHAATEVLHEWQRRHRDAGGTVLIDELGSHALSATTQGPPQRASSAQARGVEPWKAWQDTNAQAVPHFDALRPMLDGISRYHRRHAPLMRAHLSELRDRQDPTTFFLTCGDSRVVPNLITHSGPGDLFTIRNIGNLIPSDGLDTSVDAALAFAVEELGVSTIVVCGHSGCGAMGALLGKPTKNSPAVRDWLAHAEPSLRAYHDNHPVAAAAEAAGFDAYDQLAIVNVAVQIATATQHPSLVSAVAQGQVQIVGLFFDIATATVWHVSPTTVTAHHNQLATSTVHA

SEQ ID NO: 3015 - protein, 463 aa, Rickettsia akari str. Hartford
MSFLRKKSFESVKEIGSSSGLSKTLGALDLILLGLGAMIGTGVFVVTGIIAAKYSGPAVMLSYAIAGITCIFVALVYTELAAMLPTSGSIYTYSYVAFGEVFAWMIGSVIILELGVAAGIVAAGWSGYVQGILAAGGINLPKELTTVPTNGGIINLPAFLISVFIGFILYLGTKDSKRLNAILVFIKMVAIFVFILAAAPHFDVTNWSNFMPFGFSNVLVGASILFLAFTGFGTIATAAEECKNPKRDIMIGIIGSLVLTTIVYVTMAGLVTGIAHFDQLNNDQPLAYALTINNSKIGSAIVATGAVCGMMTVLMMNIYGTSRIFYAIARDGLLPKSFAKLHPKYDSPYITIIIFASLSAILGGFCSTELLTQFTSMGALIDYITVTIIVVLFRVKLPDAQRPFKCPLVFIIVPFILIACAYLLFIQIYDGEFNILMAGRALIYWFITIFILYIIRSFFMTKE

SEQ ID NO: 3016 - protein, 482 aa, Triticum aestivum
MWRRHLLRRLLPSPATAGTPSPLVRHLSTTPTPSSTTDTTSIASSLAAAVTKLSSTPPPATSPDAYFSLHFSDVRPTNALLAETLSLSPPATSRAAADLFRFLVRRSLHPSDGALALVVRHLARRRDFPAVRTLLQEFPSALGPDTVDAYLFHLARAGRATDALKVFDELPGELRTRGALTSLVSSLSSEGFPQLAERAVKKIAHEIFPDDNICTLLVSGYADAGKLDHALRLIGETRNGGFQPGLDAYNAVLDCVCRLCRKKDPLRMPVEAEKFLVDMEANGIPRDAGTFRVLIKNLCKIRRTEDAMKLFRQMGEWGCSPDADTYLVLIKSLYQAARISEGDELMIWMRSAGFGDKLDRKAYYGFIKVLCGIERVEHAVKVFRLMKGYGHAPGTKSYSLLIEKLASHNLGDRSNALFREAVARGVTVTPGVYKIDKMYVKEKKEKKVKKKLTLPEKKILKSKRLYKLKMSFVKKPKRRMRA

SEQ ID NO: 3017 - protein, 594 aa, Coprinopsis cinerea okayama7#130
MAILPPGVRFVGRGVAYMTVFVGGLVGATKIAESRGFAIPLWLVLTGAAVAIPTLAGLRIAAGEFKKRRRARALGARTVPKLQGKKFGNLDVLTTTLSNIAVGYPGDGLDEVIEARGPVFNFWLLWSDSIFTICPEHLKTILATDFSSHVKGPQFIRNMGSVLGSGVFNSDGEMWKFHRSITRPVFTRDRISDFDIFDHHTDIALQKLKERLREGYAVDFQDLMARFTLDTATQFLFGNCVNSLDAGLPYPAKFGLTVHQTLSGKKADDFARAFMEAQEAIANRERVGWIWPLFEFWKDKTEEPMKTVRAFIDPIVKEAIANRATQSLEEKTSGEKEIQDGQTLLDYLVNVTQDPTILRDEILNIMIAGRDTTAATLTFCIYLLSQHPDVFQRLRTEVLEKVGPSRRPNFDDLRDMRYLRAVLNETLRLFPIVPFNVRETANETVWPSPDPNEQALYIPPGTKITYSVFMMQRRTDLWGLDAEEFDPDRFIDERLKKYLIKNSFIFLPFNAGPRICLGQQYAYNEMSFMLIRLAQQFSSISLDLDSAPPEALAPKIWAESQGRKATEKVFPKFHLTMYAAGGLWVKMEEATGTD

SEQ ID NO: 3018 - protein, 666 aa, Bacillus anthracis str. Ames
MSHSIEQLSINTIRTLSIDAIEKANSGHPGMPMGAAPMAYTLWTQFMKHNPNNPTWFNRDRFVLSAGHGSMLLYSLLHLSGYDVTMDDLKNFRQWGSKTPGHPEYGHTAGVDATTGPLGQGIATAVGMAMAERHLAAKYNRDAYNIVDHYTYAICGDGDLMEGVSAEASSLAAHLQLGRLVVLYDSNDISLDGDLNRSFSESVEDRYKAYGWQVIRVEDGNDIEAIAKAIEEAKADEKRPTLIEVRTTIGFGSPNKSGKSASHGSPLGVEETKLTKEAYAWTAEQDFHVAEEVYENFRKTVQDVGETAQAEWNTMLGEYAQAYPELANELQAAMNGLLPEGWEQNLPTYELGSKAATRNSSGAVINAIAESVPSFFGGSADLAGSNKTYMNNEKDFTRDDYSGKNIWYGVREFAMGAAMNGIALHGGLKTYGGTFFVFSDYLRPAIRLAALMQLPVTYVFTHDSIAVGEDGPTHEPIEQLAALRAMPNVSVIRPADGNESVAAWRLALESTNKPTALVLTRQDLPTLEGAKDDTYEKVAKGAYVVSASKKETADVILLATGSEVSLAVEAQKALAVDGVDASVVSMPSMDRFEAQTAEYKESVLPKAVTKRFAIEMGATFGWHRYVGLEGDVLGIDTFGASAPGEKIMEEYGFTVENVVRKVKEML

SEQ ID NO: 3019 - protein, 113 aa, Zea mays
  misc_feature (26)..(26): Xaa can be any naturally occurring amino acid
  misc_feature (52)..(52): Xaa can be any naturally occurring amino acid
  misc_feature (61)..(61): Xaa can be any naturally occurring amino acid
RFSFYDANKPTYTSRRNLPPSIVNNXTDSIISHGCFLDYCGVKYSVVGVRSXIGTNMHLKXCIIDKNVRIGKNVMISNSEGVEEADRTSEGFYILSGITIVLKNSIIGDVLVI

SEQ ID NO: 3020 - protein, 886 aa, Escherichia coli
MSERFPNDVDPIETRDWLQAIESVIREEGVERAQYLIDQLLAEARKGGVNVAAGTGISNYINTIPVEEQPEYPGNLELERRIRSAIRWNAIMTVLRASKKDLELGGHMASFQSSATIYDVCFNHFFRARNEQDGGDLVYFQGHISRGVYARAFLEGRLTQEQLDNFRQEVHGNGLSSYPHPKLMPEFWQFPTVSMGLGPIGAIYQAKFLKYLEHRGLKDTSKQTVYAFLGDGEMDEPESKGAITIATREKLDNLVFVINCNLQRLDGPVTGNGKINELEGIFEGAGWNVIKVMWGSRWDELLRKDTSGKLIQLMNETVDGDYQTFKSKDGAYVREHFFGKYPETAALVADWTDEQIWALNRGGHDPKKIYAAFKKAQETKGKATVILAHTIKGYGMGDAAEGKNIAHQVKKMNMDGVRHIRDRFNVPVSDADIEKLPYITFPEGSEEHTYLHAQRQKLHGYLPSRQPNFTEKLELPSLQDFGALLEEQSKEISTTIAFVRALNVMLKNKSIKDRLVPIIADEARTFGMEGLFRQIGIYSPNGQQYTPQDREQVAYYKEDEKGQILQEGINELGAGCSWLAAATSYSTNNLPMIPFYIYYSMFGFQRIGDLCWAAGDQQARGFLIGGTSGRTTLNGEGLQHEDGHSHIQSLTIPNCISYDPAYAYEVAVIMHDGLERMYGEKQENVYYYITTLNENYHMPAMPEGAEEGIRKGIYKLETIEGSKGKVQLLGSGSILRHVREAAEILAKDYGVGSDVYSVTSFTELARDGQDCERWNMLHPLETPRVPYIAQVMNDAPAVASTDYMKLFAEQVRTYVPADDYRVLGTDGFGRSDSRENLRHHFEVDASYVVVAALGELAKRGEIDKKVVADAIAKFNIDADKVNPRLA

SEQ ID NO: 3021 - protein, 567 aa, Artemisia annua
MDLRRKLPPKPPSSTTTKQPSHRSHSPTPIPKASDALPLPLYLTNTFFFTLFFSVAYYLLHRWRDKIRSGTPLHVVTLTELSAIVLLIASFIYLLGFFGIDFVQSFTSRENEQLNNDDHNVVSTNNVLSDRRLVYDYGFDVTGDNDNDNDDDVIVKSVVSGEVNSYSLEASLGDCYRAAKIRKRAVERIVGREVLGLGFEGFDYESILGQCCEMPIGYVQVPVGVAGPLLLNGGEFMVPMATTEGCLVASTNRGCKAICLSGGATAILLKDGMTRAPVVRFATAERASQLKFYLEDGVNFDTLSVVFNKSSRFARLQNIQCSIAGKNLYIRFTCSTGDAMGMNMVSKGVQNVLDFLQNDFPDMDVIGISWKFCSDKKPTAVNWIEGRGKSVVFQAVITKKVVRKSALNPQTCTCRTLTCLRPLLVLLLLVLLVDLMHMLHIVSAVFIATGQDPAQNIESSHCITMMEAVNNGKDLHVNVTMPSIEVGTVGGGTQLASQSACLNLLGVKGACIESPGSNAQLLARIVAGSVLAGELSLMSAISAGQLVKSHMKYNRSSRDMSAIASKV

SEQ ID NO: 3022 - protein, 175 aa, Ipomoea nil
MAKMSDPLVIGRVVGDVVDHFSQSVKMSVVYNSNKHVYNGHEFFPSLLTSKPKVEVHDGDLRSFFTLIMTDPDVPGPSDPYLREHLHWIVTDIPGTTDSSFGREIVSYETPKPNIGIHRFVFLLYKQKRRQSVTVSSSPSRDRFNTRKFADDNDLGSPVAAVFFNCQRETAARRR

SEQ ID NO: 3023 - protein, 330 aa, Burkholderia mallei ATCC 23344
MSSTATPSLSAAHLLAPIASDMEQVNRVIRQSLASDVLLINQIAEYIIGAGGKRLRPALLLLVAGALGENTSQKHVLAAVVEFIHTATLLHDDVVDESELRRGRKTANALFGNAASVLVGDYLYSRSFEMMVGVGKMRVMEILSEATTIISEGEVLQLLNMHDADVDEARYMQVIRYKTAKLFEAAARLGAVLAGADAPTEAAAAEYGRRIGTAFQIMDDWLDYAGTAESMGKNAGDDLREGKPTLPLIYLIERGTPEQSTLAREAIEHGGTDRFDTIFDAITRSGALDHTLECARQEAQAAAAAISSFPSSNFKESLLELCSYSMSRQS

SEQ ID NO: 3024 - protein, 525 aa, Yersinia pestis CO92
MTKNIHKHRILILDFGSQYTQLLARRVREIGVYCELWAWDVTEAQIREFNPSGIILSGSPESTIENGSPRAPDYVFTAGVPVLGVCYGMQTMAIQLGGKVESSNQREFGYAQVEIKADSALIRDIKDAINPAGEAVLDVWMSHGDKVAEIPADFVTVASTDTCPFAIMANEEKRFYGVQFHPEVTHTKQGLRLLERFVLGICGCEALWTSATIIEDAIVRLREQIGDDHVILGLSGGVDSSVTAMLLHRAIGKRLTCVFVDNGLLRLNEADQVLEMFGDKFGLNIVHVAAEDRFLSALTGVDEPEAKRKIIGRVFVELFDEEACKQEQVKWLAQGTIYPDVIESAASATGKAHVIKSHHNVGGLPKEMKLGLVEPLKELFKDEVRKIGLELGLPYDMLYRHPFPGPGLGVRVLGEVKKEYCDLLRRADAIFIEELHKADLYNKVSQAFTVFLPVRSVGVMGDGRKYDWVVSLRAVETVDFMTAHWAHLPYDFLGRVSNRIINEVNGISRVVYDISGKPPATIEWE

SEQ ID NO: 3025 - protein, 234 aa, Brassica napus
MMMQSMSMVKLKFGFTSVRMRNLSVGISVMVLTLILIILQPGHKLTKKNQTVDEFDIEEESTVVQKPHLITMEDLDYLFSNSSFYKEEDESNVFLVWSLMRPFLERHDALPETGQGIEEAALAIKDLVSLINKEKLASASGMVSRRTCPDFVNAADVDLSGSRPVLELPCGLTEDSSITFVGVPDEHSRSFQIHLLGSGVLRYDVNFSKQSIVQNTWTERSGWGEEVRCPCHGS

SEQ ID NO: 3026 - protein, 345 aa, Pyrococcus horikoshii
MYKVAVIKGDGIGPEVIDAAIRVVKSVTDKIKFYEFEGGLSVFKKYGVPIREEDLEEIRKMDAILFGATTTPFDVPRYKSLIITLRKELDLYANLRIIPNFKLRKEIIIVRENSEGLYSGEGAYDSNKVVDFRIITRKGAERIAKFAVKLAKDRSTFLTFVHKANILESDRFFRKIVLDIARKEDVKVREEIVDSFTIKLVKDPWNLGIILSENMFGDILSDLATIHAGSIGIVPSGNYGEDIALFEPIHGSAPDIAGKGIANPIGAILSAAMMLDYLGLDGSIIWKAVGRYVRRGNLTPDMEGRATTLEVTNGIISEIYRLDEYEIDEVWRDEVRLGRILLEIS

SEQ ID NO: 3027 - protein, 235 aa, Rickettsia akari str. Hartford
MKDIEYWDKNFSGCKYSDKLIERLLLLNTQVKQPIDIREVKKGIYYARKYHGEQMRQSGDPYYSHPIAVTIMVAEFVAKEAPKLFTFRMLQAALLHDTIEDTELTEEMISNIFDEEVAMHVEGLTRIKACGKISSAKSLILLIKQKRYDTALIKLFDRIHNLQTLEAKSPEKAHKIIKETLKSFLVLSEILEIPSVSELIYTECYKNNLKFNINSTLNKIINFDSFPFSQNKLLP

SEQ ID NO: 3028 - protein, 474 aa, Arabidopsis thaliana
  misc_feature (97)..(97): Xaa can be any naturally occurring amino acid
  misc_feature (106)..(106): Xaa can be any naturally occurring amino acid
  misc_feature (122)..(122): Xaa can be any naturally occurring amino acid
  misc_feature (139)..(139): Xaa can be any naturally occurring amino acid
  misc_feature (152)..(152): Xaa can be any naturally occurring amino acid
  misc_feature (266)..(266): Xaa can be any naturally occurring amino acid
  misc_feature (274)..(274): Xaa can be any naturally occurring amino acid
MVFFRSVSAFTRLRSRVQGQQSSLSNSVRWIQMQSSTDLDLKSQLQELIPEHKDRLKKLKSEHGKVQLGNITVDMVIGGMRGMTGLLWETSLLDPEXGIRFRGLSXPECQKALLPTAQSGGXTITGGLLWLLLTGKVPXSKEQVEALSKDLXNRAAVSDYVYNAIDALPSTAHPMTQFASGVMALQVQSEFQKAYENGIHKSKFWEPTYEDCLNLIARVPVVAAYVYRRMYKNGDSIPSDKSLDYGANFSHMLGFDDERLKELMRXYITIHSDXHEGGNVSAHTGHLVGSALSDPYLSFAAALNGLAGPLHGLANQEVLLWIKSVVEECGEDISKEQLKEYVWKTLNSGKVIPGYGHGVLRNTDPRYVCQREFALKHHPDDPLFQCCKLMKLASCLTELESEEPWPNVDAHSGVLLNHYGLTEARYYTVLFGVSRSLGICSQLIWDRELLLALERPKSVTMDWLEAHCKKASSA

SEQ ID NO: 3029 - protein, 610 aa, Coprinopsis cinerea okayama7#130
MAILSPGIKFVGRGVAYVTVFVGGLVGATKVAESRGYFVPIWMVLTGAVVAGPALAGLYITAGELKKKRRARALGARVVPKCRGSKIGNLDVLSMTLKNLAVGYPGDGLDEIIKARGPVFNIWLLWSDTLLTTCPEHIKLILATDFHNYVKGPRFIHNMGSVLGSGVFNSDGEMWKFHRSITRPVFTRDRIGDFDIFDHHTDVVLQKLKERLREGHAVDFQARLSFIHSAIHLTTLQDLMARFTLDTATQFLFGHCVNSLDAGLPYPPKAAPYVSVQQTPAGKMADDFARAFMEAQEVIAIRERVGWIWPLLEFWKDKTVEPMKVVNAYIEPIVKDAIERKKNALPEEKSGDEKEIQEGQTLLDYLVNVTQDPTILRDEILNIMIAGRDTTAATLTFCIYLLSQHPDVFQRLRTEVLEKVGPSRRPNFDDLKDMKYLRAVLNETLRLFPIVPFNVRETIEETIWPSPDPNEKPLYIPPGTKTSYSVFMMHRRTDLWGPDAEEFDPDRFIDERLKKYLIKNSFIFLPFNAGPRICLGQQYAYNEMSFMLIRLMQQFSSVTLDLDSAPPEAIPPKVWAEAPGRKATEKVFPKLHLTMYAGGGLWVKMQEATD

SEQ ID NO: 3030 - protein, 120 aa, Rickettsia akari str. Hartford
MYNKENVFAKIINKNLPAEIIYEDEQMLAFKDIAPVAPVHIIVIPKNEYIDYADFISKAQIDEIKHFFAKIADIANEVGLDKDGYRLITNKGEKSGQTVLHFHFHIIGGEKLIGLINKND

SEQ ID NO: 3031 - protein, 141 aa, Populus tremula x Populus alba
YVGGGMGRTHRLETTFPRLAEPLGYVPKEDILYAVKAIVVTQRENGRRDDRKYSRMKYLISEWGIEKFRSVVEQYYGRKFEPSRELPEWEFKSYLGWHEQGDGGLFCGLHVDSGRIGGKMKATLRETIEKYNLDVRLTPNQ

SEQ ID NO: 3032 - protein, 416 aa, Candidatus Desulfococcus oleovorans Hxd3
MTTPYTYENSRRLFEKAAGVIPCGIYGHFSPAPLVPPENYPFFAQKASGARFTDIDGNEFIDYMCAYGPMVLGYNCEPVDRAALAQLEKGNCLSCPGPVMVELAEKLVNTVAQMDWAFFAKNGNDVTSYALMVARHATGRKKIVAIRGGYHGTAPWAQTFGHHGVTEEDAAHMVRIPWNDAAAFEAVLEQYPGQIAGFIATPYHHPVFADNEMPAQGYWQKIEALCRKHGVVLIVDDIRCGFRLDLRGSHVYFGFTPDLVCFCKAIGNGYPISALMGTDALKSAAAKVFYTGSYWFSAVPMAAAIATLDEMARINAAAAMLAYGEKLRDGLIETARRHGYDLKVSGHPAMPYLRITDDPSLMLHQRWCGECTRRGAFFTSHHNWFVSAAHTEEDLARTLEIADEAFAVIGDNPQKK

SEQ ID NO: 3033 - protein, 617 aa, Arabidopsis thaliana
  misc_feature (122)..(122): Xaa can be any naturally occurring amino acid
MFMASLSFTQFLSFPRCNADVPCLLQSHGFVKFRGERWNGKQSFSMAAGRRKLSESAPLEEEGNDGNGAVVGKKPSKSVKRTTKKKVVVKDEPLEEISEFLVDNDDVLDKESIVSALKPKKXTRTRKKAAAASSDVEEVKTEKKVRRKRTVKKDKDVEDDLATIMDAEVSDVEEALAVESTDTESEEEEIDLSKHEGEDISHTYGWPPLVCCFGSAQHAFVPSGRPANRLLDYELHERMRDAKWAPEKYIRAPGGCAGGVAIALASLGGKVAFMGKLGADDYGQAMLYYLNVCKVQTRSVKIDGKRVTACSTMKISKRGRLKSTCIKPCAEDSLSKSEINVDVLKEAKMFYFSTHSLLDKKMMSTTIQAIKISKQLGNVIFYDLNLPLPLWHSSEETKSFIQEVWNLADVIEITKQELEFLCGIEPTEEFDTENNDISKFVHYPPETVEQLWHENLKVLFVTNGTSKIHYYTKEHNGAVSGMEDVPITPFTRDMSASGDGIVAGLIRMLTVQPDLMNNKGYLERTARYAIECGIIDQWLLAQTRGYPPKDDMEEEEDDEEEDEVESDPNGIRSITEKEYRTSKPYDEPDGPYVMKPVEEREYKKLELVGSMFEDGSL

SEQ ID NO: 3034 - protein, 326 aa, Streptococcus agalactiae 2603V/R
MSSYWNNYPELKKNIDETNQLIQERIQVRNKDIEAALSQLTAAGGKQLRPAFFYLFSQLGNKENQDTQQLKKIAASLEILHVATLIHDDVIDDSPLRRGNMTIQSKFGKDIAVYTGDLLFTVFFDLILESMADTPFMRINAKSMRKILMGELDQMHLRYNQQQGIHHYLRAISGKTAELFKLASKEGAYFGGAEKEVVRLAGHIGFNIGMTFQILDDILDYTADKKTFNKPVLEDLAQGIYSLPLLLAIEENPDIFKPILDKKTDMATEDMEKIAYLVVSHRGVDKARHLARKFTEKAISDINKLPQSSAKKQLLQLTNYLLKRKI

SEQ ID NO: 3035 - protein, 309 aa, Burkholderia sp. 383
MTAPAAHTGRVTVVGSLNMDLVVRAPRLPLPGETLAGHAFAQAAGGKGGNQAVAAARLGAQVAMIGCVGADAHGAALRASLEAEGIDCAGLATSASASTGVALIVVDDASQNAIVIVAGGNGEVTTETVARHEAALASADVLICQLETPPEAVFAALSAGRRLGRTVVLNPAPAVAPLPDGWLPLVDYLIPNEVEAAALTALPVRDPAEAEAAARVLQAGGACNVLVTLGARGVLALTADGAARHYPAPAVQAVDTTAAGDTFIGGFSARLAAGADVDTAIRFAQRAAALSVTRAGAQPSIPTLAELTE

SEQ ID NO: 3036 - protein, 513 aa, Geobacter sulfurreducens PCA
MPRPLVLMILDGWGINPDPSNNAVAIGRTPAMDRLMAEYPSVEMETSGMAVGLPDGQMGNSEVGHLNIGAGRVVYQDLTRITKSIDDGDFFTNPVLLDCMARVKAAGGRLHLGGLLSDGGVHSHNTHLYALIELARRQGVKDVFVHAFLDGRDTPPSSGAGYLAELEAEIGRIGFGRVATVMGRYWAMDRDNRWERVERAYNTIVKGEGAHRPDSAAAIEASYSAGVTDEFVEPAVIAPNGSPLGLLADGDGFICFNFRSDRAREITRALTDPAFAGFDRSPWPRLASYVCLTEYDATFPLPVAYPPESLANILGQVVSRAGLRQLRIAETEKYAHVTFFFNGGVEEPFPGEERILIPSPKEVATYDQKPEMSAPLVTDALLKRIDEGVDDVVVVNFANADMVGHTGILDAAVRAIETVDECVGRVAATVLEKGGALIITADHGNAEMMVDETGGPHTAHTNERVPLILVDDSRKGARLRPGTLADIAPTMLGLLGIPQPPEMTGKSLLVATE

SEQ ID NO: 3037 - protein, 398 aa, Yersinia pestis CO92
MSEQLLTASTPIDAAPLSDNTVQTTAPATSKINLLDLNRQQMREFFAEMGEKPFRADQVMKWMYHYCYDDFEQMTDINKGLRAKLQRVAEIRAPEVAEEQRSVDGTIKWAIKVGDQQVETVYIPEADRATLCVSSQVGCALECKFCSTAQQGFNRNLRVSEIIGQVWRAAKIIGSLKSTGTRPITNVVMMGMGEPLLNLNNVVPAMDIMMDDFGFGLSKRRVTLSTSGVVPALDKLGDMIDVALAISLHAPTDDIRDEIVPINRKYNIETFLAAVRRYLDKSKANGGRVTVEYVMLDHINDSTEQAHQLAECLKDTPCKINLIPWNPFPGAPYGRSSNSRVDRFSKVLMEYGFTTIVRKTRGDDIDAACGQLAGEVIDRTKRTLKKKMAGEPIAIKTV

SEQ ID NO: 3038 - protein, 142 aa, Yersinia pestis CO92
MALERTFSIIKPNAVANNDIGAIYARFERAGFKIIAAKMLHLTKEQAEGFYAEHKGRPFFDGLVEFMTSGPIMVQVLEGENAVQRHRDIMGATNPDNALAGTLRADFSDSFTANAVHGSDAVESAQREIAYFFAADEIFPRS

SEQ ID NO: 3039 - protein, 312 aa, Zea mays
  misc_feature (267)..(267): Xaa can be any naturally occurring amino acid
  misc_feature (287)..(287): Xaa can be any naturally occurring amino acid
  misc_feature (294)..(294): Xaa can be any naturally occurring amino acid
MGSLPVPSVQALVVATGGDDVPPRYLRPDAAAEAVTGDGDGEAQIPIIDHRRLLLELDHGGEESARLHRACQDWGFFQLVNHSVPDDVVESMKANIQQFFQLPAETKKRFAQEEGQLEGYGQLFVVSDDQKLDWADMLFLYAQPPERRKTRFWPDQPATFRSTLDRYSGALKDVSDSLLATMAKNLGLKRETIAEKCTRGMQSFRMNYYPPCAQAEKVIGLSPHSDANLLTLVLQVNHVQGLQIKRNGSWLPVKPVPGAFIVNIGDXVEVFTNGRYRSIEHRAVVDXRKSRLSXAAFHFPDMDAMIGPSGRS

SEQ ID NO: 3040 - protein, 526 aa, Triticum aestivum
  misc_feature (520)..(520): Xaa can be any naturally occurring amino acid
MAAIKPPPPDRPPQAARLPSPSSSSSAVAAAKRGATGSRGLLMGRYELGRVLGKGTFAKVYHARHVQTGESVAIKVLDREKAVRSGLVSHIKREIAVLRCVRHPNIVHLFEVMATKTKIYFVMELLVRGGELFSRVSKGRLKEDIARRYFQHLISAVGFCHTRGVFHRDLKPENLLVDEAGNLKVSDFGLSAVAEPFQPEGLLHTFCGTPAYVAPEVLARRGYEGAKADIWSCGVILFVLMAGYLPFHDQNLMAMYRKVYKGEFRCPRWFSKDLTSLIMRFLDTNPSTRITLPEVMESRWFKKGFRPVKFYIEDDQLYNVIDAENDMLDLGLPDPLPQPLLPPPSSPSPQEVDGDDSGSESDASVVSCPATSSFEERHRLRGPLPRPASLNAFDIISFSRGFNLSGLFEEKGDEVRFISGEPMPGIITKLEEIANVKSFAVRKKDWRVSLEGTREGVKGPLTICAEIFELTPSLVVVEVKKKAGDKEEYDDFCNKELKPGMQHLVHQMAPVPITPTISEXAERPSR

SEQ ID NO: 3041 - protein, 389 aa, Gloeobacter violaceus PCC 7421
MTGSLLDQLRQMTIVVADTGDIQAIEQFTPRDATTNPSLITAAAQMPQYQQIVDDTLKQARAELGPEAKAAAVATLAFDRLAVAFGLKILAIVPGRVSTEVDARLSYDTEATIEKGRSLIAQYEAAGISRERVLIKIASTWEGIRAAEILEDEGIHCNLTLLFGVHQAIACAEAGVTLISPFVGRILDWYKKETGRDYEPHEDPGVVSVTTIYNYYKKFGYQTQVMGASFRNIGEIVELAGCDLLTISPKLLEQLQATDAELVRKLDPDQAAGLEIEKIDMDQATFEKRHAEDRMASEKLDEGIKGFTNALVALEKLLADRLARLEGEVALNQAFESIFRTFDLDGDGFITREEWMGTDAVFDAIDLNHDGKITAEELGAGIGAVSKLA

SEQ ID NO: 3042 - protein, 404 aa, Rhodococcus sp. RHA1
MLADYLARTAPDGIRIGLAGRSQAKLEATRAALGPRAADWPIIIADADADADADADADADDAVALAELASRTRVVATTVGPYAKYGTELVAAAVAAGTDYVDLTGEVLFVRTSIDAHHDKARANGVKVVHSCGYDSIPSDLGVHVLHRKVQADGAGELTDTTLVASLSGGVSGGTIDSLRTQIDLSRGDAALRRLAASPYSLSPDRTTEPDLGRQSDVAIVDGTEIAPQVRGWKAPFVMGSYNTRIVRRSNALQNWAYGRKFKYREVMSVGDSRLSRLYAAGVAAVLGGLVLGLSVPPTRFLLDRLLPAPGQGPSEKTQRTGYFAMDIYTTTTTGARYASRVTAQGDPGYRATAVLLGESALSLVLDRDRLPDEAGVLTPATALGDVLVDRLRGPGVEISARKL

SEQ ID NO: 3043 - protein, 542 aa, Fulvimarina pelagi HTCC2506
MTANIYETDLPKTGANYVQLSPIAFIERAASVYPNYTAVVHGKIRRTWGETFNRVKKMANALKKRGIGPGKTVSVILANTPEMFELHFAVPMTGGVLNTINTRLDAATVGFILNHAEADIFMVDPEFADVAKGAVEKAGRELLVVDVPDEMYEGDNGPIGAMTYDDLLAEGDADAEYWKPDDEWSAISLNYTSGTTGDPKGVVYHHRGAYLNALSNAHDWGIKPHPVYLWTLPMFHCNGWCYCWTLAALAGTAVCLRAVREKPILDLIRQEKVTHFCGAPIVLNTLASAPDELKKDLPSPIYAMTAAAPPPAAVIKRVEAMGISVTHAYGLTETYGPAVVCAWKSEWDSLPDDERAAMKARQGVRYTVLDDIMVADPDTMKPVPKDGETIGEIFFSGNNVMKGYLKNPEANKKSLRNGWFASGDLAVMHEDNYIEIKDRSKDIIISGGENISSIEIEGVLYKHDKIAEAAVVARPDEKWGETPCAFVVLRQGETMTEEEVIEYCKENMARFKAPKTVIFDELPKTSTGKIQKFVLRKKAEAL

SEQ ID NO: 3044 - protein, 126 aa, Candidatus Desulfococcus oleovorans Hxd3
MITPDFEKTGGLVPVVTQDAATGEVLMLAYINREAWETTLASGKATYYSRSRKQLWVKGESSGNVQIIKEIRIDCDNDTLLFRVEQIGGAACHRGYRSCFFTKVEADGTGRITQERVFDPAEVYKK

SEQ ID NO: 3045 - protein, 532 aa, Fulvimarina pelagi HTCC2506
MMDVPLLVSSILEHAAKYHTDTEVVSAGPGGAITRKTYGEVAKRSAQLAHALDELGMGEGDRIATLAWNSNRHLELYFAVGGSGKICHTINPRLFPDQVAFILNHAEDRMIFVEPIFVPLLEKLADKIPSGAKIVVLGETGEVPNSDVLSDLVAYEDLIAGKPESYDWPQLDENTACSLCYTSGTTGNPKGVLYSHRSSVLHAMAISWIDSIGIAGTDCALLVVPMFHVNAWGLPYACPMMGAKMVMPGANLDGASLQKLFDEEGVTMSAGVPTVWMGLTAHMEEQGATFKTLDRVAVGGSAMPAPLIERMNKLGVSVRHAWGMTETSPVGLASALKPKHRGLSDQERLEINAKQGRPMFGMEFRVENADGVEVERDGKEYGALLVRGPWVAERYFGRDSDSPAFRDDGWFETGDVVTMDADGYVKIVDRTKDVIKSGGEWISSIELENVATGHPAVKEAAVVAKTDEKWGERPVLFLVIKDGADAPSSSDMQTFYEGKVAKWCIPEDVRIVNDLPHTATGKLRKTDIRDML

SEQ ID NO: 3046 - protein, 402 aa, Streptococcus agalactiae 2603V/R
MKEILVLGAGYAGLKAVRNLQKQSGDFHITLVDMNDYHYEATELHEVAAGSQPKEKITFPIKDVINTNKVNFMQDEVLRVDAENKTVTVKNNGELHYDYVVVALGFVSETFGIKGAMENALQMTNISQAENIHNHIVNTMKLYRETKDENLLKLLVCGAGFTGIELAGAMVDERPKYAALAGVKPEQIEIICVEAATRILPMFDDELAQYGVNLIKDLGINLMLGSMIKEIKPGEVVYGTSKEDEELKSITAGTIIWTTGVSGSPVMGESGFDQRRGRVMVNSDLRDPKYDNVYVIGDVSAFMDTESGRPFPTTAQIATRMGAHVAKNLLHQIKGEATEDFSYSPQGTVASVGNTHGLGVVGKTKIKKYPASVMKKIIMNKSLVDMGGLKELLAKGRFDLYH

SEQ ID NO: 3047 - protein, 399 aa, Oryza sativa
  misc_feature (209)..(209): Xaa can be any naturally occurring amino acid
MMNGSNGSQGYHVNGKQVQSVVPSIQNNGPRHRPLTLMRRCRGMLCLVIMPLTAFMMMVYLSPVTTFLIRLFSVHYSRKSTCFLFGMWLAMWPFLFEKINKTKFVFSGETVPPKERVLLFANHRTEVDWMYLWDLALRKGRLQCIKYILKKSLMKLPIFNWAFHIIEFIPVERKWEVDEPLIRSRLSELKNPKDPLWLAVFPEGTDYTXREKKCIKSQEYAKEHGLPILNNVLLPKTKGFHCCLQELRDSMDSVCDITIAYKHRPPTFMDNVYGIDPSEVHIHVKIIQVSDIPTSEDEVADWLIERFKLKNKLLSDFSALGHFPNEGTEDDLSTLKCIANFVAVISTTTVLTYLTLFSSVWFKIFVAFSSAFLTFATLYSIHLPQLICSPEAGTHAKKS

SEQ ID NO: 3048 - protein, 315 aa, Roseovarius nubinhibens ISM
MADTQFGPHGWTPERLGSLAGRCYVITGANAGTGYEAARLFLSKGASVVMLNRSAEKSAAAIATLKAEHGAEADVRFIEMDLADLTSVRRAAEEIRETVPRIDALICNAAIAQVPKQRLTVDGFESQLGTNHYGHFALCGLLFERIEESEGRIVVVASLGYNMGIKTIQFDDLNWDNNYSANAVYSQSKLAQMMFAYELQDRIRAAGKSVEVLVCHPGSSKTSLIKTSGSPVMRAIWWLMTKSPMVQTAQQGAYPEVMCATEEGLEERALYGPTGRMEFVGPVGRGTLHPHAYDKPVMTRLWEVSEAATGVVWPL

SEQ ID NO: 3049 - protein, 453 aa, Mycobacterium sp. JLS
MTDLDLDLQALPLAPKNPLPYRQLLPLVRHFHTGQEVLRQAAGPVIRLKLGPKWMIPEIVVVTSPAGIRDVLGRNHASAERCRVHDEVRDLGGESLFVLPNDPWIPRRRALQPVFTKPSVRGFGGHMSRAAEMVGERWGQTAEVNLDEECRRLTMRSLGRSILGLDLDAKADVIAGPLPVAAGYAADRALKPVRAPRWLPTPQRRRANAAVATMKAVTNDILQACRADPTRDAPLVHALINASDPETGRSLSDDDICNELLVFMLAGHDTTATLLTYALWALGHHPDIQDRVAAEAYALGDRLPTPDDVGRLGYTVQVLNESLRLCPPAAGVGRLALRDVEVDGYRVEAGSLVGIGIYAVHRDPELWDRPLEFDPERFSPENVKDRDRWQFIPFAGGPRACIGQHFAMLEATLALATLIRSHEIRSIDDDFPLETPYTTVAAGPIWARVHRRT

SEQ ID NO: 3050 - protein, 197 aa, Candidatus Desulfococcus oleovorans Hxd3
MIIRSAEFVISAVQPSQYPDTDLPEIAFAGRSNVGKSSMINLLVNRKNLVKTSSTPGKTRLINFFDINGQLMFVDLPGYGYAKVSRKEQKTWGPMVERYLSSRKTLRGLMLLMDLRREPREDEFLMMQWCAHYDIPWKMVLTKADKFKKTAADRRRHEIARAVGIGADEMILFSTLQKMGRDPALETIARMTGILEE

SEQ ID NO: 3051 - protein, 402 aa, Arabidopsis thaliana
MFPMSSTSRSSAANNRKDPPRKKNKQTPSPVTREPTSIDSLPNDLLLNCFARVSRMYYPALSRVSKRFRSIVTSPEIYNTRSLLNRTEKCLYLCLRFPFDNNTHWFTLYQNPNQTVSDKVFLQIPSPQHPLTLSSNLVAVGSNIYRIGGTVGDDSCPLGFDREPSSKVSILDCRSHTWRDGPRMRLNRRSSTTSVVDGKIYVTGGTEDTDNPSHWIEVFDPKIQSWGTVTNPHIVKVWEEVCYRRAVKSIGHDGKLYLSGDKYVVYDPDEGKWNSVEEHWLIGYAIGSSNCVVDNILFYWDQGVFKWYDSKVSSWKQLKGLEGLPDDFSQREYCKLVDLGGKMAVLWDKWEYSGVCMIFCAEISLEKRDGDEIWGKVEWFDTVLEVGASCSLKSADALSASV

SEQ ID NO: 3052 - protein, 312 aa, Glycine max
  misc_feature (99)..(99): Xaa can be any naturally occurring amino acid
MAMVSMAFCVSTATFPNLNRCRGVAYASLSNKASTTSLGVRVTEGEGNLPKLVLTSPAGSEAEIYLFGGCITSWKVPSGKDLLFVRPDAVFNGNKPISXGGVPHCFPQFGPGPIQQHGFARNMDWTVVDSENTEGNPVVTLELKDAPYSRAMWDFSFHALFKVTLNAKSLATELTVKNTDNKAFSFSTALHTYFRASASNASVKGLKGCKTLNKDPDPKNPVEGKEERDVVTFPGFVDCVYLDASSELQLDNGLGDLISIKNTNWSDAVLWNPYLQMEACYKDFVCVENAKIGSVQLEPEQTWTAVQHLSIA

SEQ ID NO: 3053 - protein, 187 aa, Saccharomyces cerevisiae
MSIASYAQELKLALHQYPNFPSEGILFEDFLPIFRNPGLFQKLIDAFKLHLEEAFPEVKIDYIVGLESRGFLFGPTLALALGVGFVPVRKAGKLPGECFKATYEKEYGSDLFEIQKNAIPAGSNVIIVDDIIATGGSAAAAGELVEQLEANLLEYNFVMELDFLKGRSKLNAPVFTLLNAQKEALKK

SEQ ID NO: 3054 - protein, 596 aa, Corynebacterium glutamicum ATCC 13032
MPEQDLTTLANDWLQAFEKATASSSPDEAATAVVQLFEDEGYWRDLLAFTWNLTTAEGADEIAEMIRNTWPSSIFRNVELKGEPADEGDGVTRVHFSCESADFKCTGIVRLRNGKAWTLLTSARELLEHPEPKGRNREMGVVHGQNEDTRNWTDRKNDRQAALGVTEQPYTLIIGGGQGGIALGARLKRLGVPALIIDKASRPGDQWRSRYHSLCLHDPVWYDHLPYIPFPDHWPVFTPKDKMGDWLEHYVGIMDLDYWTNTECLRASYNEDTKQWDVTVNRDGAESTLHPTQLVMATGMSGSPNKPTLPGQDKFQGEIRHSSEHPGGDVDRDKNVVVLGANNSAHDICADLYSNGAKPVMIQRSSTHIVRSDSLMREVFGPLYSEDAVEAGIDTDTADLLFASWPYKVLPGVQKQAFDKIREDDKEFYDKLENAGFLLDFGDDDSGLFLKYLRRGSGYYIDVGASELVADGKIPVRSNVSIEDVKENSVVLTDGTELPADVIVLATGYGNMNNWVAQLVDQETADKVGPCWGLGSETTKDPGPWEGELRNMWKPTNVDSLWFHGGNLHQSRHYSRYLSMQLKARYEGMNTPVYSK

SEQ ID NO: 3055 - protein, 318 aa, Shewanella sp. MR-4
MANTLEQLKSYTTIVADTGDIEAIKRYQPEDATTNPSLILKAAQIPEYSALIDNAIAWAKLQSADIEQQIDDASDKLAVNIGVEILKLVPGRISTEVDARLSFDKEKSIAKAHKLVRLYQEAGVDKSRILIKLASTWEGICAAKELEQEGINCNLTLLFSFAQARACAEAGVYLISPFVGRILDWYKKDTGKDYDAVNDPGVVSVTEIYNYYKQHGYNTVVMGASFRNIGEIIELAGCDRLTIGPSLLEELANSQVTIQPKLIPASTTVAAGEPLTEAQFRWDFNQDPMAVDKLAEGIRNFAIDQGKLEVMLKAKLAN

SEQ ID NO: 3056 - protein, 545 aa, Shewanella sp. MR-4
MTILTQSTTWQALAAHSHQIPHMRELFAGDPARFSNMSLSTCGLFLDYSKNRATPETLNLLQTLAQEAKLDAKIKAMFAGDIINTTEKRAVLHTALRSTAEQSIVAEGQDIVPEVQQTLNKMQQFVTSVTSGQWKGFTGKAITDIVSIGIGGSFLGPKIVSQALRPYWITGLNCHFVANVDGTSISEKLKLLDPETTLFIMSSKSFGTQETLTNTLTAKAWFLAKGGSQSDVAKHFVAVTSNVAKATDFGIDADNIFPMWDWVGGRYSLWSAIGLPIALLIGMDNFRSLLKGAHQMDTHFANAPLAENMPVIMGLFSLWYGNFFNAQSHVVLTYDHYLRGLPAYFQQLDMESNGKSVTLNGTHVDYSTGPVIWGGEGTNGQHAYHQLLHQGTALIPADFIMPLQSHNPIGEHHDQLASNCFGQTQALMQGRTLDEALAELSKSSLSDEEKLLIAKHKVMPGNKPSNTLLMDKLTPETLGALIALYEHRTFVQGAIWDINSFDQWGVELGKSLGNDVLARIGAEQDATALDASSNGLINLYRQGKI

SEQ ID NO: 3057 - protein, 1071 aa, Oryza sativa
MEEAVDASAALDPKLAPLLLFGGHGDATFLYSVPKRALLAPTPTPTRVGDGGVDDMMRGHRWWATAQGWLLMAHRGSPCTFLWDPFTGRRVGLPPDHDGTVLAAEGSHLRRCLLSCCGPMDPTSCVVVVIDLADTELWYCRPGDNHWVRLHQHPYQHSNTEHRDVIIRFLRQFTAIDGKFYSELLIGDDGLVGVLEFSPELTLTKIAVHGVDDDRRPTVYKKRTTCFVESNGELHSVVFSHPIGCDRIVARVGVYRLSINLTTTQGQRSAAWVKVDSLGGRAFFVKIGSFGASLDTEGTGLRGNCVYYSGFNGKVLCVYDMERGTTVVIDPGTNLPYHQSPQVLMPTFSGYHGGTTRSVENIYQVGPTIMENAYEVKDTKVSKVKRVVRFFEDGCTCLPIPIQNTRVTKQKDKLINQKKSKRSTAGRPPYRGEGASSPETKNSYHGCGFPLEPLKRLLEWGRIADAEENLGGIEVREAHLAESLYFISVRQKKLILIHNAYHSIPRSSEITSTGIGGSQFIPRPGQQQQQQVSALNKATPASALCEVGGVGGGAAVRKRQLASVARRERPMRREEETEARLWAPHVSCGMCITDTTAIVANAMWVMQGERRRARAPWGPPDTGGALLERWISRERRSDSRDASGSAKQRSAMGNSLPVESKFTDEKENDRIKYVVSSMQGWGEKMEDAHAAILNLDDTMTSFFGVYDGHGGAEVASYCAKRFHIELCNHEDYDSNLSNAMRSAFYSMDEDLQLSDAWRELVIPRNNGWMYFIKAGVCANLSPFPQATYTAPSYEGSTACVVVIRGDQLIVGHAGDSRCVLSRNGQASALSVDHKPDRDFACKKNERLPPEDQMLTCNPDILTMDITDDMEFLVIATEGLWCNMTNQNVVDHTHDRLLEGAEARVICEELVQFGLPSGDNTTVILVLFKPGAFPAVPPVDTDTDTDSHIDDDVDPTGSNNATASDNNDPANEVDPTANAGSDDSNTGDEVKVDATATAVGSSSTTAVAADEGTGNPPHGALVDTDDEDGLTYSQDMDLPPASTSPPTFPDEDDLPRSNPDKSPPHDDTYHRW

SEQ ID NO: 3058 - protein, 269 aa, Vibrio fischeri ES114
MDKYAVFGNPIKHSKSPFIHTLFARQTMQDLEYSAIEAPINGFVESVTAFFSQQGKGCNVTVPFKEEAFQFADQLTERAKLAGAVNTLKKLDDGIILGDNTDGEGLVQDLLQYQVPLEDKHILLIGAGGAARGVILPLLKQNPASITLVNRTYEKAKQLAELFSPYGRIEAKKMSDINKGFDVIINSTSASLSGELPQIDPVIFSGGAISYDMMYGSGKTIFNQWALKNDAYQAYDGLGMLVGQAAESFTVWRGLRPGSKQILRELRKT

SEQ ID NO: 3059 - protein, 384 aa, Euglena gracilis
MDAKTFTCTAIAAVSVGVTVGLAASSVTNLHVTSAQTQAVTAAVPVMSRVNLAAPANHVVPRAAQEEVQGEYQTASNNWAVAAMASAGAAVGAAVLAMRRRATNTYEAIREDPEAVLAGAGRAMGAALIGAAVAGSANAASLTYDELQSLSYLEVKSSGIAGTCPVLADGVSSKLSLKAGKYEINNWCLEPSSFQVKLPPTEKQQVTEFERTKLMTRLTYTLDAISADLNVGGDGSWTIQEKDGLDYAATTVQLAGGERVPFLFTIKNLLAKGDAGQFLGQFDVPSYRGATFLDPKGRGGASGYDTAVALPASGDDEEYAKENSKSTAASVGTIAFKVAKVNAETGEIAGVFESIQPSDTDLGAKVPKDIKTSGVWYAQISPSK

SEQ ID NO: 3060 - protein, 314 aa, Fulvimarina pelagi HTCC2506
MPHETLDTVVSEIAEEMRARPDRGKVASYIPELGRVDPNQFAITVVTQDGHVASGGQCDIPFSIQSVSKVFTLTLALGLAGNRLWNRVGREPSGSPFNSIVQLEHERGIPRNPFINAGAIVVTDHVLAGHQPREAIGEILRFMQFLADDESIYIDHDVAASEEAHGFNNRALANFMKGFGALDNPVEYTLGVYFHHCAIAMTCRQLATAGRFLANNGIRPETGYSVVTPERARRINAIMLTCGHYDGSGEFAYRVGLPGKSGVGGAILAIVPGRASICVWSPGLDTTGNSHLGRIALEMLTTRLGWTVFGPGAV

SEQ ID NO: 3061 - protein, 388 aa, Robiginitalea biformata HTCC2501
MKKIFEDTQTAFALKSDAELERAYYLFKLIAHEPLVKIGTTLTNFAIKAHLPVEGLIRATVFDHFCGGVSEEDCMPVVERMWAQGVCTVLDYSVEGKDTEDPLDDSLAKNLEILQFVKEKEAMPFAVFKPTGYGRFGLFVKKSRGESLTQSETAEWERVVKRFDTTCKKAYDLGVSLLIDAEESWMQAAADELVEEMMRRYNQKETVVFNTLQMYRWDRMDYFRELHERAVSGGYRIGVKVVRGAYLEKENDRAEEKGYPTPICASKQLTDENFDEAIRYSLDNLETVSVFAGTHNERSSYRLMEWMEADGIAANDPRIWFGQLYGMSDNISFNLARAGYNVAKYLPFGPVRDVMPYLIRRAEENTSVAGQTSRELELLKKERKRRKM

SEQ ID NO: 3062 - protein, 537 aa, Candidatus Desulfococcus oleovorans Hxd3
MCGIAGCFGRKDEPTVKRMLDTLGHRGPNDRGMHAGASFVVGHTRLSIVDVATGRQPILTGDGTKGIVANGEIYNFRKLRMGIADKYQFRTRSDTEVVLHLYEEKGPACVKDLDGMFAFALFDGDAFMLARDPVGIKPLYYGFKQDALYFSSELGAMSFAGLDEVHEFPAGHYYTPKEGFVQYYKVPPIEDDQLTDIEETCEIIRETFIHAVKKRLLADPEVPVGSFCSGGLDSSLVAAIAADEIPRLHTFVVGMKDAFGDVSDDVKAARIAAAHIGSTHHELIFTEDEYYEALPTVINKLESYDPSLVRCAVPCYFTCKMAAEYVTVVLTGEGADELFTGYHYMKHFPEDKLNLEARRCIGNLHNINLQRADRMGMLFSLELRVPFLDEAMVDLSMKIPHELKIREHNGAKIEKWILRKAFENTHYLPDDILWRYKVQYTQGAGCEDLGERLANRMGDDEYEKIKAENPDAVINSKEAAYYFKIFREYHPQDSILGSIGIWTGFDFAEEREKVKGTVDGDLKHEHEEETDDTSQVA

SEQ ID NO: 3063 - protein, 325 aa, Zea mays
MASNGDKGLIVSFGEMLIDFVPTESGVSLAEAPGFLKAPSGAPANVAIAVSRLGGRSAFVGKLGDDEFGHMLAGILRKNGVDDQGINFDTGARTALAFVTLRADGDREFMFYRNPSADMLLRPDELNLDLIRSAKVFHYGSISLIVEPCRSAHLKAMEVAKEAGALLSYDPNLREPLWPSKEEAKTQIMSIWDKAEIIKVSDVELEFLTGSNKIDDETALTLWHPNLKLLLVTLGEKGCRYYTKTFKGAVDPFHVNAVDTTGAGDSFIGALLNQIVDDRSVLEDEERLRKVLRFANACGAITTTKKGAIPALPSDAEVRSFLEKK

SEQ ID NO: 3064 - protein, 825 aa, Triticum monococcum
MAFSPRSPWSRSKKPDIYSTVVVHDDEDNARGGGAARAEDDDDDDPSALPPLLQRLPKDFGGASFDDDDDPYSSDLDDASLSATVVIKRGAPASTSSSSRSPFLDLRRSSPRAAEADPFSTFVVHGTARSGGASSPRESVSGTFIRHSGGPPSPRESVSGTFIRHTRGSSSPHESFSGTFIHHTSSASSPRDSASGAGAGFGSSFITPSSGQAEEDRQPSLLMQQQQSRRKASMSSLPDSVTREDPSTKYELLHELGKGSYGAVYKARDLRTQELVAVKIISLTEGEEGYEDIRGEIEMLQQCSHPNVVRYFGSYQGEEYLWIVMEYCGGGSVADLIGITEEPLDEPQIAYICRETLKGLAYLHTIFKVHRDIKGGNILLTEQGEVKLGDFGVAAQLTRTMSKRNTFIGTPHWMAPEVIQESRYDGKVDVWALGVSAIEMAEGMPPRSTVHPMRVIFMISSEPAPMLEDKEKWSLLFHDFIAKCLTKDARLRPPAIEMLKHKFIEKCNTGASKMLAKIKEAKIIRETAVQNQLPDSDDAMDATVRINEDYGETVPTNSQSTHETKNDGSGGDFGTMIVHPEDGDEAAESSIFPRAEFIPGLGSINSFTHDPKRAELISKFWAESTAESDASKERDLYGLPDIQEPKTMPRSTGTVKHHKGVEGTVLRHDITASPGVASTMNKLSSSPSRKAFSVQDKLWSIYAAGNTVPIPFLKAIDISPLALVSDSVAGNGPAGSSTTDALEAVRELFSGDGQAKKGRKGQNEAPLPPGVHDRLTTSPTLMNLAQALAYHKTCYEDMPLQDSQATEEQQTIQNLCDTLRTILRL

SEQ ID NO: 3065 - protein, 246 aa, Houttuynia cordata
MGRGRVELKRIENKINRQVTFAKRRNGLLKKAYELSVLCDAEVTLIIFSNSGKLYEFCSSSSMMKTLERYQKCSYSMPEATGPSRETEKSYQEYLKLKGKVEHLQRIQRNLLGEDLGPLSSKELEQLENQLEQSLRQIRSTKTQSLLDQLSDLRRKEQQLLESKKILNKKLAEHGPENPLQLSWQSCGQSNPYSSQPAHSEAFFQPLDCNPTLQIGYPSVGQEQIMAAPATAAPQNANGFIPGWLV

SEQ ID NO: 3066 - protein, 286 aa, Gloeobacter violaceus PCC 7421
MSQSQQLQPPQQQERQPGLESEMTPKPQADDPKYRGSGKLQDKVALITGGDSGIGRAVAIFYAKEGADVAVLYLDEHDDAKETCRLVREIGQRCLTIAGDIGDESFCRQAVAQVVDEFGRLDILVNNAAEQHPQKSIEDISAEQLERTFRTNIFSFFYMTKAALPHLKPGSAIINSTSVTAYKGSPQLLDYSSTKGAIVAFTRSLSQALLEKGIRVNGVAPGPIWTPLIPASMSPERTASHGSSAPMGRVGQPEEVAPSYVFLASDDSSYITGQILHPNGGEVVNG

SEQ ID NO: 3067 - protein, 247 aa, Houttuynia cordata
MGRGRVELKRIENKINRQVTFSKRRNGLLKKAYELSVLCDAEVALIIFSNRGKLYEFCSSSSMMTTLERYQECSYSMPEATGPTRETEKSYQEYLKLKGKVELLQRTQRNLLGEDLGPLSSKELEQLENQLEHSLRQIRSTKTQALLDQLSDLRRKEQQMLESNKILKKKLAEHGPENLLQLAWQSCGQSNPYSRQPAHSEAFFQPLDCNPTLQIGYHPVGQEEITMAAPAIAPPQNVNGFIPGWMV

SEQ ID NO: 3068 - protein, 565 aa, Nitrosomonas europaea ATCC 19718
MNFILLKERHMMNKLPQQEENRRTVENRKNYLLRRQAQYQYAYEYANTIAVVRKLPCREIPGPGYWLRGGINLLQLIPSLPSLLVTYMRYLLGKPMESYRDYIFYPFSPPNPALVDNFQQDLIFGLQRVIGVNPVVLRAVTSQHPLPQKLPESEIQRVFAKYVDETDYATAITQKRVYILDYADLEILQRNPGQIDGGRKQYVTTPIVVLFLQADGILRPIAIQLYQDAGPDNPIYTPNDGNLWLAAKTFAQVADGNHHILVTHATRIHYVMEAIIMASRRQLYKSHPLCVLLNPHLRHTLNVNHQHTFLRDRKGRPGRYGELFAGDYDATTQCMANGMTSFDFRASAFPNDIASREVDNPDLFYPYRDDGVLLWNAIQHFATEYIDVCYQSDGDVAEDCEIQAWAHDIGARDRGRIPGFPARFASRQELAETIGHVIFLCTAFHSCIHFNQYKYPGFVPNMPHSAYAPPPVGKGAEMDADGLLKFQPAFRAAYSQTWTYFQTNFTVNRIGQYPLRQFDPAARDVIERFRKRLQEIEGRIDQRNSSRPVPYDRMNPRIIPNGVTV

SEQ ID NO: 3069 - protein, 406 aa, Oryza sativa (japonica cultivar-group)
MARPRTRSVARMEATAAAAAAAEEEEAGNPDGAEGAAVVAVAPEAAAEGPNEPNAGEASREPDAGQASREPDVAGPSRQPGAAGPSREPGAAGGPRQPGAAGGPWQLVPNAAGPAVAPYVEDIDRYLRSLEGREMAKCLDAVQFCTAEESRRPIVNYDQEIQGGHINMRGKLVNWMEELVYGFNLWDNILYLAVSYVDRFLSRNVVNRERLQLLGTSALFVASKYEDRCHPSARFFSSITADTYTTQQVVAMEANILSFLNFQMGSPTVITFLRRFLFSCRGSNRPINIRLELMCIYLAELSLLDDYNIRFLPSIVAAACLFVGKFTLNPNTRPWNLSVQRITGYKVSDIEDCIRSIHDLQAGRKWSNLRAIRSKYEDDAFERVSTIPSPNTIKPSFLRDLKYVNG

SEQ ID NO: 3070 - protein, 490 aa, Solanum lycopersicum
MMTTQNRRSSAVAKRQAMAANSSGLEHNQTGKLNAKKRPALSNISNNTTVSARNSVSHSSKLAPCTSKIVNIKKNTSACNSNAVSSGTAVLPASSSVRPSSKPVSIQRSDAVVPKITVIPVPATCSMDISPSHSDGSLVSMDESMSNSDTVRSPEVEYIDDHELAAVDSIEKKACSTLYISEHVKAAAADICKRDVLVDLESGDKIMNIDNNLVDPQLCATMACDIYKHLRASEAKKRPSTDFMAKVQKDINPSMRAILIDWLVEVAEEYRLVPDTLHLTINYIDRYLSGNLMDRQRLQLLGVACMMIASKYEEICAPQVEEFCYITDNTYFKEEVLQMESAVLNYLKFEMTAPTAKCFLRRFVRAAQGLNEVLSLQLEHLASYIAELSLLEYNMLCYAPSLIAASAIFLAKYILLPSVKPWNSTLRHYTLYQPSDLRDCVLALHSLCCNNNNSSLPAVREKYSQHKYKFVAKKYCPPTVPVEFFQNISS

SEQ ID NO: 3071 - protein, 133 aa, Brassica napus
MNLLKTIHHHQSTITRFYRFATTQSLASASLLSLSLQRPRISLVSTSNRSCFALSSVSRASFSGNREDGKKEEAEEGDELVYQKTLRLVECAMFAAVTGLVYFLSNSLAIENYFGCFFALPIVISSIRWNISG

SEQ ID NO: 3072 - protein, 529 aa, Fulvimarina pelagi HTCC2506
MANPIRGTFALARAAFVMAREGVIGTFPAEGMPPAALFGYKVARLFERRSAAGRERSDRLSRALNRLGPSYVKLGQFLATRPDIVGADIAGELGELQDKVPPFPTEEARQEIEVTLGRPVDELFVDLGDVVGAASIAQVYKARIIGNDGIERFAAVKVIRPHVRAQFRRELDAFAFIARFLERFFPAARRLRPVAVVETLTQTTRIEMDLRLEAAAASEMAENTAGDPGFRVPSIDWERTGRDVVTMEWIDGIKMSNVSAIIAAGHDAQRLAVNVVQSFLRHAMRDGFFHADMHQGNLFVAPDGGIVAVDLGIVGRLSDESKRFLAEILYGFIKRDYRRVAELHFEAGYVPRTQDVASFAQALRAIGEPIYGQPAETISMGHLLSLLFEVTELFEMKTRPELVLLQKTMVVVEGVARTFDPKFNMWVAAEPVVSDYILHELGPAAKLREARDGVEAILQILRRAPDLAGGLTVLSKELPDLIENGIRLNDDTLKDLATEKRASILSGRLAQWIIAISLATIALSFVFGG

SEQ ID NO: 3073 - protein, 426 aa, Vibrio fischeri ES114
MNVRAAAAKVIYQVVDQGHSLSSALPKAQSEIKPRDQALLQEICYGVLRFLPRLESVAQSLMDKPLKGKQRVFHHLILVGIYQLSFMRIPAHAAVAETVEGTKNLKGPKLRGLINAVLRNYQRSQEELDAKSVSHDSGKYGHPGWLLKMLQQAYPEQWENIVEANNSKAPMWLRVNSQHHTRDEYIALLEKEEISVTPHSQATDALLLDKARDVYTLPGFEQGWVSVQDAAAQLSAEYLQPQNGELILDCCAAPGGKTAHILERTQDTSVVAIDCDETRLKRVYENLERLNLKAQVICGDARHPEEWWKGEQFDRILLDAPCSATGVIRRHPDIKWLRRSEDIKALAELQSEIFDAMWLQLKSGGTMVYATCSITPLENCDQVKAFLARTSDATLIDNTDPEKPGRQILPGEENMDGFYYAVLQKA

SEQ ID NO: 3074 - protein, 475 aa, Solanum lycopersicum
MRITRARAKTLGSSGGLPPLHPSVRQDKKQGLVTQGTKSKRPAPDENKPANSSSTASQQPKRRAVLRDVTNVLCENPYMNCINGSKFQVKKFSDKRNSKVTPALLVKKPELEDRKESVIEEAKMVKVEESQEHCSQAHFKDHPFTQPSEYITAAQSGLVDLMPVNRSSCNDITLQTTTPKDESKVCLKQEGSNSLSIADIDSKHKDPLMCSLYAPDIYNNLQAMELDRRPSFNYMEKLQRDINKGMRSILIDWLVEVSEEYRLVPDTLYLTVHLIDRFLSEHYIEKQKLQLLGVTCMLIASKYEEICAPRVEEFCFITDNTYSKEEVVRMESLVLNFLGFQLAAPTTKKFLRRFVQASQASYEVPSVELEFMANYLAELTLAEYSFLKFLPSVTAASAVFLARWTLDQSNHPWNSTLEHYTTYKASDLKTTVLLLQDLQMNTSGSTLNAIREKYKQPKFKSVATLSSPKPVQSLF

SEQ ID NO: 3075 - protein, 378 aa, Solanum lycopersicum
MVDEENKVPATAAASRGSNKRAFDSIAITNENDPLQISERPYPANKKRVVLGELNNLGNVIVSTQNSDLTETHESKRKIKLRKTRNVVKETVELKTSANSSPKDNLQKCSYGPLIYQHLHSLEVEERRRPLSNYMEKVQNNVIPSMRTVLVDWLVEVTEEYKLVSDTLYLAVSYIDRFLSSHVLAMEKLQLLGVSCMLVASKYEEISPPHVEDFCYITDNTYTREEVVNMERDLLSFLNFEISSPTTITFLRIFLKAAQDNLSFLTLQFEFLSCYLAELSLLDYSCVRFLPSMTAASAIFLSRFTVLPEVCPWTLALQQCTGYKPSELKDCVLVIHELQSSLMEATGRALREKYMNHKYKCVAALHPPDIPSCFFDDA

SEQ ID NO: 3076 - protein, 499 aa, Glycine max
  misc_feature (151)..(151): Xaa can be any naturally occurring amino acid
MNSNGYPASSFKIPTVKFTKLFINGQFVDSLSGGEFETIDPRTGEVIARIAEGTKEDIDLAVKASRLAFDHGPWPRMPAVERARIMMKWADLIDQHVEEIAALDAIDAGKLYHMLKAIEIPATANTIRYYAGAADKIHGEVLKPAREFHAXTLLEPVGVVGHIIPWNFPSIMFVSKVSPCLAAGCTMVLKPAEQTPLSALFYAHLAKLAGIPDGVLNVVPGFGATAGAAICSDMDIDKVSFTGSTEVGREVMRAAANSNLKPVSLELGGKSPFIIFDDADLDKAVELALMAVVYNKGEVCAAGSRVFVQEGIYDEFEKRLVEKAKAWVVGDPFDPNVQQGPQVDKKQFEKILSYIEHGKREGATLLTGGKRVGNKGYYIEPTIFSNVKEDMLIAQDEIFGPVIALMKFKTIEEAIKSANNSRYGLVAGVVTKSLDTANTMSRSIRAGVVWINCYFAFENDIPYGGCKMSGFGKDSGLEALHKYLHVKSVVTPIYNSPWL

SEQ ID NO: 3077 - protein, 751 aa, Silicibacter pomeroyi DSS-3
MPKAKITNEEALAFHLEPTPGKWEVQATVPMTTQRDLSLAYSPGVAVPCEAIAADPGLAYDYTNKGNLVAVISNGTAVLGLGNLGALGGKPVMEGKAVLFKRFADVNSIDIELDTEDPDEFCRAVRLMGPTFGGINLEDIKAPECFIIEQRLKEEMDIPVFHDDQHGTAVICAAGLINALHISGKKIEDVKIVLNGAGAAGIACIELLKTMGARHENCIVCDTKGVIFQGRTEGMNQWKSAHAIKTELRSLEEAMKGADVFLGVSVKGAVTQEMVQSMADNPVIFAMANPDPEITPEEAHEVRPDAIVATGRSDYPNQVNNVLGFPYLFRGALDIHARAINDEMKIACAHALAALAREDVPDEVAMAYGKSLAFGRDYIIPTPFDPRLIHRIPPAVARAGMDTGAARRPIIDMDAYELGLKSRMDPTASILRGINARARKAQSRMIFAEGDDPRVLRAAVTYQRSGYGKALVVGRHDDVKAKLEAAGLGDAVRELEVVNAANTTHLETYKEFLYSRLQRKGFDNKDVHRLAARDRHVFSALMLAHGHGDGLVTGATRKSAHVLHQISHVFDADAAHGAAGITALLHKGKIVLIGDTLVHEWPDEHDLATIAERAADVARHMGLEPRVAFVSFSTFGYPISERTEKLTKAPKVLEARGVSFEFEGEMTVDVALNPRSKEAYPFSRLTGPANILIVPARHSASISTKLMQEMAGATVIGPILTGVDKPIQICSTVSTANDILNMAVLASAEIG

SEQ ID NO: 3078 - protein, 101 aa, Glycine max
  misc_feature (27)..(27): Xaa can be any naturally occurring amino acid
MGDETQNKYESSEVEGQNRGDFDFLGXKKEEKNKPLPQEEVIATEFKKVTVSDQGENKHSLLKKLNRSDRSFSFSFKEEGEDGEKRMKNRRGPKGLKEKIQ

SEQ ID NO: 3079 - protein, 634 aa, Listeria monocytogenes str. 4b H7858
MAYMLFAKHLVFNPANPEWFNRDRFVLSAGHGSALLYSMLHLFGYDVKMEDLKQFRQLDSLTPGHPEFGWTAGVDATSGPLGQGIGMAAGMALAESHLAAEYNQPNYPIVDHYTYAICGDGDLMEGVASETASLAGHLGLGKLIVLYDSNDICLDGDLSATFSENAADRFRAYGWQVLRVEDGNNLAAIQEKIVQAKLETSKPTLIEVKTVIGYGAPTKAGSSASHGAPLGEKEANGAKEHYEWAEEPFTVPAEVRDYLRNYKARGEKLEGAWNTMLANYKKEFPELASQLDRVLAGEVAADWNANLPTFEAGTNVATRSASGKMINAIAAELPELFGGSADLGCSNKTFIDASPAYSIQDPAGKNIWFGVREFAMGAMLNGMALHSGLRVFGSTFFVFSDYVRPAMRMAALMQLPVTYVFTHDSIAVGEDGPTHEPIEQLASLRAMPGLTVIRPADAKETRAAWEIAATNTNGPIALVLSRQDLPVLENAQEEVDAGVDKGAYIVAPANSSKPDAIIIATGSEVSLAIEAKAELAKKDIDVSVVSLSSWERFEKTTDAYKESILPKEVTARFAIEAGATFGWKEFIGSEGDMLGIDHFGASAPAKDLFNAYGFTPENVADRVETVIAKAGVRV

SEQ ID NO: 3080 - protein, 330 aa, Listeria monocytogenes str. 4b H7858
MELRDVEEPQVYGDKVKIKVAFTGICGSDIHTFKGEYKNPTTPVTLGHEFSGVVVEVGPDVTSIKVGDRVTSETTFETCGECIYCKERDYNLCSNRRGIGTQANGSFAEFVLSREESCHVLDERISLEAAALTEPLACCVHSALEKTTIRPDDTVLVFGPGPIGLLLAQVVKAQGATVIMAGITKDSDRLRLAKELGMDRIVDTLKEDLAEVVLGMTDGYGAERVFDCSGAVPAVNQGLPLTKKKGDFVQVGLFAEKKNAIDEESIIQREIAYIGSRSQKPSSWILALDLLANGKINTDKMITKVYGLDDWREAFEAVMAGNEIKVLVKS

SEQ ID NO: 3081 - protein, 350 aa, Listeria monocytogenes str. 4b H7858
MRAAVLYENNVIKAEQIDEATCGKDQVRVEVKAVGICGSDIHKMQTRWKYPLPAVMGHEFAGVVTEIGSEVTNVAIGDRVAGIPLEPCMECNYCKAGDFALCDNYRMVGSHFHGGFAENVVMKADNVISIGDLDFEEGAMIEPLAVSMHGVLGIQPRLGDTVIVFGIGTIGILVVQCLLLAGVKDIIAVDISDKKLADAREFGCKYTINPKNEDLKERVFAYTNGLGADIALECAGSKITQEQCLLVTKKKGKVGFLGIAYADVLLHEEAFENIFRRELTLKGFWNSYSAPFPGEEWRTSIEFVKQGRIKLKPLISHRYKLEETKEAFDMILSREHDYNKVMILPQKGDD

SEQ ID NO: 3082 - protein, 183 aa, Magnetospirillum magnetotacticum MS-1
MALAQRIEDRDEGQARAPAIASALRTIETEREGLACLMAAIGNGLGEPFAQAVARIGAARGRVICTGMGKSGHVARKIAATMASTGTPALYVHPAEASHGDLGMIQPDDVVLALSWSGETTELADIIGYTRRYRVGLVAITSNAASTLGREADTCLALPKAKEACPNGLAPTTSTAMQLALGD

SEQ ID NO: 3083 - protein, 431 aa, Kineococcus radiotolerans SRS30216
MATIEAVGAREILDSRGNPTVEVEVLLDDGTFARAAVPSGASTGAYEANERRDGDKGRYGGKGVEQAVEAVIEEVGPALVGHDAHEQRIIDRVMLDLDGTPTKSRLGANAILGVSLAVAKAAASAADLPLFRYLGGPNAHVLPVPMMNIVNGGAHADTGVAIQEFMIAPVGAASFREALRWGAETYHALKSVLKQRGLATGLGDEGGFAPDLPSNKDALDLIVEAIGKTGFAVGSDIALALDVAATEFHGADGYDFEGSKRSAEWMTGYYEGLVSEYPLVSIEDPLSEDDWDGWQHITNALGGKLQLVGDDLFVTNPERLQKGIDLSAGNSMLVKVNQIGSLTETLDAVDLAHRNGFSTMMSHRSGETEDTTIADLAVAVGSGQIKTGAPARSERVAKYNQLLRIEEELDDAAVYAGAKAFPRSAGFTGRA

SEQ ID NO: 3084 - protein, 618 aa, Xylella fastidiosa Temecula1
MPRRRFVPSLSGRTIVNITTALPLPTHLLSEKVTAPLLGARKIYVTGSRQDIRVPMREIALTPSSARYGGNENLSLVLYDTSGIYTDPQATIDLACGLPRLRTAWIDERADTVEAKLHFKVPESVSVTAPPFPTPPQPLRARDNVAVTQLEYARRGLVTPEMEFVAIREQQRREQTVENLRGQRHAGDAWGALVGTPITPEFVRDEIARGRAILPNNINHPESEPMIIGRNFLTKINANIGTSALSSSIAEEVEKLVWAIRWGADTIMDLSTGRDIHATREWILRNSPVPVGTVPIYQALEKVDGHVDALSWDVFRDTLIEQAEQGVDYVTVHAGVLRDFIPLTASRLTGIVSRGGSIMARWCQAHRSENFLYTHFEELCEIMRAYDVAFSLGDGLRPGCIADANDAAQFAELEILGKLTHIAWNHQVQVMVEGPGHVPMQLIKANMDKQLAACGEAPFYTLGPLTTDIAPGYDHITSAIGAAMIGWYGTAMLCYVTPKEHLGLPNLQDVHDGIIAYKIAAHAADLAKGHPAAQARDDALSKARFEFRWQDQFHLSLDPEKALALHDESLPKEAHKRAAFCSMCGPQFCSMKISQEVRDASSSELSDANTDINTSDGI

SEQ ID NO: 3085 - protein, 428 aa, Oceanobacillus iheyensis HTE831
MTLNQSIDAYKEAVDLMPGGVNSPVRAFKSVGMNPIFMKEGKGSKIVDIDNNEYIDYVLSWGPLILGHSDERVVKKLQDITAKGTSFGAPTLLENDLAKLVIDRVPSIEMVRMVNSGTEATMSAIRLARGYTDRDLILKFEGSYHGHGDSLLIKAGSGVATLGLPDSPGVPENIAKNTITVPYNDTDSLKLAFENYGDRIAAIIMEPVCGNMGVVPPKDGFLQYVRHITEENGSLLIFDEVMTGFRVGYHCAQGHYDVTPDLTCLGKVIGGGLPVGAYGGKREIMEQIAPTGPIYQAGTLSGNPLAMTAGYETLSSLSEESYEDINNKVDTLVNGFRDAADKFDIPIHINRAGSMVGVFFTDEEVINFETAQTSNLDYFAQYYRSMVNEGIFLPPSQFEGLFLSTAHTDDDIEKTVKAIHKAFEQIEK

SEQ ID NO: 3086 - protein, 507 aa, Mycobacterium sp. MCS
MTGLPHYRMYVDGEWRDAAESIEVRSPATGAPVATVAYGDLTAVDDAVAAARAAHEAGVWRSMPPQQRADLLDAIADKLAARSDELTALQVRENGATVRGAGAFLIGYAIANLRYFASLARSYAFQTSGPLIEAPTLASGLILREPVGVCAGIIPWNFPLLLAVWKLGPALAAGNTVVLKPDDQTPLTLLELARAADEVGLPAGVLNVVTGPGPVAGARLAEHPDVRKIAFTGSTEVGKGVMRAAADNVKKVTLELGGKGANIVLEDADLDLAVDGSLFAFLMMSGQACESGTRLLVHESVHDEFVRRLVARAETLVMGDPMSPATDLGPLVSAKQKARVEKYIALGQEEGCRMAFQGTVPSDPALAEGHWVPPVILTGATNQMRIAREEIFGPVLVVIPFRDDDDAVAIANDSEYGLSAGVWSADNGRALGIARRLESGTVWVNDWHMVNAMYPFGGVKQSGLGRELGPDALDEYTEPKFVHIDLTNDRRKRAFAVVVSAAAAESD

SEQ ID NO: 3087 - protein, 182 aa, Triticum aestivum
  misc_feature (78)..(78): Xaa can be any naturally occurring amino acid
MAPTVMASSATSVAPFQGLKSTAGLPVSRRSNGASLGSVSNGGRIRCMQVWPIEGIKKFETLSYLPPLSTEALLKQVXHYLIRSKWVPLPLSPARPESSFREHNAVSRGTYDGPLLAQWWERLPYGWEWPPNAHIGWNQTGGGDGRFHERDVSPLNMRYVSREIYSAHVPIQTLGESNGRVH

SEQ ID NO: 3088 - protein, 98 aa, Glycine max
MSRPMEEDAAGKNEEEEFNTGPLSVLMMSVKNNTQLLGRVRAFDRHCNMVLENVREMWTEVPKTGKGKKKAQPVNKDRFISKMFLRGDSVIIVLRNPK

SEQ ID NO: 3089 - protein, 375 aa, Solanum lycopersicum
TRLIAKGQEPVQKNKTKPLVTKGVAARKVGVPAKAEAIKKDYVKAKAGTISGICPEEDVKTIEKIPLKERKVRKSGKTLTSILTARSKAACGLSNKPRSQIVDIDAADIDNHLAGVEYVEDIYKFYKLTEDENRPCDYMDSQPEINDRVRAILVDWLIEAHKRFELRPESLYLTVNIMDRFLSEEPVPRRELQLLCISSMLIASKYEEIWAPEVNDFLTITDNAYVRDQILLMEKVILGKLEWYLTVPTPYVFLVRYIKAAVPSDQEMENMTFFLAELGLMNYTTVISYCPSKIAASAGYAARSTLNRSPRWTDTLKHHTGYTEDQLRECAKQLVSFHFGAAENKLKAVYRKFSSPDRCAVALLPPARDVHIGSS

SEQ ID NO: 3090 - protein, 434 aa, Solanum lycopersicum
MAITDENKHPLIKESSVRVKDRAEMATRKVVGVETRSNRRVLGAINQNLVGGQGYPCVVNKRGLSDGNGFCDKNLPVHGHRPITRKYAAQIASSQKHSSEENKKPKIAAESFSVWEDDMEAANDKPVPMSLEQTEKVSKGKDQMTYIQEVEMEDIFEEAVIDIDGDDAKNHLAAVEYVGDLFANYRTMEVNSCASPYYMAQQADINERMRSILIDWLIEVHHKFELREETLFLTVNLIDRFLEKQGIVRKKLQLVGLVAMLLACKYEEVCAPLVEDLVLISDKAYTRKEVLEMESMMLNTLQFNMSVPTAYVFMRRYLKAAQCDRKLELLSFMLVELCLVEYEMLKFPPSFIAAAAIYTAQTTLYGVQQWSKTCEVHTTYSEDQLLECSRSIVGYHQKAATGKLTGVHRKYSISKFGYAAKCEPAHFLVQQTQE

SEQ ID NO: 3091 - protein, 164 aa, Pleurotus sp. 'Florida'
RPLANVYFDITINNQPAGRIVFKLFDDVVPKTARNFRELATGQNGFGYAGSGFHRVIPQFMLQGGDFTKGNGTGGKSIYGEKFADENFQLKHTKPGLLSMANAGKNTNGSQFFITTVVTSWLDGAHVVFGEVVEGFDIVKKIEGYGSQSGKPSATIKISASGTV

SEQ ID NO: 3092 - protein, 206 aa, Fulvimarina pelagi HTCC2506
MSGTLVLVRHGQSEWNKQNLFTGWKDPDLTELGVEEAKAGGRRLKAAGYTFDLGFTSKLSRAQRTMKLILEEIGQTDLDVTENLALNERDYGDLAGLNKDDAREKWGKEQVHQWRRSYDVPPPNGESLKDTGARVWPYYLHDIQPSVLRGNTVIVSAHGNSLRALVMAIEGMTPEEILKYEIATGVPIVYKLNADSTVAEKTVLQA

SEQ ID NO: 3093 - protein, 474 aa, Frankia alni
MFTKAEDVLRYIRDEDVQFIDVRFCDLPGIMQHFTIPTQVFAESVFTDGLMFDGSSIRGFQAIHESDMLLLPDPQTAFVDPFREHKTLAMTFFIHDPITKEQYSRDPRNIAKKAETYLRGTSIADTAYFGPEAEFYIFDDVRYDYNPYGSMHHVDSVEAAWNTSRKEEGGNLGYKPRFKGGYFPVPPTDHFTDLRSEMTRVLYETGITVEMQHHEVGTAGQAEIDIRYDTLLKTADNLMLYKYVIRNVARSRGKTVTFMPKPLFEDNGSSMHVHSSLWKDGEPLFYSPNGYGGLSDTARYYIGGLLHHAPALLAFTNPTTNSYRRLVPGYEAPVNLVYSARNRSACCRIPLGGDSPKAKRVEFRVPDPSCNPYLAFAAMLMAGLDGIRNKIDPPDPIDKDLYELPPDELAAVPQVPGSLEKVLDALEADNDFLREGDVFTTDLIETWLEYKRLNEVDAIRLRPHPYEFTLYYDI

SEQ ID NO: 3094 - protein, 303 aa, Triticum aestivum
MAISPLVLSGAAVATLAVLGLAVYACRRWRRGAPPAAAPPPASSQGDDINRPLISDKLDDYSGPSNNLGSNNAGESTMWTNRSTTSPRTHTHPTESHPIEGEVHVIDVTNGTPEELHLGSTLKRTAEASVRASEAKHTRRASGENNNGGIPVKDITVGSHLALEVIAGPSHGINRYLQSGNTSMLPMTLGRIPQSDLVLKDSEVSGKHARIDWNPKTLRWELVDMGSLNGTFLNSQAVTHRDVGSRRWSAPAELADGDIITLGSSSKVSVQISLQNQQVPVGVGMVSDTMITRRPGKKLPMED

SEQ ID NO: 3095 - protein, 506 aa, Geobacillus kaustophilus HTA426
MIYAQPGQPGALVTFKKRYENFIGGKWVPPVDGEYFENITPITGQPYCEVPRSKAADIELALDAAHAAKDAWGRTSPAERARLLNKIADRMEENLEMLAVAETWENGKPIRETLAADIPLAIDHFRYFASCIRAQEGTISEIDHDTVAYHFKEPLGVVGQIIPWNFPILMAAWKLAPALAAGNCVVLKPAEQTPTSILVLIELIEDLLPPGVVNIVNGFGLEAGKPLASNPRVAKVAFTGETTTGRLIMQYASQNIVPVTLELGGKSPNIFFADVMDKDDEFLDKALEGFTMFALNQGEVCTCPSRALIHESIYDAFMERALERVKQIKQGNPLDTETMIGAQASSEQLEKILSYIDIGKQEGAELLIGGERNMLEGELAGGYYVKPTIFKGHNKMRIFQEEIFGPVLAVTTFKDHDEALSIANETLYGLGAGVWTRDINTAYRFGRGIQAGRVWTNCYHVYPAHAAFGGYKMSGIGRETHKMMLDHYQQTKNLLVSYSPKKLGLF

SEQ ID NO: 3096 - protein, 315 aa, Vibrio fischeri ES114
MSKTADFIWFNGEMVPWADANVHVLTHAMHYGTSVFEGVRCYNTPNGPIIFRHPEHAKRLKNSAKIYRFPIPYTEEEIMEATRETLRQNKLDSAYIRPLGFVGNVGLGVCPPEDTEMELIIAAFPWGSYLGEEALENGVDAMISSWNRAAPNTIPTAAKAGGNYLSSLLVGGEARRHGYDEGIALSVDGYLSEGAGENLFVVRDGILSTPPATSAILPGITRDSIMTLAKDMGYEIREENIAREALYLADEVFMTGTAAEIVPVRSVDKITVGEGKRGPITKEIQAAYFGLFNGTTEDKWGWLDYVYPENAPSAK

SEQ ID NO: 3097 - protein, 103 aa, Brassica napus
  misc_feature (12)..(12): Xaa can be any naturally occurring amino acid
  misc_feature (15)..(15): Xaa can be any naturally occurring amino acid
  misc_feature (22)..(22): Xaa can be any naturally occurring amino acid
  misc_feature (29)..(29): Xaa can be any naturally occurring amino acid
  misc_feature (34)..(34): Xaa can be any naturally occurring amino acid
  misc_feature (39)..(39): Xaa can be any naturally occurring amino acid
  misc_feature (49)..(49): Xaa can be any naturally occurring amino acid
  misc_feature (54)..(54): Xaa can be any naturally occurring amino acid
  misc_feature (58)..(58): Xaa can be any naturally occurring amino acid
  misc_feature (61)..(61): Xaa can be any naturally occurring amino acid
  misc_feature (69)..(69): Xaa can be any naturally occurring amino acid
  misc_feature (74)..(74): Xaa can be any naturally occurring amino acid
MASSMLSSAAVXTSXPAQVTMXAPFTGLXKTSAXFPVTXKANNDITSIXSNGGXVSCXKVXPPVGKKKXETPPXPPLTTRSLNCVEAHYLPLIFAISATPLSR

SEQ ID NO: 3098 - protein, 149 aa, Zea mays
MEQTFIMIKPDGVQRGLIGDIISRFEKKGFYLKGMKFMNVERSFAQQHYADLSDKPFFPGLVEYIISGPVVAMVWEGKDVVLTGRRIIGATRPWEAAPGTIRGDYAVEVGRNVIHGSDSVENGKKEIALWFPEGVAQWKSNLHPWIYEA

SEQ ID NO: 3099 - protein, 257 aa, Pisum sativum
VSEYIDDIYHYYWVTEAHSQALSNYMSIQTEITPHMRGVLVNWLIEVHFKLDLMPETLYLTVTLLDQYLSQVTVKRSDMQLVGLTALLLASKYEDFWHPRVKDLISISAETYTRDQMLGMEKLILRKLKFRLNAPTPYVFMVRFIKAAQSNMKLEHMAFFLIDLCLVEYETLAFKPSLLCASTLYLARCTLQITPSWTPLLQKHARYDVSQIRDCADMMLKFHKAAGKGKLTVAYEKYSRKELSAVAGVKPLDRLPH

SEQ ID NO: 3100 - protein, 174 aa, Triticum aestivum
  misc_feature (107)..(107): Xaa can be any naturally occurring amino acid
QWGILCVGLVVFSSSIYRAADLYMGFDDADAGGDEVEARGAEAYNCPFCGEDFDFVGLCCHIDDEHAVEAKSGVCPICATRVGVDLIGHLTMQHGSYFKMQRRRRVXNLPVAEPSKDFRSDSSDKTFLLNKFPDEKVVERAETSLSEKDQKERAQRSAFARGLVLSTIFDDDTM

SEQ ID NO: 3101 - protein, 405 aa, Yersinia pseudotuberculosis IP 32953
MTDKLAVNRNTFDQVILPVYAPAQFIPVKGKGSRVWDQQGTEYIDFAGGIAVTALGHCHPALVSALHQQGETLWHTSNVFTNEPALRLAQKLIAATFADRVFFANSGAEANEAAFKLARHYAIERHSPYKTKIIAFHNAFHGRTLFTVSVGGQPKYSDGFGPKPADIIHVPFNDLAAVKAVMDDHTCAVVLEPIQGEGGITSATPEFLQGVRALCDQHNALLVFDEVQSGMGRSGKLFSYMHHGVTPDILTTAKALGGGFPISAMLTTEEIASVMTVGTHGTTYGGNPLACAVAEAALDVINTPEVLNGIEQRHGLFVQALQSINSKYDVFSDIRGMGLLIGAELTAKYRGQAREFLAAAAANGLMILNAGPDVLRLAPSLVIELEDIQQGMARLEKAMASVIKG

SEQ ID NO: 3102 - protein, 194 aa, Zea mays
MSPEMRLTPPLLASLRIAGFVMPWMLSRSTLRWRLAPPLPSPLPPLPRPDIAETESYAPTRPPTRPPTRPPNLPYTRKIPSSLVRVREAAAMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 3103 - protein, 464 aa, Saccharomyces cerevisiae
NTKHYDYLVIGGGSGGVASARRAASYGAKTLLVEAKALGGTCVNVGCVPKKVMWYASDLATRVSHANEYGLYQNLPLDKEHLTFNWPEFKQKRDAYVHRLNGIYQKNLEKEKVDVVFGWARFNKDGNVEVQKRDNTTEVYSANHILVATGGKAIFPENIPGFELGTDSDGFFRLEEQPKKVVVVGAGYIGIELAGVFHGLGSETHLVIRGETVLRKFDECIQNTITDHYVKEGINVHKLSKIVKVEKNVETDKLKIHMNDSKSIDDVDELIWTIGRKSHLGMGSENVGIKLNSHDEIIADEYQNTNVPNIYSLGDVVGKVELTPVAIAAGRKLSNRLFGPEKFRNDKLDYENVPSVIFSHPEAGSIGISEKEAIEKYGKENIKVYNSKFTAMYYAMLSEKSPTRYKIVGAGPNEKVVGLHIVGDSSAEILQGFGVAIKMGATKADFDNCVAIHPTSAEELVTMR

SEQ ID NO: 3104 - protein, 539 aa, Synechococcus sp. WH 5701
MSGIRRQGRPASPGMAWGPIWRWPEPERHAAADGPPQGAAELRAAIARGRAELASEVAGLEGEAAEILAVQLALLEDDTLAAQAFAALTGPAAPPAEVAWRAALEVEIAGYQASEDATFRARAADLIDLRDRVLRCLLAPGHSVTPARQPGSVLVAPDLTPSRFLAIDWSGGGAVVLEQGSAAAHVALLARGRGVPMVVAVGAVPAEATQVLVEGDSGWVTFDPDPARAAALSAARGGSSTPAHPGGAPGPAFTAGGERVEVLLNVSDPAELEGLDPELCDGIGLVRSEFLLQVTARQEPAAATGPAGLPDEASQQRAYEALLAWSGGRPVTVRTLDLGGDKPLPGITAAEAEPALGLRGLRLTLGRPELLRPQLRALARAAVAGDLRVLLPMVTVPQEFVAAAALLEEVVAELGAAGLPCRRPPLGMMVEVPAAALTSEMFPADFYAIGSNDLAQYTLAASRSDEAFETLRRDGWPAVELLIARTLESAGRKGVPVCLCGEAAADPARLEGLLRLGLRAVSVPAKAVAAVKRTIAAAP

SEQ ID NO: 3105 - protein, 294 aa, Brassica napus
MAIGGLALDVAGGSGNIEAKITAAVVMTCVVAASGGLIFGYDIGISGGVTTMKPFLENFFPTVLKNATEAKPDVYCVYDSQLLTAFTSSLYVAGLVASLVASRLTAAYGRRATMILGGLTFLFGAVITGWAANIAMLLSGRILLGFGVGFTNQAAPVYLSEVAPPQWRGAFNTGFQFFIGVGVVSANFLNYLTANHRSGWRISLGLAALPAVIMTFGCLFISDTPSSLLARGNHDHARVSLFKVRGAKNRAEVEAELAELVKSSQLAIEARAEPFKTILERQYRPQLVVAVAIP

SEQ ID NO: 3106 - protein, 160 aa, Staphylococcus epidermidis
LESTYEAINVPVNQLQDIKKIISEKGIDGFNVTIPHKERIIPYLDDINEQAKSVGAVNTVLIKDGKWIGYNTDGIGYVNGLKQIYEGIEDAYILILGAGGASKGIANELYKIVRPTITIANRTMSRFNNWSLNINKINLSHAERHLDEFDIIINTTPAGM

SEQ ID NO: 3107 - protein, 575 aa, Mannheimia succiniciproducens MBEL55E
MISGIPASPGIVFGKALVLKEEKIVLDMQKIAEDQVETEVARFYEGRTAAVEQLSAIRDRAEKTLGEEKAAIFEGHLMILEDEELEEEIIDYLRSNKVNAGVAASKIIDQQVAMLADIDDEYLKERAGDIRDIGNRLIKNILGMKIVDLGEINEESILVAYDLTPSETAQLNLDKVLGFITDIGGRTSHTSIMARSLELPAIVGTNNATAMINSGDYLVLDAINNAVYVNPAQDVIDGLKAQQAKLAEEKAELAKLKDLPAVTLDGHRVEVVANIGTIRDCEGADRNGAEGVGLYRTEFLFMDRDQLPSEEEQFIAYKEVVEAMNGRQVVLRTMDIGGDKELPYMNLPKEMNPFLGWRAVRIALDRREILNAQLRAVLRASAFGKLAVMFPMIISVEEIRELKSVIETLKQELRTEGKAFDENIQIGVMCETPSAAVNAKFLAKEVDFFSIGTNDLTQYTLAVDRGNEMISHLYNPMSPSVLSLIKQVIDASHTEGKWTGMCGELAGDEKATILLLGMGLDEFSMSAISVPRIKKLVRSVNFAEAKALADKALQLPTAAEIEKLVADFLAEKTLN

SEQ ID NO: 3108 - protein, 195 aa, Oceanobacillus iheyensis HTE831
MKVNHAEIVISAVSKKQYPEDQLPEIALAGRSNVGKSSFINRLINRKNLARTSSKPGKTQTLNFYRINESFYFVDVPGYGYAKVSKKEREKWGRMMEEYFQTRDTLRAVVLVTDLRHDPTQDDIQMYDFIKYFDLPVIIIGTKLDKITKNKRQKHINRAKQVLEMDETDLFIPFSAEIGEGKDEAWSALSRYIKR

SEQ ID NO: 3109 - protein, 477 aa, Zea mays
  misc_feature (439)..(439): Xaa can be any naturally occurring amino acid
  misc_feature (448)..(448): Xaa can be any naturally occurring amino acid
MGRHGVDQIGAVAAFVWVTLLPLLLVCVVWPGAQAGHTSEYRRQLGSAIDMPLDADVFRPPPGYNAPEQVHITQGNHDGTAMIISWVTTSEPGSSTVIYGTSEDNLNYTANGKHTQYTFYNYTSGYIHHCTIKKLEFDTKYYYAVGIGQTVRKFWFLTPPKSGPDVPYTLGLIGDLGQSFDSNVTLTHYESNAKAQAVLFVGDLSYADNYPYHDNVRWDTWARFVERSVAYQPWIWTAGNHEIDFAPELGETKPFKPFSHRYPTPYKASGSTAPYWYSIKRASAYIIVLASYSAYGKYTPQYKWLEAEFPKVNRSETPWLVVLMHAPWYNSYNYHYMEGETMRVMYEPWFVKYKVDVVFAGHVHAYERTHRISNVAYNVVNGLCTPIPDQSAPVYITIGDGGNQEGLATNMSQPQPSYSAFREASFGHAILDIKNRTHXAYYTWHRNXQDGSAVAADSMWFTNRYWEPTDDSADDFQ

SEQ ID NO: 3110 - protein, 126 aa, Triticum aestivum
  misc_feature (73)..(73): Xaa can be any naturally occurring amino acid
  misc_feature (76)..(76): Xaa can be any naturally occurring amino acid
  misc_feature (104)..(104): Xaa can be any naturally occurring amino acid
YVPTLRTHASKLYTYIVQPWPSLVMGSRATSVSPLEGLKSTVGLPVRRRSNGSSLCSVSNCGRIRCMQAWPIXGHXKLETLSYLSPIRTDAILKHVYYLIRSKXLPWLTFNTVGSILREHNACARY

SEQ ID NO: 3111 - protein, 160 aa, Staphylococcus epidermidis
LESTYEAINVPVNQLQDIKKIISEKSIDGFNVTIPHKERIIPYLDDINEQAKSVGAVNTVLIKDGKWIGYNTDGIGYVNGLKQIYEGIEDAYILILGAGGASKGIANELYKIVRPTITIANRTMSRFNNWSLNINKINLSHAERHLDEFDIIINTTPAGM

SEQ ID NO: 3112 - protein, 282 aa, Treponema denticola ATCC 35405
MDILDKLRGGVIMDVTNPEQAKIAENAGAVAVMALERIPADIRAAGGVSRMSDPKMIKEIIKAVKIPVMAKVRIGHFVEASILEAIGIDFIDESEVLSPADEVYHVDKNKFKVPFVCGARNLGEALRRIQEGAKMIRTKGEAGTGDVIQAVKHMRQIQSEMRQLTCLREDELYVAAKNFQVPYALVEYVHKHGKLPVPNFSAGGVATPADAALMVHLGADGVFVGSGIFKSGDPAKRAAAIVKAVKNYDNPAILAEVSENLGPAMVGINEEEIKVIMSERGV

SEQ ID NO: 3113 - protein, 394 aa, Rickettsia akari str. Hartford
MDTMTNNTKTITLNLGPQHPATHGVLRLILEMDGEIVNNADPHIGLLHRGTEKLIEHKTYLQAIPYFDRLDYVSPMCQEHAFALAVESLLECEVPRRAQFIRVLFSELTRILNHTLNIGSQALDIGATTPLLWLFEEREKIMEFYERVSGSRMHSNYFRPGGVAEDLPDGLLEDIDKFIDQFPPKLHDIESLLNENRLWKQRLVDIGVVSQKEAMDWGFSGPMLRGSGIAWDLRKSNPYDVYDEMEFEVPIGKNGDCYDRYFVRMLEMYESIKIIKQCIEKMPKGAVKTNDPKLTPPTRAKMKESMEAMIHHFKLYTAGYDVPAGETYKAVEAPKGEFGVYLYSQGVNIPYRCRIKSPGFAHLQGLDFMSKGHLMADVITIIATLDIVFGEIDR

SEQ ID NO: 3114 - protein, 413 aa, Rhodococcus sp. RHA1
MPESTTVIVGASIGGVRTAQALRSEGYPGAIILIGAEGELPYDKPPLSKSILAGDSTMAEITLLTTEQARELDLELRLGQPAIRLSTANQDVELADGTRVAFDNLVLATGARARPSPWGTPNGLHVIRTAADARALRRHFGTTDHLVIIGGGFIGAETAATAVELGMRVTLVDPEPVPMARVMGAEIGELFIDLHRRRGVDTRFGVGVESVHGEHGSFAIGLSDGSTLAADTVVVGIGAIPNDDWLESSGLEVSNGVVCDVYCRAIGHDNIYAVGDVCRFDNTRRGGSTRLEHWTNAVEQAVVVARNIARPDEKIRHEPVEYVWSDQYDWKIQTVGLVGSSTHTVIGEVTNKARFAVCYPDENGRLTGVVVVNWPKALVTARKAIALGVEYAEFAARLEAMTVSARTTVKETT

SEQ ID NO: 3115 - protein, 311 aa, Streptococcus suis 89/1591
MSIQDLRDVKIITAMITPFKEDGSINFEVLPELIEHLLSHHTEGILLAGTTAESPTLTHEEELELFGAVQKIVNGRVPLIAGIGTNDTRDSIEFAKEVAAFGGFAAGLAIVPYYNKPSQEGMYQHFKAIADASDLPIIIYNIPGRVVVEMTPETMLRLAEHPNIIGVKECTSLANMAYLIEHKPEDFLIYTGEDGDAFHAMNLGADGVISVASHTNGDEMYEMFTAIEQQDIRTAAAIQRKFIPKVNALFSYPSPAPVKAVLNYLGFEVGPLRLPLVPCPEEDAKRIIKVVVDGDYEATKATVTGVVRPDY

SEQ ID NO: 3116 - protein, 478 aa, Geobacillus kaustophilus HTA426
MEHRHLKPFPPGFLWGAASAAYQVEGAWNEDGKGLSVWDVFAKQPGRTFKGTNGDVAVDHYHRYKEDVALMAEMGLKAYRFSVSWSRVFPDGNGAVNEKGLDFYDRLIEELRTHGIEPIVTLYHWDVPQALMDAYGAWESRRIIDDFDRYAVTLFQRFGDRVKYWVTLNEQNIFISLGYRLGLHPPGVKDMKRMYEANHIANLANAKVIQSFRHYVPDGKIGPSFAYSPMYPYDSRPENVLAFENAEEFQNHWWMDVYAWGMYPQAAWNYLESQGLEPTVAPGDWELLQEAKPDFMGVNYYQTTTVEHNPPDGVSEGVMNTTGKKGTSTSSGIPGLFKTVRNPYVDTTNWDWAIDPVGLRIGLRRIANRYRLPILITENGLGEFDTLEPDDIVNDDYRIDYLRRHIQEIQRAITDGVDVLGYCVWSFTDLLSWLNGYQKRYGFVYVNRDDESEKDLRRIKKKSFYWYQRVIATNGAEL

SEQ ID NO: 3117 - protein, 848 aa, Yersinia pseudotuberculosis IP 32953
MSKIKIAIIGNGMVGHRFIEDLLDKADKDQFDITVFCEEPRIAYDRVHLSSYFSHHTAEELSLVREGFYEKQGVKVLVGERAITINRAEKVIHSNSGRSLYYDKLVMATGSYPWIPPIKGSEGQDCFVYRTIEDLNAIEACTRRSKRGAVIGGGLLGLEAAGALKSLGVETHVIEFAPVLMAEQLDPMGGDQLRQKIERMGVRVHTGKNTQEIVHSGQNSRKTMLFADGTQLEVDFIVFSTGIRPQDKLANQCGLATARRGGIAINDYCQTSDPDVYAIGECASWQERTFGLVAPGYKMAQVAADHLLGRENAFLGADMSAKLKLLGVDVGGIGDAHGRTEGARSYVYLDESKEIYKRLVVSADNKTLLGAVLVGDTTDYGNLLQLALNNITLPENPDSLILPAHAGNKPAIGVDSLPDSAQICSCFDVTKGDIIRAIGQGCQTVAALKSATKAGTGCGGCIPLVTQVLNAELSKQGIEVNNHLCEHFAYSRQELYHLIRVEGIKTFTELREKYGKGYGCEVCKPTVGSLLASCWNEYVLEPQHTPLQDTNDNFLGNIQKDGTYSIIPRSPGGEITPDGLLVVGQIAKEYNLYTKLTGSQRIGMFGAQKDDLPAIWARLIDAGFETGHAYAKALRMAKTCVGSTWCRFGVGDSVGFGVALEHRYKGIRAPHKIKFGISGCTRECAEAQGKDVGIIATENGWNLYVCGNGGMKPRHADLLAADLDEETLMRYLDRFMMFYIRTADKLQRTSVWLESLEGGIRYLQSVILEDKLGINDQLEAEIARLRDKVACEWKATVENPAAQVRFAHFINSSLRDPNVQVVREREQHRPARPDERIPVRVLELEDNA

SEQ ID NO: 3118 - protein, 541 aa, Saccharomyces cerevisiae
MSEFATSRVESGSQQTSIHSTPIVQKLETDESPIQTKSEYTNAELPAKPIAAYWTVICLCLMIAFGGFVFGWDTGTISGFVNQTDFKRRFGQMKSDGTYYLSDVRTGLIVGIFNIGCAFGGLTLGRLGDMYGRRIGLMCVVLVYIVGIVIQIASSDKWYQYFIGRIISGMGVGGIAVLSPTLISETAPKHIRGTCVSFYQLMITLGIFLGYCTNYGTKDYSNSVQWRVPLGLNFAFAIFMIAGMLMVPESPRFLVEKGRYEDAKRSLAKSNKVTIEDPSIVAEMDTIMANVETERLAGNASWGELFSNKGAILPRVIMGIMIQSLQQLTGNNYFFYYGTTIFNAVGMKDSFQTSIVLGIVNFASTFVALYTVDKFGRRKCLLGGSASMAICFVIFSTVGVTSLYPNGKDQPSSKAAGNVMIVFTCLFIFFFAISWAPIAYVIVAESYPLRVKNRAMAIAVGANWIWGFLIGFFTPFITSAIGFSYGYVFMGCLVFSFFYVFFFVCETKGLTLEEVNEMYVEGVKPWKSGSWISKEKRVSEE

SEQ ID NO: 3119 - protein, 243 aa, Yersinia pseudotuberculosis IP 32953
MPCAMNWRWRLMVKFKAIRGVAFDLDGTLVDSAPGLARAIDMALAHQGLPAAGEALVSTWIGNGADVLVERALHWAGREHNAQLVAQTRELFDHYYAKTVEQGSQLFPQVKATLAQLAANGLPIGLITNKPTPFVAPLLTSLGIADYFSVIIGGDDVVVKKPHPAPLYLLLGKLGLHAREMLFVGDSRNDIMAAQAAGCPCIGLTYGYNYGEAIATSHPDCVLAHFADLLPAIGLPSLKDQEV

SEQ ID NO: 3120 - protein, 538 aa, Saccharomyces cerevisiae
MSSVAENIIQHATHNSTLHQLAKDQPSVGVTTAFSILDTLKSMSYLKIFATLICILLVWDQVAYQIKKGSIAGPKFKFWPIIGPFLESLDPKFEEYKAKWASGPLSCVSIFHKFVVIASTRDLARKILQSSKFVKPCVVDVAVKILRPCNWVFLDGKAHTDYRKSLNGLFTKQALAQYLPSLEQIMDKYMDKFVRLSKENNYEPQVFFHEMREILCALSLNSFCGNYITEDQVRKIADDYYLVTAALELVNFPIIIPYTKTWYGKKTADMAMKIFENCAQMAKDHIAAGGKPVCVMDAWCKLMHDAKNSNDDDSRIYHREFTNKEISEAVFTFLFASQDASSSLACWLFQIVADRPDVLAKIREEQLAVRNNDMSTELNLDLIEKMKYTNMVIKETLRYRPPVLMVPYVVKKNFPVSPNYTAPKGAMLIPTLYPALHDPEVYENPDEFIPERWVEGSKASEAKKNWLVFGCGPHVCLGQTYVMITFAALLGKFALYTDFHHTVTPLSEKIKVFATIFPKDDLLLTFKKRDPITGEVFE

SEQ ID NO: 3121 - protein, 452 aa, Bacteroides thetaiotaomicron VPI-5482
MGFKLLDFYKISPPVSGGETDSERSVRFKRIRWATFLSATTGYGIYYVCRLSMNVIRKPIVEDGVFTETQLGIIGSCLFFVYAVGKLTNGFLADRSNVKRFMSTGLLCSALINLCLGFTNSFFAFVLLWGLNGWFQSMGAASGVVSLTRWYSSKERGTFYGFWSASHNLGEALTFISIALLVSWMGWRYGMIGAGVIGLLGFLMMLAFMRDTPQSQGFLLDRRGTSDAHSVSGKQTEEFNKAQKAVLKNPAIWILALSSAFMYISRYAVNSWGVFYLEAQKGYSTLDASFIISISSVCGIVGTVFSGIISDKFFAGSRNVPALIFGLMNVSALCLFLLVPGVHFWVDALAMVLFGLGIGVLICFLGGLMAVDIAPCNASGAALGVVGIASYIGAGLQDVMSGILIEGQKTVQNGVEVYDFTYINWFWIGAALLSVVFALLVWNAGEKRSEIN

SEQ ID NO: 3122 - protein, 499 aa, Sulfolobus tokodaii str. 7
MIDTKRMRAIEINSEALGIPTLLLMENAGRSVKDEILARIKPNNAVIFVGHGGKGGDGLVTARHLASEGVKVKVIVLGENKHKDAVFNYNAILDMDYSIEINEIKDLEELKPVEADVLVDAMLGTGFRGKPREPFATAIRVFNESKGFKVSIDLPSGIDADTGEAPGEYVKPDLVVTFHDMKKGLLRYNFNVVVKKIGIPPEAEIYVGPGDVVVSIKKRDYKSKKGDNGRVLVIGGSYTFTGAPTLSALAALRTGADLVYVASCEETAKIIAGYSPDLIAIKLSGKNISPNNLEELKPWIDRADSVIIGPGMGLSEETIEASKMIVNYLMEKNKPAVIDADALKAISGYKLYPNAVITPHAGEFKIFFKEETEKDIRKRIAQVVEKAKECNCVVLLKGYVDIVSDGKEFRLNKTGNPGMTVGGTGDTLTGIVGTFLAQKLSPFDAAAIGVFVNSLSGTLAYSELGPHITPSDILNKIPVVLNDPIESFKKKIYKRVVNS

SEQ ID NO: 3123 - protein, 105 aa, Glycine max
  misc_feature (69)..(69): Xaa can be any naturally occurring amino acid
DVVLRQAFAKRLGAVQNERGKKKDLSPQDAALLIQISFRAYLIRRSKALRALRELAIAKSKLKEIRAQXNNFSYRRHVARDAEERQRFSEKIIVLLLTADAIEGI

SEQ ID NO: 3124 - protein, 325 aa, Geobacillus kaustophilus HTA426
MAELTMIEAINEAMRQEMERDPRIIVLGEDVGENGGVFRATDGLLAQFGEGRVFDTPLAESGIIGTSIGLAINGMRPIAEIQFLGFVYQAMDQLAAQAARIRFRSAGRFSCPIVVRSPYGGGVRTPELHSDALEALFTHSPGLKVVMPSNPYDAKGLLISAIRDEDPVLFLEPMKLYRAFRMEVPEEPYTIPLGQARVVKEGDDVTIIAWGATVPLAAKVAAEMQAKGVNAEVIDLRCLQPLDIDTIITSVEKTGRVMIVHEAVKTGGFGAEVAALISERALFSLSAPIVRIAGYDTPYPVPSVEDDWLPNAERIAEGIETLLRY

SEQ ID NO: 3125 - protein, 321 aa, Zea mays
MAKKRKRSSDAPASAAVEKPDDSAPERPERTLFGFKDQPDSPAEPASKDAGPFFRNKEKVLITCSRRIIYRYRHLMQNVVSLLPHAKKDSKVESKQSKGSALNELVELRSCSSCLFFECRKQKDLYLWMVKSPAGPSVKFLVNAVHTMEELKLTGNHLKGSRPLLTFSSNFDQQPHWKLLKEMITQIFATPKDHRKAKPFHDHVFVFSIVDDHIWFRNYQISVPHNEIDKVDKGGLDKMTLVEVGPRYCLNPIKIFGGSFGGPTLYENPFYVSPNQIRALEKRKKAGKYAKKVKAKVRRKMHEMENTLEPDEFADLWKGED

SEQ ID NO: 3126 - protein, 352 aa, Glycine max
MGEVDPAFIQDLEHRPKLSIIQAEGIPIIDLSPISNHTVSDPSSIENLVKQIGSACKEWGFFQVTNHGVPLTLRQNIEKASRLFFAQNLEEKRKVSRDESSPTGYYDTEHTKNVRDWKEVFDFLAKDPTFIPVTSDEHDDRVTHWTNVSPEYPPNFRDIMEEYIQEVEKLSFKLLELIALSLGLEAKRFEEFFMKDQTSFIRLNHYPPCPYPHLALGVGRHKDGGALTVLAQDEVGGLEVKRKADQEWIRVKPTPDAYIINVGDLIQVWSNDAYESVEHRVMVNSEKERFSIPFFFNPAHDIEVKPLEELTNEHNPSKYRPYKWGKFLVHRKGSNFKKQNVENIQIYHYKIT

SEQ ID NO: 3127 - protein, 244 aa, Brassica napus
  misc_feature (216)..(216): Xaa can be any naturally occurring amino acid
  misc_feature (223)..(223): Xaa can be any naturally occurring amino acid
ERNSSLDPRVRDPLQPDNHHLPSPPLISDRVLINGVVTPLTLTAEGELQWTTEPGRGKSTTEKEILSFAVEGDKVRVKTLVERTGSSICCGGSGGDYARKDFVFEPLYDESRKLWCDKLRQRLRSLGRPKRLLVFVNPFGGKKTARKIFLEEVKPLFDDADVQLDVQETKYQLHAKEMVRSMDVSRYDGIVGVSGDGVLVEVVNGLLEREDWRTAXKLPMEWXPAGSGNGMIKSLLDPGWDVFV

SEQ ID NO: 3128 - protein, 381 aa, Silicibacter pomeroyi DSS-3
MSKRDYYDVLGVSKGASADEIKKAYRGKAKELHPDRNKDNPDAESLFKEVNEAYEVLKDAEKKAAYDRFGHAAFEGGMGGGQRPGGGFGSGDFSSAFSDVFEDLFGDFMGGQRGGGGRRAARGSDLRYNLRVTLEEAFSGLQKTINVPTAVACSSCEGTGAEGGVEPTTCPTCSGMGKVRAQQGFFTVERTCPTCSGLGQIIKNPCKSCRGQGRVEKDRALSVNIPAGVETGTRIRLAGEGEAGMRGGPPGDLYIFVEVAKHELFERDGVNLYCRVPVSMAKAALGGAIEVPTIDGGRGRVQVPAGSQSGRQMRLRSKGMPALRGGGIGDMFIELAVETPVNLTSKQKDLLREFDELSEDNNPETKSFFSSVKSFWDGMKG

SEQ ID NO: 3129 - protein, 261 aa, Brassica napus
MAGLFDKQADLYLDARPNYPSEWFSKLAGLTDHHVLAWDAATGNGQAALAVADHYERVIATDISESQLKLATPHPKIDYRHTPSTMTDDELVELIGGESSVDLITVAQAVHWFDLPRFYAVAKRVLRKPGGIIAVWGYNDVVVSPEFDEVQYRFHAQTLPYWKYPNIQHVFDAYGALPFPFESVGMGSEGRPLMLEMPKTTSFEGILRMFKSWSAIVTAREKGVELLPESLIKELETASPGKDLIRNVVYKAFMIVGKVCV

SEQ ID NO: 3130 - protein, 120 aa, Glycine max
TDTTVNQDDTGKIAPFTDLKSMAGFPTTKTNNDITSIASNGGRAQCMYVLPPVAKKKFETLSYLPKLDDAQLANEGEYHLRNGWIPCLEFEMEHGFVYREHNRSPGYYYGRYRTMRKQPM

SEQ ID NO: 3131 - protein, 245 aa, Bacillus cereus ATCC 14579
MIKLVLIRHGQSLWNLENRFTGWTDVDLSENGLSEAREAGAILKKNGYTFDVAYTSVLKRAIRTLWIVLHEMDLTWVPIHKSWKLNERHYGALQGLNKDETAQKYGEEQVHIWRRSVDVRPPALTEDDPRYEATDPRYKTLKKGEFPLTECLEDTEKRVLAYWHSEIAPTLKSGNKVIISSHGNTIRSLVKYLDNLSSDGVVSLNIPTSIPLVYELDENLRPIRHYYLSMDGEVPEGEIPKHISF

SEQ ID NO: 3132 - protein, 234 aa, Pseudomonas chlororaphis
MKLALVGDIGGTNARFALWKDQRLESIQVLATADHASPEEAIGVYLGGLGLAPGSIGAVCLSVAGPVGGDEFRFTNNHWRLSRKAFCQTLQVDELLLVNDFSAMALGMTRLQPGEFRVVCEGTAEPLRPAVVIGPGTGLGVGTLLDLGEGRWAALPGEGGHVDLPLSSPRETQLWQHIYSEIGHVSAETALSGGGLPRVYRAICAVDGHEPVLDTPEAITAAGLAGDPIALEVL

SEQ ID NO: 3133 - protein, 334 aa, Pseudomonas chlororaphis
MTLRIAINGFGRIGRNVLRALYTQGYRQDLQIVAINDLGDSSINAHLLKYDTVHGTFDADVQHDQESLTVNGDRIAVSAIRNPAELPWAAEKIDVVFECTGLFTDRAKAAAHLSAGARKVIISAPAKGADATVVYGVNHDILRQSHQIISNASCTTNCLAPVAQVLNRELGIESGLMTTIHAYTNDQNLTDVYHSDSVPRPFGHPNMIPSKTGAAEAVGLVLPELAGKLTGMAVRVPVINVSLVDLTVQLKRNTTAEEVNALLKSASQHSKILGYNSLPLVSSDFNHNPLSSIFDANHTKVSGGKLLKVLAWYDNEWGFSNRMLDNCLALCSAE

SEQ ID NO: 3134 - protein, 408 aa, Pseudomonas fluorescens Pf-5
MRAMTYHGAHDVRVETVPDPIIEASDDIILRVTATAICGSDLHLYRGKIPAVEHGDIFGHEFMGIVEDTGSAVTAVQRGDRVVIPFVIACGDCFFCQQELYAACETTNTGTGAAMNKKLIPPPAALFGYSRIYGGIPGGQAELVRVPKANTGPFKVPGTLADERVLFLSDILPTAWQAVINAGVSQGSSLAIYGAGPVGLLSAACARMLGVERIFMVDHHPYRLDYAQRTYGVIPINFNDDDDPADTIISQTSGSRGVDGVIDAVGFEAKGSTTETVLATLKLEGSSGKALRQCIAAVRRGGVVSVPGVYAGFIHGFLFGDAFDKGLTFKMGQTHVHRYLPELLEHIETGRLQPDAIISHRLSLEQAAEGYKIFDKKQEDCRKVILTPGGSNMQLADVDDTTSLAPAV

SEQ ID NO: 3135 - protein, 215 aa, Synechococcus sp. WH 5701
MSSLPDFDHGSPGGRSGSVHRVTGETDVRVRLGLDGRGRCRVSTGVPFLDHMLHQLASHGLLDLEISAEGDTHIDDHHTNEDVGIAVGQALAQALGSRKGIHRFGHFSAPLDEALVQVVLDCSGRPHLSYGLVIPGQRIGTYDTELVREFFVAVVNNSGLTLHIRQLDGLNSHHIVEACFKAFARALRQAVEIDPRRAGEVPSSKGVLEQAGVLG

SEQ ID NO: 3136 - protein, 412 aa, Beta vulgaris
MPRQQNRLISSQNKSNYRQPSQNQSKYRQPSQINTNQRGENSQNASPQYDNLYHESPSENANLSYRQVDPNYGFSQYGQEDASPYNDVDDDGGEYEEGGDGFGQYHQDDDSDDDDEFVQGTQSFSQLLSGNQSQQPPQRQPVQSQNPPFPATSSSAKRVWDQVEDELLVSAFMNTSLDKVSGTYQKKNIFWGKVWEAFEEGRIANPTETAPRNVDMVKGRWSRLAPRVLRWAAFYDEALARKKSGQNDDDVLREAHALHRRKNGRFILEHAWKLLRKFRKWRSIVIKSMESQRGRPKDPQENVDSPGSGGSGKRTRVDGSDSMPETPTSAEGGEDDPRPYGTKKAKAKLKGVAGQTIECFATFNERLRIHAEGRSVDVEIENRKMEVQARKVAAKEAENSVANQDAESARVS

SEQ ID NO: 3137 - protein, 477 aa, Pseudomonas fluorescens
SQKFDVVVIGAGPGGYVAAIRAAQLGLKTACIEKYIGKEGKVALGGTCLNVGCIPSKALLDSSYKYHEAKEAFKVHGIEAKGVTIDVPAMVARKANIVKNLTGGIATLFKANGVTSFEGHGKLLANKQVEVTGLDGKTQVLEAENVIIASGSRPVEIPPAPLSDDIIVDSTGALEFQAVPKKLGVIGAGVIGLELGSVWARLGAEVTVLEALDKFLPAADEQIAKEALKVLTKQGLNIRLGARVTASEVKKKQVTVTFTDANGEQKETFDKLIVAVGRRPVTTDLLAADSGVTLDERGFIYVDDHCKTSVPGVFAIGDVVRGAMLAHKASEEGVMVAERIAGHKAQMNYDLIPSVIYTHPEIAWVGKTEQTLKAEGVEVNVGTFPFAASGRAMAANDTTGLVKVIADAKTDRVLGVHVIGPSAAELVQQGAIGMEFGTSAEDLGMMVFSHPTLSEALHEAALAVNGHAIHIANRKKR

SEQ ID NO: 3138 - protein, 297 aa, Geobacillus kaustophilus HTA426
MNKPTITVIGSLNMDLVTVAARFPNQGETILGEQFLTTPGGKGANQAVAAARLGANIRMIGAVGDDAFGQELIRSLQNEGISVDYVKPVTHGSTGIASITISERDNRIIVVPGANHALTPEDLDSCESVIAESDVCLLQLEIPLPVVERAVSIAHRHGVRVIVNPAPAQPLPPSVLEQASFLTPNEHERTILFDKMDEEAFADKLIVTEGAKGVRIWQDGQERLIPSFQVPVVDTTGAGDTFNGALAVALAEGKPLDEACRFANAAAALSVTKLGAQAGMPRRQEVESFLSRQKESH

SEQ ID NO: 3139 - protein, 314 aa, Glycine max
MAMASLASSSVLLNLLFIVSALHLGAAAARILSEKEDQQQLQFQYHKGPLLSGNISVNLIWYGSFKPSQRAIISDFITSLSSSPKSTAQPSVATWWKGTEKYYQLIKSAPKPSLTLALGAQILDENYSLGKSLTTDNIVSLASKGAPNDAINVVLTFSDVTVEGFCSSRCGTHGSSVGPRKFAYVWVGNSETQCPGQCAWPFQQPIYGPQNPPLVAPNNDVGLDGMVINVATLLAGTVTNPFGNGYFQGPKEAPLEAASACTGVYGKGAYPGYAGELLVDPTTGASYNANGVSDRKYLLPALFDPTTSACSTLA

SEQ ID NO: 3140 - protein, 617 aa, Aspergillus oryzae
MALASKDRIEPGSFNVPVGAFPATCSSTGIDADKIASEVIRLLNTALGLKQPQQISKLFLEDGYWRDHLVLTWDFRTIKGQENITRFLQENPRLLQVEIDRSSAFKAPAIFPIDAFGDVTGVQFFIKVTTDAGSGKGVVRLAEKDGEWKIFTFFTSLLEIKGSEEKINHHRPVGVSHGEHHDRRNWQDRRTADFNYEGKSPTVLIVGAGQAGLTIAARLKMLDIDALIIDEEDRIGDNWRRRYHQLVLHDPVWFDHMPYLQFPANWPIFTPKDKLAEFFECYAKLLELNVWTKTKLQSTSWSDANNVWTIELQRQKEDGTVETRTFNPRHVIQATGHSGKKNLPEFKGVETFQGKRICHSSEFPGADPNSKGKKAVVVGSCNSGHDIAHDYFEKGYDVTMVQRSSTCVISSKSITDIGLKGLYEESAPPVEDADLFLWSIPSDLFKAQQKKVTAVQNQNDKATLDGLEKAGFKVDRGPDDAGLLIKYLQRGGGYYIDVGASQLIVDGKVKVKQGQEIAEVIPQGLRFADGSELEADEIIFATGYQNMRTQARIIFGDEVADRIQSVWGYNEEGEMRTIWQRSGHPGFWFMGGNLALCRYYSRLLALQIKGVELGLNH

SEQ ID NO: 3141 - protein, 323 aa, Triticum aestivum
  misc_feature (187)..(187): Xaa can be any naturally occurring amino acid
  misc_feature (240)..(240): Xaa can be any naturally occurring amino acid
  misc_feature (249)..(249): Xaa can be any naturally occurring amino acid
  misc_feature (253)..(254): Xaa can be any naturally occurring amino acid
  misc_feature (263)..(263): Xaa can be any naturally occurring amino acid
  misc_feature (272)..(272): Xaa can be any naturally occurring amino acid
  misc_feature (286)..(286): Xaa can be any naturally occurring amino acid
  misc_feature (293)..(293): Xaa can be any naturally occurring amino acid
  misc_feature (305)..(305): Xaa can be any naturally occurring amino acid
  misc_feature (313)..(313): Xaa can be any naturally occurring amino acid
MASGTDEKAKMESLTSPAAFVEGGVQDACDDACSICLEAFCESDPSALTGCKHEFHLQCILEWCQRSSQCPMCWQPVSMKDPTSQELLEAVQWERNIRTNQTQNTTIFHHPALGDFEVQHLPVVGNDAELEERILQHLAAAAAMGRSHQHGRREGQRNRSGSHGRPQFLVFSAHPNTPAGSVSSSSXQGEGNQSPGVLTYDAEQDAVVSIWEIVPPVSIPRFSNKEHPSLDNQLPVGNDXAGASDFILXNSSXXPRLNAVPFXKYKNLLQKXLQGWKESFFKLTNXVRFLGPXIRPNLIMDSSVXRMMDLWEXKNGQTIPTLL

SEQ ID NO: 3142 - protein, 334 aa, Marinobacter sp. ELB17
MTIRIAINGFGRIGRNTLRALYENNYREQMQVVAINDLGDAETNAHLLKYDSVHGRFAADVSHDADSLSVNGDRIAISAIRNPADLPWKDLGVDVVLECTGLFTTREKAAAHLQAGARKVIISAPSPDADAMVVFGVNDQILNADHHIISNASCTTNCLAPIAEALNNAVGIESGLMTTIHSYTNDQHLSDVYHSDLYRARSATQSMIPTKTGAAAAIGKIIPALNGKLDGLAVRVPTINVSLVDFGFIASRDTSVEEVNAAVKAAADKNSVLGYNQEKLVSVDFNHDARSSIFDANHTRVIGRHVKVMAWYDNEWGFSNRMLDNAAALIKASQ

SEQ ID NO: 3143 - protein, 517 aa, Zea mays
MGCWRSSLRSGPHAAEKPPRHRHRPPPPPTNGPTSSLNAQQAAPPARASGEVPALAEFSLAELRAATAGFAPGNIVSESGEKAPNLVYRGQLRGPGGAPPRAVAVKKFAKLAWPDPKQFAEEAKGVGGLRHRSMANLIGYCCDGDDRLLVAEFMPNDTLAKHLFHWENQTIEWAMRLRVAYYISQALEYCSTKGWPLYHDLNAYRVLFDENGDPRLSCFGLMKNSRDGKSYSTNLAYTPPEYLRNGRVTPESVIFSFGTVLLDLLSGKRIPPSHALDIMRGRNIQAVMDSHLEGNYSIEVATTLVNLASQCLQYEPRDRPGIKKLVSILEPLQKKIEVPSYVMLGFAKPVEEPQAPPTPQRPLSPMGDACSRMDLTAIYQILFTTHYRDDEGSNELSFQEWTQQMRDMLDARKRGDSAFKDKDFKAAIDCYTQFVDVGIMVSPTVFARRSLCYLMCDQPDAALRDAMQAQIVYPDWPTAFYMQAVALSKLNMQSDAVDMLNEASQLEEKRQKSTRVP

SEQ ID NO: 3144 - protein, 352 aa, Solanum tuberosum
MSRPQEPHRPFLPFGNPFKFILPKGSYLSPKLLALLNAFEESLAERVKSLKPGGKEDILTLSWMTQAISTLCAIHTDVKTLITELELPVCDWDEKWIDVYLDNSVKLLDICIAFSSDISRLNQGHLYLQCGLHNLDGTSNQFMKARSSFDGWKQHINSKNPRLENCFAILDSLTESLNLPKIKNSAKGKVLMRAMYGVRVVTVFILSMFAVTFSGSTKELKDLQIHETCLWTEAFVDVRDFISQEIRRIYSSGRITALKELEVVDTSVKKLYPLIQDGVDPNEAEQLHLLTSNLTEKAEKLSGGLDLLAKEADRFFHILLTGRDSLLCNLRIDSTVSNPAEVNNNVERKEVR

SEQ ID NO: 3145 - protein, 468 aa, Nostoc sp. PCC 7120
MLEFIHNIFADNLFIPHGHCYLWQPGLVWLHLLSDFLIAVAYYSIPITLIYFVRKRQDLPFKWIFLLFGAFIISCATSHVMEIWTLWHPTYWLSGFMKAITAFISIYTAIVLVPIVPQLLALPSPAQLEAANNQLKIEIIERKTAEAALLQIKADLENRVEERTNQLQQSMLASLATAAKAKDQAEKLQVALNDLANAQVQLIQTEKMSSLGQLVAGIAHEINNPVNFIYGNIHFIYEYTKDLWQLIILYQQCYPEPAWEIAAYTQEIDLDFVQNDFAKILASIKNGAERIREIVLSLRNFSRLDEAEIKQVDIHEGIDNTILLLKNRLKGQGKHPDIEVVREYNNLPLVECYPGQLNQVFMNILTNAIEAAKESVNNPLIRIQTEALDSDQVMIQISDNGCGMTEEIRNKIFDPFFTTKPIGSGTGLGMSISYQIIDKHGGTLKCVSAPNEGTEFIIYIPTRLKSSI

SEQ ID NO: 3146 - protein, 411 aa, Triticum aestivum
RTVQNTVNTGRTVVCTIHQPSIDIFESFDELLLMKRGGRVTYAGKLGRHSNILVKYFEAIPGVPKIEEGYNPATWMLEVTSPLAEARLNVDFAEIYANSAFYRSNQVLIKEMSVQQPGSQDMSFPIKYSQNFPNQCMANAWKQFRSYWKFPPYNAMRYLMTVLYAVLFGTVFWGKGKNVESVQDMYSLLGAIYAAVFFLGASTVFSVLPVVSTERTVFYREKAAGMYSPLSYAFAQALVEFVYSAAQGVLYTVLFYGMVGFEWKADKLLYFTFFLAACFVYITLYGMMLIACTPSYLLATVLVSFTIMQWNIFAGFLISRPMIPVWWRWFYWADPVSWTIYGVIASQFGDDDRILTAPGQTGGVVVKDFLNDKLGYRHDFLGYVVLGHFAFILLFFFLFAYGIKKLNFQKR

SEQ ID NO: 3147 - protein, 302 aa, Oryza sativa (indica cultivar-group)
MAARPETAATQLKGNKDLAEPCESLALTTQIDATRAQYSPYISPVCTTNCELQKARVQWKKQMVAVQTVHAALLPSTTTTRRRPSPGRLPRRSPIRARAGSSETSSPRGRENWRVQEALARVAEIQVLKVRIASFLDDCSENLLWLAENADAELDATAQDSLRVLDLDGAADDEIMERLYCKLGCFDDAQAEEKWMDLIGLGIDEGVSVESIGEEAKHEHVLVARESGRYRTRRNVYLGVMGLIWVGLMQTTVFAAPNVELDKFAALCLIFLAHIVQVCFKEETDKKQVCVNHETQISGRQR

SEQ ID NO: 3148 - protein, 391 aa, Zea mays
GMAAASQPPSSALRMHGCGGAASASSAPVRLFTESRGRVVASIGRGRRRRRAISCCSSPDADGPRPAAPPTSAAPSDGSIQLYSQIERVITEAAKQSREGWGSTGDWTEVEGSWVLRPKSLEPSFVVHFVGGIFVGAAPQITYRFFLECLANRGALVIATPYASGFDHFFIADEVQFKFDRCLRNLDEPVNDLPTFGVGHSLGSVIHMLIGSRYAVQRSGNVLMSFNNKEASSAIPLFSPVIVPMAQSFGPIFSQLASYPTIRFGAEAAIKQLENLSPPVVKQLLPLLQQLPPLYMDLIKGREDFIPKPEETRRLIKSYYGISRNLLIKFKDDQIDETSTLAQVLSSEAAISSLLDMSIRSLPGDHGLPLQQVLPDVPPAMADAVNREVNF

SEQ ID NO: 3149 - protein, 663 aa, Oryza sativa (indica cultivar-group)
MTLQMEPPPPPPRRSVSTSCDLHPGETFTGFCAACLRERLAGLEASTAAAAAAPGRRSTSAIRSLFSRPFVAAGGGGGGSGGGAVPSGSGAAVPDLRRCKSFSCGLVADVLAGVCGDEPQRRSCDVRGRSTLWALFHQDDRERVRDGTAFGAFPASSSAAAAALASEVQPQPPPPPPPPPCVPEVFLEEEIAMAEESDEITPVVEPILVVDTSGEMETEANGGREAKAMKDHIDLECSQAKKPQPKDLKEIAGSFWLAASVFSKKWQKWRRKQKLKKQDAAGSKAAAAAMPPPEKPSKPSFLRRSRLRGEACSEFAGGRRSCDTDPRFSLDAGRMSVDDVGFSWDEPRASWDGYLFGAGTGIGLGRAPPPLSRLPPILSAMEDSPAGIVERSDGQIPVEDDSQPEPDPDADTPGGSVQTRDYYDTSSSSRRRRSLERTSSVRRPSFEVTDAKPVLPAAAAITSVKDSPLIGSSEFYHFQHAEDLLEHHRFSTSSLIEDFPMSLDAAFPGPDKKPRRWRKAWSLWGLIHRRAAGRRGGASDVADRAFSEPWPELRVRGCNARMQRCNSNASARSSFSSNSGGLGSSRRSYVDGNGNVVKRRREECALERNRSARYSPGHADNGMLRFYLTPMRSASGRRAPGLPAKGGRQLRSQSFARSMLRLY

SEQ ID NO: 3150 - protein, 324 aa, Shewanella oneidensis MR-1
MQQLFVQLLEERYFNRLPEALVLKFATESADFVRFWLVHCMRSMVSERELAIALFFSAEWELEELASLKSFWGSYVAMEEAQEVKATFCHFVPWLKTISPHHEDAICVFSALWFFEHRPTSVGKQLQSATLSHSQLPVSLLDDIKLFSLPHLRPITVYGHQGKGSVESGIRNNMHYPTPIPNDNLAMACVERVIAKFAGIKLAFAEPIVVLRYEPGQFYQWHYDAIHAYTAEIQAELERFGQRSRTAILYLNDDFEGGETEFKAPYIQVKPETAAILVFDNTDQTGKPIPSSLHRGCEVTAGKKWVCTQWFRDKPFWLRAGLLA

SEQ ID NO: 3151 - protein, 374 aa, Clostridium perfringens ATCC 13124
MKKVLILSTSTGYGHNQAANSLMELIKNDDTEILVHDFLKENRFFDRSIVNGYDLCASSLGTLYGLLYKISNIKFINNLVSFLFLPVANKLAKFIDSFNPDLIITTHPLAVSILSYLKKRQIIKVPVISVVTDFKCHYTYVSKIIDHYIVACDFTKENLASKGIPKEKISPFGIPVKQDFYKEDYHNYVENIIQSPLNILLMGGGMGLDNISKVLKTLIKNENPLNLTIVCGNNAELKKELCKEYGHIKGNKKLNILGYTNEIPKIMKSSDLIITKPGGLTTTESLLSHLPMIIPFIIPGQESENREFLSKSNCAITINHLEELNKVINDLNKDNDKLINMRKSILDVLSSYSLEGTIKLCTKMLNDSYNKRRY

SEQ ID NO: 3152 - protein, 358 aa, Solanum tuberosum
  misc_feature (277)..(277): Xaa can be any naturally occurring amino acid
MSCYKGKYADELIKNAAYIATPGKGILAADESTGTIGKRLSSINVENVESNRRALRELLFCAPGALQYLSGIILFEETLYQKTAAGKPFVDVMKEGGVLPGIKVDKGTVELPGTNGETTTQGLDGLAERCQKYYAAGARFAKWRAVLKIGANEPSQLAINDNANGLARYAIICQQNGLVPIVEPEILVDGSHDIKKCADVTERVLAACYKALNDHHVLLEGTLLKPNMVTPGSDAPKVAPEVIAEYTVRALQRTMPAAVPAVVFLSGGQSEEEATRXLNAMNKLQTKKPWTLSFSFGRALQQSTLKAWSGKEENIGKAQAALLTRCKANSEATLGKYAGSSNLGDGASESLHVKDYKY

SEQ ID NO: 3153 - protein, 212 aa, Oryza sativa (japonica cultivar-group)
MKFRSDSSGGDEPRAPAAGDGGGGGDEPAKRQRTDPSSSSSQGEASSSSQPPPQQAAGGAASGDAGEGEQPRVPDLGEDLVFEVLRRAEARTLAAAACVSRGWRQLAEDERLWEAACVREWANLGFSERQLRAVVLSLGGFRRLHAVYIRPLQWRGAGVPRQQGRRQPPVRLGRDQVQLSLSLFSIGFFQNMPCPKKDKGNDSDKNGGGQCG

SEQ ID NO: 3154 - protein, 668 aa, Aspergillus oryzae
MVAGISKRQQLRNERALQDLVRSVPGNDRCADCQAMNPGWASWNMGIFLCMRCAALHRKMGTHISKVKSLSMDSWTAEQVDNMKSHGNNLMNKIFNPRNVKPPVPADVDESDACMERFIRQKYQHRTLEEGKPKPPSREGTRRDDRSPEGSPPPLPPKPARPHGLGLRSASSTTSLHRLSNRQAASSRFEAYESPRSVSQGMGASVGNSNASHESQMATLRSMGFTNEYRNSAVLKGLDGNLDKSIETLVRLGEGPPSLQGGTRVQTTTANDAARQQASSNPFDQLDSKPAQPSGQSYNPFDVPTPQPAAQTLEASFQNLQVSQPLFPHSTGGYPNQQPSFPQPLYQQPITPPVMPTISQGAVVQSPQPVDGGQNPFFQSGSFTSTPNQTPGLAQPQTNPFFTQPPSQLNSMQTPSQAPAGYPHPPRHANTMPAISSTSPFGTASPFQQQQQQQQQIQPPQLQVQPPQQMQPSHNPFQPMTAPPTPQSAGYQVQSQLGLQAPAQHLAPQPTGRIDKNSILSLYGLSPPPSATSEYSQPPNPAGAFPGPGTAPAPAPGYATTTQPQQPTDPHSAGTRNPFLTSQAPAAGLPQQQQQQAYLQQPQLQPQPQYTTTSPFTMPVKSNTMPPAAPSAFPRPQGHMSQQSVDINAFQNGRHSPDAFASLSARYG

SEQ ID NO: 3155 - protein, 210 aa, Staphylococcus aureus subsp. aureus MW2
MTNYKIDFSKGLVPAILQDNQTKQVLMLGYMNQEAFDKTIEDGVVCFYSRSKQRLWTKGETSGHTQRVKDIHVDCDNDTILIDVIPNGPTCHTGSQSCFNTEVPFSVQTLAQTVQDSAQSNNEKSYTKYLLTEGIEKITKKYGEEAFEVVIEAIKGDKKAFVSEVADELYHLFVLMHALGVDFSEIEAELARRHHKRNNFKGERQNIEQW

SEQ ID NO: 3156 - protein, 285 aa, Pseudomonas fluorescens Pf-5
MKSYPRPPFPAQQQAVPGTQAAMAPYPDCGEQSYQGSGRLAGKIALVTGADSGIGRAVAIAFAREGADVALAYLDEHDDAHETARWVEQAGRQYLLLPGDLAGRQQCHDIVAKTVEQFGRIDILVNNAAYQMTHHELADISDDEWVRTFDINITAMFRICQASVPHMAPGSSIINTSSINSDAPKPTLLPYSTTKGAIANFSAGLGQLLGPAGIRVNSVAPGPIWTPLIVSTMPSEAITHFGEQTPLGRPGQPVEVAPIYVLLASDEASYISGSRIGVTGGKPIL

SEQ ID NO: 3157 - protein, 386 aa, Pseudomonas fluorescens Pf-5
MKAVVFHSVGDIRLEDVAEPTLLAPTDAIIRVTASAICGTDLHFVRGTVAPMKPGTILGHEAVGIVEQLGTDVRNLQVGDRVVVPSTIACGNCSYCRAGYYAQCDDVNPHGKEAGTAFYGGPEITGPFHGLQAEKARIPFAHIGLVKLPEQISDDQAILLSDIFPTGYFGARLAEVSHGDTVAVFGCGPVGQFAIASARLLGATRVFAIDHHQDRLQMARRQGAETIDFDQEDPVATLKRLTAGIGVDRAIDAVGVDAEHACHGDDGRPARSCQWQSGNAPDQVLRWAVEGLAKAGTLSIIGVYPQEARSFPIGLSMNKNLTINMGNCHHRKYIPTLIDMVLNQRIDPASILTQTRPMDDAIAAFEAFDRREPGWTKVQLRPQPQC

SEQ ID NO: 3158 - protein, 380 aa, Magnaporthe grisea 70-15
MLSGKIPSVDFGLWAGGTSQERNQIARDLSNACRHVGFVYLVNHGIEQNLLTEAFAWSKKLFDLPIEKKMLVPHPPGMGCLVFYNFLMMSYIWFCLGIATPKGFLIHRGYSWPGLEKVSQQEDLTNSSDPATATANIRTVPDVKESFEMGSEEFAEQPNVWPPEADALSELSGFRTFMVRFYKECARLSLEVIRAMASGIQLSPSEETHLVASHAGALNNQLRLLHYPPVSGASLRRGEVARMPAHSDWGTITLLFQDGAGGLQVEDPGASGRFVDAPPVDGAVVVNVGDALMRWTNGYFKSTLHRVGIPPDYSDAAKPQEEQNGRRDLTPSRYSIPYFVSPNPDAVVDCFASCVTDDRPLGYERIIYEDYRKMRASTQY

SEQ ID NO: 3159 - protein, 589 aa, Triticum aestivum
  misc_feature (238)..(238): Xaa can be any naturally occurring amino acid
  misc_feature (314)..(314): Xaa can be any naturally occurring amino acid
MGFSFFASRAAARFLQDIRRPSSAGVSTAALLLTAASGGGIVAYADSARAEEAPEPPPRKKKVVVLGTGWAGTSFLKNLDSSRYEVKVISPRNYFAFTPLLPSVTCGTVEARSVVEPIRRMFEKKGKDVAYYEAECFKIDPTKKAVHCRSAVGTNLDGNGDFMLDYDYLVVALGATVNTFNTPGVMEHCHFLKEVEDAQKIRKSVIDCFERASIPNISEEEKRKILHFVIIGGGPTGXVEFAAELHDFLVEDLVKLYPAIAQFVKITIIQSGEHILNTFDQRIAVFAESKFQRDGIELSTGFRVIKVSDDSITXKCKSSGVETLVPYGMAVWSAGIGTRPVITDFMSQVGQGKRRALATNEWLRVPECDSVYAIGDCSSISQRKIMEDISTIFKVADKDNSGTLTLKEINDVLEDICIRYPQVELYMKSMHMVDIADLIKGGVGDSNKESMVVNIEEFKKALSHVDSQVKTVPATAQVVAAQQGYYLADCFNKKDHCIEHPEGPLRLTGSGEGHHNFRPFRYKHLGQFAPLGGEQAAAELPGDWVSMGHSTQWLWYSVYASKQVSWRTRVLVVSDWTRRFIFGRDSSRI

SEQ ID NO: 3160 - protein, 395 aa, Mycobacterium sp. MCS
MSGAHAQRTEPRDVALRAGIPPFYVMDVWLAAAERQRTHGDLVNLSAGQPSAGAPTAVREAAIAALQENQLGYTVALGIPELREAIAARYADQFGLTVGLDDVVLTTGSSGGFLLAFLACFDVGDRVAIASPGYPCYRNILTALGCEVVEIPCGADTRFQPTAAMLAELDPPVQGVIVASPANPTGTVIAPAELAAIATWCEATGTRLISDEVYHGLVYDGAPPISCAWQTSRKAVVVNSFSKYYAMTGWRLGWLLVPQELRRAVDRLTGNFTICPPALAQHAAVAAFTPESTAEADGLLAHYAENRRLLLDGLRAIGISRLAPADGAFYVYADVSHLTDASLSFCAKLLADTGVAIAPGIDFDTVHGNSFVRLSFAGPTADITEALSRIGGWLR

SEQ ID NO: 3161 - protein, 307 aa, Triticum aestivum
  misc_feature (172)..(172): Xaa can be any naturally occurring amino acid
  misc_feature (184)..(184): Xaa can be any naturally occurring amino acid
  misc_feature (210)..(210): Xaa can be any naturally occurring amino acid
  misc_feature (284)..(284): Xaa can be any naturally occurring amino acid
MVVPVIDFSKLDGAERAETMAQIADGCENWGFFQLVNHGIPLELLDRVKKVCSESYRLREAAFRSSEPVQTLERLVETERRGEAVAPVDDMDWEDIFYLHDDNQWPSDPPAFKETMREYRAELKKLAERVMEAMDENLGLDKGRMKAAFTGDGLHAPFFGTKVSHYPPCPRXPDLITGTPGAHXDAGGVILLFQDDKVGGLEVLKDGEWXDVQPLPEAIVVNTGDQVEGLTKGRYRRGWHRVLPQGKRKRPPIAFFYNPALEGAFRRRWGKGPAARYPNYVFGXYMDVYTGRSRCQEPDRGRQVASS

SEQ ID NO: 3162 - protein, 292 aa, Oryza sativa (indica cultivar-group)
MTIYIAREASKVWRKVTTETSVELSLLREKWGLLLAGIVFQLVPRSYMVYAIVEDLGFMALPELGQDKGYLSESIFASIFASFVLASQVLRIITFYSTQLPGPNYHCREGSKLATLPPPNNVFEVLLINFPRGVLFGCGDLIFSSHMIFTLVFVRTYHKYGSKRFVKLLAWFMAIVQSLLIIASRKHYSVDVVVAWYTVNLVVFFVDNKLPGYIFVTFVALRLYRDLYGKHFVTSFVEIFTEMPDRTNGVPLLPLSTREKDGRLKEEKDSRLKEEFHKLLNGNHGDPTDRVL

SEQ ID NO: 3163 - protein, 571 aa, Oceanobacillus iheyensis HTE831
MVKQEKVWHSRYPKEIPITIDYVKRPLYDDLAESAKKYGQKKALHFMGKDISYQSLYDEAKKMANYLQSIGVRKGDKVAIMLPNTPQAVVSYYGILMAGAVVVQTNPLYTERELTYQVNDSEATVIICLDILLPRVNQVRSHTSLDHVIVTGIKDYLPFPKNLIYPFIQKKEYNMVVKVEESNDTHVWQKIMEHSVADYLESTIDPEEDIALLQYTGGTTGHPKGVMLSHYNLTSNVQMCETWLYKIVDSESNKQNVVLGVLPFFHVYGMTTVMNFSIKKGSKIILMPKFNATDILKAIDKQKPNLFPGAPTIYIGLLNHPDLEKYDLSSIEACISGSAPLPIEVQERFEKITGGKLVEGYGLTESSPVTHSNFVWEERINGSIGVPWPDTDAVIFKMDGELEPAEIGEVGEIAVKGPQIMKGYWKNEEETAKVLKEGWLMTGDMGYMDENGYFYVVDRKKDMIIASGYNIYPREVEEVLYEHPSVQEAVVAGVPDPYRGETVKAYVVLKDGAALTEEELNEYSRKHLAAFKVPRIYEFRDELPKTAVGKILRRKLIDEEKEKQTEEVSSV

SEQ ID NO: 3164 - protein, 683 aa, Streptococcus suis 89/1591
MALRQFQAFLDDVATIRLVMEKRFDSEHMSFSLESNDATSQLFIHSCLEVDNLVIYYLTSLHALTLDKDYTIYDQDRNKAELGYGHIVRSTLFEQSYTYNGQDLGATYRPEATTFKLWAPISKQVFLVLEGNPHAMTKGAKGVWEITVEGDLEAHSYHYLHKVNGEWISVHDPYALSSTANSGDSYVINPDKLHKIRRAKTQRPISQAIIYEMSVRDFSWQKEAGFKHRSQFLGLTESPTMDGMKLGMDYIRELGVTHIQLLPVYDFGSVDENKPQAVYNWGYDPMQYNLPEGSYSSQPNDPYARIIELQEAIQAYHDADISVIMDVVYNHVYHAEKYAFELIVPGYFYRYDDHGMRTDGTFCGNDVASERSMVRNYIKQSLRQWLELYGFDGFRFDLMGILDSETINQIQTELSAIHPNVYLYGEGWKMATGLEFEKLAHQYNAEHLPEISFFNDDYRDTFKKLLLNPNRLVDKQLHEKVQHLLTGSRLSHFLTPQQSLNYIECHDNATAFDYFHIENPNWTPQQQKRAASFGLQLILISQGMAFIHSGQEFFRTKDEIDNTYNVPDRINRLDWTRAIRYKEHIEFIQELITFRKNNPILSQDNYESIQETCDFYWLTEYVLRYQVTSEEKTIQFIINFADSDFTYEREKDKAVLYNYPPVENRDQQEITIAGQSICILEDK

SEQ ID NO: 3165 - protein, 506 aa, Shewanella oneidensis MR-1
MIYAQPGTAGALVNFKEKYANFIGGKWVAPVNGKYFDNRSPVNGQNFCKIPRSDAQDIELALDAAHAAKDAWGKTSVTERSNILLRIADRVEQNLEYLAVAETWENGKAVRETLNADLPLFVDHFRYFAGCIRAQEGSAADIDGNTVSYHFPEPLGVVGQIIPWNFPLLMAAWKIAPALAAGNCVVLKPAEQTPVSILVLLELIEDLLPPGVLNVVNGFGAEAGQALATSKRIAKLAFTGSTEVGFHILKCAAESLIPSTVELGGKSPNLYFADVMDQEDEYLDKAVEGMLLAFFNQGEVCTCPSRVLIQESIYDRFIEKVLARAQTIKQGNPLDTATQVGAQASQEQFDKILSYLAIGKDEGAQVLLGGSLCQLEGEQSKGYYISPTIMKGHNKMRIFQEEIFGPVISVTTFKDEAEALAIANDTEYGLGAGVWTRDMNRAQRMGRGIQAGRVWINCYHAYPAHAAFGGYKKSGIGRETHKMMLNHYQNTKNLLVSYDINPLGFF

SEQ ID NO: 3166 - protein, 308 aa, Solanum tuberosum
MAIISDFEEQDSKPTSSSAAAVSKPFKAVLDPANPLGFLQAVFEFVGRESDLFKSDSLINDVNAVVRMVKDKLVTEERKRKVEAEASNSKAAGKKVKEDVPVVAATAAAKKEEVKEAKGKEVMKEAKEEDKNGSQGPAAPNNNNGLDLENYSWGQSLQEVNVNIPVPAGTKSRFIVCDISRNRLKVGLKGQPPIIDGELYRPVKVDDCFWSLEDQKSISVLLTKKDQMEWWKCCVKGEPEIDTQKAEPESSKLSDLDPETRSTVEKMMFDQRQKSMGLPTSDESQKQEILKKFMAEHPEMDFSKAKIS

SEQ ID NO: 3167 - protein, 465 aa, Glycine max
  misc_feature (347)..(347): Xaa can be any naturally occurring amino acid
  misc_feature (367)..(367): Xaa can be any naturally occurring amino acid
  misc_feature (392)..(392): Xaa can be any naturally occurring amino acid
MGNSSSAVTKIQYHGQGCIIQPQNGSRKETGECFQSYLSLSIARFRGRGRKRKVSFMAATSSSFFSQDSTLLNVGAPQTFNHRKGSRLIVRANADYYSVLGVSRNASKSEIKSAISKLFTFDISAYRKLARNYHPDVNKEPGAEQKFKEISNAYEVLSDDEKRSIYDRFGEAGLKGSAMGMGDFSNPFDLFESLFEGMNRGAGSRGSWNGAIDGEDEYYSLVLNFKEAVFGIEKEIEISRLESCGTCNGSGAKPGTTPSRCSTCGGQGRVVSSTRTPLGIFQQSMTCSSCNGTGEISTPCNTCSGDGRVRKSKRISLKVPAGVDSGSRLRVRNEGNAGRKGGSPGGXSLVVIGGLFPDPILKRDDTXNILYTCKVSYIDAILGTTIKVPYLXKGTVDLKIPAGTQPNTTLVMAKKGVPFLNKDNMRGDQLVRVQVEIPKRLSNDERKLIEELADLSKGKTATGRR

SEQ ID NO: 3168 - protein, 622 aa, Oryza sativa
MPPSPPPLLLLLAVLLAAAPAAAQSATPREDDVRCLKEVKAELRDPDGRLSAWSFGNTSAGALCLLSGVSCWNPQESRIIGLSLSGFGLQGGIPSALQFCSAATTLDLSNNALVGVIPPALCDWIPFVVNLDLSGNQLSGQLPSELANCRFLNSLKLSGNSFSGQIPDSLGRLDRLKSLDLSDNRLDGQIPPQLATFGKDSFAGNKGLCGRPVSSRCGRALSGAGLGIVIAAGVFGAAASLLLAFFFWRCTGKSKGGRRRRRGGSESGGGSAEDGSWWAERLRAAHNRLAPVSLFQRPIVKVKLADLMAATQDFSTSHIVVAGSSRAGTAYRAVLRDGSALTVKRLHSCPLSEKAFRAEMGRVGQLRHPNIVPLLGFCVVEDERLLVYKHMESGALSSVMKEPGEAPLDWATRLRIAVGAARGLAWLHHGFQVPQIHQNLSSSAVLLDEDYEARFTDVGLTRLVRMAPGEGGDTSPFLNGDFGEYGYVAPECASNPVATMKGDVYAFGVILLELVSGQEAATVTGDAAGEGFKGTLVDWVNQLKASGRIGDAVHKSLRGNGHDSEIDEFVKIAFACIMVHPRERFSMYRVYHSLKSIGQGRDVSEQFDEFPLAYNKDESDTM

SEQ ID NO: 3169 - protein, 279 aa, Arabidopsis thaliana
  misc_feature (174)..(174): Xaa can be any naturally occurring amino acid
MQSSNVTDCTMRKRGTKRKIEIEKRMTKQQRSVACSKRRPTLFSKAADLCLLSGANIAVFVTSPDENSDVVYSFSGYSHASEIVDCYLNNKSPPKTTINPESAKFWWEEPDLYRDCDDLSELRIIEDRLMRTKKHLMDYLEKKEKSHSVSKSDQNPNNDSGSSSSSSQIASDFXESSSDQSRYLVNEDSGFVDGLLCETEEENNGMRLPQETQTQPMFTEEDQSFWENLDVDDVFGLFKDDNNLEVPLQDHSSTNEDDELLIDISEYLSEEAMECPCFS

SEQ ID NO: 3170 - protein, 287 aa, Triticum aestivum
  misc_feature (214)..(214): Xaa can be any naturally occurring amino acid
HYRTSLYKKAGWYRSGIPGISSTHASGEDWFHEDHIGLDFLAWQIPRDEEGEPLYEEFICHQCSPVCYFLKLYPDTIWASSKQSSASEAVTADSNGMEGGSSGHADTEKNENGAPVDRQSIENTSVEENCTKDIAASDKSILGDNSGVNCKIGVDINTTSADSEKTMPFFMSKGWRETLCKCGTCTNFYAQRGIAHLTDKEDSIEEYEKIAKPXDKREKKLEQQEGAEANFINSLNHVQKIEILSGINDMKNEFQSFMESFDPSKPVTSDDVKSIFENLARKKQRLS

SEQ ID NO: 3171 - protein, 428 aa, Yersinia pseudotuberculosis IP 32953
MVRFESTDSLMLARQLPNKTVALILAGGRGSRLKDLTATRAKPAVHFGGKFRIIDFALSNCLNSGVRRIGVITQYQSHTLVQHIQRGWSFLNEEMNEFVDLLPAQQRLSTEQWYKGTADAVCQNLDIIRRYDAEYIVILAGDHIYKMDYSRMLLDHVEKGAECTVACIPVPISEGSEFGIMEVTADYQITAFYEKPANPPPIPGDPSNALASMGIYIFNADYLFKLLEEDNNTPGSSHDFGKDIIPQLTARKVVWAHPFDLSCVTSNAELPPYWRDVGTLDAYWRANLDLASVTPELDMYDRAWPIRTHMEPLPPAKFVQDRSGSHGMTMNSLVSGGCIVSGSVVVHSVLFPRVRVNSFCTIDSSLLLPDVHVGRSCRLRRCIIDRACHIPEGMVIGENANEDSARFYRSEGGVVLVTRDMLAKLEAK

SEQ ID NO: 3172 - protein, 662 aa, Yersinia pseudotuberculosis IP 32953
MAVLTHGSPTPSGAYFDGKGINFTLFSAHAEQVTLCLFDEQGQERQIAMPARTGDIWHGYLPGGKPGQRYGYRVSGPFDPSRGHRFNPHKLLIDPRTRALEGKVGDDPRFTGGVSQPDVRDSAAALPKCLVIHEEYDWQGDKPPAIPWGNTVIYEAHVRGLTQLHPDIPPELRGTYAALAHPALIEHLKTLGITTLELLPVQFHIDEPRLQKMGLSNYWGYNVLAPFAVDPDYASGREGISPLRELRDAVKALHNAGIEVILDVVFNHSAELDVFGPTLCQRGIDNASYYWLTPDGEYDNITGCGNALRLSHPYVTQWVIDCLNYWRDSCHVDGFRFDLGTVLGRTPAFDQHAPLFAALAADERLSACKLIAEPWDIGLGGYQLGNFPTGFSEWNDQYRDAMRGFWLRGEVPRGTFAQHFAASSRLFEQRGRLPSASINQITAHDGFTLLDLLCFNQKHNQMNGEENRDGSDNNHSNNFGCEGLVADAAIWQRRKACQRALLTTLLLSQGTPMLLAGDEQGHSQQGNNNAYCQNNILTWLDWGSADRALMTFTADLIRLRQQIPALTQDQWWQSGDSNVQWLDSQGQALSDAAWEQGCQQQLQILLSQRWLVLINATDHECEMHLPEGEWEGIPPFGVSDHAERLTTWRGSAHTICVLIKRD

SEQ ID NO: 3173 - protein, 227 aa, Triticum aestivum
  misc_feature (160)..(160): Xaa can be any naturally occurring amino acid
MPAPAQAPSAAAAGGAAWRHLLLLLTALPLALALLAFALQWRGGGVDDAGSRWPARLAVPAPSRLQSLHSSAASCVEVLAASAAPAFPYLRGWSFHFDAPDTHHPKVCVQTSTSAGLDQILPWLFYHKVVGVAHFLLFLEGKAAQPSVAGVLKSIPGVRXVDQTQELEGQQGPHPTLGNKTWLITILFNKPCKIPNCFGQTIRSNKRNGSIRNAPQEIAPGPGIIES

SEQ ID NO: 3174 - protein, 429 aa, Zea mays
MATSLYTPSQLRPSHSQARRLGSHPRVCSARCPARRRRAAAISVRASTDGDAAVTVRRFPAAPTKAGGLSGVKKIMILGAGPIVIGQACEFDYSGTQACKALVEEGYEVVLVNSNPATIMTDPGLAHRTYIGPMTPTLVERIIDAERPDALLPTMGGQTALNLAVSLADSGALDRLGVRLIGASLPAIRAAEDRQLFKQAMDRIGLQTPPSGIGTTLEECLTIAEDIGEFPLIVRPAFTLGGTGGGIAYNRAEFEDICRAGLTASHTQQVLVEKSLLGWKEYELEVMRDMADNVVIICSIENIDPMGVHTGDSITVAPAQTLTDKEYQRLRDYSVAIIREIGVECGGSNVQFAVNPADGEVMVIEMNPRVSRSSALASKATGFPIAKMAAKLSVGYTLDQIPNDITKKTPASFEPSIDYVVTKRVGRLN

SEQ ID NO: 3175 - protein, 149 aa, Methanosarcina barkeri str. Fusaro
MEQTYVMVKPDGVQRGLVGEIISRIEKRGLKIVALRMNVISEATAKEHYSEHAAKPFFPGLVGFITSGPSVSMVVEGKDAIRVMRAINGATNPVDAAPGTVRGDFALDVGRNVVHASDSPEAAAREIAIHFKDSEIGNYSRIDEVCLYE

SEQ ID NO: 3176 - protein, 331 aa, Streptomyces hygroscopicus
MRSAGPSAPSNGSTPRPGSTGRSGSRRRCDRTGRPPRRTGSAPIRPLPSLAIPFVVFPFSGPRSFRPRSFGPHSSDRVLRTAPETRTGGPPYRPAPRECSMNTHPISHGGPLSGAGVAPITSVVFDLDGVLVNSFAVMREAFTLAYAEVVGDGEPPFEEYNRHLGRYFPDIMRIMGLPLEMEGPFVRESYRLAHLVEMFDGVPELLSELRHRGLRLAVATGKSGPRARSLLDTLGIRGQFHVVLGSDEVARPKPAPDIVLKAMDMMDADPDRTVMVGDAVTDLASARGAGITAVAAMWGETDEKTLLAAEPDVILHKPAELLSLCPEVTVP

SEQ ID NO: 3177 - protein, 544 aa, Arabidopsis thaliana
  misc_feature (173)..(173): Xaa can be any naturally occurring amino acid
MEISVASVTVSVAVVVVSWWVWRTLQRVWLKPKMLESYLRRQGLAGTPYTPLVGDLKRNFSMLAEARSKPINLTDDITPRIVPYPLQMLKTHGRTFFTWFGPIPTITIMDPEQIKEVFNKVYDFQKAHTFPLGRLIAAGLVSYDGDKWTKHRRIINPAFHLEKIKVYKLSFPXSQFSFMYVCPFGSEPICVLCFYVQNMVPAFHQSCSEIVGEWDKLVTDKQSSCEVDIWPWLVSMTADVISRTAFGSSYKEGQRIFELQAELAQLIIQAFRKAIIPGYRYFPTKGNRRMKAAAREIKFILRGIVNKRLRAREAGEAPSDDLLGILLESNLGQTKGNGMSTEELMEECKLFYFAGQETTTVLLVWTMVLLSQHQDWQARAREEVKQVFGDKEPDAEGLNQLKVMTMILYEVLRLYPPVVQLTRAIHKEMQLGDLTLPGGVQISLPILLIQRDRELWGNDAGEFKPDRFKDGLSKATKNQVSFFPFAWGPRICIGQNFALLEAKMAMTLILRKFSFELSPSYVHAPYTVLTTHPQFGAPLILHKL

SEQ ID NO: 3178 - protein, 375 aa, Triticum aestivum
  misc_feature (167)..(167): Xaa can be any naturally occurring amino acid
VGGQPQPEERKWPEASGSWLVGAGNCVDFAPLWPQGRGGGAMGESEYRCWEELLLDALGLVFRNLPLQEVLTVVPRVCKSWGRVVAGPYCWQEIDIEEWSQQRHSRPDHLVRMLDLLLRRSSGACRRICVSGLPCDPLFSFIGDHARALRTLEIPRSEISDAVVEAXEAVAPGLPNLTFLDISSCTKIGARALEAFGRHCRSLAALRRVMHPIDVAGRNACGQHDEARAIARTMPALRHLEVGYMLVTTEAILEVLSRCRGLEFVDLRGCWAVDEALLRERHPRLSVLGPGVDDCFENSYWEECSDDDDDDSDDDDDVYSWELMDDDEYYGVVGSDDDDEAVWGDGPGLVENLEVRFYGGGFSESYAGFDWPASP

SEQ ID NO: 3179 - protein, 811 aa, Oceanobacillus iheyensis HTE831
MLVSYNWLKNYVNLDAVTPEELAAKITKSGIEVEGVEYIAEKNENIVVGYVETCEKHPDADKLNVTQVSVGEETLQIVCGAPNIAKGQKVAVAKPGAVLPGNMKIKKVKLRGVESNGMICSLQELGLEEKYIPTDIAEGIFVFPEDEDIEVGSKVDEWLNLTDAVLDLDVLANRPDALSMLGVAYEVAAVLDQPIELPTKNIDYIDEKVSDQIEINIESKDLNPYYAAFMVKDVVIKPSPLWMRNYLMASGIRPINNIVDITNYVLLEYGQPLHAFDFDRFASNQIVIRRGVEGEVIQTLDEQERKLTEDNLVITNGSEPVALAGVMGGANSEVTDKTVNVLLEAAYFEATAVRHTVRQTGLRSESSTRFEKGIDPNRIVEAGLRACQLMQRYAGGKVLQGFAEENHLDTKSTKEVKVPLTQVNQRLGMELTEKDVQSVLNRLKFDFDQDGHTFIVHVPTRRRDITIFEDMLEEIIRIHGYDHLPYTIPQGWVKSGGLTDKQLLQRKIREFMMSSGAMETLTYSLTNEQNVKRLVTPNIDLENSYPISLAMPMSEDHKYLRLSIVPELLRILQHNIARKQTDLNYFEIGKVFISEEQELTHQPTEKLHLAGAFTGLWHNHPWQQDKKQVDFFVVKGIIEGLFNYLQLNISFKQVKMKDMHPGRCAELNIDGENIGFMGQLHPKTANVFDLPETYVFEIDLESVFEKYINVPSFTDIPRYPSVSRDIAFILDTEVFSGEVQQYIQEIGAPLVKEVSIFDVYQGEHLEDGKKSVAYRLMYQDPAKTLQDDEVESSYQQIVEAVNKKFGSYVRS

SEQ ID NO: 3180 - protein, 430 aa, Arabidopsis thaliana
MAAFLQTNISLNAIKIVPGKYSSLTDHQFRAPYRIRCAAASPGKKRYNIALLPGDGIGPEVISVAKNVLQKAGSLEGLEFDFKEMPVGGAALDLVGVPLPEETFTAAKLSDAILLGAIGGYKWDKNEKHLRPEMALFYLRRDLKVFANLRPATVLPQLVDASTLKKEVAEGVDMMIVRELTGGIYFGEPRGITINENGEEVGVSTEIYAAHEIDRIARVAFETARKRRGKLCSVDKANVLDASILWRKRVTALASEYPDVELSHMYVDNAAMQLIRDPKQFDTIVTNNIFGDILSDEASMITGSIGMLPSASLGESGPGLFEPIHGSAPDIAGQDKANPLATILSAAMLLKYGLGEEKAAKRIEDAVVDALNKGFRTGDIYSPGNKLVGCKEMGEEVLKSVESKVPLEKVCVALGFTVTYMLIHATLYLL

SEQ ID NO: 3181 - protein, 256 aa, Mycobacterium sp. MCS
MADGVPTDLRQALDGAARLPRLLIACDYDGTLAPIVSNPADARPLPASAAAVEELAALPATTVALISGRALGVLKELSGVSGRVHLVGSHGAEFDTGFLSPIDERAEALLVEIKQTLDEIAAEYAGVTTELKPASVALHVRNASTDDGEAAMHRANEAAARWDAQVTDGKAVKEFAVIQTDKGQAVDILRDQHDASAVLFLGDDVTDEKAFRRMRDGDIGVKVGPGDTAAAYRVDEPRDVAEVLEYLLAGRRRAHS

SEQ ID NO: 3182 - protein, 305 aa, Triticum aestivum
  misc_feature (234)..(234): Xaa can be any naturally occurring amino acid
NKFVQKSRLVPVRNSRDIVDPRVRLYGARVTSWKNNSGEQQLFLSKKASFKPPKAIRGGIQICFPQLGNHGVVEQHGFARNRLWSVDESPPLPDTTSDCHIDLILKQSEEDMKTWPHSYELRLQVALSPRGDLILTSRIKNKNADGKPFQFTFAYHTYFSVSDISEVRVEGLDTLDYHDNLQSKIRCTEQGDAVVFESEVDRIYLSAPPKIVTIDHEKKRTFVLRKKELPDVLXWNPWDRKAKAMPDFGAEEYKCMLCVGAARIEKPITLRPGEEWQGRQEISPVPSSYSSGLLDPEMIQQMQRI

SEQ ID NO: 3183 - protein, 291 aa, Fulvimarina pelagi HTCC2506
MQDKAFRGLTPILCSLWALWLAGCAGALNAVTSSAGYSVVEDVRYMPGARGTLDLYIPDGAQPDTPVVVFVHGGSWDTGSKDMYLFVGQSLASEGIIVAIPNYRLYPAVQFPGFVEDAARATVAVSSWAQRGENGLPAGRHPFFLMGHSAGAEIAGLLATDGRYLTDAGGSIGALDGFVGLSGPFDFLPLTEERYKRVFPEATRAASQPVNYIDGDEPPMLLIHGGADTVVDPKNTRSLAAKARAAGIPISDHIVPGVDHTGSIKAFATALELGDRSIRADVIEFVRQRSR

SEQ ID NO: 3184 - protein, 663 aa, Fulvimarina pelagi HTCC2506
MANAIRFLSADAVENAGSGHPGLPLGAADIATVLFTRFMRFDPTMPEWPNRDRFVFSAGHGSMLLYSLLHLLGYKDIGIEEIRSFRQLGSKAAGHPEYGHAAGIETTTGPLGQGIANAVGMAIAERHLAARFGDELVDHRTYVFVGDGCLMEGISQEAISLAGQLKLSKLTMLWDDNGITIDGAVSLADATDQLARFQASGWDTFSCDGHDQDEIAAALEAANASDKPSLVDCRTTIGFGASGKAGTAKAHGSPLGEDEIKQMRETLDWPHEPFEVPANITDQWRIAGLRSAAARRKWEERHAALDAEQRGEFDRLHRGDLPSGLQQRIERAKRNANEMRPAVATRKASEMALEVINEIVPETLGGSADLTGSNNTLTEGLGVLSAENHDGRYIHYGIREHAMAGIMNGLALHGGVIPYGGTFLAFSDYARGAIRLSALMGLRVVYVLTHDSIGLGEDGPTHQPVEHLAALRAIPNLAVMRPADIVETLECWHLALESEDRPTVLALSRQAVPALRTDEHDENKSSRGAYELVSAHGEAKVTLFATGTEVEIAVAAQKSLEQDGYPTRVVSVPCFELFEAQTETYRAAFLDDPSLKVAIEAGVRQGWDALIGRHGIFVGMNGFGASGKAGELYTHFGITADEVVRQVRERMDPNPKDSEETEE

SEQ ID NO: 3185 - protein, 310 aa, Desulfobacula toluolica
MKPGCYTALITPFNQAGELDQKGLEQLINFQIENGITGILATGTTGESPTFKWTEHDDVIAQVAKHAKDKCLTIAGTGSNNTAEALEAVGNAAKKGIDAVLLVDPYYNGPSSLEIRREYYEVIAKQFPDVNIIPYIIPGRTGAQMLPQDLAILAKNFSNVSCVKEATGNIENMQLTRKFCGNDFKIFSGDDALVYDVMTDPKIKACGGISVMSNIAPKFMTQMILQLNQADTNGAMKIQQALKPLLDLVVVTTQEDSEFGPVTCRAENPLPLKTLMQLLGMRQSLPQTLGKNDPQRLSNPFGCRKKRPGP

SEQ ID NO: 3186 - protein, 335 aa, Fulvimarina pelagi HTCC2506
MAVRVAINGFGRIGRNILRSIVESGRTDIEVVGINDLGPVETNAHLIRFDSVHGRFPGEVKVDGETIDVGRGPIRVTAERDPKNLPWGDLDVDVALECTGLFTARDKAAAHLDAGAKKVLISAPGTDADLTVVYGVNHDKLTAEHKVVSNASCTTNCLSPVAKVLHEAIGIEKGMMTTIHSYTGDQPTLDTMHKDLYRGRAAALSMIPTSTGAAKAVGLVLPELDGKLDGFAMRVPTPNVSVVDLKFVAKRSTSVDEIKNAIKAAADGPLKGILAYTNEKNVSIDFNHDPHSSIFHMDQTKVMDGTLVSVLSWYDNEWGFSNRMSDMAIALHNAG

SEQ ID NO: 3187 - protein, 458 aa, Pseudomonas putida
QQTIQTTLLIIGGGPGGYVAAIRAGQLGIPTVLVEGQALGGTCLNIGCIPSKALIHVAEQFHQASRFTEPSPLGISVASPRLDIGQSVAWKDGIVDRLTTGVAALLKKHGVKVVHGWAKVLDGKQVEVDGQRIQCEHLLLATGSSSVELPMLPLGGPVISSTEALAPKALPQHLVVVGGGYIGLELGIAYRKLGAQVSVVEARERILPTYDSELTAPVAESLKKLGIALHLGHSVEGYENGCLLANDGKGGQLRLEADRVLVAVGRRPRTKGFNLECLDLKMNGAAIAIDERCQTSMHNVWAIGDVAGEPMLAHRAMAQGEMVAEIIAGKARRFEPAAIAAVCFTDPEVVVVGKTPEQASQQGLDCIVAQFPFAANGRAMSLESKSGFVRVVARRDNHLILGWQAVGVAVSELSTAFAQSLEMGACLEDVAGTIHAHPTLGEAVQEAALRALGHALHI

SEQ ID NO: 3188 - protein, 267 aa, Salmonella enterica subsp. enterica serovar Typhi str. CT18
MAEPLTVSPELTANYAYFFDLDGTLAEIKPHPDQVVVPHKILQLLDRLAAHNAGALALISGRSMTELDALAKPFRFPLAGVHGAERRDISGKTHIVRLPEAVVREVEALLRSTLAALPGTELETKGMAFALHYRQAPEHEAALLALAQHVTQHWPQLALQPGKCVVEIKPKGTNKGEAIAAFMQEAPFTGRIPVFVGDDLTDEAGFGVVNHAGGISVKVGVGATQAAWRLESVPDVWRWLEQINYPQQEQQVMNNRRDGYESFSRSI

SEQ ID NO: 3189 - protein, 112 aa, Chlamydomonas reinhardtii
GGSVIVIDSKAAWDAQLAKGKEEHKPIVVAFTATWCGPCKMIAPLFETLSNDYAGKVIFLKVDVDAVAAVAEAAGITAMPTFHVYKDGVKADDLVGASQDKLKALVAKHAAA

SEQ ID NO: 3190 - protein, 185 aa, Salmonella enterica subsp. enterica serovar Typhi str. CT18
MKKVAVLLAPGFEEAEAIVTLDILRRLHIDVETLACAESRAVVSYHDIPMVADSTLSERQQALFDAVVLPGGPQGSANLAANPAVIAFVARHDAAGKLICPICSAAARVLGAHGLLKGRRYVCSGDLWKAVPEGVYVDAPVVEDGNLISGKGLGHVFDFALTLSARLLGDDALVREQAEHIYYPW

SEQ ID NO: 3191 - protein, 86 aa, Glycine max
MCPLRFILVFFSAVLAGYFAWKTVRSNPIEVFSEDSADEDKSSKKGDFDFKKMIQNGFWGFVDMASGRYLWRNLRSTNKDAELKSS

SEQ ID NO: 3192 - protein, 359 aa, Glycine max
  misc_feature (74)..(74): Xaa can be any naturally occurring amino acid
MSHFKGKYHDELIANAAYIGTPGKGILAADESTGTIGKRLASISVENVESNRRALRELLFTAPGALKYLSGVIXLFEETLYQSTAAGKPFVEVLKEAGVLPGIKVDKGTVELAGTNGETTTQGLDGLGQRCAKYYEAGARFAKWRAVLKIGPNEPSELAIHENAYGLARYAVICQENGLVPIVEPEILVDGSHDIHKCAAVTERVLAACYKALNDHHVLLEGTLLKPNMVTPGSNSAKVSPQVVAEHTVRALQRTVPAAVPAIVFLSGGQSEEEASVNLNAINQVNGKKPWSLSFSFGRALQQSTLKAWSGKEENVKKAQEALLVRAKANSEATLGTYKGNSKLADGASESLHVEDYKY

SEQ ID NO: 3193 - protein, 630 aa, Nicotiana tabacum
MAATFQRIFTAALLLLMCAAAPALSARRCADCGSSPVPYPLSTGPDCGDQSYKIRCTSTQLLFDTLNNSYPITSISPETQRLTIQPSPFLPNTCITQDISTIGVQLNSSLPFNITSSNTIVYLNCSETLLTSPLNCSSASLCHAYVNGSSSGNGGAVGACRSAPICCTFRAGGSSTSYMIRVRESGCRAYRSFVNLDSSLPVSRWPQPGLELQWVSPPEPVCTAQSDCDSDSTCTPDPNSNGGISRCFCHSGFHWDPIAALCAQDVTCEDSDGCGSDHTALIAGLTSGLGVAVIAVAIAVFVYRRHKRIKDAQDRLAREREDILSSGGVKNAKLFTGKEIRKATNNFSRDRLLGAGGYGEVYKGVLDDGTDVAVKCAKLGNTKGTDQVLNEVRILCQVNHKCLLRILGCCVELEQPLLVYEYVPNGTLSDHLQGPNRKLLTWDCRLSVAHATAEGLAYLHFSAVPPIYHRDVKSSNILLDERLNAKVSDFGLSRLAHADLSHVSTCAQGTLGYLDPEYYRNYQLTDKSDVYSFGVVLLELLTSQKAIDFDRAQDDVNLAVYVQRLVEEERIMDAVDPALKEGASSLQLETMKALGFLAVSCLEERRQNRPSMKEVAEEIEYIISIATAKA

SEQ ID NO: 3194 - protein, 516 aa, Chlorobium tepidum TLS
MATSLQSVIVLDFGSQYTQLIARRIREIGIYSEIFPYHTKAETIRAHQPKAIILSGGPNSVYDEKAFMPDPEVFSLGVPVLGICYGLQAIAKHFGGNVESSSKQEFGRAKMLVNHDESESLLFRDIPDSDVWMSHGDKVTQLPEGFRVTASTANAEVCAIESFGSKAALKVYGLQFHPEVQHSLYGKQLLSNFLIDIAGITPDWSPKSFIQHQIEEIKRVAGDSTVVCGISGGVDSTVAAVLVSKAIGDKLHCVFVDNGLLRKDEAVKVMEFLKPLGLNISLVDASDLFLGRLKGVASPEKKRKIIGRTFIQVFEKNIHDEKFLVQGTLYPDVIESVSVKGPSETIKSHHNVGGLPKRMKLKLIEPLRELFKDEVRAVGRELGIAEDILMRHPFPGPGLAVRVLGSLTRERLDVLRDADQIFIDELKSSGLYSKVWQAFSVLLPVQSVGVMGDKRTYENVLALRAVESTDGMTADWAHLPHDFLAKVSNRIINEVRGINRVVYDISSKPPATIEWE

SEQ ID NO: 3195 - protein, 357 aa, Oryza sativa
MAARSCRFLYSSSSSPIATTSPLLSPTPSAATRRKLLLSSTCGTIASAAAASAMEGQGAPAAPGGKGSAIVVVDSHLHVWASPQQAAERYPYFPGQEPPIRGDVDLLLQCMDEAGVDGALIVQPINHMFDHSLVTSVLKKYPSKFIGCCLANPADDGSGIKQLEHLIVQEKYRAVRFNPNLWPSGQKMTNEVGRSLFAKAGGLGAPVGIMVMKGISTYIQEIEELCTDYPKTTVIFDHMAFCKPPMNIEEEKAFTSFLELSRFPQIYVKYSALFRISREAYPYEDTSQLLSRVISSYGANRIMWGSDFPFVVPECGYKGAKEAISHVAGKIPVSSSDLEWILGKTVTQLFQGAWVSA

SEQ ID NO: 3196 - protein, 390 aa, Streptomyces coelicolor A3(2)
MSVNRTAAAATPVEVPRGLAGVVVADTEVGDVRGLEGFYHYRQYSAVELARSRGFEDVWHLLVHGELPDARTGAAFAAETAALRRLPDAVRAALPAIAEAGAGSGPLAGMRTGLSLLGAALGFRPVYDLSVDQRRQDTLVAAAAVPTLLTALHRLGRGLEPVEPREDLSYAANYLYMLTGQEPDEACTRAIEQYLISTIDHGFNASTFTARVIASTGADVAACLAGAVSALSGPLHGGAPSRALDTLDAIGTPDRIDAWIRERVLAGDRIMGFGHAVYRTEDPRSRMLREVAQSFGGPRVEFAVEVERQVEAILAELKPGRELHTNVEFYAGVVMELCGLPREMFTPTFAAARVVGWSANILEQASDSKIIRPAARYVGPGAPVGVPAVA

SEQ ID NO: 3197 - protein, 257 aa, Mycobacterium smegmatis str. MC2 155
MRTPTMTHRLTAEFVGTFWLVLGGCGSAVFAAKFVADDGVSLGIGFLGVALAFGLTVLTGVYAFGVISGGHFNPAVTLGAALAKRVEWGAVLPYWIVQVIGGLLAGLVIYVVAKGKEGWSAIGNMAANGYGEHSPGGYSLVAVLIAEIVLTGIFLLVILGSTDDRAPKGFAGLSIGLTLTLIHLISIPISNTSVNPARSTAVAFFNGDGAPAQLWAFWLAPLVGAAIAGVAYPYLFGVAEELAERPVRDDALDDRRG

SEQ ID NO: 3198 - protein, 477 aa, Listeria monocytogenes
MAKEYDVVILGGGTGGYVAAIQAAKNGQKVAVVEKGKVGGTCLHRGCIPTKALLRSAEVLQTVKKASEFGISVEGTAGINFLQAQERKQAIVDQLEKGIHQLFKQGKIDLFVGTGTILGPSIFSPTAGTISVEFEDGSENEMLIPKNLIIATGSKPRTLSGLTIDEEHVLSSDGALNLETLPKSIIIVGGGVIGMEWASMMHDFGVEVTVLEYADRILPTEDKEVAKELARLYKKKKLNMHTSAEVQAASYKKTDTGVEIKAIIKGEEQTFTADKILVSVGRSANTENIGLQNTDIATENGFIQVNDFYQTKESHIYAIGDCIPTIQLAHVAMEEGTIAANHIAGKAAEKLDYDLVPPLYLYFTSTEIASVGITEEQAKERGHEVKKGKFFFRGIGKALVYGESDGFIKIIADKKTDDILGVSMIGPHVTDMISEAALAQVLNATPWEVGNTIHPHPTLSESFREAALAVDGNAIHG

SEQ ID NO: 3199 - protein, 1146 aa, Populus tremula
MASQSQRQSNQPAHNQAQSSGTSNMRQHHHPTESVSKAIAQYTVDAQLHAVFEQSGGTGKSFDYSKSVRTPNQSVPEEQITAYLSKIQRGGHIQPFGCMIAADEQSFRLIAYSENAKDMLGLTPQSVPSLEKQEILFVGADVRILFRPSSAVLLEKAFGAREITLLNPIWIHSKNSGKPFYAILHRIDVGIVIDLEPARTEDPALSIAGAVQSQKLAVRAISQLQSLPGGDIKLLCDTVVDSVRELTGYDRVMVYKFHEDEHGEVVAENKRVDLEPYIGLHYPSTDIPQASRFLFKQNRVRMIVDCHAIPVSVIQDEGLMQPLCLVGSTLRAPHGCHAQYMENMGSIASLAMAVIIYGNDEEAIGGRNSMRLWGLVVCHHTSARCIPFPLRYACEFLMQAFGLQLNMELQLASQLLEKHVLRTQTLLCDMLLRDSPTGIVTQSPSIMDLVKCDGAALYYQGQYYPLGVTPTEAQIKDIVEWLLTLHGDPTGLSTDSLADAGYPGAAFLGDAVCGMAVAYIAERDFLFWFRSHTAKEVKWGGAKHHPEDKDDGQRMHPRSSFKAFLEVVKSRSLPWENAEMDAIHSLQLILRDSFRDAEATNSKAVVHTQLKDMELQGMDELSSVAREMVRLIETATAPIFAVDVEGRINGWNAKVAELTGLSVEEAMGKSLVHDLVYKEYEEIVDKLIHRAVKGEEDKNVEIKLRTFCSEHQKKAVFVVVNACSSKDYMDNIVGVCFVGQDVTGQKVVMDKYVLIQGDYKAIVHSPNPSIPPIFASDENTCCLEWNTALEKLTGWSRGEVVGKMLVGEVFGSCCRLKGPDALTKFMIALHNAIGGIDTDKLPFSFFDRNEKNVQTLLTANKRVNMKGDIIGAFCFLQIASPELQPSLKVQKQQEKKSFARMKELAYICQEIKNPLSGIHFTNSLLENTDLTEDQQQFLETSAACEKQILKIIRDIDLESIENGSLELEKAEFLLGSVINAVVSQAMLLLRERNLQLLRDIPEEIKTLAVYGDQARIQQVLADFLLNMVRYAPSSAGWVEIHVCPTLKQISDGHTLVHTEFRYLERVLQTRMLGLQHPLRSFLNCKLTLVMLHREGMVPKIQFQGLSVCQGRLIWLSFPENTTVALYPLTIWFLLLHRHQSRSITHT

SEQ ID NO: 3200 - protein, 326 aa, Listeria monocytogenes
MPVISYIDAITMALKEEMERDDKVFILGEDVGKKGGVFKATAGLYDEFGEDRVLDTPLAESAIAGVGIGAAMYGYRPVAEMQFADFIMPAVNQIISEAARIRYRSNNDWSCPMVIRAPFGGGVHGALYHSQSVEKVFLGQPGLKIVVPSSPYDAKGLLKAAIRDNDPLFFEHKRAYRLLRGEVPETDYIVPIGEANVVREGDDITVITYGLAVQFAQQAAERLAAEGVEAHILDLRTIYPLDQEAIIEATKKTGKVLLVTEDNKQGSIISEVAAIISEHCLFDLDAPIARLAGPDTPAMPFAPTMEKHFMINPDKVADAMKELAEF

SEQ ID NO: 3201 - protein, 416 aa, Listeria monocytogenes
MAVDKITMPKLGESVTEGTISSWLVKPGDTVEKYDAIAEVLTDKVTAEIPSSFSGTIKEILAEEDETLEVGEVICTIETEEAGSSEPVAEAEQTEPKTPEKQETKQVKLAEAPASGRFSPAVLRIAGENNIDLSTVEGTGKGGRITRKDLLQVIENGPVAPKREEVKSAPQEKEATPNPVRSAAGDREIPINGVRKAIAKHMSVSKQEIPHAWMMVEVDATGLVRYRNTVKDSFKKEEGYSLTYFAFFIKAVAQALKEFPQLNSTWAGDKIIEHANINISIAIAAGDLLYVPVIKNADEKSIKGIAREISELAGKARNGKLSQADMEGGTFTVNSTGSFGSVQSMGIINHPQAAILQVESIVKRPVIIDDMIAVRDMVNLCLSIDHRILDGLLAGKFLQAIKANVEKISKENTALY

SEQ ID NO: 3202 - protein, 1146 aa, Populus tremula
MASQSQRQSNQPAHNQAQSSGTSNMRQHHHPTESVSKAIAQYTVDAQLHAVFEQSGGTGKSFDYSKSVRTPNQSVPEEQITAYLSKIQRGGHIQPFGCMIAADEQSFRVIAYSENAKDMLGLTPQSVPSLEKQEILFVGADVRILFRPSSAVLLEKAFGAREITLLNPIWIHSKDSGKPFYAILHRIDVGIVIDLEPARTEDPALSIAGAVQSQKLAVRAISQLQSLPGGDIKLLCDTVVDSVRELTGYDRVMVYKFHEDEHGEVVAENKRVDLEPYIGLHYPSTDIPQASRFLFKQNRVRMIVDCHAIPVSVIQDEGLMQPLCLVGSTLRAPHGCHAHYMENMGSIASLAMAVIIYGNDEEAIGGRNSMRLWGLVVCHHTSARCIPFPLRYACEFLMQAFGLQLNMELQLASQLLEKHVLRTQTLLCDMLLRDSPAGIVTQSPSIMDLVKCDGAALYYQGQYYPLGVTPTEAQIKDIVEWLLTLHGDPTGLSTDSLADAGYPGAAFLGDAVCGMAVAYIAERDFLFWFRSHTAKEVKWGGAKHHPEDKDDGQRMHPRSSFKAFLEVVKSRSLPWENAEMDAIHSLQLILRDSFRDAEATNSKAVVHNQLKDMELQGMDELSSVAREMVRLIETATAPIFAVDVEGRINGWNAKVAELTGLSVEEAMGKSLVHDLVYKEYEEIVDKLIHRAVKGEEDKNVEIKLRTFCSEHQKKAVFVVVNACSSKDYMDNIVGVCFVGQDVTGQKVVMDKYVLIQGDYKAIVHSPNPSIPPIFASDENTCCLEWNTAMEKLTGWSRGEVVGKMLVGEVFGSCCRLKGPDALTKFMIALHNAIGGIDTDKLPFSFFDRNEKNVQTLLTANKRVNMKGDIIGAFCFLQIASPELQPSLKVQKQQEKKSFARMKELAYICQEIKNPLSGIHFTNSLLENTDLTEDQQQFLETSAACEKQILKIIRDIDLESIENGSLELEKAEFLLGSVINAVVSQAMLLLRERNLQLLRDIPEEIKTLAVYGDQARIQQVLADFLLNMVRYAPSSAGWVEIHVCPTLKQISDGHTLVHTEFRYLERVLQTRMLGLQHPLRSFLNCKLTLVMLHREGMVPKIQFQGLSVCQGRLIWLSFPENTTVALYPLTIWFLLLHRHQSRSITHT

SEQ ID NO: 3203 - protein, 205 aa, Triticum aestivum
  misc_feature (24)..(24): Xaa can be any naturally occurring amino acid
  misc_feature (32)..(32): Xaa can be any naturally occurring amino acid
  misc_feature (50)..(50): Xaa can be any naturally occurring amino acid
SVQPVVAVERTVFYRERAAGMYSXALPYAFGXQVVVELPYVLVQSLAYGXVIVYAMIGFQWDAKKFCWYLYFMYFTLLYFTYYGMLAVGLTPSYNIASIVSSFFYGVWNLFSGFVISQPTMPVWWRWYSWACPVSWTLYGLVASQFGDLTEPLQDTGEPINAFLKSFFGFRHDFLGVVAVVTAAFAIFFAVAFGLSIKVLNFQRR

SEQ ID NO: 3204 - protein, 485 aa, Mycobacterium sp. MCS
MRHYYSAEAIRDAEAPLLQRLPDGALMRRAALGLATAIARELTARTGGVAGRTVCAVVGSGDNGGDALWAATLLRRRGASATAVLLNPDRAHPKGLAAFRGVGGRVVEKVPTATDLVIDGVVGISGSGALRPAAAEVFAAVDDAGIPVVAVDIPSGLDVQTGAADGPHVHAALTVTFGGLKPVHALGECGRVELVDIGLDLPPSDVLGIEAADVRARWPRPGPKDDKYTQGVTGVLAGSSTYPGAAILCTGAAVAATSGMVRYAGSAAAEVVSHWPEVVAAPSAAAAGRVQSWVVGPGLGTDEAGAAALCFALDTDLPVIVDADGLTLLAAHPELVVDRGAPTVLTPHAGEFARLAGSPPGDDRVRAARKVADQFGATVLLKGNVTVVAEPGSAGRSVATGGRPGRAYLNPAGEAWAATAGSGDVLSGMIGALLAAGLPAGEAAAMAAFVHARAANASAADPGPRPAPTSASRILHHIRTALGSI

SEQ ID NO: 3205 - protein, 640 aa, Streptococcus suis 89/1591
CFDFHKEGNIVTKNIVIVGAGYAGIAAARLLGKTFKKDQDVTVTLIDKNSFHTYMTELHEVAAGRVEANAIKYDLQRIFKKYPKVQLVTDKVVEIDYDKKQVVAEHQTLDFDYLLLAMGGEANDFGVKGVKEHGFTLWSIEAAERLHDHMIDACYRAMREHDEAKRRALLTFTVIGAGFTGIEMIGELIDWVPILAREFKLDPKEFSLKVVEATPNILAMVTEKEQVKARKYLEKKGVELVLGDGVASVQEDSLTLSSGRQIPTYTSIWTAGVQANTDASEFGIEKARAGRLVANEFMEAKGKENVYVAGDLVYFEESEGKPTPQIVQAAEQTGHTAARNIISAIKGGEKHSYKGKYDGFMVSIGARYGVAFLMDKYHMSGFMAMAVKHMVNLLYFFTIRSFFYMGSYVRHEFFDIQNKRNIFGGHTSGKGNLLWSVPMRVLYGSVWLYEGIKKAFGLFGTTSWFGDQVVFPFPWLADPVSGASAAEAVSSASQAATAAAEAAEPIFGLSYAYGEAPMAVLDKMPDWFATIMEFMMPNQEVALFMQKFMTVAEIGIGLALIAGAFVWIVSAATVALVVMFSLSGMFYWVNIWFIPAAISLMNGAGRAFGLDYWIMPWLGRFLDKKIYGKPKHIYRIKYKK

SEQ ID NO: 3206 - protein, 203 aa, Hypocrea virens
SNVFAGSDTTAIALRSIFLNLLRHPHVLSKLIAELEERRAAGRLSNTVTFQEAEACPYLQAVMHEALRIFSPAGFSFDRDVPKEGMIISGKFVPGGTVVGSSPWVIHSLPEVWGADFDKFRPERWLEGENSSELKRFFFAFGGGTRTCIGKNISWLEMEKLVATLLMRYDFELVEDENISDSCRWVMLSEPSYSRNSTWNVSH

SEQ ID NO: 3207 - protein, 137 aa, Oryza sativa
MAAKSLILFGVLLASLLLVSQDVVAARELTEAHESERKNVKPEVEQNNWGGGYMHGGGYEHGGGYSQPRYGGGYGQPGYGGGYGQPGYGSGYGPGYGGGGSGPGYGGGYGSPGYGGGYGSPGYGGGSGGGGQHGGWH

SEQ ID NO: 3208 - protein, 303 aa, Zea mays
MSGMSLSHRLPPAAAAVDPYYVYAAHPDPQRQGVLTLFVAGLPDDVKPREIHNLFSHRPAFDHCLLEYTGRGNQAVAFVTFFTHEAALSAMSSLNGTIFDPESGDRLHIELAKSTSRRPRGGVEGYRVIDKRANKTEGNADHENVGDEDDDEVWGEDEDGGNDNNGDGGSDEPSGTENENPSDKNELPTDKSDQPGHKQQNGQSLSNEGRDKSSSDIPPCSTIFIANLGHTCTEDELKEVLSKEPGFHVLKMRRRGGMPVAFADFMDIESSTAAMNRLQGTVLASSDNDGLHIEYARSKMRKS

SEQ ID NO: 3209 - protein, 293 aa, Streptococcus suis 89/1591
MVHQIWNTYPEIERGLEEVKSIILSEMMVLHPAVTSKIVEYVEAPGKYLRAGLCLLFAQMTEGKISRSKLYFAAHLEVLHLATLIHDDVIDGADKRRGVTAAHQQFSNRIAIYTGDYLLAYSSRLFGKGLRLLEVSRDDLDLGNDKLMETILRGELSQLLNQFDANMTMKAYLKQIQGKTAFLFGLACQLGSFVPGQSRKDSSMAFRSGQALGMAFQLRDDLIDYQLDVAESGKPRLQDIQNGIYTAPLLFAMREDKSIQQQLRAYIQSPTAEGLESLQIGFLQRMLLPKQRN

SEQ ID NO: 3210 - protein, 148 aa, Fagus sylvatica
MADQLTDDQISEFKEAFSLFDKDGDGCITTKELGTVMRSLGQNPTEAELQDMINEVDRDGNGTIDFPEFLNLMARKMKDTDSEEELKEAFRVFDKDQNGFISAAELRHVMTNLGEKLTDEVDEMIREADVDGDGQINYEEFVKVMMAK

SEQ ID NO: 3211 - protein, 120 aa, Brassica napus
MLTFPLCGCELSSESKTLGFAASLISISQTRRQIVLGRRDSVKVSAAKSGNFSLGSIFKSCDTYGAKGAIECPGCKGTGRNKKNGNIFERWKCFDCQGFGMKSCPKCGKGGLTPEQRGER

SEQ ID NO: 3212 - protein, 235 aa, Triticum aestivum
MAMASSTRRLAFVLLVLAFSAALAESRDAYMRSANRYACILTQESFPLASRGAGLTSANGKLCVLCEQYSTEALVYLRQNETQTEILSALHHTCASLGPLRQQCITLVDYYIPAFFLEVSVVKPEELCESAHLCPKGAATRSSTRGDACGLCHHVLVEVLMMLKDPNTKLEIVGLLFKTCSKAKNYEPQCKRLVLDYIPLILVKTQEFLETTDVCFATHACKTGMQATIPLSAAL

SEQ ID NO: 3213 - protein, 254 aa, Solanum tuberosum
MTDYVQEQEMEIEALEAILMDEFKEIHSSESGLNTSNRCFQITISPQEEDEGIYTIIRFCYFHIRLALIFSHTEKYPDEPPLLNVSSLKGIHSGDLKILKEKLEQEAVENLGMAMIYTLVSSAKDWLSERFAQENDEGVEDDEAKKEEVIVPHGEAVTVETFLAWRERFEAELALERAKLMPDAALSVSKEKKLTGRQWFESGRASGKAAIATAEESDEDVDDIDFDDDDFEDDEEEDMLEHYLAEKTDSSSHS

SEQ ID NO: 3214 - protein, 218 aa, Polaromonas sp. JS666
MSLHHIANRTKKLPPLRVGIGGPVGSGKTTLLEMLCKAMKNKYDLVAITNDIYTKEDQRLLTVSGALAAERIMGVETGGCPHTAIREDASINLEAIDRMLVDFPDADVVFVESGGDNLAATFSPELSDLTIYVIDVAAGEKIPRKGGPGITKSDLFVINKTDLAPYVGADLGVMEADTIRMRTTPKGLKPFVMTNLKTNTGLAEVIAFIETKGMLQAG

SEQ ID NO: 3215 - protein, 566 aa, Ustilago maydis 521
MGAWTNFVDGFKPEVTDESASDSVPAYAEKDSKDFETNAVAGFKDPKDETGLKRRLTGRHVQFIALGGSIGTGLFIGSGGALATGGPGFLMIDFILIGIMLLMVVMALGELGAIFPVAGSFAAYSTRFIDPAVGFAMAYNYWLQWLIVLPLELVAASIVIVFWDPNETVPKGVWIAVFLIIITIINLFGVRGYGEFEFFGSLVKVLAVIGFIIAGVVINVGGGPDGKYYGTETWRNPGAFNNGFKGFSSVFVTAAFAFAGTELIGLAAAETANARKEIPKAAKQIFMRVTIFYVVSLLVVSFLVPYTNPALLGGSYDARASPFVIAVANARISVLPSILNAVILISVLSVGNSAVYAASRTLQAMSTIGQAPRYFSYIDRQGRPLPAVILSLIFGLLGFLIYAGDDARGLVFSWLLAISGLSTIISWLCICISHARFRQAWTRAGHTLEELPWKSPFGIWGSLYGAFFNVLVIIVTFYVSAFPIGEGEMSATERANAFFQSFLSVPVVVFVFYLPYKFFMRSKYVDIDDIDISTGRRDPVPVEVLRREREEAAALPMYKKVWHFLF

SEQ ID NO: 3216 - protein, 179 aa, Nymphaea alba
MFPMVTGFMNYGQQTVRAARYIGQSFMITLSHANRLPVTIQYPYEKSITSERFRGRIHFEFDKCIACEVCVRVCPIDLPVVDWRLETDIRKKRLLNYSIDFGICIFCGNCVEYCPTNCLSMTEEYELSTYDRHELNYNQIALGRLPMSVIGDYTVRTIMNSTQIKISMDKPLDSRTITN

SEQ ID NO: 3217 - protein, 554 aa, Vibrio sp. Ex25
MCSVFGILDIKSDAAALRPIALEMSKKLRHRGPDWSGIYSSERAILAHERLAIVGLNSGAQPLYSPDKKLILAVNGEIYNHKEIRARYEGKYEFQTDSDCEVILALYQDMGADLLEELNGIFAFVLYDEEKDEYLVGRDHIGIIPLYQGHDEHGNYYVASEMKALVPVCKTVSEFPPGSYYSSKDAEPTRYYVRDWNEYAAVQGNTTSKEELTEALEAAVKRQLMTDVPYGVLLSGGLDSSITSAVAKRFAAMRIEDDEKSEAWWPQLHSFAVGLEGAPDLKAAREVADQIGTVHHEMTYTIQEGLDAIRDVIYHIETYDVTTIRASTPMFLMGRKIKAMGIKMVLSGEGADEIFGGYLYFHKAPNAKEFHEETVRKLLALNMFDCARANKSLAAWGVEGRVPFLDKEFIDVAMRLNPADKMCGNGKMEKHILRECFEHYLPESIAWRQKEQFSDGVGYSWIDTLKEVAEQKVTDQQMETAQYRFPYNTPTTKEGYVYREIFEELFPLPSAAECVPGGPSVACSSAKAIEWDESFQNCVDPSGRAVQTVHNDAY

SEQ ID NO: 3218 - protein, 413 aa, Neorickettsia sennetsu str. Miyayama
MQQIQKVKAREIFNSRGWPTIEVEVTTSCGRVGCAIAPSGASKGVLEACELLDGDKARLSGRGVLRAVENVHTIIAPALMGKSVAAQAEIDSLLIQLDGTTNKSVLGANAIVAVSLAVAKANASVRGVPLCIVFHNLLTSEGDDFVYVPPVPMLNVINGGVHADNRLAIQEFMICPVGRRSFRESMEKAADVFHRLKGLLKQYGKSTNVGDEGGFAPDLSSTEETLGLLSEAIGDSKESVKIALDAASSTFYKDGKYSIDGKLLNVNEMVDFYAAIIEKYDIVSIEDPLYESDWESWQVMTRKLSDKIHIVGDDIFVTNPKIIKKGIKTGVANAVLVKINQVGTVTETIESIKLARKAGYKVVISHRSGETEDLSIAHLAVACGGAFLKAGSLSRSERVAKYNEVLRLEEVFV

SEQ ID NO: 3219 - protein, 557 aa, Gluconobacter oxydans 621H
MSIPVGHYQYDRIDRDFLQARIAEFEGQVQRRLDGTLSEDEFKPLRLMNGLYLQLHAYMLRVAIPYGILDSRQLRKLGEIARRYDRDYGHFTTRQNIQFNWIRLEDTPAILRELAEVDMHAIQTSGNCIRNVTADEYAGAAADELVDPRVHAEILRQWSTLHPEFTFLPRKFKIAISGSPNDRVAARFHDIGILARPGEDGAPVFRIFVGGGLGRTPVIGEELFDSVREEHLLATLEAILRVYNAHGRRDNIYKARIKILVQAIGVEAYREAVEAELAQMDLERYRLTPEAVAAIRSRFAVPLLEAPADADAVLAQQRREDPLFDRWVRSNTHVHRDPGHIIATISLKPAGGIPGDATSAQIARLADLADAYSFGEIRITHLQNVVLGHVRKDRLRDLWLGLSEVGLAEANIGLIGDIVACPGLDYCALANARSIPIAQKLGARFADTALQAEIGALRINISGCINACGHHHAGHIGLLGVDKRGEEFFQLTVGGRAENGAAIGTILGAALPEDETVDAIARLVDCYLGRRESGETFLDTLTRLGHEPFREAAYETV

SEQ ID NO: 3220 - protein, 274 aa, Anabaena variabilis ATCC 29413
MDASELLETITLLIEQAEQGEIDPWDVKVIEVIDRYLELMTPKTTARGYESDLSQSGQAFLSASMLVLFKANTLMQLSTAEDLEDIEDSLLAENGDSLFHQTHRLPLERVLRRRPAAMPPPKRRVTLQELIAQLQIMANQLKLVQKVSKPERPKRQPTVKAMREALELAHQENLTEVAGELEQVLHFSAQELLLEQNYLNLEQLVQLWTQTKQSHQLSAHESVNSDLVSVFWALLLLSAQSKVELVQEEFYQEVRIRLLSDSVNTYQSLEQPIN

SEQ ID NO: 3221 - protein, 1197 aa, Polaromonas sp. JS666
MAQNLHAKQVTTSPPTPPMDAPVMPSPLPARPDAPPASPDARARPEVAVQRIIKVRRDYNSWVASETMEDYALRFTPQRFRKWSEFRVANTAFGAASFLILEAVGATLLVKYGFTNAFWAIVATGLIIFLAGLPISIYAARYGVDMDLLTRGAGFGYIGSTLTSLIYASFTFIFFALEAAVMAYALDLALGIPPSWGYLICALVVIPLVTHGVSAISRLQVWTQPLWIVMLVVPFIYVLLRNPGAFSGVLHYGGERGVGGEFNLHLFGAALTVGIALITQMGEQADYLRFMPVQTRANRWRWWGGVLVGGPGWVVLGVVKMLGGALLAYLAITNMVPPDRAVDPNQMYLAAYEYVFPDYGLAVAATALFVVISQLKINVTNAYAGSLAWSNFFSRLTHSHPGRVVWVVFNTLIAFMLMEMNVFQALGDVLGLYSNIAIAWVMAVVADLVINKPLGLSPRGIEFKRAHLYDINPVGVGAMALASLLSVAAYLGLYGELARAFSAVIAMGTAFVTAPLIAWATRGRYYIARSSGTSEADASYQRYATQQCVICERAYEGPDMAHCPAYQGPICSLCCTLDARCGDLCKPQASLSAQWSAALRWLLPHRIWPYLDTGLGHFLLLMLIIVPLLASVFGLLYHQEMGALGDFMLSGSALRSGFLKAYMALLVIAGLVAWWLVLAHKSRQVAQEESNRQTHLLMREIELHRQTDEALQLAKLHAEHARHAADQANQAKSRYISAISHELRTPLNSILGYAQLMGEDAAIPPHRKQAVSVIRRGGEHLLSLIEGTLDIARIEAGKLTLTVKPMQFADCVHEMAGMFELQAAAKGLGFRFETAGNLPELVRADEKRVRQILINLLGNAIKFTAQGQVIFRLRHAREMAYIDIEDTGPGMSEAELAQIFEPFARGAAAGHSAEGTPGAGLGLTIAKMLTDLMGGEMTVLSTPGQGSVFRVRLFLPEVHVTAGAGKSTLAAPARRQPRGYEGVRRKLLVVDNEEPDRELLVQLLEPMGFDLRTAASGHDCLDLLAAGYQPDVIFMDLAMPGIDGWETLRRVRSAGHTGTHLAIVSANAFDKGLDNDVGIPPEDFILKPVRHTELIDWLERRLGLRWCYEAQADAGQLPAPAAPPPRVLPDAPQLAALLEVVTLGFYRGIMNKLAEIETQQPATAAFVEDMRALARQFQFEAMGRQLTNQEAAHEQRA

SEQ ID NO: 3222 - protein, 389 aa, Anabaena variabilis ATCC 29413
MKAMILAAGKGTRVRPITYTIPKPMIPILQKPVMEFLLELLRQHGFDQIMVNVSHLAEEIENYFRDGQRFGVQIAYSFEGKIDDEGKLVGEAIGSAGGMRRIQDFSPFFDDTFVVLCGDALIDLDLTAAVKWHKSKGSIATIITKTVPEEEVSSYGVVVTDENSRVKAFQEKPSIEEALSTNINTGIYIFEPEVFNYIPSGVEYDIGGQLFPKLVEIGAPFYAIAMDFEWVDIGKVPDYWRAIRGVLQGEIKNVQIPGHEVAPGIYTGLNVAVNWDKVDITGPVYIGGMTRIEDGAKIVGPAMIGPNCWICGEATVDNSVIFEWSRLGHGARLVDKLVFGRYCVDKTGAAIDVQAAALDWLITDARQTPPEHTPVERQAIAELLGTNAI

SEQ ID NO: 3223 - protein, 261 aa, Zea mays
MASAELSREENVYMAKLAEQAERYEEMVEFMEKVAKTVDSEELTVEERNLLSVAYKNVIGARRASWRIISSIEQKEEGRGNEDRVTLIKDYRGKIETELTKICDGILKLLETHLVPSSTAPESKVFYLKMKGDYYRYLAEFKTGAERKDAAENTMVAYKAAQDIALAELAPTHPIRLGLALNFSVFYYEILNSPDRACSLAKQAFDEAISELDTLSEESYKDSTLIMQLLRDNLTLWTSDISEDPAEEIREAPKRDSSEGQ

SEQ ID NO: 3224 - protein, 1144 aa, Populus tremula
MASQSQRQSNQPAHNQAQSSGTSNMRQHHHPTESVSKAIAQYTVDAQLHAVFEQSGGTGKSFDYSKSVRTPNQSVPEEQITAYLSKIQRGGHIQPFGCMIAANEQSFRVIAYSENAKDMLGLTPQSVPSLEKQEILFVGADVRILFRPSSAVLLEKAFGAREITLLNPIWIHSKNSGKPFYAILHRIDVGIVIDLEPARTEDPALSIAGAVQSQKLAVRAISQLQSLPGGDIKLLCDTVVDSVRELTGYDRVMVYKFHEDEHGEVVAENKRVDLEPYIGLHYPSTDIPQASRFLFKQNRVRMIVDCHAIPVSVIQDEGLMQPLCLVGSTLRAPHGCHAQYMENMGSIASLAMAVIIYGNDEEAIGGRNSMRLWGLVVCHHTSARCIPFPLRYACEFLMQAFGLQLNMELQLASQLLEKHVLRTQTLLCDMLLRDSPTGIVTQSPSIMDLVKCDGAALYYQGQYYPLGVTPTEAQIKDIVEWLLTLHGDPTGLSTDSLADAGYPGAAFLGDAVCGMAVAYIAERDFLFWFRSHTAKEVKWGGAKHHPEDKDDGQRMHPRSSFKAFLEVVKSRSLPWENAEMDAIHSLQLILRDSFRDAEATNSKAVVHTQLKDMELQGMDELSSVAREMVRLIETATAPIFAVDVDGRINGWNAKVAELTGLSVEEAMGKSLVHDLVYKEYEEIVDKLIHRAVKGEEDKNVEIKLRTFCSEHQKKAVFVVVNACSSKDYMDNIVGVCFVGQDVTGQKVVMDKYVLIQGDYKAIVHSPNPSIPPIFASDENTCCLEWNTAMEKLTGWSRGEVVGKMLVGEVFGSCCRLKGPDALTKFMIALHNAIGGIDTDKLPFSFFDRNEKNVQTLLTANKRVNMNIIGAFCFLQIASPELQPSLKVQKQQEKKSFARMKELAYICQEIKNPLSGIHFTNSLLENTDLTEDQQQFLETSAACEKQILKIIRDIDLESIENGSLELEKAEFLLGSVINAVVSQAMLLLRERNLQLLRDIPEEIKTLAVYGDQARIQQVLADFLLNMVRYAPSSAGWVEIHVCPTLKQISDGHTLVHTEFRYLERVLQTRMLGLQHPLRSFLNCKLTLVMLHREGMVPKIQFQGLSVCQGRLIWLSFPENTTVALYPLTIWFLLLHRHQSRSITHT

SEQ ID NO: 3225 - protein, 446 aa, Synechococcus sp. RS9916
MATHDIFMPALSSTMTEGKIVEWLKKPGEKVGRGESVLVVESDKADMDVESFNEGYLAAVLMPAGSTAPVGETIGLIVETEAEIAEAQAKAGSGGGAASAPAAAAPAAPAPAPAAAPAPAAPAPVAPPAPAVAAAPAAPAPVVNSGRLVASPRAKKLASQMGVNLASVRGSGPNGRIQAEDVERAAGRPVSVPRVGEGTPAAVVAGAGAAAPSAPAGNSFGAPGDTVAFNTLQAAVNRNMEASLAVPCFRVGYTITTDKLDAFYKQVKPKGVTMTALLAKAVAVTLARHPQVNAATTAAGMAYPADVNVAVAVAMEDGGLITPVLRQADRTDLYEMSRQWADLVKRSRSKQLQPEEYSTGTFTLSNLGMFGVDRFDAILPPGTGAILAVAASRPTVVAGKDGSISVKRQMQVNLTADHRVIYGADGAAFLKDLAELIETRPESLAI

SEQ ID NO: 3226 - protein, 136 aa, Methanosarcina barkeri str. Fusaro
MVLKNIKYAIRNITRPPVTRMYPEKQSELSDRFRGLQILDKSKCIGCGICANTCPNAAIKIVKAPIAPGSTKQRWFPQIDIGHCLFCGLCIDQCPKGALSSGKEYAKGLVKWKHKDLLITPEKLAREVDLEEGDEK

SEQ ID NO: 3227 - protein, 1144 aa, Populus tremula
MASQSQRQSNQPAHNQAQSSGTSNMRQHHHPTESVSKAIAQYTVDAQLHAVFEQSGGTGKSFDYSKSVRTPNQSVPEEQITAYLSKIQRGGHIQPFGCMIAADEQSFRVIAYSENAKDMLGLTPQSVPSLEKQEILFVGADVRILFRPSSAVLLEKAFGAREITLLNPIWIHSKNSGKPFYAILHRIDVGIVIDLEPARTEDPALSITGAVQSQKLAVRAISQLQSLPGGDIKLLCDTVVDSVRELTGYDRVMVYKFHEDEHGEVVAENKRVDLEPYIGLHYPSTDIPQASRFLFKQNRVRMIVDCHAIPVSVIQDEGLMQPLCLVGSTLRAPHGCHAQYMENMGSIASLAMAVIIYGNDEEAIGGRNSMRLWGLVVCHHTSARCIPFPLRYACEFLMQAFGLQLNMELQLASQLLEKHVLRTQTLLCDMLLRDSPTGIVTQSPSIMDLVKCDGAALYYQGQYYPLGVTPTEAQIKDIVEWLLTLHGDPTGLSTDSLADAGYPGAAFLGDAVCGMAVAYIAERDFLFWFRSHTAKEVKWGGAKHHPEDKDDGQRMHPRSSFKAFLEVVKSRSLPWENAEMDAIHSLQLILRDSFRDAEATNSKAVVHNQLKDMELQGMDELSSVAREMVRLIETATAPIFAVDVDGRINGWNAKVAELTGLSVEEAVGKSLVHDLVYKEYEEIVDKLIHRAVKGEEDKNVEIKLRTFCSEHQKKAVFVVVNACSSKDYMDNIVGVCFVGQDVTGQKVVMDKYVLIQGDYKAIVHSPNPSIPPIFASDENTCCLEWNTAMEKLTGWSRGEVVGKMLVGEVFGSCCRLKGPDALTKFMIALHNAIGGIDTDKLPFSFFDRNEKNVQTLLTANKRVNINIIGAFCFLQIASPELQPSLKVQKQQEKKSFARMKELAYICQEIKNPLSGIHFTNSLLENTDLTEDQQQFLETSAACEKQILKIIRDIDLESIENGSLELEKAEFLLGSVINAVVSQAMLLLRERNLQLLRDIPEEIKTLAVYGDQARIQQVLADFLLNMVRYAPSSAGWVEIHVCPTLKQISDGHTLVHTEFRYLERVLQTRMLGLQHPLRSFLNCKLTLVMLHREGMVPKIQFQGLSVCQGRLIWLSFPENTTVALYPLTIWFLLLHRHQSRSITHT

SEQ ID NO: 3228 - protein, 374 aa, Methanosarcina barkeri str. Fusaro
MEEKLEPNEMIVHLGPQHPMQPGPFRLNLRLKGETVVDADIELGFIHKGIEKILENKTYLQGITIVDRICYLVALVNEECFVGCTEKLLGIEPPERSQYIRVILDELTRIQSHLLGMGEFGEFIGFVSMFMYTIREREEVLSLIDMITGARITHSYLKFGGVRDDLPDGFKEKALSVLNNLKKSVDDFEEMFHTDRIYRERTVGVGVLTADVAKNLGVSGPPLRATGVPFDIRKNEPYLVYKDLDFKVCTETAGDCFARVQVRINEIRESIYILEQCFDQIPSGPLFPEGSLYGRRTPVMRVPAGEVFYRVEDPRGEMGMYMISDGSDKPYRVKIRGPYYPTLQALPPLIIGTTVADVAAISGSMDGCTSEADR

SEQ ID NO: 3229 - protein, 261 aa, Brassica napus
  misc_feature (219)..(219): Xaa can be any naturally occurring amino acid
  misc_feature (251)..(251): Xaa can be any naturally occurring amino acid
MGASRKLQGEIDRVLKKVQEGVDVFDSIWNKVYDTDNVNQKEKFEADLKKEIKKLQRYRDQIKTWIQSSEIKDKKVSASYEQSLVDARKLIEREMERFKICEKETKTKAFSKEGLGQQPKTDPKEKAKSETRDWLNNVVSELESQIDSFEAELEGLSVKKGKSRPPRLTHLETSITRHKDHIIKLELILRLLDNDELSPEQVNDVKDFLDDYVERNQDXFDEFSDVDELYSTLPLDEVEVLRSSYCCPLVXGTPLSMKSLC

SEQ ID NO: 3230 - protein, 1144 aa, Populus tremula
MASQSQRQSNQPAHNQVQSSGTSNMRQHHHPTESVSKAIAQYTVDAQLHAVFEQSGGTGKSFDYSKSVRTPNQSVPEEQITAYLSKIQRGGHIQPFGCMIAADEQSFRVIAYSENAKDMLGLTPQSVPSLEKQEILFVGADVRILFRPSSAVLLEKAFGAREITLLNPIWIHSKNSGKPFYAILHRIDVGIVIDLEPARTEDPALSIAGAVQSQKLAVRAISQLQSLPGGDIKLLCDTVVDSVRELTGYDRVMVYKFHEDEHGEVVAENKRVDLEPYIGLHYPSTDIPQASRFLFKQNRVRMIVDCHAIPVSVIQDEGLMQPLCLVGSTLRAPHGCHAQYMENMGSIASLAMAVIIYGNDEEAIGGRNSMRLWGLVVCHHTSARCIPFPLRYACEFLMQAFGLQLNMELQLASQLLEKHVLRTQTLLCDMLLRDSPTGIVTQSPSIMDLVKCDGAALYYQGQYYPLGVTPTEAQIKDIVEWLLTLHGDPTGLSTDSLADAGYPGAAFLGDAVCGMAVAYIAERDFLFWFRSHTAKEVKWGGAKHHPEDKDDGQRMHPRSSFKAFLEVVKSRSLPWENAEMDAIHSLQLILRDSFRDAEATNSKAVVHTQLKDMELQGMDELSSVAREMVRLIETATAPIFAVDVEGRINGWNAKVAELTGLSVEEAMGKSLVHDLVYKEYEEIVDKLIHRAVKGEEDKNVEIKLRTFCSEHQKKAVFVVVNACSSKDYMDNIVGVCFVGQDVTGQKVVMDKYVLIQGDYKAIVHSPNPSIPPIFASDENTCCLEWNTAMEKLTGWSRGEVVGKMLVGEVFGSCCRLKGPDALTKFMIALHNAIGGIDTDKLPFSFFDRNEKNVQTLLTANKRVNINIIGAFCFLQIASPELQPSLKVQKQQEKKSFARMKELAYICQEIKNPLSGIHFTNSLLENTDLTEDQQQFLETSAACEKQILKIIRDIDLESIENGSLELEKAEFLLGSVINAVVSQAMLLLRERNLQLLRDIPEEIKTLAVYGDQARIQQVLADFLLNMVRYAPSSAGWVEIHVCPTLKQISDGHTLVHTEFRYLERVLQTRMLGLQHPLRSFLNCKLTLVMLHREGMVPKIQFQGLSVCQGRLIWLSFPENTTVALYPLTIWFLLLHRHQSRSITHT

SEQ ID NO: 3231 - protein, 640 aa, Oryza sativa (japonica cultivar-group)
MDELNLLRQHQHQHQHHLVVRGLGEEIDLEIGPGDDPSFPGAALVGVTPGAHDPADDHKSLLIPCSQPVAEGQPQPTPPQVEEHDGLLRLPGQTKKKKKVVKKWREEWADTYKWAYVAVHDNTSRIFCTVCKEYGRKHRRNPYGNEGSRNMQMSALEEHNNSLLHKEALRLQTASKENAQPPEIERPVYVKALSKTAASILESILKKDPHEAEFIQSIQEVVHSLEPVLVKNSQHVQILERLLEPERCFIFRVPWVDDRGEAHVNRGFRVQFSQALGPCRGGLRFHPSMTLSVAKFLAFEQTLKNALSQYKLGGAAGGSDFDPKGKSESEIMRFCQSFMDELYRYLGPDQDFPAEDVGVGPREMGYLFGQYRRLSGHFQGNFTGPKIFWSGSSFRTEATGYGLVFFARVVLADMNKELKGLRCVISGSGKIAMHVLEKLLSCEAIPVTVSDSKGYLLDTEGFDYMKYSVLRNIKAQQRSLKEYLKSYPNAKYIDDAKPWSEKCDVAFPCASQNEIDQAEALAIINSGCRVLIECSNMPCTAQAVDILRTAKVVVAPAKATAAGGVAVGELELNPEFSLMQWSVEDFENKIQDAVKQTYDRSIKAAQDYGIMKENPESLVHGANICAFLNIAQAMTDQGCV

SEQ ID NO: 3232 - protein, 357 aa, Prochlorococcus marinus str. MIT 9515
MKKYKVVLLSGDGIGPEISEISSEILKKLSHKYSFDIEIKEEYFGGIAYEKYKDPAPKATLDQCKSSDAVLLACVGDLKYDSLPRELRPESGLLKLRSALNLFANIRPVKIRKSLLDASSLKKEIIEDVDLVVVRELISGIYFGQPRGQITNTKVKKAFNTMVYDTKEIERITEVAIKIANQRSKKICSVDKSNVLEVSQLWRDTVLDVASKNKDLSLSNMYVDNAAMQLVKDPSQFDVILTSNLFGDILSDLAAMITGSIGMLPSASLSNSGPGVFEPVHGSAPDIAGKNLANPIAMALSTSMMLKIGLNEEKAADDIEIAIDNVLSKGYRTSDLDNGDCNVLSCSEIGEKIIQEI

SEQ ID NO: 3233 - protein, 1144 aa, Populus tremula
MASQSQRQSNQPAHNQAQSSGTSNMRQHHHPTESVSKAIAQYTVDAQLHAVFEQSGGTGKSFDYSKSVRTPNQSVPEEQITAYLSKIQRGGHIQPFGCMIAADEQSFRVIAYSENAKDMLGLTPQSVPSLEKQEILFVGADVRILFRPSSAVLLEKAFGAREITLLNPIWIHSKNSGKPFYAILHRIDVGIVIDLEPARTEDPALSIAGAVQSQKLAVRAISQLQSLPGGDIKLLCDTVVDSVRELTGYDRVMVYKFHEDEHGEVVAENKRVDLEPYIGLHYPSTDIPQASRFLFKQNRVRMIVDCHAIPVSVIQDEGLMQPLCLVGSTLRAPHGCHAQYMENMGSIASLAMAVIIYGNDEEAIGGRNSMRLWGLVVCHHTSARCIPFPLRYACEFLMQAFGLQLNMELQLASQLLEKHVLRTQTLLCDMLLRDSPTGIVTQSPSIMDLVKCDGAALYYQGQYYPLGVTPTEAQIKDIVEWLLTLHGDPTGLSTDSLADAGYPGAAFLGDAVCGMAVAYIAERDFLFWFRSHTAKEVKWGGAKHHPEDKDDGQRMHPRSSFKAFLEVVKSRSLPWENAEMDAIHSLQLILRDSFRDAEATNSKAVVHTQLKDMELQGMDELSSVAREMVRLIETATAPIFAVDVEGRINGWNAKVAELTGLSVEEAMGKSLVHDLVYKEYEEIVDKLIHRAVKGEEDKNVEIKLRTFCSEHQKKAVFVVVNACSSKDYMDNIVGVCFVGQDVTGQKVVMDKYVLIQGDYKAIVHSPNPSIPPIFASDENTCCLEWNTAMEKLTGWSRGEVVGKMLVGEVFGSCCRLKGPDALTKFMIALHNAIGGIDTDKLPFSFFDRNEKNVQTLLTANKRVNINIIGAFCFLQIASPELQPSLKVQKQQEKKSFARMKELAYICQEIKNPLSGIHFTNSLLENTDLTEDQQQFLETSAACEKQILKIIRDIDLESIENGSLELEKAEFLLGSVINAVVSQAMLLLRERNLQLLRDIPEEIKTLAVYGDQARIQQVLADFLLNMVRYAPSSAGWVEIHVCPTLKQISDGHTLVHTEFRYLERVLQTRMLGLQHPPRSFLNCKLTLVMLHREGMVPKIQFQGLSVCQGRLIWLSFPENTTVALYPLTIWFLLLHRHQSRSITHT

SEQ ID NO: 3234 - protein, 1144 aa, Populus tremula
MASQSQRQSNQPAHNQAQSSGTSNMRQHHHPTESVSKAIAQYTVDAQLHAVFEQSGGTGKSFDYSKSVRTPNQSVPEEQITAYLSKIQRGGHIQPFGCMIAADEQSFRVIAYSENAKDMLGLTPQSVPSLEKQEILFVGADVRILFRPSSAVLLEKAFGAREITLLNPIWIHSKNSGKPFYAILHRIDVGIVIDLEPARTEDPALSIAGAVQSQKLAVRAISQLQSLPGGDIKLLCDTVVDSVRELTGYDRVMVYKFHEDEHGEVVAENKRVDLEPYIGLHYPSTDIPQASRFLFKQNRVRMIVDCHAIPVSVIQDEGLMQPLCLVGSTLRAPHGCHAQYMENMGSIASLAMAVIIYGNDEEAIGGRNSMRLWGLVVCHHTSARCIPFPLRYACEFLMQAFGLQLNMELQLASQLLEKHVLRTQTLLCDMLLRDSPTGIVTQSPSIMDLVKCDGAALYYQGQYYPLGVTPTEAQIKDIVEWLLTLHGDPTGLSTDSLADAGYPGAAFLGDAVCGMAVAYIAERDFLFWFRSHTAKEVKWGGAKHHPEDKDDGQRMHPRSSFKAFLEVVKSRSLPWENAEMDAIHSLQLILRDSFRDAEATNSKAVVHTQLKDMELQGMDELSSVAREMVRLIETATAPIFAVDVDGRINGWNAKVAELTGLSVEEAMGKSLVHDLVYKEYEEIVDKLIHRAVKGEEDKNVEIKLRTFCSEHQKKAVFVVVNACSSKDYMDNIVGVCFVGQDVTGQKVVMDKYVLIQGDYKAIVHSPNPSIPPIFASDENTCCLEWNTALEKLTGWSRGEVVGKMLVGEVFGSCCRLKGPDALTKFMIALHNAIGGIDTDKLPFSFFDRNEKNVQTLLTANKRVNMNIIGAFCFLQIVSPELQPSLKVQKQQEKKSFARMKELAYICQEIKNPLSGIHFTNSLLENTDLTEDQQQFLETSAACEKQILKIIRDIDLESIENGSLELEKAEFLLGSVINAVVSQAMLLLRERNLQLLRDIPEEIKTLAVYGDQARIQQVLADFLLNMVRYAPSSAGWVEIHVCPTLKQISDGHTLVHTEFRYLERVLQTRMLGLQHPLRSFLNCKLTLVMLHREGMVPKIQFQGLSVCQGRLIWLSFPENTTVALYPLTIWFLLLHRHQSRSITHT

SEQ ID NO: 3235 - protein, 355 aa, Prochlorococcus marinus str. MIT 9515
MALNYYKNELKENAQLLASKGKGILAVDESTKTVGKRLAGIGVENTEENRKAYRGMLFTTEGLGKYISGAILFEETLFQNHQDGESMVKKLNDLGIIPGIKVDKGLNPLPGGGDVETFCSGLDGLVERAAKYYEQGARFAKWRAVLQITEDGCPSKLSIQENAWGLARYARSVQESGLVPIIEPEILMDGNHTIEKTAEVQEEVIKQVYIACQANGVFLEGTLLKPSMTVNGAECPTKADPMKVAEMTIRTMERCVPASVPGIVFLSGGLSEEAASVYLNNMNTLYRKALWNVSFSYGRALQHSCLKAWKGSEIEAGQKALIARAQANSEASTGSYVAGSQPSSDEQLFVAGYTY

SEQ ID NO: 3236 - protein, 949 aa, Shewanella oneidensis MR-1
MRLTRKTDPVVEPKVPALGLNRRQFLKSAGLATGGIAAASMLGTGMMRKAEAKDIPHNAPTEVKRTICSHCSVGCGVYAEVQNGVWTGQEPAFDHPFNQGGHCAKGAALREHGHGEKRLKYPMKLEGGKWKKISWDQAINEVGDKMMAIRQESGPDSIYFMGSAKFSNEQAYLYRKFAALWGTNNVDHSARICHSTTVAGVANTWGYGAQTNSVNDIRHSKCILFVGSNPSEAHPVAMQHILVAKERGAKIIVVDPRFTRTAAKSDEYVHIRPGTDIPFIYGLLWHIFENGWEDKDFIKRRVYGMERIREEVKKYTPEEVENVVGAPKAQMYRVAKMMAETKPGSIVWCMGGTQHHVGNANTRSYCILQLALGNMGVTGGGTNIFRGHDNVQGASDFGLSFDDLPGYFGLTSGSWAHWANVWDLDPKWVTSRFDQGEYLGQSPQTSPGIPCSRWHDGVLEDKTKIAQKDNIRLAFFWGQSVNTETRGREVRQALDKMDTVVVVDPFPTMAGVMHQRKDGVYLLPAATQFETYGSVSATNRSIQWRSKVIEPLFESLPDHVIMCKLAKKVGIDKELFKHIKVNGEEPLIEDIVREYNRGMWTIGYTGQSPERLKMHQENWGTFNVDSLEAPGGPAKGETYGLPWPCWGTPEMKHPGSHILYNETKHVKDGGGSFRARFGVERNGVNLLSEEAYSAGSEIQDGYPEFTADMLKQLGWWDDLTEDEKKYAEGKNWKTDISGGIQRVVIKHGCIPYGNGKARAVVWNFPDDIPLHREPLYTPRRDLVAKYPTYEDRMVARLPTLYKSIQDKDFAKDFPLALTSGRLVEYEGGGEETRSNPWLAELQQEMFIEISPADAADRGIRDGDNVFVHSPEGAKITVKAMVTPRVVPGECFMPYHFAGVFEGESLAKNYPEGTVPYVIGESANTILTYGYDVVTQMQETKSSLCQISKA

SEQ ID NO: 3237 - protein, 393 aa, Nymphaea alba
MTVPDARKDLLVVNMGPHHPSMHGVLRLIVTLDGEDVIDCEPILGYLHRGMEKIAENRTIIQYLPYVTRWDYLATMFTEAITVNAPEELGNIQVPKRASYIRVIMLELSRIASHLLWLGPFMADIGAQTPFFYIFRERELLYDLFEAATGMRMMHNYFRIGGVAADLPHGWIDKCLDFCDYFLTGVVEYQKLITRNPIFLERVEGVGFIGGEEAINWGLSGPMLRASGIQWDLRKVDRYECYDEFDWEVQWQKEGDSLARYLVRIGEMTESIKIIQQALEGIPGGPYENLEFRRFAGTKDSELNDFEYRFISKKPSPSFELSKQELYVRVEAPKGELGIFLIGDNSVFPWRWKIRPPGFINLQILPQLVKRMKLADIMTILGSIDIIMGEVDR

SEQ ID NO: 3238 - protein, 319 aa, Aspergillus oryzae
MDRSNKPSAIGVGASVPQPTISLRDNTVEATLPSGESVTIHLYGATVTSWKLANGKEQLFVSEKAHLDGSKPIRGGIPVVFPVFGPPPQNHATSSLPQHGFARNSTWEFLGKSSSESLGKDRSGDGSVKLDFGLSRPMLTEYFQKAWPYDFGLVYSVTLTKESLETSLQVQNKGSQNFDFQVLMHTYLKIDDISDIRVKNLESKTYADKTQNAAVITETSPAVEINKETDRVYQSLDPKVPIIVSSASDDKPIFSITREGLNDVVVWNPWIEKAKGMADFGPDEAYKNMICVEAGSVAGWQTLEAGDFWEGGQSIRPRL

SEQ ID NO: 3239 - protein, 149 aa, Anabaena variabilis ATCC 29413
MERTFLAIKPDGVQRGLVGEIIRRFETKGFTLVGLKFLQVSKELAEQHYGVHRERPFFPSLVEFITSGPVVAMVWEGDGVIASARKIIGATNPLTAEPGTIRGDFGINIGRNLIHGSDAPETAQKEVSLWFTDAELVNWQPHLTPWLHE

SEQ ID NO: 3240 - protein, 489 aa, Talaromyces emersonii
MTTTETPTTTTTSTLPPDFLWGFATASYQIEGAFDEDGRLPSIWDTFSKTPGKVEDGTNGDVACDSYHRTGEDIEILKKYGAKIYRFSLSWPRIIPLGGRNDPINEKGLQFYSKFLDDLHAAGIEPFVTLFHWDLPDELMKRYGGMLNKEEFVADYANYARVVFNALGSKVKHWITFNEPWCSSVLGHNTGKHAPGRTSDRTKSPEGDGTREPWIVGHNLLVAHGTVVDIYRREFKEKQGGEIGITLNGDWAEPWDPENPADVEACDRKIEFAISWFADPIYHGKYPDSMVKQLGDRLPKFTPEEIAFVHGSNDFYGMNHYCENYIRNRTGEPDPEDIAGNLDILMEDKNGNPIGPETQCEWLRPFPLGFRKLLKWLADRYNNPKIYVTENGTSVKGESDKPLEEVLNDEFRVQYYRDYIGAMVDAVAQDGVNVKAYMAWSLLDNFEWSEGYRSRFGVTYVDYKNGQKRIPKKSALVIGELFNKYIRKE

SEQ ID NO: 3241 - protein, 541 aa, Glycine max
MAVSGLRSGGLPLFHHHHHHHHLRFLQSPPSFAKLSFLGSKSSKKGFTVFSRYAQARDLFSSRRFQDSMEKLPNLVEDIVQTSLNTGPRGVLRLAQGVQAFLGVGQEWLTDVSKSANSFAGLPTELQLGLLSPFYLRRLFERMGATYIKLGQFIASAPTLFPPEYVQEFQNCFDRAPPVPFEEIESILRKELGKPLESVYEYIDPTPIASASIAQVHGARLKGSREDVVIKVLKPGIEDILVADLNFVYVVARILEFLSPEISRTSLVGIVKDIRESMLEEVDFYKEAANIEAFRRYLETMGLTGNATAPKVYRYCSTMKVLTMQRLYGVPLTDLDSISSLVSNPETSLITALNVWFGSLLACESFHADVHAGNLWLLRDGRIGFLDFGIVGRISPKTWAAMEVFLGSIAIEDYDSMASSLIEMGATNQDVDAKAFARDLEKVFSSIKELDTEIVVATTTGTATNATAVAANIVVDERQMNALFLDVVRVSESYGLKFPREFALLLKQLLYFDRYTRLLAPNLNMLQDQRISIASNSRSRV

SEQ ID NO: 3242 - protein, 72 aa, Marinobacter sp. ELB17
MGYFEEAAVYSYGEYLAEVDSGRLENVPAPQIAIDYWKLPADATLRDVIIVVRMDEAGHRDVNHRFADSFDH

SEQ ID NO: 3243 - protein, 153 aa, Oryza sativa
MSNIEEQTYIMTKPDGVQRGLVGEIIKRFEQRGYHLSALKLTQPTETLLQEHYKDLSARPFFPGLVKYMASGPVVCMVWTGLNAVKAGRAMLGETNPQESKPGSIRGDFCVQTGRNICHGSDSVESAQREIALWFKPEELIKWKSANQSWIYE

SEQ ID NO: 3244 - protein, 142 aa, Marinobacter sp. ELB17
MNEALGSFSTAHNSDPLSKHHTPSGFSDRVAFRLTRLLRFFADLFFAKRYGHRAVVLETVAAVPGMVGGMVGHMRSLRRMEDNREWIHTLLEEAENERMHLMTFVQIAQPSVLERVLILLAQGFFLPAFYFSTLFLAAPHIG

SEQ ID NO: 3245 - protein, 1144 aa, Populus tremula
MASQSQRQSNQPAHNQAQSSGTSNMRQHHHPTESVSKAIAQYTVDAQLHAVFEQSGGTGKSFDYSKSVRTPNQSVPEEQITAYLSKIQRGGHIQPFGCMIAADEQSFRVIAYSENAKDMLGLTPQSVPSLEKQEILFVGADVRILFRPSSAVLLEKAFGAREITLLNPIWIHSKNSGKPFYAILHRIDVGIVIDLEPARTEDPALSIAGAVQSQKLAVRAISQLQSLPGGDIKLLCDTVVDSVRELTGYDRVMVYKFHEDEHGEVVAENKRVDLEPYIGLHYPSTDIPQASRFLFKQNRVRMIVDCHAIPVSVIQDEGLMQPLCLVGSTLRAPHGCHAQYMENMGSIASLAMAVIIYGNDEEAIGGRNSMRLWGLVVCHHTSARCIPFPLRYACEFLMQAFGLQLNMELQLASQLLEKHVLRTQTLLCDMLLRDSPTGIVTQSPSIMDLVKCDGAALYYQGQYYPLGVTPTEAQIKDIVEWLLTLHGDPTGLSTDSLADAGYPGAAFLGDAVCGMAVAYIAERDFLFWFRSHTAKEVKWGGAKHHPEDKDDGQRMHPRSSFKAFLEVVKSRSLPWENAEMDAIHSLQLILRDSFRDAEATNSKAVVHNQLKDMELQGMDELSSVAREMVRLIETATAPIFAVDVDGRINGWNAKVAELTGLSVEEAMGKSLVHDLVYKEYEEIVDKLIHRAVKGEEDKNVEIKLRTFCSEHQKKAVFVVVNACSSKDYMDNIVGVCFVGQDVTGQKVVMDKYVLIQGDYKAIVHSPNPSIPPIFASDENTCCLEWNTAMEKLTGWSRGEVVGKMLVGEVFGSCCRLKGPDALTKFMIALHNAIGGIDTDKLPFSFFDRNEKNVQTLLTANKRVNINIIGAFCFLQIASPELQPSLKVQKQQEKKSFARMKELAYICQEIKNPLSGIHFTNSLLENTDLTEDQQQFLETSAACEKQILKIIRDIDLESIENGSLELEKAEFLLGSVINAVVSQAMLLLRERNLQLLRDIPEEIKTLAVYGDQARIQQVLADFLLNMVRYAPSSAGWVEIHVCPTLKQISDGHTLVHTEFRYLERVLQTRMLGLQHPLRSFLNCKLTLVMLHREGMVPKIQFQGLSVCQGRLIWLSFPENTTVALYPLTIWFLLLHRHQSRSITHT

SEQ ID NO: 3246 - protein, 1144 aa, Populus tremula
MASQSQRQSNQPAHNQAQSSGTSNMRQHHHPTESVSKAIAQYTVDAQLHAVFEQSGGTGKSFDYSKSVRTPNQSVPEEQITAYLSKIQRGGHIQPFGCMIAADEQSFRVIAYSENAKDMLGLTPQSVPSLEKQEILFVGADVRILFRPSSAVLLEKAFGAREITLLNPIWIHSKNSGKPFYAILHRIDVGIVIDLEPARTEDPALSIAGAVQSQKLAVRAISQLQSLPGGDIKLLCDTVVDSVRELTGYDRVMVYKFHEDEHGEVVAENKRVDLEPYIGLHYPSTDIPQASRFLFKQNRVRMIVDCHAIPVSVIQDEGLMQPLCLVGSTLRAPHGCHAQYMENMGSIASLAMAVIIYGNDEEAIGGRNSMRLWGLVVCHHTSARCIPFPLRYACEFLMQAFGLQLNMELQLASQLLEKHVLRTQTLLCDMLLRDSPTGIVTQSPSIMDLVKCDGAALYYQGQYYPLGVTPTEAQIKDIVEWLLTLHGDPTGLSTDSLADAGYPGAAFLGDAVCGMAVAYIAERDFLFWFRSHTAKEVKWGGAKHHPEDKDDGQRMHPRSSFKAFLEVVKSRSLPWENAEMDAIHSLQLILRDSFRDAEATNSKAVVHTQLKDMELQGMDELSSVAREMVRLIETATAPIFAVDVDGRINGWNAKVAELTGLSVEEAMGKSLVHDLVYKEYEEIVDKLIHRAVKGEEDKNVEIKLRTFCSEHQKKAVFVVVNACSSKDYMDNIVGVCFVGQDVTGQKVVMDKYVLIQGDYKAIVHSPNPSIPPIFASDENTCCLEWNTAMEKLTGWSRGEVVGKMLVGEVFGSCCRLKGPDALTKFMIALHNAIGGIDTDKLPFSFFDRNEKNVQTLLTANKRVNINIIGAFCFLQIASLELQPSLKVQKQQEKKSFARMKELAYICQEIKNPLSGIHFTNSLLENTDLTEDQQQFLETSAACEKQILKIIRDIDLESIENGSLELEKAEFLLGSVINAVVSQAMLLLRERNLQLLRDIPEEIKTLAVYGDQARIQQVLADFLLNMVRYAPASAGWVEIHVCPTLKQISDGHTLVHTEFRYLERVLQTRMLGLQHPPRSFLNCKLTLVMLHREGMVPKIQFQGLSVCQGRLIWLSFPENTTVALYPLTIWFLLLHRHQSRSITHT

SEQ ID NO: 3247 - protein, 1144 aa, Populus tremula
MASQSQRQSNQPAHNQAQSSGTSNMRQHHHPTESVSKAIAQYTVDAQLHAVFEQSGGTGKSFDYSKSVRTPNQSVPEEQITAYLSKIQRGGHIQPFGCMIAADEQSFRVIAYSENAKDMLGLTPQSVPSLEKQEILFVGADVRILFRPSSAVLLEKAFGAREITLLNPIWIHSKNSGKPFYAILHRIDVGIVIDLEPARTEDPALSIAGAVQSQKLAVRAISQLQSLPGGDIKLLCDTVVDSVRELTGYDRVMVYKFHEDEHGEVVAENKRVDLEPYIGLHYPSTDIPQASRFLFKQNRVRMIVDCHAIPVSVIQDEGLMQPLCLVGSTLRAPHGCHAQYMENMGSIASLAMAVIIYGNDEEAIGGRNSMRLWGLVVCHHTSARCIPFPLRYACEFLMQAFGLQLNMELQLASQLLEKHVLRTQTLLCDMLLRDSPTGIVTQSPSIMDLVKCDGAALYYQGQYYPLGVTPTEAQIKDIVEWLLTLHGDPTGLSTDSLADAGYPGAAFLGDAVCGMAVAYIAERDFLFWFRSHTAKEVKWGGAKHHPEDKDDGQRMHPRSSFKAFLEVVKSRSLPWENAEMDAIHSLQLILRDSFRDAEATNSKAVVHTQLKDMELQGMDELSSVAREMVRLIETATAPIFAVDVDGRINGWNAKVAELTGLSVEEAMGKSLVHDLVYKEYEEIVDKLIHRAVKGEEDKNVEIKLRTFCSEHQKKAVFVVVNACSSKDYMDNIVGVCFVGQDVTGQKVVMDKYVLIQGDYKAIVHSPNPSIPPIFASDENTCCLEWNTAMEKLTGWSRGEVVGKMLVGEVFGSCCRLKGPDALTKFMIALHNAIGGIDTDKLPFSFFDRNEKNVQTLLTANKRVNMNIIGAFCFLQIASPELQPSLKVQKQQEKKSFARMKELAYICQEIKNPLSGIHFTNSLLENTDLTEDQQQFLETSAACEKQILKIIRDIDLESIENGSLELEKAEFLLGSVINAVVSQAMLLLRERNLQLLRDIPEEIKTLAVYGDQARIQQVLADFLLNMVRYAPSSAGWVEIHVCPTLKQISDGHTLVHTEFRYLERVLQTRMLGLQHPPRSFLNCKLTLVKLHREGMVPKIQFQGLSVCQGRLIWLSFPENTTVALYPLTIWFLLLHRHQSRSITHT

SEQ ID NO: 3248 - protein, 1146 aa, Populus tremula
MASQSQRQSNQPAHNQAQSSGTSNMRQHHHPTESVSKAIAQYTVDAQLHAVFEQSGGTGKSFDYSKSVRTPNQSVPEEQITAYLSKIQRGGHIQPFGCMIAADEQSFRVIAYSENAKDMLGLTPQSVPSLEKQEILFVGADVRILFRPSSAVLLEKAFGAREITLLNPIWIHSKNSGKPFYAILHRIDVGIVIDLEPARTEDPALSIAGAVQSQKLAVRAISQLQSLPGGDIKLLCDTVVDSVRELTGYDRVMVYKFHEDEHGEVVAENKRVDLEPYIGLHYPSTDIPQASRFLFKQNRVRMIVDCHAIPVSVIQDEGLMQPLCLVGSTLRAPHGCHAQYMENMGSIASLAMAVIIYGNDEEAIGGRNSMRLWGLVVCHHTSARCIPFPLRYACEFLMQAFGLQLNMELQLASQLLEKHVLRTQTLLCDMLLRDSPTGIVTQSPSIMDLVKCDGAALYYQGQYYPLGVTPTEAQIKDIVEWLLTLHGDPTGLSTDSLADAGYPGAAFLGDAVCGMAVAYIAERDFLFWFRSHTAKEVKWGGAKHHPEDKDDGQRMHPRSSFKAFLEVVKSRSLPWENAEMDAIHSLQLILRDSFRDAEATNSKAVVHNQLKDMELQGMDELSSVAREMVRLIETATAPIFAVDVEGRINGWNAKVAELTGLSVEEAMGKSLVHDLVYKEYEEIVDKLIHRAVKGEEDKNVEIKLRTFCSEHQKKAVFVVVNACSSKDYMDNIVGVCFVGQDVTGQKVVMDKYVLIQGDYKAIVHSPNPSIPPIFASDENTCCLEWNTAMEKLTGWSKGEVVGKMLVGEVFGNCCKLKGPNALTKFMIALHNAIGGIDTDKLPFSFFDRNEKNVQTLLTANKRVNMKGDIIGAFCFLQIASPELQPSLKVQKQQEKKSFARMKELAYICQEIKNPLSGIHFTNSLLENTDLTEDQQQFLETSAACEKQILKIIRDIDLESIENGSLELEKPEFLLGSVINAVVSQAMLLLRERNLQLLRDIPEEIKTLAVYGDQARIQQVLADFLLNMVRYAPSSAGWVEIHVCPTLKQISDGHTLVHTEFRYLERVLQTRMLGLQHPLRSFLNCKLTLVKLHREGMVPKIQFQGLSVCQGRLIWLSFPENTTVALYPLTIWFLLLHRHQSRSITHT

SEQ ID NO: 3249 - protein, 1146 aa, Populus tremula
MASQSQRQSNQPAHNQAQSSGTSNMRQHHHPTESVSKAIAQYTVDAQLHAVFEQSGGTGKSFDYSKSVRTPNQSVPEEQITAYLSKIQRGGHIQPFGCMIAADEQSFRVIAYSENAKDMLGLTPQSVPSLEKQEILFVGADVRILFRPSSAVLLEKAFGAREITLLNPIWIHSKNSGKPFYAILHRIDVGIVIDLEPARTEDPALSIAGAVQSQKLAVRAISQLQSLPGGDIKLLCDTVVDSVRELTGYDRVMVYKFHEDEHGEVVAENKRVDLEPYIGLHYPSTDIPQASRFLFKQNRVRMIVDCHAIPVSVIQDEGLMQPLCLVGSTLRAPHGCHAQYMENMGSIASLAMAVIIYGNDEEAIGGRNSMRLWGLVVCHHTSARCIPFPLRYACEFLMQAFGLQLNMELQLASQLLEKHVLRTQTLLCDMLLRDSPTGIVTQSPSIMDLVKCDGAALYYQGQYYPLGVTPTEAQIKDIVEWLLTLHGDPTGLSTDSLADAGYPGAAFLGDAVCGMAVAYIAERDFLFWFRSHTAKEVKWGGAKHHPEDKDDGQRMHPRSSFKAFLEVVKSRSLPWENAEMDAIHSLQLILRDSFRDAEATNSKAVVHTQLKDMELQGMDELSSVAREMVRLIETATAPIFAVDVDGRINGWNAKVAELTGLSVEEAMGKSLVHDLVYKEYEEIVDKLIHRAVKGEEDKNVEIKLRTFCSEHQKKAVFVVVNACSSKDYMDNIVGVCFVGQDVTGQKVVMDKYVLIQGDYKAIVHSPNPSIPPIFASDENTCCLEWNTAMEKLTGWSRGEVVGKMLVGEVFGSCCKLKGPNSLTKFMIALHNAIGGIDTDKLPFSFFDRNEKNVQTLLTANKRVNMKGDIIGAFCFLQIASPELQPSLKVQKQQEKKSFARMKELAYICQEIKNPLSGIHFTNSLLENTDLTEDQQQFLETSAACEKQILKIIRDIDLESIENGSLELEKAEFLLGSVINAVVSQAMLLLRERNLQLLRDIPEEIKTLAVYGDQARIQQVLADFLLNMVRYAPSSAGWVEIHVCPTLKQISDGHTLVHTEFRYLERVLQTRMLGLQHPLRSFLNCKLTLVKLHREGMVPKIQFQGLSVCQGRLIWLSFPENTTVALYPLTIWFLLLHRHQSRSITHT

SEQ ID NO: 3250 - protein, 950 aa, Shewanella oneidensis MR-1
MKLTRKSDVAQVANKPTLGISRRQFMKQAGIATGGIAAASLMGTGMMRRAEAKDVPYDAPIEIKRTICSACAVGCGLYAEVQNGVWTGQEPAFDHPFNAGGHCAKGAALREHGHGEKRLKYPMKLVDGKWKKISWEDAINEVGDQMLNIRKESGPDSVYFMGSAKFSNEGCYAYRKLAAMWGTNNVDHSARICHSTTVAGVANTWGYGAQTNSFNDIQNANAIFLIGANPAEAHPVSMQHILIAKEKNNAKIIVVDPRFSRTAAHSDLHCAIRPGTDIPFIYGMLWHIFENGWEDKTFIQHRVFEMETIRAEVKKFPPKEVANITGVSEEVVYQAAKLMAENRPGTVIWCMGGTQHHVGNANTRAYCILQLALGNMGVSGGGTNIFRGHDNVQAATDLGLLFDNLPGYYGLTTAAWEHWTNVWELDMEWMKSRFDHGTYLGREPMTTPGMPCSRWFDGVLLEKDKLAQKDNIRMAFFWGQSVNTGTRQRDVRDALDKLDTVVVVDPFPTIAGIMHSRKNGVYLLPACTQFEASGAVSNSGRSIQWREQVIQPLFESKNDIEIMYMLAKKVGISEQWAKRWNIAGNMPVVEDISREINRGMWTIGYTGQSPERIKQHTQNWGTFSNKTLEAAGGPCKGETYGLPWPCWGTPEAKHPGTQILYNQDKHVKDGGGNFRARYGVEYNGKNLLAEGTFSKGAEIQDGYPEFSDKLLKQLGWWDDLTAEEKAAAEGKNWKTDLSGGIVRVAIKHGCIPFGNAKARCIVWTFPDQAPVHREPIYTARRDLVAKYPTYDDMQVHRLPTLYKTLQENDLSGKYPLVMTSGRLVEYEGGGEESRCNPWLAELQQEMFIEISPADAADRAIRNGEFVWVEGAEGGRIKVQAMVTPRVAPGVTFMPYHFAGVMHGESLAANYPEGTVPYVIGESCNTALTYGYDPVTQMQETKASLCQIVKA

SEQ ID NO: 3251 - protein, 144 aa, Legionella pneumophila str. Lens
MAHLIHSVLPVPPRKIAYIHPDDSVKECIKQMVEKDIGALVVFDNDAHLIGIVSERDILRCYFHKNLSLETAKVSDVVYNNVTILSPHDSVEKAMQVITETKRRHVLIQEEGELLAILSIGDLLYHVLEDKLRVIEHLENYIHS

SEQ ID NO: 3252 - protein, 431 aa, Prochlorococcus marinus str. MIT 9515
MKRVLAIILGGGKGSRLYPLTKMRAKPAVPLAGKYRLIDIPISNCINSGINKMYVLTQFNSASLNRHIGRTYNLSAPFGQGFVEVLAAQQTPDSPKWFEGTADAVRKYQWLFQEWDVDEYLILSGDQLYRMDYSLFVQHHRDNGADLTVAALPVDEAQAEGFGLMRTDDLGNIKEFSEKPTGEKLKSMAVDTSKFGLTKESALEKPYLASMGIYVFSRKTLFDLLNKFPNYTDFGKDIIPEALGRGDNLKSYVFDDYWEDIGTIGAFFESNLALTRQPKPPFSFYDEKFPIYTRPRYLPPSKLVDAQITDSIVCEGTILKSCSILHCVLGVRSRIESDSVIEDALVMGADFFESQEERVELRKGGGTPLGVGVGSTIKRAILDKNARIGDNVVIVNKDRVEEADKPELGFYIRNGIVVVVKNATIANGTII

SEQ ID NO: 3253 - protein, 556 aa, Ustilago maydis 521
MASILGVGQQGLNFSRSSAPSSPLIPRDSALGKVFSIVDLTRLPSLQEADRTTVVFTILAVVATLLLAEQYTYQKKKAGLPGPKWTIPVIGKFADSLHPTLEKYQEGWNSGPLSVASVFNIFIVIASSNEYTRKILNSPTYAEPCLVASAKKVLCPDNWVFLNGKTHVDYRRGLNTLFTRQALGIYLGIQETIYKRYFEEWLADTNPNPQPYMMKFRDLNMETSLRVFCGNYIPDEGAKQISDNYWLITVALELVNFPFAFPGTKVYNAIKARKTAMKWFELTARESKKRMAAGEEVTCLTDAWIKAMVDARLQRDNADLEAETRRVLLRDFSDREIGMVLLSFLFASQDAMSSGLTYLLQHVADRPDVLRKVREEQYRVRGDDINAALTYNAIEQMEYTKAVVKESLRIKPPVIMVPYLTQKDFPIDKNYTVPKGSMVIPSFWNSLHDEKVYPQPDEFKPERWLDEADPANKSPKNYLVFGSGPHYCIGQQYANMHLTAVLGTASVLMNWEHEVTPLSEKVEVIATIFPKDGARIKFSRRAAPAPGTAPEVAARA

SEQ ID NO: 3254 - protein, 184 aa, Brassica napus
  misc_feature (53)..(53): Xaa can be any naturally occurring amino acid
MIYTAIDNFYLPEEQIKNSPSRKDGIDETTETTLRIYGCDLIQEAGILLRLPXAVMATGQVLFHRFYCKKSLAKFDVKIVAASCVWLASKLEENPKKARQVIIVFHRMECRRENLPLDHLDLFSKKYSELKVELSRTERHILKEMGFVCHVEHPHKFISNYLATLETPPELRQEAWNLANDSLR

SEQ ID NO: 3255 - protein, 408 aa, Oryza sativa (japonica cultivar-group)
MSLRCYHHHLKVRALLCGFGGGCFPTRTPPSPSPWSPPLTHFIKHLLGSPAALSGTATGAACEPCSLTLHFLRNTCGLSEDEAAAAAARVRLRSTKKAHAIVALFRGIGFSAADIARLVTSNPSLLSYRADATLMPKIEFFRRELGLTDAEIRRLVLANPYRVLRYSLKRCIRPNYLILRDLLGSDKNVTAAVLQSTDLIHGDVRGILLPKIKILQDYGATNDVIVKLVTTHPRALMHRASRFEESLAAMKELGVRPSSGMFPYSFGLFARLHPRKWKGRMDNFLSLGWTKEQVIEAFVRHPYCMSVSNDKVKLIWQFLAKKLRWTTDYVARSPMVLSFSYDKRILPRCTVLNLLASRGIFNRDIKTSHLVLGEKKFKEKYVTPYQDEIPEVLEAYSSVAESRVPVYK

SEQ ID NO: 3256 - protein, 596 aa, Neorickettsia sennetsu str. Miyayama
MNNKTLNIAVIAHVDHGKTTLTNNLLRQANVLDEVGMDRNPLEQKRGITMFSKVASVSYGNVKINLIDTPGHSDFGGEVERILSMVDSVMLLVDSAEGVMPQTKFVLSKALKVGLRPIVIINKVDRPDRRIEEVINEISDLFLALEANDEQLDFPVLYASGRDGWCVRDLNDQRESLVPLLETIIGYTPVRKYDREAPFSMLVTMLENDNFLGRILIGKIEQGSISVNAHVKAINLSGELLENSRITKLQIFDGMVKKVVENAEAGEIIAIAGLADTSVTDTVCDPSVNTPIDAIPIDPATISINISVNTSPFTGKEGNKLTSRMILARLLQEVKTNVSIKMEERGEGQFEVMGRGELQLGVLIENMRKEGFELSVSRPKVVIKIDENGQKMEPIEELTIDMDEEYAGIVMETLNTRKGIMQSMENYPGGRVRLVYHIPARSLIGYHGKFYSDTRGSGILNKVFYGYAPYSGKIDSRSNGVLVSNGQGEAVAYALFNLQDRGIMFVKPQDPVYCGMIVGEHSRGNDLDVNVLKGKQLTNIRAAGSDEAVRLSPPLLMTLEEMMAYINDDELVEVTPLSLRLRKKVLDSNMRKKQNV

SEQ ID NO: 3257 - protein, 519 aa, Neorickettsia sennetsu str. Miyayama
MMPEIAIIDLGSQFTQLIARKLRENGCCSCIYNPSGFTFSNDIKGVILSGSHQSTSEYANYRDLIAMVLSLNSTHGIPVLGICYGKQLLSDFLGASVVSGKNREYGRARLQIVAESPIVSNISASDFTVWMSHGDAVVTLPCGFKCVAKTDDCQFALIADENRKIYGFQFHPEVSHTENGGVLLRNFISIAGVENTWDLQVFSEEEKRMVVATTGDAGVLAAVSGGVDSTVAAKFMHGAIGERLHCIFVDTGLLRKNEANEVKESFSSLGIPLKIVFAADRFFKKLAGVADPEQKRRIVGETFIQVFEEEALKIQGVEFLLQGTLYPDVIESGGGGSHTIKSHHNVGGLPKKMGLKLLEPFRLLFKDEVRAIGRQLGVSEVLLMRHPSPGPALAIRILGEVTQEKVAVLQDIDEIYISTMKEYNLYSHIWQAFSVLLPVCSVGVMGDKRSYNYVCALRAIVSHDGMTASAYPFEAHDDDKLRFLSFLNEVATKIPNRVSAVSRVVYDITSKPPATVEWE

SEQ ID NO: 3258 - protein, 307 aa, Nostoc sp. PCC 7120
MKGFDRLDTVDLSNWVTLAKTKTNCGRVVERIPKLAVADTAWFAVHICCQSGKFYSEGDTQCVFPLMSVIKPFTFLYLLEHMGVEKVLSWVGTKPSDAPFNSLEQLVADGGYPRNPMINSGAITLADKLPGEDADHRTRFFCKWLNQLAGSQIQLDESMLASVRLSRSPANQAIANYLAEKGYLEDLDVALDTYEQICCLSGTVEDLALLGKLLALESSSISPQHQQLVNSVMLTCGLYEASAEYAVTIGLPMKSGIGGGLLAIVPTAGAIACYSPALDRIGNPVGAIAFVEVLSRSLGLCGRFSHL

SEQ ID NO: 3259 - protein, 478 aa, Vaccaria hispanica
MSNNENNATQVIVLPYHGQGHMNTMVQFAKRLAWKGVHVTIATTFNTIQQMKLNISSYNSITLEPIYDDTDDSTLHIKDRMARFEAEAASNLTRVLEAKKQQQALNKKCLLVYHGSLNWALVVAHQQNVAGAAFFTAASASFACYYYLHLESQGKGVDLEELPSILPPPKVIVQKLPKSFLAYGDNNSHNNNNNNNNNNNNNNMGLHPLVLWLLKDYGNSVKADFVLLNSFDKLEEEAIKWISNICSVKTIGPTIPSTYLDKQIENDVDYGFNQYKPTNEDCMKWLDTKEANSVVYIAFGSVARLSVEQMAEIAKALDHSSKSFIWVVRETEKEKLPVDLVEKISGQGMVVPWAPQLEVLAHDAVGCFVSHCGWNSTIEALSFGVPILAMPQFLDQLVDAHFVDRVWGVGIAPTVDENDLVTQEEISRCLDEMMGGGPEGEKIKKNVAMWKELTKEALDKGGSSDKHIDEIIEWLSSS

SEQ ID NO: 3260 - protein, 599 aa, Chlorobium tepidum TLS
MVYRKAPKHSGDAPDSSANPADRPASTGKERRYQGIGSAKGFAIGETYEFVRETIEHETADLSPENIEGEIERFMTALHRSEKELKKIERVTTRKIGRLYSDLFQAQIMLLKDPVLTGNITRRIRQELKPAHIVIEQEFGKLLEHFLNSDDVIFRERAADLHDLKERIIRNLHIRKLHSWVPEGSIVVSHHLSPADIILLSRSNIKGFATDTGGKTSHVSLICKSLNIPIVVGLGNFSQKAVSGERIILDGNEGLVITNPLDETVDTYLKKREEESKREADDSIMAHRHAFTRCGVRISVYSNIDFKEEIEHLDSMGAEGVGLFRTENLFLDDLKPPKEAAQQEYYRKMGEMLAPKPLVIRLFDIGGDKLIYSPVKEPNPNLGWRGVRILIDVPEILDAQLQAVIRANIHGNIDVLIPMISSVEEIMHIKQAVEEHYKHIRSLTTEPLDKPGIGAMIEVPAAVELIDEITQIVDFVSIGTNDLTQYTLAVDRNNLIVQDLFEKFHPAVIRQLHRVISTAQKNHCRVSLCGDMGSDPLATPYLIGCGLREFSIVSSDIPALKAMVGKYTVEECEALAAECLKLSSASAIKAHLEAFVKAH

SEQ ID NO: 3261 - protein, 216 aa, Thellungiella salsuginea
MNSFSAFAEMFGSEYESPVTVGGDYCPTLATSCPKKPAGRKKFRETRHPIYRGVRRRNSGKWVCEVREPNKKSRIWLGTFPTAEMAARAHDVAAIALRGRSACLNFADSAWRLRIPESTCAKDIQKAAAEAAVAFQAEMSDTMTSDHGLDMEETTVEVIVTEEEQSEGFYMDEEAMFGMPRLLANMAEGMLLPPPSVQWGHNYDCDGDADVSLWSY

SEQ ID NO: 3262 - protein, 1146 aa, Populus tremula
MASQSQRQSNQPAHNQVQSSGTSNMRQHHHPTESVSKAIAQYTVDAQLHAVFEQSGGTGKSFDYSKSVRTPNQSVPEEQITAYLSKIQRGGHIQPFGCMIAADEQSFRVIAYSENAKDMLGLTPQSVPSLEKQEILFVGADVRILFRPSSAVLLEKAFGAREITLLNPIWIHSKNSGKPFYAILHRIDVGIVIDLEPARTEDPALSIAGAVQSQKLAVRAISQLQSLPGGDIKLLCDTVVDSVRELTGYDRVMVYKFHEDEHGEVVAENKRVDLEPYIGLHYPSTDIPQASRFLFKQNRVRMIVDCHAIPVSVIQDEGLMQPLCLVGSTLRAPHGCHAQYMENMGSIASLAMAVIIYGNDEEAIGGRNSMRLWGLVVCHHTSARCIPFPLRYACEFLMQAFGLQLNMELQLASQLLEKHVLRTQTLLCDMLLRDSPTGIVTQSPSIMDLVKCDGAALYYQGQYYPLGVTPTEAQIKDIVEWLLTLHGDPTGLSTDSLADAGYPGAAFLGDAVCGMAVAYIAERDFLFWFRSHTAKEVKWGGAKHHPEDKDDGQRMHPRSSFKAFLEVVKSRSLPWENAEMDAIHSLQLILRDSFRDAEATNSKAVVHTQLKDMELQGMDELSSVAREMVRLIETATAPIFAVDVEGRINGWNAKVAELTGLSVEEAMGKSLVHDLVYKEYEEIVDKLIHRAVKGEEDKNVEIKLRTFCSEHQKKAVFVVVNACSSKDYMDNIVGVCFVGQDVTGQKVVMDKYVLIQGDYKAIVHSPNPSIPPIFASDENTCCLEWNTAMEKLTGWSRGEVVGKMLVGEVFGSCCRLKGPDALTKFMIALHNAIGGIDTDKLPFSFFDRNEKNVQTLLTANKRVNMKGDIIGAFCFLQIASPELQPSLKVQKQQEKKSFARMKELAYICQEIKNPLSGIHFTNSLLENTDLTEDQQQFLETSAACEKQILKIIRDIDLESIENGSLELEKAEFLLGSVINAVVSQAMLLLRERNLQLLRDIPEEIKTLAVYGDQARIQQVLADFLLNMVSYTQSSAGWVEIHVCPTLKQISDGHTLVHTEFRYLERVLQTRMLGLQHPPRSFLNCKLTLVKLHREGMVPKIQFQGLSVCQGRLIWLSFPENTTVALYPLTIWFLLLHRHQSRSITHT

SEQ ID NO: 3263 - protein, 406 aa, Mycobacterium smegmatis str. MC2 155
MSTPGGLQRRLGTFDAVTIGLGSMIGAGIFAAIGPAAAAAGSGLLIGLALAAVVAYCNATSSARLAAIYPQSGGTYVYGRERLGEFWGYLAGWSFAVGKTASCAAMALTVGSYAWPEHANAVAVGAVVALTAVNYVGVQKSAVLTRVIVAVVLAILATVVVLLLGSGDADPARLSLGDDVSAVGVLQAAGLLFFAFAGYARIATLGEEVRDPARIIPRAIRIALGLTLVVYAVVAGAVLAVLGGTDLAGATAPLADAVAAVGAGQWQPLVRAGAAIAALGSLLALILGVSRTTLAMARDHHLPSALGAVHPRFGVPHRAEVTVGVVVAVLAAVADLRGAIGFSSFAVLLYYAIANASAATLGGRLVPAVGLVGCLVLAFTLPLSSVLAGLAVVAAGAVVYGVRRIS

SEQ ID NO: 3264 - protein, 1146 aa, Populus tremula
MASQSQRQSNQPAHNQAQSSGTSNMRQHHHPTESVSKAIAQYTVDAQLHAVFEQSGGTGKSFDYSKSVRTPNQSVPEEQITAYLSKIQRGGHIQPFGCMIAADEQSFRVIAYSENAKDMLGLTPQSVPSLEKQEILFVGADVRILFRPSSAVLLEKAFGAREITLLNPIWIHSKNSGKPFYAILHRIDVGIVIDLEPARTEDPALSIAGAVQSQKLAVRAISQLQSLPGGDIKLLCDTVVDSVRELTGYDRVMVYKFHEDEHGEVVAENKRVDLEPYIGLHYPSTDIPQASRFLFKQNRVRMIVDCHAIPVSVIQDEGLMQPLCLVGSTLRAPHGCHAQYMENMGSIASLAMAVIIYGNDEEAIGGRNSMRLWGLVVCHHTSTTCIPFPLRYACEFLMQAFGLQLNMELQLASQLLEKHVLRTQTLLCDMLLRDSPTGIVTQSPSIMDLVKCDGAALYYQGQYYPLGVTPTEAQIKDIVEWLLTLHGDPTGLSTDSLADAGYPGAAFLGDAVCGMAVAYIAERDFLFWFRSHTAKEVKWGGAKHHPEDKDDGQRMHPRSSFKAFLEVVKSRSLPWENAEMDAIHSLQLILRDSFRDAEATNSKAVVHTQLKDMELQGMDELSSVAREMVRLIETATAPIFAVDVEGRINGWNAKVAELTGLSVEEAMGKSLVHDLVYKEYEEIVDKLIHRAVKGEEDKNVEIKLRTFCSEHQKKAVFVVVNACSSKDYMDNIVGVCFVGQDVTGQKVVMDKYVLIQGDYKAIVHSPNPSIPPIFASDENTCCLEWNTALEKLTGWSRGEVVGKMLVGEVFGSCCRLKGPNALTKFMIALHNAIGGIDTDKLTFSFFDRNEKNVQTLLTANKRVNIKGDIIGAFCFLQIASLELQPSLKVQKQQEKKSFARMKELAYICQEIKNPLSGIHFTNSLLENTDLTEDQQQFLETSAACEKQILKIIRDIDLESIENGSLELEKAEFLLGSVINAVVSQAMLLLRERNLQLLRDIPEEIKTLAVYGDQARIQQVLADFLLNMVRYAPSSAGWVEIHVCPTLKQISDGHTLVHTEFRYLERVLQTRMLGLQHPLRSFLNCKLTLVMLHREGMVPKIQFQGLSVCQGRLIWLSFPENTTVALYPLTIWFLLLHRHQSRSITHT

SEQ ID NO: 3265 - protein, 559 aa, Malus x domestica
MGSSGIDWKLPDHPKLPKGKVIGLIVLDGWGEANADQYNCIHVAETPVMDSLKKGAPERWRLVRAHGTAVGLPTEDDMGNSEVGHNALGAGRIFAQGAKLVDAALASGKIFEGEGFKYVKESFETNTLHLIGLMSDGGVHSRLDQLLLLLKGASEQGAKKIRVHILTDGRDVLDGSSVGFAEILENDLAKLREKGVDAQIASGGGRMYVTMDRYENDWSVVKRGWDAQVLGEAPYKFKNAVEAIKTLRAEPNANDQYLPPFVIVDDSGKPVGPIVDGDAVVTFNFRADRMVMIAKALEYADFDKFDRVRVPKIRYAGMLQYDGELKLPSHYLVEPPEIDRTSGEYLTYNGVRTFACSETVKFGHVTFFWNGNRSGYFNDKMEEYVEIPSDSGITFNVQPKMKAVEIAEKARDAILSGKFEQVRVNLPNGDMVGHTGDIEATIVACKAADEAVKIILDAIEKVGGIYVVTADHGNAEDMVKRNKTGQPLLDKSGNIQILTSHTLQPVPIAIGGPGLAPGVRFRKDLPSGGLANVAATVMNLHGFQAPSDYEPSLIEVVDN

SEQ ID NO: 3266 - protein, 1146 aa, Populus tremula
MASQSQRQSNQPAHNQAQSSGTSNMRQHHHPTESVSKAIAQYTVDAQLHAVFEQSGGTGKSFDYSKSVRTPNQSVPEEQITAYLSKIQRGGHIQPFGCMIAADEQSFRVIAYSENAKDMLGLTPQSVPSLEKQEILFVGADVRILFRPSSAVLLEKAFGAREITLLNPIWIHSKNSGKPFYAILHRIDVGIVIDLEPARTEDPALSIAGAVQSQKLAVRAISQLQSLPGGDIKLLCDTVVDSVRELTGYDRVMVYKFHEDEHGEVVAENKRVDLEPYIGLHYPSTDIPQASRFLFKQNRVRMIVDCHAIPVSVIQDEGLMQPLCLVGSTLRAPHGCHAQYMENMGSIASLAMAVIIYGNDEEAIGGRNSMRLWGLVVCHHTSARCIPFPLRYACEFLMQAFGLQLNMELQLASQLLEKHVLRTQTLLCDMLLRDSPTGIVTQSPSIMDLVKCDGAALYYQGQYYPLGVTPTEAQIKDIVEWLLTLHGDPTGLSTDSLADAGYPGAAFLGDAVCGMAVAYIAERDFLFWFRSHTAKEVKWGGAKHHPEDKDDGQRMHPRSSFKAFLEVVKSRSLPWENAEMDAIHSLQLILRDSFRDAEATNSKAVVHTQLKDMELQGMDELSSVAREMVRLIETATAPIFAVDVDGRINGWNAKVAELTGLSVEEAMGKSLVHDLVYKEYEEIVDKLIHRAVKGEEDKNVEIKLRTFCSEHQKKAVFVVVNACSSKDYMDNIVGVCFVGQDVTGQKVVMDKYVLIQGDYKAIVHSPNPSIPPIFASDENTCCLEWNTAMEKLTGWSRGEVVGKMLVGEVFGNCCRLKGPDALTKFMIALHNAIGGIDTDKLPFSFFDRNEKNVQTLLTANKRVNMKGDIIGAFCFLQIASPELQPSLKVQKQQEKKSFARMKELAYICQEIKNPLSGIHFTNSLLENTDLTEDQQQFLETSAACEKQILKIIRDIDLESIENGSLELEKAEFLLGSVINAVVSQAMLLLRERNLQLLRDIPEEIKTLAVYGDQARIQQVLADFLLNMVRYAPSSAGWVEIHVCPTLKQISDGHTLVHTEFRYLERVLQTRMLGLQHPLRSFLNCKLTLVMLHREGMVPKIQFQGLSVCQGRLIWLSFPENTTVALYPLTIWFLLLHRHQSRSITHT

SEQ ID NO: 3267 - protein, 1146 aa, Populus tremula
MASQSQRQSNQPAHNQAQSSGTSNMRQHHHPTESVSKAIAQYTVDAQLHAVFEQSGGTGKSFDYSKSVRTPNQSVPEEQITAYLSKIQRGGHIQPFGCMIAADEQSFRVIAYSENAKDMLGLTPQSVPSLEKQEILFVGADVRILFRPSSAVLLEKAFGAREITLLNPIWIHSKNSGKPFYAILHRIDVGIVIDLEPARTEDPALSIAGAVQSQKLAVRAISQLQSLPGGDIKLLCDTVVDSVRELTGYDRVMVYKFHEDEHGEVVAENKRVDLEPYIGLHYPSTDIPQASRFLFKQNRVRMIVDCHAIPVSVIQDEGLMQPLCLVGSTLRAPHGCHAQYMENMGSIASLAMAVIIYGNDEEAIGGRNSMRLWGLVVCHHTSTRCIPFPLRYACEFLMQAFGLQLNMELQLASQLLEKHVLRTQTLLCDMLLRDSPTGIVTQSPSIMDLVKCDGAALYYQGQYYPLGVTPTEAQIKDIVEWLLTLHGDPTGLSTDSLADAGYPGAAFLGDAVCGMAVAYIAERDFLFWFRSHTAKEVKWGGAKHHPEDKDDGQRMHPRSSFKAFLEVVKSRSLPWENAEMDAIHSLQLILRDSFRDAEATNSKAVVHNQLKDMELQGMDELSSVAREMVRLIETATAPIFAVDVDGRINGWNAKVAELTGLSVEEAMGKSLVHDLVYKEYEEIVDKLIHRAVKGEEDKNVEIKLRTFCSEHQKKAVFVVVNACSSKDYMDNIVGVCFVGQDVTGQKVVMDKYVLIQGDYKAIVHSPNPSIPPIFASDENTCCLEWNTAMEKLTGWSRGEVVGKMLVGEVFGSCCRLKGPDALTKFMIALHNAIGGIDTDKLPFSFFDRNEKNVQTLLTANKRVNIKGDIIGPFCFLQIASPELQPSLKVQKQQEKKSFARMKELAYICQEIKNPLSGIHFTNSLLENTDLTEDQQQFLETSAACEKQILKIIRDIDLESIENGSLELEKAEFLLGSVINAVVSQAMLLLRERNLQLLRDIPEEIKTLAVYGDQARIQQVLADFLLNMVRYAPSSAGWVEIHVCPTLKQISDGHTLVHTEFRYLERVLQTRMLGLQHPLRSFLNCKLTLVMLHREGMVPKIQFQGLSVCQGRLIWLSFPENTTVALYPLTIWFLLLHRHQSRSITHT

SEQ ID NO: 3268 - protein, 183 aa, Arabidopsis thaliana
MSGNKEEEDPRIHGIKTKIRVVPDFPKKGIMFQDITTVLLDPKAFKDTIDLFVERYRDKNISVVAGIEARGFLFGPPIALAIGAKFVPLRKPKKLPGETIFEEYELEYGNDRLEMHIGAVEAGDRALVVDDLIATGGTLCAAINLLERVGAEVVECACVIELPELKGRQRLKGKPLCMLVEYR

SEQ ID NO: 3269 - protein, 198 aa, Mycoplasma hyopneumoniae 232
MVKCKLFFWLISWFLKVKNGEKVWKFLKSCPENCYSEPQFAFIGRSNVGKSTLINALANKKIAKTSTKPGRTQLLNFYKNESEKLFVDLPGYGYAAVSKTKKHQIDRIIAGYFQKDQPISAVFLILDARVGFTNLDYIMIEYIIQQGFKLHILANKIDKTNQSTRAILLNQCKKLKLNCLLISAKNKNNLSKLQELLE

SEQ ID NO: 3270 - protein, 519 aa, Mycobacterium sp. MCS
MNSPSPRPVLVVDFGAQYAQLIARRVREARVFSEVVPHTATVEEIKAKDPQAIVLSGGPASVYADGAPQLDPALFDLDVPVFGICYGFQAMAQALGGTVTHTGTREYGRTELKVAGGELHSDLPAVQPVWMSHGDAVTEAPSGFEVVATSAGAPVAAFENRARRLAGVQYHPEVLHSPHGQQVLSRFLHEFAGIGAKWTPANIADALVEQVREQIGDGRAICGLSGGVDSAVAAALVQRAIGDRLTCVFVDHGLLRSGERAQVQRDFVAATGANLVTVDVADRFLQELSGVTNPEGKRKIIGREFISAFDDAVVDIVGDSGAPVEFLVQGTLYPDVVESGGGSGTANIKSHHNVGGLPADLKFKLVEPLRLLFKDEVRAVGRELGLPEDIVARQPFPGPGLGIRIVGEVTRGRLETLRHADAIAREELTAAGLDNQIWQCPVVLLADVRSVGVQGDGRTYGHPIVLRPVSSEDAMTADWTRVPYEVLERISTRITNEVPEVNRVVLDVTSKPPGTIEWE

SEQ ID NO: 3271 - protein, 1146 aa, Populus tremula
MASQSQRQSNQPAHNQAQSSGTSNMRQHHHPTESVSKAIAQYTVDAQLHAVFEQSGGTGKSFDYSKSVRTPNQSLPEEQITAYLSKIQRGGHIQPFGCMSAADEQSFRVIAYSENAKDMLGLTPQSVPSLEKQEILFVGADVRILFRPSSAVLLEKAFGAREITLLNPIWIHSKNSGKPFYAILHRIDVGIVIDLEPARTEDPALSIAGAVQSQKLAVRAISQLQSLPGGDIKLLCDTVVDSVRELTGYDRVMVYKFHEDEHGEVVAENKRVDLEPYIGLHYPSTDIPQASRFLFKQNRVRMIVDCHAIPVSVIQDEGLMQPLCLVGSTLRAPHGCHAQYMENMGSIASLAMAVIIYGNDEEAIGGRNSMRLWGLVVCHHTSARCIPFPLRYACEFLMQAFGLQLNMELQLASQLLEKHVLRTQTLLCDMLLRDSPTGIVTQSPSIMDLVKCDGAALYYQGQYYPLGVTPTEAQIKDIVEWLLTLHGDPTGLSTDSLADAGYPGAAFLGDAVCGMAVAYIAERDFLFWFRSHTAKEVKWGGAKHHPEDKDDGQRMHPRSSFKAFLEVVKSRSLPWENAEMDAIHSLQLILRDSFRDAEATNSKAVVHTQLKDMELQGMDELSSVAREMVRLIETATAPIFAVDVDGRINGWNAKVAELTGLSVEEAMGKSLVHDLVYKEYEEIVDKLIHRAVKGEEDKNVEIKLRTFCSEHQKKAVFVVVNACSSKDYMDNIVGVCFVGQDVTGQKVVMDKYVLIQGDYKAIVHSPNPSIPPIFASDENTCCLEWNTAMEKLTGWSRGEVVGKMLVGEVFGSCCRLKGPDALTKFMIGLHNAIGGIDTDKLPFSFFDRNEKNVQTLLTANKRVNMKGDIIGAFCFLQIASLELQPSLKVQKQQEKKSFARMKELAYICQEIKNPLSGIHFTNSLLENTDLTEDQQQFLETSAACEKQILKIIRDIDLESIENGSLELEKAEFLLGSVINAVVSQAMLLLRERNLQLLRDIPEEIKTLAVYGDQARIQQVLADFLLNMVRYAPSSAGWVEIHVCPTLKQISDGHTLVHTEFRYLERVLQTRMLGLQHPLRSFLNCKLTLVMLHREGMVPKIQFQGLSVCQGRLIWLSFPENTTVALYPLTIWFLLLHRHQSRSITHT

SEQ ID NO: 3272 - protein, 192 aa, Corynebacterium efficiens
MDSGRDSGNDSGSVNMARARVALTEHTRYVHDFPAEGVLFEDLTPVLANAEAFAAVVDAQAEAAEELGAEIIGGLDARGFLLGSAVAYKLGLGVIAIRKKGKLPPPVVTQDYDLEYGSAALELPAEGLDLEGRRVVLIDDVLATGGTLAAARKLIETCGGNVTGYVLAIEVGGLGGRERLGDIPVHVIRDPQ

SEQ ID NO: 3273 - protein, 201 aa, Oryza sativa
  misc_feature (87)..(87): Xaa can be any naturally occurring amino acid
  misc_feature (107)..(107): Xaa can be any naturally occurring amino acid
MAAWSMASLMIVAAIFLLSLTSASVVHGRSSRRRFVRSYDEPCMEMRLYLHDILYDYSNSTTNSTSAAATKPTALSTAVSSPGYFFXGRVVVFNDPMTEGRALPPSXEETAVKAHGLYLLDKKDDFSAWFAFSIVFNSTARRGTLNLMGADPNAATRDISVVGGTGDFLMSRGVATLRTDAIEGFKYFRVQMDIKLYECYV

SEQ ID NO: 3274 - protein, 549 aa, Zea mays
  misc_feature (302)..(302): Xaa can be any naturally occurring amino acid
  misc_feature (399)..(399): Xaa can be any naturally occurring amino acid
MAAPPEGNVRLGEGWDEDDVLEPQPLEVIAPDVKSKKRNPAPGVRVVGRRIYDPENGKTCHQCRQKTTDFAAACKQVKKKGPCPVKYCLKCLLNRYGESAEEAAGKEDWICPKCRGICNCSFCRKKKGEMPTGIMAHIAKASGCTSVHDLLKKGSDVVSAAQAILKVNGSDKGTKRSRGTDAAAEVATEKDVNIGIDINTVIADEGDENIGVDLNSLPSVDTKKRQKRQKLKHRTKKDPADATSHGVNTEPLQMDGNLDFLNSKTVRPRGTPVTKIAGAELDDEDTGAAIQFIEFCRAFTEXSKIFQIKKGQPEKILQDLVGGRELRFVSSVVAGFHINLLSVIQEGKGKKPLAYTRDGDAWVIDIGKYISESASISKGFPLNHINQGISGYKNLSPSXKLRNWIDMQNDIAAEPVNAAREKARAAKEMVKELKERLKDNMNKIIVSPNEAAASNSEANKYIISQIKEAQEVKRAAINDMATMEKQGGFWTKPLMVEKGAAYWKLDGYCDNSAILLQEYGGDELMANKDKWFMFTEDEEKIIEKHLATR

SEQ ID NO: 3275 - protein, 468 aa, Neorickettsia sennetsu str. Miyayama
MTNNRAASILEFVAKNEIRFIDFRFTSITGKFLHITRHSDSITADALTHGISLDSSLIQGWHDVDRSDVVLVPDLESCSSFLDPFAAQPTLCVVCDIVEPHGRGSYEHSPRATTKKAMEFLRSIGIADKAFFGLEMEFFVLDDARFAVKENGAFFELDSSEGIYNSGRRYEYNNHAHREGSRNCYLASQPSDSLNDIRAEILETLREVKIKPLLHHHGAASSQCRICFHHGEALETSDNMQKCKYITRNVASSYGKSATFMPKPFKDYNGNGMRLHVSLWKDEQNLFVPQDPREEISQLCKYYIGGIIKHRKALNAILNPLANSYKRLADIHNASYGLGYSPENRLAVVRIPHCRKGNPSGKRIEIRFPDAGTNPYIGTAALIMAGIAGIREKVLPEAAVELEKSSKVSLCRSLEEALLALDTDRQFLTEGDVFTNDQLDTYIKLLSDDSEEVSKHPVPIEFIKYYNV

SEQ ID NO: 3276 - protein, 82 aa, Arabidopsis thaliana
PKPRIIFYPNDKGEVIFEGNHEGPRFPTPNPMVTSYSREVESLDLLPRNYPELSHSNQDGPRPKIASEPEFMKNQWTRFDFL

SEQ ID NO: 3277 - protein, 100 aa, Triticum aestivum
  misc_feature (49)..(49): Xaa can be any naturally occurring amino acid
FGARWLRASSKQLLDPEEVDVVPAADRERGVTPVEFRLVKIHMSFRCIXIISDIWRLAQQVKVRQRVIATAITYFRRVYTRKSMTEYDPRLVAPACLYLA

SEQ ID NO: 3278 - protein, 502 aa, Aspergillus oryzae
MSDVTVQLTAPNGRKYAQPIGLFINNEFVPSKSGEKFATINPADEKEIASVYAAGEEDIDIAVKAARKAFKDPSWKLLPPTDRGALMLKLADLIEQHREILATIETWDNGKPYSVSLSSDLGEVINTLRYYAGWADKVHGQTISTTPDKLAYTLRQPIGVVGQIIPWNFPLAMAAWKLGPALACGNTIVMKPAEQTPLSILYLATLIKEAGFPPGVINIVNGLGRVAGSALVTHPDVDKVAFTGSTLTGREVMKLAAGTLKNITLETGGKSPLVVFGDADIEQAAKWAHIGIMYNQGQVCTATSRILVHESIYDKFIELFKQEVASVSKVGDPFADDTFQGPQVTKAQYDRVLSYIEAGKSEGATLVAGGEPYKNVGDGKGFFIAPTIFTNVKDNMRIYREEVFGPFVVISSFAAEDEAVTRANDTTYGLGAAIFTKDIERAHRVASEIEAGMVWINSSNDSDFRVPFGGIKQSGIGRELGEAGLEAYSQVKAIHVNLGSKL

SEQ ID NO: 3279 - protein, 247 aa, Chlamydomonas reinhardtii
MAEANSRELALYSAKIAEQSERYQDMVEEMKKVAVLANEQELSVEERNLLSVSYKNLVGSRRASWRILQSIEQSEQAKGNEKRVGMIKRYRAVVEGELDKICHEILDLLDKYLVPSASTTEAAVFYLKMKADYHRYLSEYKTDEAKAAAAELTLAAYKVAQEKADELPTTNPIRLGLALNFSVFYYEVMNQPALACSLAKKAFDEAISDLDSLGEDSYKDSALIMQLLRDNLTLWTSEMQDDDKNRA

SEQ ID NO: 3280 - protein, 244 aa, Zea mays
  misc_feature (159)..(159): Xaa can be any naturally occurring amino acid
ETGEMGKGAQGSDAAAAGGEVEENMAAWLVAKNILKIMPFKLPPVGPYDVRVRMKAVGICGSDVHYLREMRIAHFVVKEPMVIGHECAGVVEEVGAGVTHLSVGDRVALEPGVSCWRCRHCKGGRYNLCEDMKFFATPPVHGSLANHVVHPADLCFKLXDGVSLEEGALCDPLSVGVLACLRAVVGPRTGVLLGGARPLGLVPLLAARAFRAPLRGGSLLSFYLFFPVYFFRFRPLVPGAVPPV

SEQ ID NO: 3281 - protein, 388 aa, Methanosarcina barkeri str. Fusaro
MATTRDYYDILGLSKDASSEDIKKTYRKLALKYHPDRNKEPGAEEKFKEISEAYAVLSDDEKRAQYDRFGHAGINGQYSAEDIFRGADFGGFGDIFEMFFGGGGRRGPMGPRRGSDLQYDLYITFEEAAFGVRKDIDIPRTERCSNCSGTGAKPGTSPKRCPTCGGTGQIRTTRSGLGMQFVSTTTCNTCHGRGQVIESPCPVCSGTGRVRNTRKITVNVPAGADSGMNLRLSGEGDSGEPGAPSGDLYVVLHVMEHPYFKRVDYDVISELPISFAQAALGTDIMVDTLHGKVKMNIPAGTQTHSVFRLKDKGIQRLHGSRKGDQLVRVVIKTPKKLTHEQKELLRQFEALSNGKNPNEDEKDRNEKSTEKSRKSKGFFEKVKDAFEG

SEQ ID NO: 3282 - protein, 1146 aa, Populus tremula
MASQSQRQSNQPAHNQVQSSGTSNMRQHHHPTESVSKAIAQYTVDAQLHAVFEQSGGTGKSFDYSKSVRTPNQSVPEEQITAYLSKIQRGGHIQPFGCMIAADEQSFRVIAYSENAKDMLGLTPQSVPSLEKQEILFVGADVRILFRPSSAVLLEKAFGAREITLLNPIWIHSKNSGKPFYAILHRIDVGIVIDLEPARTEDPALSIAGAVQSQKLAVRAISQLQSLPGGDIKLLCDTVVDSVRELTGYDRVMVYKFHEDEHGEVVAENKRVDLEPYIGLHYPSTDIPQASRFLFKQNRVRMIVDCHAIPVSVIQDEGLMQPLCLVGSTLRAPHGCHAQYMENMGSIASLAMAVIIYGNDEEAIGGRNSMRLWGLVVCHHTSARCIPFPLRYACEFLMQAFGLQLNMELQLASQLLEKHVLRTQTLLCDMLLRDSPTGIVTQSPSIMDLVKCDGAALYYQGQYYPLGVTPTEAQIKDIVEWLLTLHGDPTGLSTDSLADAGYPGAAFLGDAVCGMAVAYIAERDFLFWFRSHTAKEVKWGGAKHHPEDKDDGQRMHPRSSFKAFLEVVKSRSLPWENAEMDAIHSLQLILRDSFRDAEATNSKAVVHNQLKDMELQGMDELSSVAREMVRLIETATAPIFAVDVDGRINGWNAKVAELTGLSVEEAMGKSLVHDLVYKEYEEIVDKLIHRAVKGEEDKNVEIKLRTFCSEHQKKAVFVVVNACSSKDYMDNIVGVCFVGQDVTGQKVVMDKYVLIQGDYKAIVHSPNPSIPPIFASDENTCCLEWNTALEKLTGWSRGEVVGKMLVGEVFGSCCKLKGPDALTKFMIALHNAIGGIDTDKLPFSFFDRNEKNVQTLLTANKRVNMKGDIIGAFCFLQIASPELQPSLKVQKQQEKKSFARMKELAYICQEIKNPLSGIHFTNSLLENTDLTEDQQQFLETSAACEKQILKIIRDIDLESIENGSLELEKAEFLLGSVINAVVSQAMLLLRERNLQLLRDIPEEIKTLAVYGDQARIQQVLADFLLNMVRYAPSSAGWVEIHVCPTLKQISDGHTLVHTEFRYLERVLQTRMLGLQHPLRSFLNCKLTLVMLHREGMVPKIQFQGLSVCQGRLIWLSFPENTTVALYPLTIWFLLLHRHQSRSITHT

SEQ ID NO: 3283 - protein, 320 aa, Escherichia coli O157:H7 EDL933; identical to SEQ ID NO: 1192

SEQ ID NO: 3284 - protein, 1146 aa, Populus tremula
MASQSQRQSNQPAHNQAQSSGTSNMRQHHHPTESVSKAIAQYTVDAQLHAVFEQSGGTGKSFDYSKSVRTPNQSVPEEQITAYLSKIQRGGHIQPFGCMIAADEQSFRVIAYSENAKDMLGLTPQSVPSLEKQEILFVGADVRILFRPSSAVLLEKAFGAREITLLNPIWIHSKNSGKPFYAILHRIDVGIVIDLEPARTEDSALSIAGAVQSQKLAVRAISQLQSLPGGDIKLLCDTVVDSVRELTGYDRVMVYKFHEDEHGEVVAENKRVDLEPYIGLHYPSTDIPQASRFLFKQNRVRMIVDCHAIPVSVIQDEGLMQPLCLVGSTLRAPHGCHAQYMENMGSIASLAMAVIIYGNDEEAIGGRNSMRLWGLVVCHHTSARCIPFPLRYACEFLMQAFGLQLNMELQLASQLLEKHVLRTQTLLCDMLLRDSPTGIVTQSPSIMDLVKCDGAALYYQGQYYPLGVTPTEAQIKDIVEWLLTLHGDPTGLSTDSLADAGYPGAAFLGDAVCGMAVAYIAERDFLFWFRSHTAKEVKWGGAKHHPEDKDDGQRMHPRSSFKAFLEVVKSRSLPWENAEMDAIHSLQLILRDSFRDAEATNSKAVVHNQLKDMELQGMDELSSVAREMVRLIETATAPIFAVDVEGRINGWNAKVAELTGLSVEEAMGKSLVHDLVYKEYEEIVDKLIHRAVKGEEDKNVEIKLRTFCSEHQKKAVFVVVNACSSKDYMDNIVGVCFVGQDVTGQKVVMDKYVLIQGDYKAIVHSPNPSIPPIFASDENTCCLEWNTAMEKLTGWSRGEVVGKMLVGEVFGSCCRLKGPDALTKFMIALHNAIGGIDTDKLPFSFFDRNEKNVQTLLTANKRVNMKGDIIGAFCFLQIASPELQPSLKVQKQQEKKSFARMKELAYICQEIKNPLSGIHFTNSLLENTDLTEDQQQFLETSAACEKQILKIIRDIDLESIENGSLELEKAEFLLGSVINAVVSQAMLLLRERNLQLLRDIPEEIKTLAVYGDQARIQQVLADFLLNMVRYAPSSAGWVEIHVCPTLKQISDGHTLVHTEFRYLERVLQTRMLGLQHPLRSFLNCKLTLVMLHREGMVPKIQFQGLSVCQGRLIWLSFPENTTVALYPLTIWFLLLHRHQSRSITHT

SEQ ID NO: 3285 - protein, 502 aa, Oryza sativa (indica cultivar-group)
MPGAVIVHHHTRYKTYPGEVTGFVFFCCLIASVGGCIFGYDIGLTAGLTSTESFLAMFFPVIFEQQQERVITNQYCKLDSQVLTLFGSSLFLSAMVAGIFASPMSRAFGRKWTLFVAAVAYLIGAILGAISFNFIVLLTGRLLLGVGVGVCIHASPLYISEMAPAQQRGMLNILFQLMITVGILSASLTTYWTSKIAGGWGWRVGLAFGTVPAAVIALGSLAIPDTPVSLIARGEGEAARATLAKIRGVDDVRAEFEDLTTASEESKAVAHPWRELFFGGRYKPQLAFAVLIPFFQQLTGINVIMFYAPVLFKTVGFRQDASLVSSVITGLVNVFSTFVAVMTADKILVGTFIGLQFGVSGTGAMSEQYAMCIVLFVCVYVAGFAWSWGPMGWLIPSEVYPLAVRSAAQSVTVAVNMFFTAFISQIFLTLLCHLRFGLFYFFGAWVLLMTVFIATLLPETKCVPLEEVAHVWRKHWFWRKFIVDSPDRGGAEMRKRIALEMS

SEQ ID NO: 3286 - protein, 398 aa, Thalassiosira pseudonana
MTVKKKNLLKKIKNFTINFGPQHPAAHGVLRLVLELNGEIVNRADPHIGLLHRGTEKLIEYKNYVQALPYFDRLDYVSMMAQEHSYCLAIEKLFNCKIPERAQYIRVLFAEITRILNHLLAVGCHAMDVGAMTPFLWAFEEREKLMEFYERVSGARMHAAYFRPGGLQVDIPKGLLDDIYMFIEQFTLRLTEMEDMLTENRIWKQRLVDIGVVTAKDACQWGFSGVMLRGSGINWDLRKSQPYEVYEKLEFDIPVGTNGDCYDRYLIRVFEMKESLKIIEQCLNLMPAGYVKTNDFKISPPTRVEMKQSMEALIHHFKMYTQGVIIPSNETYIGTEAPKGEFGVYLISDNTNRPYRCKIKAPGFNHLQALDFMSKGHLIADVVTIIGTQDIVFGEVDR

SEQ ID NO: 3287 - protein, 1146 aa, Populus tremula
MASQSQRQSNQPAHNQAQSSGTSNMRQHHHPTESVSKAIAQYTVDAQLHAVFEQSGGTGKSFDYSKSVRTPNQSVPEEQITAYLSKIQRGGHIQPFGCMIAADEQSFRVIAYSENAKDMLGLTPQSVPSLEKQEILFVGADVRILFRPSSAVLLEKAFGAREITLLNPIWIHSKNSGKPFYAILHRIDVGIVIDLEPARTEDPALSIAGAVQSQKLAVRAISQLQSLPGGDIKLLCDTVVDSVRELTGYDRVMVYKFHEDEHGEVVAENKRVDLEPYIGLHYPSTDIPQASRFLFKQNRVRMIVDCHAIPVSVIQDEGLMQPLCLVGSTLRAPHGCHAQYMENMGSIASLAMAVIIYGNDEEAIGGRNSMRLWGLVVCHHTSARCIPFPLRYACEFLMQAFGLQLNMELQLASQLLEKHVLRTQTLLCDMLLRDSPTGIVTQSPSIMDLVKCDGAALYYQGQYYPLGVTPTEAQIKDIVEWLLTLHGDPTGLSTDSLADAGYPGAAFLGDAVCGMAVAYIAERDFLFWFRSHTAKEVKWGGAKHHPEDKDDGQRMHPRSSFKAFLEVVKSRSLPWENAEMDAIHSLQLILRDSFRDAEATNSKAVVHTQLKDMELQGMDELSSVAREMVRLIETATAPIFAVDVEGRINGWNAKVAELTGLSVEEAMGKSLVHDLVYKEYEEIVDKLIHRAVKGEEDKNVEIKLRTFCSEHQKKAVFVVVNACSSKDYMDNIVGVCFVGQDVTGQKVVMDKYVLIQGDYKAIVHSPNPSIPPIFASDENTCCLEWNTAMEKLTGWSRGEVVGKMLVGEVFGSCCRLKGPDALTKFMIALHNAIGGIDTDKLPFSFFDRNEKNVQTLLTANKRVNMKGDIIGAFCFLQIASPELQPSLKVQKQQEKKSFARMKELAYICQEIKNPLSGIHFTNSLLENTDLTEDQQQFLETSAACEKQILKIIRDIDLESIENGSLELEKAEFLLGSVINAVVSQAMLLLRERNLQLLRDIPEEIKTLAVYGDQARIQQVLADFLLNMVRYAPSSAGWVEIHVCPTLKQISDGHTLVHTEFRYLERVLQTRMLGLQHPLRSFLNCKLTLVMLHREGMVPKIQFQGLSVCQGRLIWLSFPENTTVALYPLTIWFLLLHRHQSRSITHT

SEQ ID NO: 3288 - protein, 255 aa, Escherichia coli O157:H7 EDL933
MRHPLVMGNWKLNGSRHMVHELVSNLRKELAGVAGCAVAIAPPEMYIDMAKREAEGSHIMLGAQNVDLNLSGAFTGETSAAMLKDIGAQYIIIGHSERRTYHKESDELIAKKFAVLKEQGLTPVLCIGETEAENEAGKTEEVCARQIDAVLKTQGAAAFEGAVIAYEPVWAIGTGKSATPAQAQAVHKFIRDHIAKVDANIAEQVIIQYGGSVNASNAAELFAQPDIDGALVGGASLKADAFAVIVKAAEAAKQA

SEQ ID NO: 3289 - protein, 596 aa, Prochlorococcus marinus str. MIT 9515
MIKVEKVKKKKKIEKQETVCLANGLEVSKFENFKKGSEFLKEPLASELKNESDHFTNDAVQLLKFHGSYQQDNRENRKPGKGKDWQMMLRLRSPGGEIPGKLFLSLDELSDKLGNGTLRITTRQAFQMHGIRKDNLKKVIKSIVNSMGSTLAACGDINRNVMAPAAPFETSEYITARTLAVKVADLLTPVAGQGTFLELWADGDLEYTIKPDKEIEENRKLQFKENVFSGSKKEPLYGSTYLPRKFKCAVTVPGDNSVDLLTNDIGIVAFTSKEGEFEGCNFYIGGGMGRTHNNEETFARIADPLGYVDKKDIYELIQSIVAIQRDYGDRKSRKNSRMKYLLHRKGIKWFKKILLDKYFRKEIKPLRKEPENKLIDYLGWHKQNEDYYFVGLPLLSGRLYGKKKSLIRNIVKENNLDLRLTPNQDILLCNIPKKNKREIQKALKSIGYDNLHDINEIQRHALACPALPLCGLAMTEAERILPEVLSRIENLLNDMNIEKTILFRMTGCPNGCTRPYMAELALVGSGQNKYQLWLGGSKNLQRLARPYLQRMDLDDLEKTIKPLLEFWKKSNPEKDFGDFINNETDSSINNLLIEFD

SEQ ID NO: 3290 - protein, 346 aa, Triticum aestivum
  misc_feature (154)..(154): Xaa can be any naturally occurring amino acid
  misc_feature (161)..(161): Xaa can be any naturally occurring amino acid
  misc_feature (174)..(174): Xaa can be any naturally occurring amino acid
  misc_feature (187)..(187): Xaa can be any naturally occurring amino acid
  misc_feature (223)..(223): Xaa can be any naturally occurring amino acid
MPNDSVLSLFFFVTLFTCLLSATSHDDHIFLPSQLHDDDSVSCTATDPSLNYKPVIGILTHPGDGASGRLSNATGVSYIAASYVKFVESGGARVIPLIYNESPENLNKKLDLVNGVLFTGGWAVSGPYLDTLGNIFKKALEKNDAGDHFPVIAXFNLGGNXLVIRIVSEQTDIXLEPFTASSLPSSXLVLWREANAKGSLFQRFPSDLLTQLKTDCLALHNHXYAISPRKLQYNTKLSDFFEILATSEDRDGKTFVSTARGRKYPVTVNLWQPEKNAFEWATSLKAPHTEDAIRVTQSTANFFISEARKSTNTPDAQKVRDNLIYNYKPTFGGTAGKGYDQVYLFE

SEQ ID NO: 3291 - protein, 1146 aa, Populus tremula
MASQSQRQSNQPAHNQAQSSGTSNMRQHHHPTESVSKAIAQYTVDAQLHAVFEQSGGTGKSFDYSKSVRTPNQSVPEEQITAYLSKIQRGGHIQPFGCMIAADEQSFRVIAYSENAKDMLGLTPQSVPSLEKQEILFVGADVRILFRPSSAVLLEKAFGAREITLLNPIWIHSKNSGKPFYAILHRIDVGIVIDLEPARTEDPALSIAGAVQSQKLAVRAISQLQSLPGGDIKLLCDTVVDSVRELTGYDRVMVYKFHEDEHGEVVAENKRVDLEPYIGLHYPSTDIPQASRFLFKQNRVRMIVDCHAIPVSVIQDEGLMQPLCLVGSTLRAPHGCHAQYMENMGSIASLAMAVIIYGNDEEAIGGRNSMRLWGLVVCHHTSARCIPFPLRYACEFLMQAFGLQLNMELQLASQLLEKHVLRTQTLLCDMLLRDSPTGIVTQSPSIMDLVKCDGAALYYQGQYYPLGVTPTEAQIKDIVEWLLTLHGDPTGLSTDSLADAGYPGAAFLGDAVCGMAVAYIAERDFLFWFRSHPAKEVKWGGAKHHPEDKDDGQRMHPRSSFKAFLEVVKSRSLPWENAEMDAIHSLQLILRDSFRDAEATNSKAVVHTQLKDMELQGMDELSSVAREMVRLIETATAPIFAVDVDGRINGWNAKVAELTGLSVEEAMGKSLVHDLVYKEYEEIVDKLIHRAVKGEEDKNVEIKLRTFCSEHQKKAVFVVVNACSSKDYMDNIVGVCFVGQDVTGQKVVMDKYVLIQGDYKAIVHSPNPSIPPIFASDENTCCLEWNTAMEKLTGWSRGEVVGKMLVGEVFGSCCRLKGPDALTKFMIALHNAIGGIDTDKLPFSFFDRNEKNVQTLLTANKRVNIKGDIIGAFCFLQIASPELQPSLKVQKQQEKKSFARMKELAYICQEIKNPLSGIHFTNSLLENTGLTEDQQQFLETSAACEKQILKIIRDIDLESIENGSLELEKAEFLLGSVINAVVSQAMLLLRERNLQLLRDIPEEIKTLAVYGDQARIQQVLADFLLNMVRYAPSSAGWVEIHVCPTLKQISDGHTLVHTEFRYLERVLQTRMLGLQHPLRSFLNCKLTLVMLHREGMVPKIQFQGLSVCQGRLIWLSFPENTTVALYPLTIWFLLLHRHQSRSITHT

SEQ ID NO: 3292 - protein, 123 aa, Oryza sativa
MQQDLTHLCINTIRALSADQPQAANSGHPGAPMGMAPMAHILWTEFMQFNPANPRWVNRDRFVLSNGHACALLYSMLHLTGHDMTIDDLKKFRKVGSKTPGHPESFETPGVEVTTGPLGQGLS

SEQ ID NO: 3293 - protein, 1146 aa, Populus tremula
MASQSQRQSNQPAHNQAQSSGTSNMRQHHHPTESVSKAIAQYTVDAQLHAVFEQSGGTGKSFDYSKSVRTPNQSVPEEQITAYLSKIQRGGHIQPFGCMIAADEQSFRVIAYSENAKDMLGLTPQSVPSLEKQEILFVGADVRILFRPSSAVLLEKAFGAREITLLNPIWIHSKNSGKPFYAILHRIDVGIVIDLEPARTEDPALSIAGAVQSQKLAVRAISQLQSLPGGDIKLLCDTVVDSVRELTGYDRVMVYKFHEDEHGEVVAENKRVDLEPYIGLHYPSTDIPQASRFLFKQNRVRMIVDCHAIPVSVIQDEGLMQPLCLVGSTLRAPHGCHAQYMENMGSIASLAMAVIIYGNDEEAIGGRNSMRLWGLVVCHHTSARCIPFPLRYACEFLMQAFGLQLNMELQLASQLLEKHVLRTQTLLCDMLLRDSPTGIVTQSPSIMDLVKCDGAALYYQGQYYPLGVTPTEAQIKDIVEWLLTLHGDPTGLSTDSLADAGYPGAAFLGDAVCGMAVAYIAERDFLFWFRSHTAKEVKWGGAKHHPEDKDDGQRMHPRSSFKAFLEVVKSRSLPWENAEMDAIHSLQLILRDSFRDAEATNSKAVVHTQLKDMELQGMDELSSVAREMVRLIETATAPIFAVDVDGRINGWNAKVAELTGLSVEEAMGKSLVHDLVYKEYEEIVDKLIHRAVKGEEDKNVEIKLRTFCSEHQKKAVFVVVNACSSKDYMDNIVGVCFVGQDVTGQKVVMDKYVLIQGDYKAIVHSPNPSIPPIFASDENTCCLEWNTAMEKLTGWSRGEVVGKMLVGEVFGSCCRLKGPDALTKFMIALHNAIGGIDTDKLPFSFFDRNEKNVQTLLTANKRVNIKGDIIGAFCFLQIASPELQPSLKVQKQQEKKSFARMKELAYICQEIKNPLSGIHFTNSLLENTDLTEDQQQFLETSAACEKQILKIIRDIDLESIENGSLELEKAEFLLGSVINAVVSQAMLLLRERNLQLLRDIPEEIKTLAVYGDQARIQQVLADFLLNMVRYAPSSAGWVEIHVCPTLKQISDGHTLVHTEFRYLERVLQTRMLGLQHPLRSFLNCKLTLVMLHREGMVPKIQFQGLSVCQGRLIWLSFPENTTVALYPLTIWFLLLHRHQSRSITHT

SEQ ID NO: 3294 - protein, 499 aa, Legionella pneumophila str. Lens
MIRNSMKSHTELLSWSLLQKEAKRVRLNSDSQPRVVPDSNNYESRKQINCIVYDYSRQRVNRTIIDLLIDLANEVKLPEKIDNLINGKKINISENRPALHTALRDLSNKSILIDGLDIMSEVVSTREKIRMISNRIREKKWLGYSGLPITDVVNIGIGGSDLGPRVCIHALSNYVSKEFNYHFISDVDPASFNDVIVKINPETTLFIVSSKSFTTKETLLNARKAFALYEDRASIDQHFIAVTAHPERAHQIGIKTVLPIWDWVGGRFSFCSAVNLITAIAIGYEQFVELLAGAHDVDTHVQFTDFKNNIPVLMALIGIWNNNFLNIHNLLILTYSKKLEYFVPYVQQLDMESNGKSIDVNGRMVGYATGPIVWGGLGNQAQHSYFQLLCQGTHRCVGDFITLKTNDEHEINSMCHYKMKVLSEGIQTIENPYGYIPGNMPMNHLILSDCSPYTLGALVALYEHKIFVQSVIWNINPFDQPGIESAKSAHREITLSSEL

SEQ ID NO: 3295 - protein, 501 aa, Burkholderia pseudomallei K96243
MNLAALSTQHQRQSGFLARRQFGNWIDGRAAEPRSGCYLPVVDPATEMTIAEVAASDARDVDAAVAAARRAFDSGDWPRMRPASREKLLHQLAERLERYADELAALETLETGKLIGVARAIDVLGGAEYVRYMAGWATKLEGSTLDTSIAAPAGAEYFAYTRREAVGVVGAIVPWNFPLAIALWKVATALACGCTVVLKPSEETPLTALRLGELAQEAGLPDGVLNIVTGAGAEAGAALAAHPGIDKITFTGSVGVGRAIGHAAVERMARFTLELGGKSPLIVLDDADPDFAAHGAAQGIFFNQGQVCTAGSRVYVQKRLFERVVAGIAAAAEAMKIGSGFDPNTQIGPLVSKRHFERVLGHVDAAKEEGATLVTGGTRALDGGYFVKPTVFVDAAPAMRIVREEVFGPVVTVTPFDTVDDAVRLANDTDFGLAASVWSQNLSHVHRVVPRLKAGIVWVNTHNMLDPNLPFGGFKQSGYGRELGRAALEQFTELKSVCIAH

SEQ ID NO: 3296 - protein, 980 aa, Zea mays
MAAPPKAWKAEYAKSGRASCKSCRSPIAKDQLRLGKMVQASQFDGFMPMWNHARCIFSKKNQIKSVDDVEGIDALRWDDQEKIRNYVGSASAGTSSTAAPPEKCTIEIAPSARTSCRRCSEKITKGSVRLSAKLESEGPKGIPWYHANCFFEVSPSATVEKFSGWDTLSDEDKRTMLDLVKKDVGNNEQNKGSKRKKSENDIDSYKSARLDESTSEGTVRNKGQLVDPRGSNTSSADIQLKLKEQSDTLWKLKDGLKTHVSAAELRDMLEANGQDTSGPERHLLDRCADGMLFGALGPCPVCANGMYYYNGQYQCSGNVSEWSKCTYSATEPVRVKKKWQIPHGTKNDYLMKWFKSQKVKKPERVLPPMSPEKSGSKATQRTSLLSSKGLDKLRFSVVGQSKEAANEWIEKLKLAGANFYARVVKDIDCLIACGELDNENAEVRKARRLKIPIVREGYIGECVKKNKMLPFDLYKLENALESSKGSTVTVKVKGRSAVHESSGLQDTAHILEDGKSIYNATLNMSDLALGVNSYYVLQIIEQDDGSECYVFRKWGRVGSEKIGGQKLEEMSKTEAIKEFKRLFLEKTGNSWEAWECKTNFRKQPGRFYPLDVDYGVKKAPKRKDISEMKSSLAPQLLELMKMLFNVETYRAAMMEFEINMSEMPLGKLSKENIEKGFEALTEIQNLLKDTADQALAVRESLIVAASNRFFTLIPSIHPHIIRDEDDLMIKAKMLEALQDIEIASKIVGFDSDSDESLDDKYMKLHCDITPLAHDSEDYKLIEQYLLNTHAPTHKDWSLELEEVFSLDRDGELNKYSRYKNNLHNKMLLWHGSRLTNFVGILSQGLRIAPPEAPVTGYMFGKGLYFADLVSKSAQYCYVDRNNPVGLMLLSEVALGDMYELKKATSMDKPPRGKHSTKGLGKTVPLESEFVKWRDDVVVPCGKPVPSSIRSSELMYNEYIVYNTSQVKMQFLLKVRFHHKR

SEQ ID NO: 3297 - protein, 349 aa, Mesorhizobium sp. BNC1
MVKPTSRLGRTIFVNESNLLKNGSGTLCPIDPEISLFLERLREGWSRHPPLSAVSSAEARWIAEIVREPFRQGGPVMAETLELLIPTRHGDMRARLYDPGLGEDAPVLIYLHGGGFTLFSINTHDRLMREYAHAARVKVLGLDYYLAPEHKYPVALDQVEDTLEWIGSANLGVDMQRLALGGDSAGGNLSLAAAIRMRDKGRPAAVKGLLFNYAGFATDCSDEAEALHGGPGSVMDRDEVRSFIRNYTRSPEDMKNPEVNLLDANVDHLPPSFFVIADRDIIAENSLAMAGKLRAAGNAMTCKIYRGATHSFLEAMSMSALARQAIADGADFIARILNTDAKYGLRAAS

SEQ ID NO: 3298 - protein, 386 aa, Gibberella zeae PH-1
MSRILRPAARLAASTRAIRAPVAPSVAQSAISRAALARPVVFGSAQTRSYADNSSGVKEYTVRDALNEALAEELDQNEKVFILGEEVAQYNGAYKVTKGLLDRFGDKRVIDTPITESGFCGLAVGAALSGLHPVCEFMTFNFAMQAIDQVINSAAKTLYMSGGIQPCNITFRGPNGFAAGVAAQHSQDYSAWYGSIPGLKVVSPWSAEDAKGLLKAAIRDPNPVVVLENELMYGQSFPMSEAAQKDDFVIPFGKAKIERSGKDLTIVSLSRTVGQSLIAAENLKKKYGVEAEVINLRSIKPLDVETIIQSVKKTHRLLSVESGYPAFGVGSEILALTMEYGFDYLDAPAARVTGAEVPTPYAQKLEEMSFPTEKLIEDYAAKVLRL

SEQ ID NO: 3299 - protein, 619 aa, Aspergillus oryzae
MSNPSQSFEPNRRATTYGRPEELHIPSGGMGAANLQRQSMSHEFPATADNHVPSINVHPTNSQPNQYGAGGNNTALPGALQPGNANRPPAVSINTAPSGIPTLSQMSTQLQQQPQPQPQHQQPPPQQPQPPTTPRSNMSNAHGHSRSSPANARYGSSPGAGFPPHTPQGAKYSPLGLADIRPTGDLLGDPITSPGSLPFNGDNQVPSNSNYIAPWPIYAVDWCKWPIPGNSGSFGGKIALGSYLEDNHNYIQIIDTHWTKPDPDTPDAATGEIKLEYVKTAEATHSYPVTRILWEPPSSQKQSTDLLATSGDHLRLWSLPANQPVQSSNSITRSATQRDTPSAKLSPLALLSNSKSPEHTAPITSLDWNTISPSLIITSSIDTTCTIWDIPTLTAKTQLIAHDKEVYDVRFCANSVDVFVSCGADGSVRMFDLRSLEHSTIIYEPTEKSDKRVSSTVVSPGNGSPSAPASIWPPPLLRIAASPHDAHLLATFSQDSNIVRVLDVRQPGQALLELKGHGSSINCVEWSPNRRGLLASGADDCCVLLWDLMNQHNAASVPPPVHTPGAPSATQERGPAAAWQCDYEVSNISWSPQGGTTGAGHPRDWLGVCGGRGVWGVAL

SEQ ID NO: 3300 - protein, 444 aa, Oryza sativa (japonica cultivar-group)
MDPCPFVRVLVGNLALRMPVAPPAAGAGAGVHPSTAPCYCKIRLGRMPWQVAAAPLVVADGGEQAPSGALAAAFHLSKADLEWFARKPSLLFSSSSSSRGPATLKVAVYAGRKGTTCGVSSGRLIGKATIPVDLKGAEAKAAVVHSGWICVGKKSGGKGGSAAAELSLTVRAEPDPRFVFEFDGEPECSPQVLQVRGSMKQPMFTCKFGCRSNSDLRRSVVQTERDAAAAAGKERKGWSVTVHDLSGSPVALASMVTPFVASPGTDRVSRSNPGAWLILRPAGDGSWEPWGRLECWRERGGAGASNSLGYRFDLLLPGVDHAVPLAESSIAASKGGKFAIDLTSMQPQSRGGTPGCSPRGSGDFSQWPLASYSYRGFVMSSSVQGEGRCSKPTVEVGVPHVGCAEDAAAFVALAAAVDLSMDACRLFSHKLRKELSHLRSDVLR

SEQ ID NO: 3301 - protein, 458 aa, Acinetobacter sp. ADP1
MTDQHAHELKKGLSNRHVQLIALGGAIGTGLFLGISHTIQLAGPAVLLGYAIAGMIAFLIMRQLGEMVVEEPVSGSFSYFAHKYWSSMAGFMSGWNYWVLYVLVSMAELSAIGIFVQFWWPQIPTWLTALVFFVLINAINLINVRFFGELEFWFSCIKIIAIISMIGFGAYLLLSGTAGAHAGIANLWQHGGFMPNGWTGLIIAMAFIMFAFGGLELVGIAAAETKNPTQTIPKATNQIVYRILIFYIGAIAILLSLYPWNQVAQGGSPFVMIFQSLNNTGVAHVLNMVVLIAAISVYNSCVYSNSRMLLGLAEQGNAPKLLKRVNARGIPVYAVYASVMVTALCVLLNYVMPEKAFNLLMMLVVAALVINWLMISITHLKFRQYMLEAGRKPIFRSLGAPFTNYITIAFVFFILLIMSYTSEMRIAVFLVPVWLGILYIFYRFKAPASKMTESVLDQ

SEQ ID NO: 3302 - protein, 427 aa, Gluconobacter oxydans 621H
MKPCSGQPEQGFAIPHKPFRFQPDIQRSIMIPALMPNYKRADLAFEQGEGVWLTATNGRRYLDFGAGIAVTSLGHAHPKLVKTIAEQAAKVMHVSNLYRIPQAEKLAELLVQNTFADSVLFCNSGAEANEGMVKMIRRAQFENGHPERTNILCFDGAFHGRTLAMISATGNPAYQKGFGPVVEGFDHAPFNNTNTLRDAITPHTAGIVVEPVQGESGIKPATREFMEGLRAVCDEFGLYLGFDEVQTGVGRTGKLFAHEWYGVRPDVISVAKGIGGGFPLGAVLATEELARHLTPGSHGTTFGGNPLACAAGVTVLEEILSPGFLEHVRSVGDAFGKMLEDVVSRSEGVFDNVRGIGLMRGLHCVPPVADVMQAVLNQELLTVSAGDNVLRLVPPLVVTEAECREACERLVKAAHSLKTPTTQENAS

SEQ ID NO: 3303 - protein, 107 aa, Triticum aestivum
MAKLMCLCFIILTIAVAVSADECEGDRQAMIKECAKYQQWPANPKLDPSDACCAVWQKANIPCLCAGVTKEKEKIWCMEKVAYVANFCKKPFPHGYKCGSYTFPPPA

SEQ ID NO: 3304 - protein, 645 aa, Oryza sativa (japonica cultivar-group)
MEPSRRLLLSDYDGAIVSPLPSPPPSSATPFRPGVAVVVGILTSVFSITFLLLLYAKHCKRNAAESSGPYGSGGAFGSSGGGGAGERRNSGVDRAVVESLPVFRFGALRGQKAGLECAVCLGRFEPTEALRLLPKCRHGFHVECVDTWLDAHSTCPLCRSRVDPEDVLLLPEPPKPSTTGPPDPPETKVAAAAAAATAKDKEASLAPAAPAPSPAFRGFFSGRHSTGSVRAPGRVGPASRRSADLVGGDGGAVVGCFEAAKVRKDRVLLMEPAAAVAEPDPEAYDRRFGHRILVSTAGGCEDETAPAAKQRWSEVRPSDLMFVRSEMLVTEAGRVQLETITSRALFLSTIGCYYYPMVNMHVSRRQSGDVIVVRVSLIETWRTTDDDVLSRSSLLGGPDEHDVREHLLDVDGVGEEGAAAAAGPKIRVRGLTRRSEARGEEILRGVDLDVPRGVVVGVIGPSGSGKSTLLRALNRLWEPAPGAVLLDGVDICGIDVLALRRKVGMLFQLPAMFDDKNYFEKYFYCGRNYNYPKLPKVVFEGTVADNVRYGPQLQGKKLTDAEVLLLDEPTSALDPISTQNIEEAIVRLKKTRGLTTVMVSHSVKQIQRIADLVCLLVAGEVVEVLPPSELSEAKHPMARRFLELS

SEQ ID NO: 3305 - protein, 225 aa, Zea mays
  misc_feature (33)..(33): Xaa can be any naturally occurring amino acid
  misc_feature (46)..(46): Xaa can be any naturally occurring amino acid
MGEGYRKGAMPRRRAATCDENMAAWLVAKNTLXLMPFKLPPVRPYXVRVRMKAMGICCSDVHYLREMLIAHFVVNEPMVIRHDCAGVVEEVGACVTHLPVGDRLALDPGVSCCRCRHCYGGRYNLCEDMKFFSTPPVHGSLAIQVVLPADLCFKLPHRVSLDEGAMYYPLSVGVHACLLAPVGPHTGVLMLGACPIGPASMLAGLSFGAHCLVALAGDDSRLAVA

SEQ ID NO: 3306 - protein, 375 aa, Brucella melitensis 16M
MKFKAAVLDRHGVERPYNQTKPLVIREVELREPKADEVLVKLAASGLCHSDLSVINGDRSRQIPMVLGHEAAGVVEKIGEGVTDLVPGDHVVCVFVPNCGHCQPCAEGRPALCEPGAAANGKGEMLSGGLRLFCDDGDVYHHCGVSAYAEYAVMSRYSIIRIEKDIPLHIAALMGCAVLTGTGSIFNTGLVKPGSRVAIAGLGGVGLAAVMGAVAAGATEIIALDMFDDKLALAEQLGATKTFNVQSEGVVEAVKEYTKGGVDAAFEYAGSGAALAMCYALTKRGGEVVTAGLPNPKNMLSIPAVSLVAEEKSIRGSYLGSGVPTRDIPLFLDLYRKGKLPVEKLLTHRIKLEEINEGFERLAAGKAIRQVVEFN

SEQ ID NO: 3307 - protein, 483 aa, Brucella melitensis 16M
MDMQEELMYPNLTLIVGGEERNKGSAGTLCLTDPADGRELTIAPRAGRAEALQAAAAEKGFAEWSALSALERSKIMRRAADIMRERADAAARIMSMEQGKPLSEARGEWLGSADLLDWFAEEGRRVYGRIVPSRAPNIQIQVLKHPIGPVAAFTPWNFPAWNTMQKVAPALGAGCSVVIKPASDTPGTAWLIGKCLLEAGLPPKAVSVIWGTTSELSDALIKAPEIRKVSLTGSTRVGRIVAAQAGEYLKKVTMELGGHGPVIVAADADLDHLIPLAVQWKFRNCGQVCVSPTRFIVEASIHDEFIRRFSEKARELKVGKGVEEGAQMGPLTSQNQLETVLSMVEDALTKGAKIETGGNRIGDTGNFYEPTILSGMTAEMLAMNEEPFGPLALVMRVHSLDEAIAESNRLPVGLGAYLFTSSMTTAHRVQNHLQAGMLGVNHFALALPETPFGGVRDSGFGSEGGLEGIEAYLTTMTVTTMMV

SEQ ID NO: 3308 - protein, 283 aa, Brucella melitensis 16M
MWLAVFIWPDIMITGHTKLYGIVANPIAHVKTPEEVNKHFAALGHDGVLVPFHVLPENLAQFVNSLRKLENLGGLVVTVPHKTAILSLCDRLEGDAAAIGAANVIRRESDGTLVGVMLDGKGFVSGLVASDIDVTGMNACLLGAGGAASAIAFALAEAGVARLTIVNRSEDKARDLAARVSERYPAVQIDAGAPQTASRDLIINATSLGLRAGDPLPLDDLAFHAGQIVAEVIMEPEVTPLLAAARDKGARIHFGRPMLRQQIRLMAEHMGAKANADVQKPTE

SEQ ID NO: 3309 - protein, 290 aa, Methylobacillus glycogenes
MLQGSLVAIVTPMLDDGSLDIQALRSLIDYHIEQKSDGIVVVGTTGESPTVDFDEHALLIKTTVEHSAGRIPVIAGTGANSTSEAIALTRKAKELGADACLLVTPYYNKPTQEGLYQHFQAIAAAVDIPQILYNVPGRTGCDLQNDTVLRLAAIKNIVGIKDATGNIERGTDLILRAPAGFAIYSGDDASSLALLLLGGHGVISVTANAAPRLMHDMCTAALAGDTKAARSANAKLFALHQKLFVEANPIPVKWVLQQMGLIQGGIRLPLVPLSSQFHDTLRSAMKQAAI

SEQ ID NO: 3310 - protein, 215 aa, Capsicum annuum
MNIFRSYYSDPLTESSSSFSDSSIYSPNRAIFSDEEVILASNNPKKPAGRKKFRETRHPVYRGVRKRNSGKWVCEVREPNKKSRIWLGTFPTAEMAARAHDVAAIALRGRSACLNFADSAWRLPVPASSDTKDIQKAAAEAAEALRPLKLEGISKESSSSTPESMFFMDEEALFCMPGLLTNMAEGLMLPPPQCAEIGDHVETADADTPLWSYSI

SEQ ID NO: 3311 - protein, 330 aa, Yersinia pestis KIM
MPKVHAQTMRNDNMTDKLTSLRQITTVVADTGDIAAMKLYQPQDATTNPSIILNAAQIPEYRKLIDEAIAWAREQSSDHAQQIVDATDKLAVNIGLEILKLIPGRISTEVDARLSYDTVASVAKAKRLIKLYNEAGISNDRILIKLASTWQGIRAAEQLEKEGINCNLTLLFSFAQARACAEAGVFLISPFVGRILDWYKANGDQKEFAPSEDPGVVSVTEIYQYYKKHGYKTVVMGASFRNLGEIIELAGCDRLTIAPSLLKELAESEGPVERKLAYTGEIQAKPAPLTEAEFYWQHNQDPMAVDKLADGIRKFAIDQGKLEKMISDLL

SEQ ID NO: 3312 - protein, 613 aa, Candida albicans SC5314
MSIKPLSITVPHPSTQRGHATHISYDPVNERLAYVNGKSVIIRPVDFKSTSPTVVFSKHIFPTTAVKFSPSGYYVASGDEAGNIKIWDASPKSEPDFEQPVIKSEFQVMSGPIRSIAWDADNSRIIAVGQGKEKFGHAFSWDSGNSIGDIQGHSSPINVVDIKPQRPYRAATVGDDHALVFFTGPPFKFDKSLRGNHNNVVRDVKFSPDGEYIVSVGSDRVIAIYQGKTGEFVKKIEKAHEGGIFAVAWLPDSKHFITASADNTLKKWTLDGENTQKFEISSTTSVGNQQVGLALTKEFVVSLSGNGNLNYFDHEGNLVQIVQGHQSPITKVEFHDGFLLSGGSDGKLFKWEVGTDGPKALPVLQDDDEHSNYVVDILTVDDVTYTTGWDDTLKSWRDGKVVSSVKLPSQPKQLGSIKGAVFVLFESALQLYTEVNFQLIAETKFDFTATYAAPTNDTHILITNTTSNTVEEFQVGNGEIRKTSKEFPKSRSPPTFITVSPSREFFAVADSAGKYTLFNTSDGTVVSTRWAFHNSKVFDAKWTSDSKYLISGGLDSSLLLYSVEKPSRVVKYLLAHPSGISSIDWVAYDSEKKTGTFVSAGLDATIRSWNISI

SEQ ID NO: 3313 - protein, 226 aa, Triticum aestivum
HASAHTLRPPLPLPLPLPPTSNRRHHRPPPPPSRSRPRAVRRSELLAGDGMASHGSHPTLLEHMGRTGAPADLAVLVAHIQAACKRIAALVASPGNADLSRAKPAAAGAASAAGRDAPKPLDELSNEIILSSLQSSGKVAVVASEENDLPVWLCDDGPYVVVTDPLDGSRNIEVSIPTGTIFGIYDRLVELDQLPVEEKAQLNSLQSGSRLVAAGYVLYSSATIFC

SEQ ID NO: 3314 - protein, 724 aa, Bradyrhizobium sp. ORS278
MPVPLTTPAFGHATLANCEREQIHLAGSIQPHGILLAVKEPDNVVIQASINAAEFLNTNSVVGRPLRDLGGDLALQILPHLNGPLHLAPMTLRCTVGSPPRRVDCTVHRPSNGGLIVELEPATKTTNVAPALDGAFHRITSSSSLIGLCDETATIFREITGYDRVMVYRFDEEGHGEVLSERRRPDLEAFLGNRYPASDIPQIARRLYERNRVRLLVDVNYTPVPLQPRISPLNGRDLDMSLSCLRSMSPIHQKYLQNMGVGATLVCSLMVSGRLWGLIACHHYEPRFVPFDIRAAGEALAETCAIRIAALESFAQSQSELVVRRLEQRLVEAVSRDGEWQAALFDGSQSLLQPLGASGAALLFEGQVMTAGDVPSTQRIRDLATWLDRRRKAPDAPPQGLTVTASLTLDDPSFADIRSIASGLIAAPLSASEGEYLLWFRPEQVRTVTWGGDPLKAVIIGDDPSDLSPRRSFAQWHQLVEGKSEPWSPAELASARLVSETVADVALQLRSVRMVIAQDQLATISAQVLRSEQPVIIADVEGRILLLNEAFEQQLRASHPHIPHLRDLGAYCTAPAEFRANLDDLMRNKRSWRGELTLTGGATPQRPLMVRADPVIAPHDRVLGFVLIFSDLTERKTAEAARARFQEEIDGARRPSLRLDQSASLIYKELAASTVENAQLAALEVTHGAEAGSMPEMLESIRNSTARTLGILEHLVWYRSQSEE

SEQ ID NO: 3315 - protein, 344 aa, Triticum aestivum
  misc_feature (196)..(196): Xaa can be any naturally occurring amino acid
TLPRRATTPAAVAERPPRPRLPRPAAAGKGKGKMKGDDLSEEDLELKARLEDCVERAQSRDPRLRIGAIDTLRKEIRAATSSMTSAPKQLKFLRAHYGTLKTCFERMQDSEQQKKHPARILPVVPRARSGEGERESLKYCMMGSLVDVCSWGHEYVRNLAFEIGKEWKFNGSSTPIESKINVVLEIVKFHMKHNAXETEALDLLLEVGYLEMLSDEKKEEYLTMLLHLVDSTNYKRACLYLTSCSKYLSTPDHEATLGTAYDMYMKFRDLASALRIALLVDDHKYCGQNVKIKMVFEETKDFSLKQQFAFMIARYGLSVEIDDEMVADENEKNALQEVVCNTKL

SEQ ID NO: 3316 - protein, 223 aa, Acinetobacter sp. ADP1
MSLYATQDEKKQAAAKAALKHLPKGGILGVGTGSTVNFLIELLPELQLEAAVASSEATAKRLKELGIEVVDMNHVGGLDAYVDGADEIDRHMHMIKGGGAALTREKIVASIAKKFVCIVDDSKWVEQLGRDFPLPVEVIPMARSAVARKLVSLGGDPVYREGVVTDNGNVILDVYNLNILNALELEKTINDIPGVVTNGIFALNAASIAIVATNNGIEERTAV

SEQ ID NO: 3317 - protein, 675 aa, Ustilago maydis 521
MSQNIASRRIPLRTRSTASASGAQAKENAGVTSVSSRGARYRHDGAAADAGPSKPASTATAATKASVASAASGVLGTRKRAALGDLTNANRTRSAMAGNDDKGKAALKDAIKPRATTSASTSSRSAVGTAASATTTGTGAARRVVRTRPTTASSTTASTTVTDAASDRPFRASRRVAGTTASTASGIPSATSRPTSTTTATSAVTAARKASMVRASSAGSQTDVRRDVSNTSAVTTNTTAPITAASRSSKVQLNEVHDTDDKMEAPQAKRLKTEQTNKPAKDEGWEDLDAEDADDPLMVAEYVNDIFEYMKELEIINMPNGDYMANQKEINWDVRAILIDWLVDVHAKFRLLPETLYLAVNIIDRFLSRRTISLSKLQLVGVTAMCIASKYEEVMCPSIQNFCHLADGGYTDVEILRAERYMLKVLDFSMSYANPMNFLRRISKADNYDIQTRTVAKYFMEISLLDYRLMEHPPSLIAAASVWLAREVLERGEWTPTLVHYSTYSEQELLGTAEIMLDYCLRPIAHQFFHKKYAHKKFMRASTYVIEWAHKAFPEGVVGVDEQQDLNVLRIDLYERNEIERPEMSPVSSSRATSPVSMHGQAHFEVEPSQNVDGDDTVSYAHDDDHEEEDDLVDDAQEIEGDVQLLDDVKAAAQRQDTRQVLRDVTNAYEATETF

SEQ ID NO: 3318 - protein, 160 aa, Primula vulgaris
FGKVTGDDVAEWGSIGPSVGQDVEEYSSGVARAIAAGSGHVAKGILWCGDVGVEKLKWGHEFMRRRLKEGSSEISPEGLKRMERVKKLTKMCEDVATGILSGVVKVSGFFTGCIVNSTVGKKFFSLLPGEIVLASLDGFNKVFDAVEVAGRNVMSTTSVV

SEQ ID NO: 3319 - protein, 345 aa, Erwinia carotovora subsp. atroseptica SCRI1043
MTQIDRINRRVVLAQRPHGAPTQDNFRLEQQAVPSVDSGQVLLRTVFLSLDPYMRGRMSDAPSYAKPVELNDVMVGGTISRVVESKHPDYQTGDWVLSYSGWQDYAISDGKGLTNLGQSPTNPSYALGILGMPGFTAYMGLTDIGQPKAGETLVVAAATGPVGATVGQIGKLKGCRVVGVAGGAEKCRYAVEVLGFDVCLDHRADDFAEQLKQACPQGIDIYFENVGGKVFDAVLPLLNTSARIPVCGLVSGYNGTGLPDGPDRLPLLAGTLLKKRIRMQGFIIFDDYGHRFDEFWKEVSPWVAQGKIKYREEIVDGLENASEAFIGLLHGRNFGKLVIRIGPDA

SEQ ID NO: 3320 - protein, 167 aa, Arabidopsis thaliana
  misc_feature (26)..(27): Xaa can be any naturally occurring amino acid
MASKALILLGLFAILLVVSEVSAARXXGMVKPESEETVQPEGYHGGHGGHGGGGHYGGGGHGHGGHNGGGGHGLDGYGGGHGGHYGGGGHGLDGYGGGGGHYGGGGGHYGGGGGHYGGGGGHYGGGGGGHGGGGHYGGGGGGYGGGGGHHGGGGHGLNEPVQTKPGV

SEQ ID NO: 3321 - protein, 529 aa, Zea mays
MAMMDKWTGLGSALASMLFLWSMVQNHLPAAFGYRLSTWGNKLASLFSPYLEITISEYGAERFRRSDFFLAAEAYLSDACSRRARKLRADLGKDSKNLQVSVDDNDEVTDAFSGATIWWYASKQLARSQVISFYPGEDERRFYRVVFHRRHRDLVVDEYLPHVLEEGRAVTVRNRQRRLFTNNPSGSWNSYRGKSVWSHVPFEHPATFDTLAMDPDDKEDILDELRAFRDAKAYYTKVGKPWKRGYLLYGPPGTGKSTMIAAMANFLDYDVYDLELTAVKNNTELRKLFIETTGKSIIVIEDIDCSIDLTGKRKDDKKRASAEADDKPKTPTDPDKDEGSKVTLSGLLNFIDGLWSACGGERIIIFTTNHKDKLDPALIRRGRMDRHIEMSYCRFRTFKVLAKNYLDVEEPHELFGQIEKLLEETDMSPADVAENLMPMSKKKKRRDANACLESLVEALKQAKEDAAAAAAAKALADARAAKEEAEEAKEKEAKEKDEATNSKGAADPAGKDTKMSNGDVTANKEGDDE

SEQ ID NO: 3322 - protein, 510 aa, Gibberella zeae PH-1
MAHSPSSSSVEDAAENTADEEDSEDYCKGGYHPVQVGEKFKDGKYTVVRKLGWGHFSTVWLSRDNTNGKHVALKVVRSAAHYTETAIDEIKLLNKIVQAKPDHPGRKHVVSLLDSFEHKGPHGTHVCMVFEVLGENLLGLIKRWNHRGIPMPLVKQITKQVLLGLDYLHRECGIIHTDLKPENVLIEIGDVEQIVKRVVKPEAAEKENNRNGRRRRRTLITGSQPLPSPLNTSFNQSNLFPSPTPHSSLAGVLNDGKSSNEASPKPSDDAQKQREKSADLLSREVSGISLDKSNSPSTAAGDKRKAEDAHAFDVISVKIADLGNACWVNHHFTNDIQTRQYRSPEVILGSKWGASTDVWSMAAMVFELITGDYLFDPQSGTKYGKDDDHIAQIIELLGPFPKSLCLSGKWSQEIFNRKGELRNIHRLRHWALTDVLREKYHFKEEEAKRIADFLTPMLELVPDKRANAGGMAGHNWLEDTPGMKGLKIEGLEVGGRGEGIDGWSTEVRKR

SEQ ID NO: 3323 - protein, 487 aa, Glycine max
MAAPSSETKSPSSSNTQLPLKPIPGSYGMPFFGAISDRHNYFYHQGRDKFFATRIEKHNSTVIRTNMPPGPFISSDPRVVALLDGASFPILFDNDKVEKLNVLDGTFMPSTKFTGGFRVCAYLDTTEPNHALIKQFFLNVLAKRKDSFVPLFRNCLQESFAEIEDQLSKNTKADFNTVFSDASFNFMFRLFCDGKDPSQTNLGSKGPKLVDTWLLFQLAPLATLGLPKIFNYIEDFLIRTLPFPACLTKSGYKNLYEAFKTHATTALDEAEKLGLKRNEACHNVVFTAGFNAYGGLKNQFPYVLKWLGLSGEKLHADLAREVRRVVNDEGGVTFTALENMPLVKSVVYEVMRIEPAVPYQYARARENLVVSSHDASFEVKKGEMLFGYQPFATRDPRIFEDAEVFVPRRFVGEGEKMLKHVLWSNGRETEEPSASNKQCPGKNLVVLLCRLFLVELFLRYDTFEFEYTQAGFGPTITIKSLTKASTI

SEQ ID NO: 3324 - protein, 202 aa, Triticum aestivum
MDAAVERLKTGFEKFKTEVYDKKPDFFEPLKAGQAPKYMVFACADSRVCPSVTLGLEPGEAFTIRNIANMVPSYCKNKYAGVGSAIEYAVCALKVEVIVVIGHSRCGGIKALLSLKDGADDSFHFVEDWVRIGFPAKKKVQTECASMPFDDQCTVLEKEAVNVSLQNLLTYPFVKEGVSNGTLKLVGGHYDFVSGKFETWEQ

SEQ ID NO: 3325 - protein, 390 aa, Chlorobium tepidum TLS
MHIGVLTGGGDAPGINACIKTIVTISTEKGYRVTGIRRGWNGLLAFDPDDPASRTEHIVDLDSELVRRIDRTGGTLLHTSRINPGNLKKKEIPPFLRNSPHLLRTGLHHSGNFDLTDHVLRSIDALGLDVIIVIGGDDTIGYADHLAKAAVKVIGVPKTMDNDVYGSDYCIGFGTAVTRSVQYIHQLRTSSGSHERITIVELFGRSTGETCLVSAYLAGVDRALIPEVPFDPETLADYVIQDKAANPSQYAMIAISEGARMIGSKMIEYCGRRYDEDGHEPAGIGQLTRETISMLTGQDVICQQLGYLMRSGIPDALDLMVGFNFAQLAVELIAEGTFGVMVALQKGIYTCLPLAEVSSNTKQVDISELYDPRYYRPKMRSVMGKPMFLY

SEQ ID NO: 3326 - protein, 116 aa, Photobacterium sp. SKA34
MSNIIKALEQEQLKTDLPTFAPGDTVVVQVKVKEGDRERLQAFEGVVIAIRNRGLHSAFTVRKISNGEGVERAFQTHSPVVDSITVKRRGAVRRAKLYYLRERSGKSARIREKLSK

SEQ ID NO: 3327 - protein, 794 aa, Shewanella sp. MR-7
MTNHWIDIKNSNVVIIMGGNAAEAHPVGFGWVTEAMQHNNAKLIVVDPRFNRSASLADHYAPIRSGTDIAFLLGVIRYLISTNQVNFDYVKAYTNASYLVRDDFDFHDGLFSGFDEAKGEYNKESWFYQLDEDGYAKVDETLEHPRCVWNLLKQHVERYDFATVSNITGTPTADYQVVCDAIASTHTKDRVATFMYALGWTHHSKGAQNIRSMAMIQLLLGNIGQLGGGVNALRGHANVQGSTDMGLLAQSLPGYLKLPNDKEPTLAAHLAANTPKPLRPGQTNYWQNYPKFYVSLLKAFWGENATPENEFGYQWLPKWDQMYDFGKHLDMMYRGKVNGCIVQGVNAINSMPNRNKNIKALSNLKYLVVLDNLSSETATFWQNEPGFNEVDTASIQTEVFRLPATVFAEEEGSIVNSGRWMQWHYKGANPPGEAMSDSEIVSGLLQELKHLYREEGGKLPEPIEAINWNYIDPHNPSSIELTKELNGYDVATKRQISSFAELKADGSTASACWIYAGSWTEAGNQMARRDNHDPSGKGITPGWAFAWPLNRRVLYNRASCDVNGKPWDEHRKIVEWKDGKWEGIDVPDFNAKLNPQESAHPFIMQADGVGRFFALKLLKEGPFPEHYEPVESPIGTNPLHPNVVHSPVLRWFEGVKDTIGTKEEYPYACTTYSLTEHFNFWTTHCRLAAIAMPETFVEMNEQLAAEKGIKNGDWVKVSSKRGHILTKALVTKRMRPLQVNGQTVHTLGIPRHGSHNALTRKAYSCNVLTTEMGDANTGVPEYKAFLVNVEKAEV

SEQ ID NO: 3328 - protein, 386 aa, Escherichia coli O157:H7 EDL933
MTRKQATIAVRSGLNDDEQYGCVVPPIHLSSTYNFTGFNEPRAHDYSRRGNPTRDVVQRALAELEGGAGAVLTNTGMSAIHLVTTVFLKPGDLLVAPHDCYGGSYRLFDSLAKRGCYRVLFVDQGDEQALRAALAENPKLVLVESPSNPLLRVVDIAKICHLAREVGAVSVVDNTFLSPALQNPLALGADLVLHSCTKYLNGHSDVVAGVVIAKDPDVVTELAWWANNIGVTGGAFDSYLLLRGLRTLVPRMELAQRNAKAIVKYLQTQPLVKKLYHPSLPENQGHEIAARQQKGFGAMLSFELDGDEQTLRRFLGGLSLFTLAESLGGVESLISHAATMTHAGMAPEARAAAGISETLLRISTGIEDGEDLIADLENGFRAANKG

SEQ ID NO: 3329 - protein, 388 aa, Xanthomonas axonopodis pv. citri str. 306
MAGLGVWGMLAVLLVFTQLTIFAVTLYLHRSQAHRGVDFHPVIAHFFRFWTWLTTSMITREWVAIHRKHHAKVETEEDPHSPQTKGIAQVFWRGVELYREARTQRADIEQYGKGAPSDWIERHLYTPHANAGPIALLVINAVLFGLPGIALWAIQMAWIPFWAAGVVNGLGHWWGYRNFESADTSTNLTPWALWIGGEELHNNHHAFPSSARFSMRRWELDIGWVAIRGLQALGLAKVLRVAPSLDIRPNIAVPDADTLKALLSHRFQAMTDYQRNVFKPALREEAAATGAKLRELLPRRLRKGLVDDGRWLKPDARAQLQAWVAQRPRMRTLVEYRARLTALLEARSHDASERLRQLQQWCHEAEASGNAALQAYAARLKGYALSGA

SEQ ID NO: 3330 - protein, 507 aa, Brucella melitensis 16M
MSTTAYPDTILIIDFGSQVTQLIARRVREANVYCEIVPFQSADEAFKRLQPKGVILSGSPHSTTDIGSPRAPQAIFDAGIPVLGICYGEQTMCAQLGGNVESGHDREFGRAFLDVQEDSPLFAGIWAKGTRHQVWMSHGDRVTSLPDGFTIIGTSPNAPYAVIADEKRKYYGVQFHPEVVHTPDGAKLLQNFVHRIVGVKPGWTMGAYREQAVEAIRKQVGSGKVICALSGGVDSSVAALLAHEAVGDQLTCILVDHGLMRKDEVQQVVEMFREHYNLPLILVDASDRFIGALEGESDPEKKRKTIGRLFIEVFEEEARKLGGADFLVQGTLYPDVIESVSFTGGPSVTIKSHHNVGGLPERMKMQLVEPLRELFKDEVRLLGKELGLPDSFIGRHPFPGPGLAIRCPGGVTREKLEILREADAIYLDEIRKAGLYDAIWQAFAVLLPVQDRGRDGGWPHLRIRLRLARGDFGGRHDGGFLPLRHEFPRQCGHPHHQRSPRHQPRCL

SEQ ID NO: 3331 - protein, 380 aa, Brucella melitensis 16M
MFTMRCGASSPSSGAWMPTTRALAFGGLLADDGMDIEMVDAALHGDRFAPEGLDAARRAAWQSRDLATAPAHIQADVPEWCIPSLEELFGERWVSEGKALATRPAVDLRVNSLKATPEKTLAALEKAGAAPAPFLAQALRIPPIEALGRHPNVQGEQAFLDGWFEVQDLGSQLAALFAGVKPGEQVLDYCAGAGGKTLALAAAMGNSGQIHAYDAERARLSPMHERLQRAGVRNTQVYGGLDELGPLAGKMDLVLTDAPCTGSGTWRRRPDAKWRLNEQQLERRVQDQQDVLDSARRFVKPGGRLAYVTCSLFAEENTRQVARFLGENPDFKEIAPQTLWGTVVQDDSAGKPVFPSHGSVFSPLSTGTDGFYVSILQRQN

SEQ ID NO: 3332 - protein, 337 aa, Mycobacterium sp. MCS
MAFTRKPPIDPVRWQPPPVDGLPPLPSPSVTVVPVPGHAPEDVVVDAAGRLYTGVDDGRILRLTPDGGEPAVIANTGGRPLGLAVARDGRLLICDSPRGLLALDPETGRFDPLVETVGGRHLQFCSNVTETADGTIYFTESTSAFTYAYFKGAALEARGRGGLFRRDPDGTVTTLADGLYFTNGVTVTADGSALVFAETLGRRLSKFWLTGPQAGTITPLVGHLPGYPDNLSTGADGRIWVAMVSAPNAAAEGLAPRTPVLRKLLWLLPDRFAPQLKPEVWAVAFDPDSGAVVGGLRTTHPDFGMVTGLVEAGGRLWMGCIGASALAHVALDDVALP

SEQ ID NO: 3333 - protein, 461 aa, Mycobacterium sp. MCS
MTQSYITEPVTSELGAKANRHLWGHFARHGEGITPPIITRGEGVRIWDDKGRSYIDGLSGLFVVQVGHGRKELAEAAAKQAETLSFFPLWSYATPPAIELAERIANYAPGDLNRVFFTTGGGEAVESAWKLAKQYFKLTGKPGKHKVVSRAIAYHGTPQGALAITGIPAFKAPFEPLTPGGFRAPNTNFYRAPEPYAHDVKAFGQYCADRIAEAIEFEGPDTVAAVFLEPVQNAGGCFPPPPGYFERVREICDEYDVLLVSDEVICAYGRIGSMFACDDFGYVPDIITSAKGLTSGYSPLGAMIASDRLFEPFNDGKTTFGHGYTFGGHPVSAAVALANLDIFEREGLNDHVKENAPAFRATLEKLYDLPIVGDVRGEGFFYGIELVKDKATKETFDDDESERLLRGFLTPALWEAGLYCRADDRGDPVVQLAPPLISGQAEFDAIYEILHGVLSEAARRL

SEQ ID NO: 3334 - protein, 186 aa, Triticum aestivum
  misc_feature (8)..(8): Xaa can be any naturally occurring amino acid
  misc_feature (11)..(11): Xaa can be any naturally occurring amino acid
  misc_feature (180)..(180): Xaa can be any naturally occurring amino acid
ATGTCIDXPGXGLLTSCKWDPRLGATFIYNTAISVPLRNAAAFVADVKRLRDLNPRTFCSLDARGGLLARYIRASSAYLGKPEDAVDFDITYYRSYTAGAPRAHADVIDELEQMALHKYGGFPHWGKNRNFAFDGAVGRYPKAGEFLEVKGRYDPDGLFSSEWSDQVLGINGTSPSVDKXGCAMEG

SEQ ID NO: 3335 - protein, 867 aa, Neorickettsia sennetsu str. Miyayama
MSEKLVYHFSPSNADGDALMLDVLGGKGANLAQMCNMGLPVPPGFTISSSACELYHRDKDLFRKILEKEIQKSLQVLEAVTGKVFGSKVRPLLVSVRSGSKFSMPGMLDTILNVGLNDEIIASCSSRFILDSYRRLIQMYGDVVLKVESYHFEEVLYNYKNSKGILRDHDLSISDLHELIEAFREVVKRNSHASLPEDVYVQVMACIEAVFQSWGNERAKTYRKIHDIPESVGTAVNIQSMVFGNFNERSGSGVLFTRNPSNGHKTMFGEYMKCVQGEDIVSGVRTPQPIGELKSENPRLYEQIESVCQSLEKHYRDVQDIEFTIEDDALYILQTRSAKRSVEAAIRVAVDMVKEGLITKEEAVLRIRPKSLESLLHPRIDDEANHQIIGSGLPASPGAASGKIIFSTEEAVKRAQGGEKVILVKSETSPEDIAGMHAAVAILTTRGGMTSHAAVVARGMGKPCVCALSGGSIDQYSQVLRITPDVTLNKGDEITIDGTSGNVILGNASTSEFSFSDEFSTFMTWVDEFRQISVRANAETKEDVEVALRFGADGIGLCRTEHMFFSEDRIHIVRDMIVAEDLRQRSIALKKLLPIQQGCFAAIFREMQGRCVTVRLLDPPLHEFLPADEASLESFRKHSALEDSFIQRRIKVLKEENPMLGHRGCRIAISHPEIYEMQLHAIFGAAQEVGDVKLEVMIPFIMNADELCAIKQLVTSVAQGYSVDYLLGNMIELPSAAILADRIAESSDFFSFGTNDLTQTTLGISRDDCGMFMNIYKEKGLFREDPFISIQVESVGFLIKEAIKKGRSANKALKIGICGEHGGDPYSVEFFASSGVDYVSCSPYRVPIAKVAAAQHSIKMKQNNETL

SEQ ID NO: 3336 - protein, 772 aa, Yarrowia lipolytica CLIB122
MVTTPRDSFDSLISENSNPQITEPEPPSSPRNVFRPFTDTINRAQALASAALTDDSEFTYNHNIFYDDKTTIDWMHEFAKERQQRRIAWDTPGVRGQALRLVNTSRRWIILIGTGIAVGLIAACIDITSHWIADVRLGYCQNAFYLSRDSCCSGIATNDPCPGWIEWSSSYFLRYMMYTFICVICATSASVLVITYSPHSKLSGISEIKTILAGYIIKGFMGKWTLLIKSLGLGLAVGSGVWVGKEGPLVHVACCCANLLIRYTSREHNEAQKREILSAAAAAGISVAFGSPIGGVLFSLEQVSYYFPDKTMWHSFVCAMIAAVTLQFVNPFRTGKLVLFQVEYDRLWHRFELVPFAILGIFGGLYGAYFIKLNLKYAKMRKTTFIKNFPILEVAILALITGLINYPNVYMRLQPSVLLSYLFQECNASTPEALCNLDNWSQSVALLLSACGLGFLLASYSFGVALPAGIIIPSMCIGALFGRAVGILMATWHETNRDFFLFASCPAEGTCVTPGVYAVVGAASALGGVTRLTISIVVITFELTGALNYVLPIMAGVMVSKWVGDAIGGKRGIYESWIHVLNLPYLDNKDDEPVPVVYVKEFMTSIDDLVVIQTNSSDHVNTIDSLQSTISSCTFQGFPIVNQDTILQGYIFRSELKFSIDKALLFDHLTGETECVFESRDAEDSSCLLLREWVVQAPPTVTSSATLQLVSNMFFKLGLRYICVVDKGKLVGLITKEDLWRLFNSDRLKTMAVPILGTVNDESRQGLLHDDV

SEQ ID NO: 3337 - protein, 513 aa, Zea mays
MAGGFAVSKSGADGREFKGRITWYVWMCGIVAATSGLMFGYDVGISGGVTAMDDFLELFFPSVYARKHRARENNYCKFDDQRLQLFTSSLYLAALVASFVASRACSRFGRKRTMQAASVFFLAGTALCASATNIAMLIVGRVCLVVGVGFGNQAAPLFLSEIAPAHVRGALNILFQLNVTVGILIASVVNYFASRAHPLGWRYALGGAAAPAAVLFLGSLAITETPTSLVERGRTDAGRRTLEKIRGTADVGAEFDEIRAACDLARALGEEEKPYRRLMRPESRPPLVIAIAMQVFQQFTGINALMFYAPVLFQTMGFETDGSLLSAVVTGSVNVVSTVVSIVLVDRVGRRKLLLEACAQMLVAQTAVGAIMLVHVRANNNPSQSWAVAIVVLICVYVSSFAWSWGPLGWLIPSETFPLETRTAGFSFAVSSNMLFTFLIAQAFLSMMCSMRAFIFFFFAAWIVVMAIFVLTLLPETKGVSIDEMVDRVWRRHWFWKRCFADDYDAARVYDNC

SEQ ID NO: 3338 - protein, 262 aa, Triticum aestivum
MEDERSTQSYQGGEAAEQVEVTDRGLLGNLLGKKKAEEDKEKEEELVTGMEKVSVEEPEVKKEEHEDGEKKETLFSKLHRSSSSSSSSSDEEEEEVIDDNGEVIKRKKKKGLKEKLQGKLPGHKDTEGEHVTGLPAPAAPASVQTHGGHHDTDVVVEKIDGDVKTEAAPAVPEEEKKGFLEKIKEKLPGGHKKPEDAAAVPVTHAAPAPVHAPVPAPEEVSSPDAKEKKGLLGKIMDKLPGYHKTGEEDKAAAATGEHKPSA

SEQ ID NO: 3339 - protein, 523 aa, Mycobacterium sp. MCS
MRYAQQGGCGSDSVGPMTALASNASASNSVASSWIDGAPVQTGGGSFQIVNPATGAVVTEYARAANVDVDVAVAAARAALPGWATATPAERSAVLAKLAKLADEHTDVLVAEEVSQTGKPVRLAREFDVPGSVDNIDFFAGAARHLEGKATAEYSGDHTSSIRREAIGVVATITPWNYPLQMAVWKVLPALAAGCTVVIKPCELTPLTTLTLARLAGEAGLPPGVLNVVTGFGADVGTALAGHPGVDLVTFTGSTVVGRKVMSAAAVHGHRTQLELGGKAPFVVFDDADLDAAIQGAVAGSLINSGQDCTAATRAIVARDLYDDFVAGVAEVMGKIVVGDPEDPDTDLGPLISTAHRDKVAGMVSRAPAEGGRVVTGGTIPDLPGSFYRPTLIADVGEQSEVYREEIFGPVLTVRSFTDDDDALRQANDTDYGLAASAWTRDVYRAQRASREINAGCVWINDHIPIISEMPHGGVGASGFGKDMSDYSFEEYLTIKHVMSDITGVADKEWHRTVFKKRSGLNH

SEQ ID NO: 3340 - protein, 377 aa, Glycine max
MADAEDIQPLVVDNGTGMVKAGFAGDDAPRAVFPSIIGRPRHTGVMVGMGQKDAYVGDEAQSKRGILTLKYPIEHGIVSNWDDMEKIWHHTFYNELRVAPEEHPVLLTEAPLNPKANREKMTQIMFETFNVPAMYVAIQAVLSLYASGRTTGIVLDSGDGVSHTVPIYEGYALPHAILRLDLAGRDLTEYLVKILTERGYSFSTSAEKEIVRDVKEKLAYVALDFEQEMETTKSSSAVEKSYELPDGQVITIGSERFRCPEVLFQPSLIGMEATGIHETTYNSIMKCDVDIRKDLYGNIVLSGGSTMFPGIADRMSKEISALAPSSMKIKVVAPPERKYSVWIGGSILASLSTFQQMWISKGEYDESGPAIVHRKCF

SEQ ID NO: 3341 - protein, 266 aa, Shewanella sp. MR-7
MCILFVALNTHPQYPLIICANRDEFHHRPTAPAQFWPPEENILAGKDLQAGGTWFGVNKQGQIAGVTNLRVAQKSQEPMRSRGELIIKALSSGSLICPNWLEEHAEDYQPFNLVFGQGTNLYCFNSLKRNTVKLTAGFHAISNGALDDIWPKMAKGQRSLEALIQQAGPLELESLIQLMQDDSRPQDNELPDTGVGLEWERRLAAIYIRHPDYGTRSTSILLQNAQGEVQFTEVRYDGKGRRLGQQDFHFTLPPQLPKEPDCLAHF

SEQ ID NO: 3342 - protein, 341 aa, Amycolatopsis methanolica
MRVGVLTGGGDCPGLNAVIRAVVRKGIEAHGWEIVGFRSGWRGPLTGDSRPLGLDDVEEILIRGGTILGSSRTNPYKEEGGVEKIRAVLADQGVDALIAIGGEDTLGVAKKLTDDGIGVVGVPKTIDNDLAATDYTFGFDTAVHIATEAIDRLRTTAESHYRAMVVEVMGRHAGWIALHAGLAGGANVILVPERPFSVEQVVEWVERRFEKMYAPIIVVAEGAVPEGGAEVLRTGEKDAFGHVQLGGVGTWLADEIAERTGKESRAVVLGHTQRGGTPTAYDRVLATRFGLHAVDAVADGDFGTMVALRGTDIVRVKLAEATAELKTVPPERYEEAEVFFG

SEQ ID NO: 3343 - protein, 398 aa, Brucella suis 1330
MDAANSPHIVVVGAGFGGLQLIRDLDGAKVRITLIDQRNHHLFQPLLYQVATTILSTSEIAWPIRNLFRDRAEVTTLLGTVIDVDTARKSVFLENGDEVSYDMLVLATGARHAYFGNDQWEKLAPGLKALEDATTIRRRLLLAFERAEREPDMARRQALLTFSIVGGGPTGVELAGIIAELARRTLWPEFRNIDTRQARVLLLEAGPRILSAFPEDLSAYARRALEKLGVEVRLGIPVKDITQEGVTVGDEFIPCHTTVWAAGVAASPAALWLDAESDRAGRVKVLSNLSVPGHEDIFAIGDTAWVEGDDGRPVPGIAPAAKQQGNLATIGKGAAVVDMGRIRLKGTIAWWFWGIAHIFFLIGTRSRAAVAWSWLWTYITGQHSARLITQGKPSDEFR

SEQ ID NO: 3344 - protein, 589 aa, Chlamydomonas reinhardtii
MQSRQCLNRKASGARPCANSRSLTARVLATAAPVAPSATPASAPLPLPDGVGEHSGLKHLPEAARTRALDKKANKFEKVKVEKCGSRAWNDVFELSSLLKEGKTKWEDLNLDDVDIRLKWAGLFHRGKRTPGKFMMRLKVPNGELTAAQLRFLASSIAPYGADGCADITTRANIQLRGVTMEDSETVIKGLWDVGLTSFQSGMDSVRNLTGNPIAGVDPHELVDTRPLLRDMEAMLFNNGKGREEFANLPRKLNICISSTRDDFPHTHINDVGYEAVAKPNGEVVYNVVVGGYFSIKRNIMSIPLGCSITQDQLMPFTEALLRVFRDHGPRGDRQQTRLMWLVEAVGVDKFRQLLSEYMGGATFGEPVHVHHDQPWERRNLLGVHRQRQAGLNWVGACVPAGRLHAADFEEIAAVAEKYGDGTVRITCEENVIFTNVPDAKLEAMKAEPLFQRFPIFPGVLLSGMVSCTGNQFCGFGLAETKAKAVKVVEALDAQLELSRPVRIQFTGCPNSCGQAQVGDIGLMGAPAKHEGKAVEGYKIFLGGKIGENPALATEFAQGVPAIESVLVPRLKEILISEFGAKERATATA

SEQ ID NO: 3345 - protein, 567 aa, Oryza sativa (japonica cultivar-group)
MASSALICDTEQWKGLQAHVGEIQKTHLRHLMHDVERCKAMTAEYEGIYLDYSRQRATGETMEKLFKLAEAAKLKEKIEKMFRGDKINSTENRSVLHVALRAPRDEVINSNGVNVVPEVWGVKDKIKQFSETFRSGSWVGATGKALTNVVSVGIGGSFLGPLFVHAALQTDPEAAESAKGRQLRFLANVDPVDVARSIKDLDPETTLVVVVSKTFTTAETMLNARTLKEWIVSSLGPDAVAKHMIAVSTNLELVEKFGIDPKNAFAFWDWVGGRYSVCSAVGVLPLSLQYGFPIVQKFLEGAASIDKHFRSSSFEKNIPVLLGLLSVWNVSFLGYPARAILPYSQALEKFAPHIQQLSMESNGKGVSIDGVQLPFESGEIDFGEPGTNGQHSFYQLIHQGRVIPCDFIGVVKSQQPVYLKGEIVSNHDELMSNFFAQPDALAYGKTPEQLHSEKVPEHLIPHKTFQGNRPSLSLLLPSLSAYEIGQLLAIYEHRIAVQGFLWGINSFDQWGVELGKSLASQVRKSLHASRVEGKPVLGFNSSTTSLLTRYLAVEPSTPYNTTTLPKV

SEQ ID NO: 3346 - protein, 640 aa, Ustilago maydis 521
MNGYNSGSTLSDAPPGQGQIQQLPGRPMIDLKKKLVVVGDGGCGKTCLLIVYSQNKFPQEYVPTVFENYVPIIQFEGKTIELALWDTAGQEEYDRLRPLSYPESDVILICFAVDFPTSLANVQDKWFPEINHFCEGVPILLVGLKTDLRKDANSLAMLQAQGTKPVTPAQGQHVADEIGAAKYVECSAKTKDGVQNVFDTAIREACRKKGWARRAGVGGAGGAKKNLDPTGLQADAHTGITIVGPAFSHMHPLSGPIVALTRYHYRSLTDTSYDHFRSLVHVLVHVGLPAHTWACSSSSSHPLHQLVFLSTSLSTLSKHVSSLQSLSHMVYFPYASTTQSCHATPRLHAQQRYMSVMSLMDSSIVRHSMQDGMWMFVLMTFENWLDLFIQVVCGSYRLCQIEDRFTRRYRFFVVILDLDIDDMYWSIQLGASAEQVLADGIEAPFFARDDDVGCIFSFLPTLRCAFDVFVSIQHGHKTVGPVQTRIFRIQIRDDVCMLGRLILGPGKRTAEPVPADVTLKPDFASRACAAIDRFWFDAQTTQNKTLLSEDEPATTPLTAAASIVGVGAGIVVEDADADDVGGYGGVVDDDEDICTTKGSAVLEMLAGYEQGRRSAARSISRRNSADYIPRTLVSTSGNEC

SEQ ID NO: 3347 - protein, 873 aa, Oryza sativa (japonica cultivar-group)
MPPREDPNGDASSASPSDPVPPPPQQPQPQPAKGKGKKKDEKKDDDLSEEDQALKEQLELYVVRAQDTDPGVQKLALESMRQEIRSATSSMTSVPKPLKFLRPHYGTLKAYFETMPESDLKKYMADILSVLALTMSAEGERESLNYRMIGSEGDIGSWGHEYVRNLAGEIAQEFQKRQDDGMPTDSLKELVEQIVSFHMKHNAEPEAVDLLMEVEKLDLLVKHVDSTNYKRTCLYLTSSSKYLPAPDDMSALKIAFEIYMKFGDFANALRIALLLYDKSLELKPIFTATDDFQLKKQFAFIIARHGLSIEIDDDIAADENEKEALQDIISNIKLSEGYLTLARDIEVMEPKSPEDIYKVHLIDGRGATSSSLDSARQNLAATFVNAFVNAGFGQDKLMTTPSDSSSSGSSGNWLFKNKEHGKASAAASLGMILLWDSDSGLAQLDKYLHSNDIHVVAGALLGIGIVSCGVKSDCDPAFALISEYFSRDESIIRIGAILGLGIAYAGSQKEEVRENLTAFLTDSQVPLEVLVFSAISLGLVFVGSCNEEVAQTIICVLMERSEPELAEPIMRLLPVALGLLYLGKQESVEATAEVSKTFDEKIRNYCDVTLMSLAYAGTGNVLKVQKLLGICSEHLEKGETHQGPAVLGISLIAMAEELGAEMAVRSLERLLQYGEQNIRRAVPLALGLLCISNPKVNVMDTMSRLSHDADAEVSMAAIISLGLIGAGTNNARIAGMLRNLSSYYYKEAGHLFCVRIAQGLVHLGKGLLTLSPYHSDRFLLSPIALAGLVTVLHACLDMKSIILGKYHYMLYILTLAMQPRMLLTVDEDLKPLSVPLIFAYAYAYALSMCRYLPLTPVLEGFVILRKNPEYHED

SEQ ID NO: 3348 - protein, 253 aa, Yarrowia lipolytica CLIB122
MTDRVVYVGSIPYDQTEEQMLDIFKSVGPVISLKLMFDKETGRSKGYGFAEYPDADTARSAIRNLNGFQVGSRQLRVDHSHEGQVREFFASQNRFPNPNVSKNGRPGLPAGVPLRQGLEPAQQVSETMNGYTKSQMVAVVTDLMSMSKNSPQLLADLFAQAPQLAYAAVQCLLNLGLVDEQRVLSVVRGNPALNAGGNPPSAPAQSTPDPVAGNAALIQQVMALSEADINALAPEHQRSIRELRDRIQRGEVI

SEQ ID NO: 3349 - protein, 592 aa, Bacillus cereus G9241
MAETLAKRGPDDNKVWIKGNVAFGHKRLIVVDPEGGKQPMTCLKDEANYAICYNGELYNTEDIRKELLRRGYTFKGHSDTEVLLASYMEWKEECVDHLNGIYAFAVWDEQKEQVFIARDRLGVKPLFYKYDSGRLLFGSELKAILAHPDVKVEVTLEGLSEIFGLGPSRTPGHGIYAGIKELRPGHAMTFSKNGLCIWRYWNVESKKHEDSFEETVEKTRFLLQDAITRQLVSDVPLCTFLSGGVDSSAITAIAAKEYERSGKGQLHTYSIDYEDNDKYFKANAFQPNSDAPFIHLMTETFQTIHHRCVISNEQLAQYLTEAVLVRDLPGMADIDSSLLWFCREIKQDFVVGLSGECADEIFGGYPWFYREDDLQSSAFPWMRSTEAREQLLKKEWRNKLNLQQYVQRRYEESIQEVPILEGESPIEAKRRQLFYLNMVWFMTTLLDRKDRMSMGASLEVRVPFADHRLVEYAWNIPWEMKMYKNREKGLLRKALEGLLPNEILYRKKSPYPKTHNPHYTKAVTVWLQDLLTDKGSILHELFDKEQLSGLIESGGSAFQSPWFGQLMTGPQLLAHLAQIHVWFKEYGVNIKE

SEQ ID NO: 3350 - protein, 131 aa, Brucella melitensis 16M
MEAVDIYTRQCSTLVTATDLATMGATLAAGGVNPISGKRMVSAGNVAPILAEMTMEGLYTALGDWAYTVGLPGKSGVGGGIMAVVPGELAIAAFSPPLDPAGNSVKAMAAVAAVADSLGHNLYTTRGKVSS

SEQ ID NO: 3351 - protein, 200 aa, Brucella melitensis 16M
MSSSSDAIKAALEKGRAAGLSATGGKNADYIPFLASVPSDLFGLAVVTADGQTFKTGDADIAFAIESISKVFTLALVMEEIGPDSVREKVGADPTGLPFNSVIALELHNGKSLSPLVNAGAIATASLVPGDTADARWNNILECQCGFAGRRLKLSNEVNQSNRRPIFTTAPLPGCFTVPVLATAIRWRPWIFIRANVQRL

SEQ ID NO: 3352 - protein, 463 aa, Photorhabdus luminescens subsp. laumondii TTO1
MDREFMADQQHSLQRGLEARHIELIALGGTIGVGLFMGSASTLKWAGPSVLLAYIIAGIFVFFIMRSMGEMLFLEPVTGSFASFGHKYLSPYWGCLTAWGYWFMWVAVGISEITAIGVYAEFWFPELPQWVSALIAVALVALANLAAVRLYGELEFWFAMIKVTTIIVMILIGLGLIFFGIGNQWQPIGLDNLTVHGGFFAGDWQGFLFALCIVVASYQGVELVGITAGEAKNPQVTLKKAINNILWRILIFYVGAIFIVVTLFPWTEVGAQGSPFVMTFTKVGITSAAAVINFVVLTAALSGCNSGMYSGGRMLYALAQNRQLPSSLTKLSKNGVPVIGIAITILCLIVGSSLNYLIPNPQAVFVYVYSASVLPGMVPWFVILMSQLRFRQYHQQALKQHSFKSILFPYVNYLTLAFLCCVLVGMAINPDTRFSLLVGGGFLLIVSLIYWLVKLFNGKKPKA

SEQ ID NO: 3353 - protein, 433 aa, Triticum aestivum
  misc_feature (204)..(204): Xaa can be any naturally occurring amino acid
  misc_feature (402)..(402): Xaa can be any naturally occurring amino acid
AARNADHAAAGDHHHTCKYVVWIPTEGLGNRMLSLVSTFLYALLTDRILLVHEPPEMEGLFCEPFPGTTWLLPPADFPHKLDAATFSSRSKESYVNMLHSNIIRYGYGDDARAQVLPAYVYLHLETVFLLTASVKLRLQNHTFCDEDHRLINKFDWLVVKSDNYFAVALFTMPMYRRELDRMFRAKGAVFHHLGRYLLRPGNRXWGMVDRFFEGYLAGADERVGMHVRNKQIFPVPPEIMFEQILRCAREHHLLPQVLATSEPPTAEAKMKKKKKKAVAVLMLSLKPEYHDKLHAMYYTNATVAGDVVVSVHQPSHDGEQQSDARAHNERALAEIYLLSFCDRMVTTGWSTFGYVAQALAGIRPWMLLPVNRSKMRADVACVRPPSVEPCTHPQPLLLTCQXGAGLRHMDDPVKRVPFLRHCEDVPLGLKLFG

SEQ ID NO: 3354 - protein, 304 aa, Brucella melitensis 16M
MCWHKFARYWDVEIREIPMEPGRLFMGPEQMLEAVDENTIGVVPTFGVTYTGNYEFPEPLQDALDKLQKTKGLDIDIHVDAASGGFLAPFCAPDIPWDFRLPRVKSISASGHKYGLAPLGCGWVVWRDKEALPEELIFNVDYLGGQVGTFAINFSRPAGQVISQYYEFMRLGREGYTKVQQAAYRVAQYIAREIEPLGPYEFICAGEEKGGIPAVCFRIREGEDPGYSLYDLSERLRLTGWQVPAFALSGKASDITVMRVMCRRGFEMDLAALFIRDFKAGIEFFKSHPSPKITPSMGTGFHHT

SEQ ID NO: 3355 - protein, 80 aa, Glycine max
  misc_feature (53)..(53): Xaa can be any naturally occurring amino acid
  misc_feature (67)..(67): Xaa can be any naturally occurring amino acid
  misc_feature (72)..(72): Xaa can be any naturally occurring amino acid
NTTSSNRNASFTSLKSIAGYPTIKTNKHITFIASNGGRMQCMHVWPQFGKKKXENIYYLPDLEDAHXANEVXYLLTKGWI

SEQ ID NO: 3356 - protein, 468 aa, Arabidopsis thaliana
MLEMGKSNIHVQEWDWETKDILNDTTAMDVSPSSAIGESSEHKVAAASVELASSTSGEAKICLSFAPATGETTNLHLPSMEDLRRAMEEKCLKSYKIVHPEFSVLGFMKDMCSCYIDLAKNSTSQLLETETVCDMSKAGDESGAVGISMPLVVVPECEISGDGWKAISNMKDITAGEENVEIPWVNEINEKVPSRFRYMPHSFVFQDAPVIFSLSSFSDEQSCSTSCIEDCLASEMSCNCAIGVDNGFAYTLDGLLKEEFLEARISEARDQRKQVLRFCEECPLERAKKVEILEPCKGHLKRGAIKECWFKCGCTKRCGNRVVQRGMHNKLQVFFTPNGKGWGLRTLEKLPKGAFICEYIGEILTIPELYQRSFEDKPTLPVILDAHWGSEERLEGDKALCLDGMFYGNISRFLNHRDIEAMEELAWDYGIDFNDNDSLMKPFDCLCGSRFCRNKKRSTKTMQILNKA

SEQ ID NO: 3357 - protein, 327 aa, Oryza sativa
LLFSHEVLLFEALREALIEEMKEDPTVCVFGEDVGHYGGSYKVTKGLAEMFGDLRVLDTPIAENSFTGMGVGAAMKGLRPVVEGMNMGFLLLAYNQISNNCGMLHYTSGGQFKIPIVIRGPGGVGRQLGAEHSQRLESYFQSIPGLQMVACSTPYNAKGLMKAAIRSENPVVLFEHVLLYNLKEKIPDEEYVLCLEEAEMVRPGEHVTILTYSRMRYHVMQAAKTLVNKGYDPEVIDIRSLKPFDLHTIGNSIKKTHRVLIVEECMRTGGIGASLRSAIIDNFWDYLDAPIMCLSSQDVPTPYAAPLEDATVVQPAQIVAAVEQICQ

SEQ ID NO: 3358 - protein, 395 aa, Rhizobium leguminosarum bv. viciae 3841
MSFTGLPPEAVPALMTGAITPHPALEGRADAYLPSPCIQNHAANLAFLPDGTLTCVWFGGTMEGMGDISIYMSRLTPGSDRWSVPEKMSDDPEKSEQNPLIFKAPDGKVWLLYTSQTSGNQDGSVVKCRISGDGGQTFGPVQILCDSPGTFVRQQIVVNGRGDWLLPVFRCVGLNGQRWSGDADTAAVLVSRDGGASWQMRDIPDSIGAVHMNILPLGGDEMIAFYRNRFAENILSSRSSDGGETWSAPEPAELPNNNSSIQATILNDGAIAMVYNHSNAAMSDARRQSLYDEIEGGEAEETAVIADSSARKAVWGVPRAPLSLAISRDGGKSFPHRIDLDTGDGFCLSNNSKDSLNREFSYPSIVQGGDGTLHIAYTYYRRAIKYVRLAPQLLP

SEQ ID NO: 3359 - protein, 130 aa, Salmonella enterica
ATFMPKPMFGDNGSGMHCHMSLAKNGTNLFSGDKYAGLSEQALYYIGGVIKHAKAINALANPTTNSYKRLVPGYEAPVMLAYSARNRSASIRIPVVASPKARRIEVRFPDPAAPPYLCFAALLMAGLDGI

SEQ ID NO: 3360 - protein, 197 aa, Nostoc punctiforme PCC 73102
MTHSTDIATLARWMSADFSNQEQAFENPPFYAHIRVCIRPLPLELFSGVSLFLEQAYDFMLNQPYRMRVMKLIPAENHIAIEHYTVKEEQKFYGASREPERLKDLSVDQLEKMSGCNMIVEWTGKSFKGRVEPGKGCIVVRDGKNTYLDNEFEIDAKEFFSLDRGRDLDTDERLWGSIAGPFHFVRWANFADEVKAN

SEQ ID NO: 3361 - protein, 403 aa, Neisseria gonorrhoeae FA 1090
MNQLKLAVSGAQILFVAFGAMVLVPLLTGLNPALALLGAGLGTLLFQITTKRKVPIFLGSSFAFIAPIIYSVGEWGLPSTMFGLFAAGFMYFVFAALIRWRGLAAVHKLLPPVVTGPVIMVIGLSVAVAASSMAMGQADGKQVIDYTDSLILSGFTFAVTAIVSVFGSRMMKLIPILIGVASGYVLALLMGLVDTTSIAHAPWFAVPHFETPQVNWQAALFMLPVAVAPAIEHIGGIMAIGNVTGKDYTKDPGLDKTLAGDGLGVCVAGLIGGPPVTTYGEVTGAVMITKNSNPVIMTWAAVFAVCMAFFGKFNAFLASIPMPVMGGIMLLLFGTIASLGIKTLIDAKVDLMLPKNLVIVSSVLTTGIGGMTLKLGSFSFVGVGLCAVLAIVLNSLLPDPKES

SEQ ID NO: 3362 - protein, 306 aa, Vibrio vulnificus CMCP6
MNKLVVLGSVNADHVLQVPSFPRPGETLHGRNYQVIPGGKGANQAVAAARLGADTGFIACVGDDSFGINIRENFKLDGIQIDGVKMQPNCPTGIAMIQVADSGENSICISAEANAKLTEVAIESDLPRIRDARFLLMQLETPICGIELAAREAKAAKTNVILNPAPARTLSDELLACIDVITPNETEAQVLTGIEVVDDESAQQAANVLHQKGIEIVMITLGSKGVWLSENGRGQRICGFKVDVTDTTAAGDTFNGALVTGLLEDMPLESAIKFAHAAAAISVTRFGAQTSIPTRKEVDEFLAAHS

SEQ ID NO: 3363 - protein, 444 aa, Brassica rapa subsp. chinensis
MATITAVKARQIFDSRGNPTVEVDVHTSNGVKVTAAVPSGASTGIYEALELRDGGSDYLGKGVSKAVGNVNNIIGPALIGKDPTQQTAIDNFMVHELDGTQNEWGWCKQKLGANAILAVSLAVCKAGAVVSGIPLYKHIANLADNPKIVLPVPAFNVINGGSHAGNKLAMQEFMILPVGASSFKEAMKMGVEVYHNLKSVIKKKYGQDATNVGDEGGFAPNIQGNKEGLELLKTAIEKAGYTGKVVIGMDVAASEFYSSDKTYDLNFKEENNNGSQKISGDALKDLYKSFVSEYPIVSIEDPFDQDDWEHYAKMTAECGDNVQIVGDDLLVTNPKRVAKAIAEKSCNALLLKVNQIGSVTESIEAVKMSKRAGWGVMASHRSGETEDTFIADLSVGLSTGQIKTGAPCRSERLAKYNQLLRIEEELGSEAVYAGANFRKPVEPY

SEQ ID NO: 3364 - protein, 142 aa, Salmonella enterica
FMPKPMFGDNGSGMHCHMSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGIKNKIHPGEAMDKNL

SEQ ID NO: 3365 - protein, 410 aa, Zea mays
  misc_feature (107)..(107): Xaa can be any naturally occurring amino acid
  misc_feature (152)..(152): Xaa can be any naturally occurring amino acid
MDGVLGALLHRRSGGRPPPARATRRRALTRQPSAYDAGGGHRRAMLSKKYSYIPDTYTSLDEVAAALREQGLESSNLILGIDFTKSNEWTGRQSFGGQSLHRVGDTXPTPQPRTYEQAISIIGKTLAPFDEDNLIPCFGFGDATTHDYNVFXSFHPDNSPCHGFEEVLACYRKIVPHLKLSGPTSFAPIVEAAVDIVDRSGGQYHVLVVVADGQVTRSVDTGDGDLSPQEKRTVESIVTASSYPLSIVLVGVGDGPWDDMRRFDDKLPARDFDNFQFVNFTAIMARAATAQQKESAFALAALMEVPIQYKATMELGILGRSTGNAKRVAPAPPPLPHAQRQASSLRRGASNVGGAAAAPRDDQVCPICLTNAKDLAFGCGHMCCRECGESLTRCPICRQPIRSKLRLYSG

SEQ ID NO: 3366 - protein, 147 aa, Salmonella enterica
TFMPKPMFGDNGSGMHCHMSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGIKNKIHPGEAMDKNLYDLP

SEQ ID NO: 3367 - protein, 350 aa, Vibrio vulnificus CMCP6
MVTPWYGIKEGFGFEHLIWLLVTFSFTNLSITAGYHRLWSHKTYEAHPLLRVVFAIGGAFSLQNSALHWSSDHRMHHKFVDHHDKDPYSASRGFWFSHIGWMLRDYNQSTYNDYTNCRDLQKDPVIMWQHKYYVPLAIATNLGIPLLLGWYYQDIIGMLLVVGALRLTLSHHSTFFINSLAHIWGKQTFTDKNSARDNGFLAVLTFGEGYHNFHHIFENDYRNGIYWWQYDPTKWLIKSCSWLGLTRNLRLTPQMKIDKARAATRLKNALHQLAQRGEQESLKQQLQLEFDGLVATMKDYYDAKKQLLECKKQTAFKKYEVALVKIRYQQAKEDLLSRYKRWHALTAHYA

SEQ ID NO: 3368 - protein, 103 aa, Neisseria gonorrhoeae FA 1090
MKQLTLKEAQEFYAVHKDRPFYAGLVEFMTGGPVMIQVLEGENAVLKNRELMGATNPTEAAEGTIRADFATSVSINAVHGSDSVENAALEIAYFFSQTEICPR

SEQ ID NO: 3369 - protein, 298 aa, Bacillus thuringiensis serovar konkukian str. 97-27
MKIIKGAFPVLITPMDEFQEINWNGVKQNVNYFIEQKVAGIIINGSTGEFVSLSKEERFKMVETVLKEVNGRIPVIVGTAAETTKETIEFTKHAETHGADCALIINSYYCKPKEEEIYFHFKEISNAVNIPIMLYNNPFTSGVDMSTELMLRIGKECENVTHIKESSGDIRKARDLVRQGEGAFQVFCGSEDLVMESYLVGATGWVSVAGNIVPGLVTKMYEHFHNGELEKAWEINDAILPLCEFLEGSGKYVQIVKRSMELHGQAGGPSRYPRLGLTEEEDQKLQTIISKIAAHAAV

SEQ ID NO: 3370 - protein, 450 aa, Escherichia coli CFT073
MTKHYDYIAIGGGSGGIASINRAAMYGQKCALIEAKELGGTCVNVGCVPKKVMWHAAQIREAIHMYGPDYGFDTTINKFNWETLIASRTAYIDRIHTSYENVLGKNNVDVIKGFARFVDAKTIEVNGETITADHILIATGGRPSHPDIPGVEYGIDSDGFFALPALPERVAVVGAGYIAVELAGVINGLGAKTHLFVRKHAPLRSFDPMISETLVEVMNAEGPQLHTNAIPKAVVKNADGSLTLELEDGRSETVDCLIWAIGREPANDNINLEAAGVKTNEKGYIVVDKYQNTNVEGIYAVGDNTGAVELTPVAVAAGRRLSERLFNNKPDEHLDYSNIPTVVFSHPPIGTVGLTEPQAREQYGDDQVKVYKSSFTAMYTAVTTHRQPCRMKLVCVGPEEKIVGIHGIGFGMDEMLQGFAVALKMGATKKDFDNTVAIHPTAAEEFVTMR

SEQ ID NO: 3371 - protein, 365 aa, Gentiana triflora
MGSLLPSRVESLAISGIKTIPKEYIRPKEELASIGNIFEEAKNNNETTQIVPTIDLKDMDSLDNNKDVQTQCHGELKNAAMEWGVMNLVNHGISQELINRVKSAGQAFFDLPIEEKEKYANDQASGNVQGYGSRLANNASGQLEWEDYFFHCIYPERKRDMSIWPKTPHDYIPATIEYAKQLRDLATKVLAVLSVGLGLEPDRLENEVGGMEEMILQKKINYYPKCPQPELALGVEAHTDVSALTFILHNMVPGLQLFYQGKWITAKCVPDSIIMHVGDTLEILSNGKYKSILHRGLVNKEKVRISWAVFCEPPKDKIILKPLPETVSEIEPARFPPRTFAEHIKHKIFRKTEEAIKDNNIANGN

SEQ ID NO: 3372 - protein, 434 aa, Photobacterium sp. SKA34
MSKIVKVLAREIIDSRGNPTIEAEVHLEGGFVGMAAAPSGASTGSREALELRDGDKSRFLGKGVLKAVAAANGPIAEALIGQDAKDQAAIDQVMIDLDGTENKSNFGANAILAVSLANAKAAAASKGMPLFEHIAELNGTAGQFSMPLPMMNIINGGEHADNTVDIQEFMIQPVGAKTLREAVRMGSEVFHSLAKVLKSKGMSTAVGDEGGFAPNLESNEAALKAIQEAVEAAGYELGTDITLAMDCAASEFYNKEQGIYDLKGEGKQFTSEEFNYFLKDLTEKFPAIVSIEDGLDESDWAGFKHQTELLGDKIQLVGDDLFVTNTKIFAEGIEKGITNSILIKLNQIGSLTETLAAIKMAKDAGYTAVISHRSGETEDATIADLAVGTAAGQIKTGSMSRSDRVAKYNQLIRIEEALGERAPFNGLKEVKGQA

SEQ ID NO: 3373 - protein, 1076 aa, Pseudomonas putida KT2440
MTTMPKRTDIKSILILGAGPIVIGQACEFDYSGAQACKALREEGFRVILVNSNPATIMTDPAMADATYIEPIKWQSVAKIIEKERPDAVLPTMGGQTALNCALDLERHGVLEKFGVEMIGANADTIDKAEDRSRFDKAMKDIGLECPRSGIAHSMEEANAVLEKLGFPCIIRPSFTMGGTGGGIAYNREEFEEICTRGLDLSPTKELLIDESLIGWKEYEMEVVRDKKDNCIIVCSIENFDPMGVHTGDSITVAPAQTLTDKEYQIMRNASLAVLREIGVETGGSNVQFGICPNTGRMVVIEMNPRVSRSSALASKATGFPIAKIAAKLAIGYTLDELQNDITGGRTPASFEPSIDYVVTKLPRFAFEKFPKADARLTTQMKSVGEVMAIGRTFQESLQKALRGLEVGACGLDPKVDLASPEAASILKRELTVPGAERIWYVADAMRSGMTCEEIFNLTGIDMWFLVQMEDLIKEEEKVKTLALSAIDKDYMLRLKRKGFSDQRLAVLLGITDKNLRRHRHKLEVFPVYKRVDTCAAEFATDTAYLYSTYEEECEANPSTRDKIMILGGGPNRIGQGIEFDYCCVHAALALREDGYETIMVNCNPETVSTDYDTSDRLYFEPLTLEDVLEVCRVEKPKGVIVHYGGQTPLKLARALEEAGVPIIGTSPDAIDRAEDRERFQQMVQRLSLLQPPNATVRSEEEAIRAAGSIGYPLVVRPSYVLGGRAMEIVYELDELKRYLREAVQVSNDSPVLLDHFLNCAIEMDVDAVCDGTDVVIGAIMQHIEQAGVHSGDSACSLPPYSLSKEVQDEVRVQVKKMALELGVVGLMNVQLALQGDKIYVIEVNPRASRTVPFVSKCIGTSLAMIAARVMAGKTLKELGFTQEIIPNFYSVKEAVFPFAKFPGVDPILGPEMKSTGEVMGVGDSFGEAFAKAQMGASEVLPTGGTAFISVRDDDKPQVAGVARDLIALGFEVVATAGTAKVIEAAGLKVRRVNKVTEGRPHVVDMIKNDEVSLIINTTEGRQSIADSYSIRRNALQHKIYCTTTIAAGEAICEALKFGPEKTVRRLQDLHAGLKA

SEQ ID NO: 3374 - protein, 141 aa, Legionella pneumophila subsp. pneumophila str. Philadelphia 1
MAKELTLSIIKPDAVAKSVIGEIYTRFEKAGLDIVAAKMTQLSREQAESFYDIHRARPFFKDLVDFMISGPVMIQVLKGENAVAKNREIMGATNPKEAAPGTIRADFADSIDANAVHGSDSLENAAREIAFFFEQHELCNR

SEQ ID NO: 3375 - protein, 375 aa, Pseudomonas putida KT2440
MSKRDYYEVLGVERGATEADLKKAYRRLAMKYHPDRNPGDKESEDKFKEANEAYEVLSDASKRAAFDQYGHAGVDPSMGGGGAGFGGANFSDIFGDVFSDFFGGGGRGGGRGGAQRGSDLRYTLELNLEEAVRGTTVSIRVPTLVNCQPCDGSGAKKGSTPSTCPTCGGIGQVRMQQGFFSVQQTCPRCHGQGKIITDPCTSCHGEGRVEEYKTLSVKVPAGVDTGDRIRLSGEGEAGTHGGPTGDLYVVISVREHEIFQRDGKHLYCEVPISYTDAALGGELEVPTLDGRVKLKIPEGTQTGKQFRLRGKGVAPVRGGGAGDLLCRVAVETPVNLSRRQRELLEELRDSLEGDSSHSPKASGWFDGVKRFFGDL

SEQ ID NO: 3376 - protein, 201 aa, Brassica napus
MVHAGGHNSPGSNPNPTHMNKFAFGCAVVASIISIIFGYDTGVMSGARIFIQDDLKINDNQVEVLMGILNLCALVGSLTAGKTSDVIGRRYTIALSSVIFLVGSVVMGYGPNYAVLMVGRCIAGVGVGFALMIAPVYSAEIASASHRGFLTSLPELCISLGILIGYVSNYCFGKLALKLGWRLMLGLAAIPSMILAFGILK

SEQ ID NO: 3377 - protein, 679 aa, Oryza sativa
  misc_feature (650)..(650): Xaa can be any naturally occurring amino acid
MAASSAQLIFLLLLAVLAAASSRNDEEARALMALKESLDPAGRVLGSWARSGEPCGGSFVGVTCDSGGRVTAISLQGRGLSGTLPPAIAGLRRLTGLYLHYNGIKGAIPREIGSLSELTDLYLDVNHLTGPLPVEIAAMENLQVLQLGYNQLTGSIPPQLGKLNKLAVLALQSNQLTGAIPATLGDLTQLARLDLSFNSLFGSIPSKIAEVPLLEVFDVRNNSLSGSVPAGLRRLNGGFQYVNNKGLCGVGFSLLDLCLSSEDGLKPSKPEPFGPDGTVKTRQVPQSANTDNHCEGSGCSKSSNASVGVLVVGVVAVVIGAAFCGIFAFSYYRRQKQKIGSSLEVSDSRLSTDHYQQKEVCRRSASPLISVEYSNGWDPLSGGGVGSSGEVGDSFRFNLEEVECATQYFSEVNLLGKSGFAATYKGILRDGSVVAVKSLNKTSCKQEESDFLRGLKMLTVLRHENLVGLRGFCCSRGRGECFLVYDYMVNGCLSQYLDVKEGSGANILDWPTRVSIIRGIAKGVEYMHCKKTNKPSVVHQNISAEKILLDHHLTPRLSVPGLHKLLADDVVFSTLKASAAMGYLAPEYATTGRFTEKSDVFAFGIVVLQVITGRRAVSQLKVSTVANDLDSLIDENLNGVFSRTEAAKLXAAIAALCTSETASQRPTMEAVVQQLSNCH

SEQ ID NO: 3378 - protein, 134 aa, Salmonella enterica
GSGMHCHMSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGIKNKIHPGEAMDKNLYD

SEQ ID NO: 3379 - protein, 429 aa, Zea mays
MGSHLGARSMCRWRMPLALRTRGLYGHQALTVRLGVENPAPAVQVADYLALRRGPSMPPQRLASVVSSGEVMNRGEFQTSLVQQMIWSGGGGGNTTAAGSSNIMSSGFKQSCHEDQQEASRNLQLLPSLSSPSSLLFSNAQQFPHTTSSGQQLAHTNAGGAAAGSLPSLDDDGGSGQDSHMPESWSQMLLGEFAGERYAATACLLSKGVEDWGDHAAAAASACMVGGGGGVEEEGSAAMPLYSLYGGGSHSHSHSHLAAAGDHEMPPAPAAAAAGANKSQLSQMLLASSPRSCVTTSLGSNMLDFSNNGVPPAPDQLKSHHHHQSDNSSECNSTVTGSAIKKPRVQASSSAQSTLKVRKERLGDRITALHQIVSPFGKTDTASVLQETIGYIRFLLGQIEALSYPYMGHGNGTSIQNAHTHDRSLWKES

SEQ ID NO: 3380 - protein, 148 aa, Salmonella enterica
TFMPKPMFGDNGSGMHCHMSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGIKNKIHPGEAMDKNLYDLPP

SEQ ID NO: 3381 - protein, 202 aa, Oryza sativa (japonica cultivar-group)
MAADALVVAGQAKARHPLSQIAESGTHRLLLKQWLKEEDLLARRVALREARLDGARKEIAFLYCAFFAFHAASILLLFLSASASTSAACRRSWIPCLVSLLSSLAMLWALRYKADTEAVLERLLAREREDALLLGKCVAELKRKGLEFDLLKEVDALRRAKSLRVEAKGGAGGERPKRWAARDLAVFLLFGAACGVLVLTRL

SEQ ID NO: 3382 - protein, 346 aa, Arabidopsis thaliana
MAVTLRLTNSLAFSSHPLTSSVLFRGSKSIGTITKIASTIRTVKMAAFAGSDSETTSSTSRVIDSHLHIWASPQEAETYPYFPGQEPTLTGDVNFLLKNMEEARVDGALIVQPINHKFDHSLVTSVLKRYPSKFVGCCLANPAEDGSGITHLENLVLESNYRAVRFNPYLWPSGQKMTNAVGKALFSKAGELCVPVGFMCMKGLDLHIAEIEELCTEFPKTTVLLDHAGFCKVPESGEAKLAYSQLMKLSRFPQVYVKFSALFRISRTGFPYQDLSPLLSQLVSHFGANRVMWGSDFPFVVLECGYKEAKEAVTIIAKEASLSSSEMDWILGKTLMQLFPGQWVLP

SEQ ID NO: 3383 - protein, 124 aa, Salmonella enterica
LAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGINNKIHPGEAMDKNLY

SEQ ID NO: 3384 - protein, 1072 aa, Bacillus thuringiensis serovar konkukian str. 97-27
MPKRLDINTILVIGSGPIVIGQAAEFDYSGTQACQSLKEEGYKVILVNSNPATIMTDTATADKVYIEPLTLEFVSRIIRKERPDAILPTLGGQTGLNMAVELAKSGVLEECGVEILGTKLSAIEQAEDRDLFRTLMQELNEPTPPSEIIHNLDEAYGFVKEIGYPVIVRPAFTLGGTGGGICHNEEELIEIVTSGLKHSPVTQCLLEKSIAGCKEIEYEVMRDSNDNAIVVCNMENIDPVGVHTGDSIVVAPSQTLSDREYQMLRNTSLRIIRALGIEGGCNVQLALDPYSFQYYVIEVNPRVSRSSALASKATGYPIAKLAAKIAVGLTLDEIVNPVTQKTYACFEPALDYVVSKIPRWPFDKFESANRTLGTQMKATGEVMSIGRNLEESLLKAVRSLELGIYHLELDHLKELDKETMKKRIIKADDERLFIVAEAIRQGVTKEEINEWCEMDFFFLQKVENIVNMEREVKANVGNMEVLQTAKEMGFSDHYIAAAWNKTEREIYDMRKENNMTPVFKMVDTCAAEFESATPYYYSTYADENESIVTDRKSVVVLGSGPIRIGQGVEFDYATVHSVWAIKEAGYEAIIINNNPETVSTDFSISDKLYFEPLTIEDVMHIIDLEKPEGVIVQFGGQTAINLAAKLEEHGVKILGTSLEDLDRAEDRDKFEAALTKLGIPQPVGKTATTVEQAVAIAEEIGYPVLVRPSYVLGGRAMEIVYRQEELLHYMKNAVKVHADHPVLIDRYMVGKEIEVDAISDGENVFIPGIMEHIERAGVHSGDSIGVYPPQSLSEKLKEQIIEHTIALGKGLNIVGLLNIQFVVFEDQVYVIEVNPRASRTVPFLSKITGVPMANVATKVILGQDLVEQGYGTGYHPEEKEVYVKAPVFSFAKLRSVDTTLGPEMKSTGEVMGKDLTLEKALYKGLVASGINIPTHGSVIITVADKDKEEAMEIAKRFHEIGYNLLATAGTAQSLTEQNIPVQVVNKIDSEDYNLLDIIRQGKAQFVINTLTKGKQPARDGFRIRRESVENGVACLTSLDTTRAILRVLESMTFSAHSMKEITQTKRHEVVHA

SEQ ID NO: 3385 - protein, 129 aa, Salmonella enterica
CHMSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGIKNKIHPGEAMDKNLYD

SEQ ID NO: 3386 - protein, 200 aa, Magnaporthe grisea 70-15
MPFDSERATAVLASVSSAGLAASATGPIPAGFRPTMDLFVSFGAKQVELGNSFVKSECAEAPKVYFEAEDAATYTLFLVDPDAPYPNDNKFANWRHWVVTGLRPAASGSQGGQDIASTGTALTQYLAPGPKDDSEPHRYLFQLFREPKGGLGHLTKADIGGEEFVERRSFDSVGWAAARGLELVAANWMSCASDAWVRAE

SEQ ID NO: 3387 - protein, 286 aa, Prochlorococcus marinus str. MIT 9303
MDSPSTTASGWIDEHHQGVRYGLQGRVLVDEKSPYQRITVIDSSRYGKGLLLDGCWMTAEHQERHYHESLVHPALCSAAQLERVLVIGGGDGGTARECLRYQDVKHLDMVEIDGRVVELSQKHLPSIGGHAWSDARLQLNLEDGIAWTANATDSSYDVILVDGSDPTGPAEGLFNEAFFKQCRRILRPGGVFATQSESPEAFRQIHIDTVRLIRQVFGYADPLYGWVPMYPSGWWSWTFAAVDGPRYRNPLPARAAAISSGCEIWSPRWQQGAFEAIPAFIERELT

SEQ ID NO: 3388 - protein, 472 aa, Oryza sativa (japonica cultivar-group)
MAFFRGLTAVSRIRSRMAQEATTLGGVRWLQMQSPSDLDLKSQLQELIPEQQDRLKKLKSEHGKVQLGNITVDMVLGGMRGMIGMLWETSLLDPEEGIRFRGLSIPECQKVLPTAIKGGEPLPEGLLWLLLTGKVPTKEQVDALSKELVTRSSVPGHVYKAIDALPVTAHPMTQFTTGVMALQVESEFQKAYDKGMPKSKFWEPTYEDCLNLIARLPPVASYVYRRIFKDGKTIAADNALDYAANFSHMLGFDDPKMLELMRLYVTIHTDHEGGNVSAHTGHLVGSALSDPYLSFAAALNGLAGPLHGLANQEVLLWIKSVIGETGSDVTTDQLKEYVWKTLKSGKVVPGFGHGVLRKTDPRYTCQREFALKYLPEDPLFQLVSKLYEVVPPILTELGKVKNPWPNVDAHSGVLLNHFGLSEARYYTVLFGVSRSIGIGSQLIWDRALGLPLERPKSVTMEWLENHCKKAAA

SEQ ID NO: 3389 - protein, 112 aa, Rhodopirellula baltica SH 1
MSSIFSKIIAKEIPADIVYEDDLCLAFRDIAPKAPTHILVIPKREIVSLADLTDEDQAVMGRCVVVASKVAADEGLGDGFRLVVNTGSDGGQEVPHVHFHLLGGRKMTWPPG

SEQ ID NO: 3390 - protein, 408 aa, Oryza sativa
MSSRMAGATLLRHLGPRLFAAEPVYSGLAASARGVMPAAARIFPARMASTSSAGADVKEGAAEKLPEPAATAAAAATDPQNKKAVVSYWGIQPPKLVKEDGTEWKWLSFRVSAHQPLMCALLFLFFCTVNSRFDRVHDVCFFCIVTQPWDTYTSDTSIDVTKHHEPKGLPDKLAYWTVRSLAVPRDLFFQRRHASHALLLETVAGVPGMVGGMLLHLRSLRRFEQSGGWIRALLEEAENERMHLMTFLEVMQPRWWERALVLAAQGVFFNAYFVGYLVSPKFAHRFVGYLEEEAVSSYTEYLKDLEAGKIENTPAPAIAIDYWRLPADATLKDVVTVIRADEAHHRDLNHFASVRICQPENNQSRLLNFCVNGFELTDRVSRVGTSLVQDIQQQGMKLKDTPAPIGYH

SEQ ID NO: 3391 - protein, 293 aa, Brassica napus
  misc_feature (243)..(243): Xaa can be any naturally occurring amino acid
MSYSAAGHGKPGSGKRRIRELLTQSDNRFCADCGAPDPKWASANIGVFICLKCCGVHRSLGTHISKVLSVTLDEWSDEEVDSMIEIGGNDSANSIYEAFIPHGFTKPGPDASHDQRLRFIRSKYEHQEFLKPSLRITSVKAPSTKTSSSYLSSSLSKKFMDSFRTNSSSQHPQLEGMVEFIALLKVTLKKGTNLAVRDMMTSDPYVKLTLGQQTVQSTVKKSNLNPVWNEELMLSVPHDYGSXVKLQVFDYDTFSGDDIMGEAGIDIQPLITSAMAFGDPEMFGDMQMGKWLK

SEQ ID NO: 3392 - protein, 361 aa, Photorhabdus luminescens subsp. laumondii TTO1
MMKMDCLIVGAGQAGLSLAATLAAKNINVCILEREARIGDVWRRRPDNMLLFTSRGMTQLHGLPFPGIKEGYPDKNEVADYLERYASHHNLAIHTQTEVVEVKHDTDGYRVKTKDGKVFHAPCLVNATGANQLVDIPALAERFSTDIQQITADQYREPKQIKTGSRVAVVGDGASGRQIAKDLAATAKVTLFCGSSRPLLPNRILGKDIFWWLSKSGLLFANYYSLVGKIMRRRNPIPCGDLKNHRLAVLDIKIANRLVDIKDNKLCDSSGNQYEVDTVIWCLGYKDDTAWLTLPGAADANGFVCKNGHAEGGKTPYPGLFIVGRKWLSSRGSELMLGAYKDTCRVAKWVENYLKEHVPLK

SEQ ID NO: 3393 - protein, 382 aa, Triticum aestivum
MLHLRKRVLSGPPLPSTFPLLSLQRLLSTAAAPAVSSNPSFAVEEYLVATCGLTRAQALKASTKLSHLKSPAKPDAVLAFFAGLGLSGADVAAVVARDSQILCAGVETTLSPVVAGLTGLGLSQAEIARLVSLSPDNLRHRSVVSKIEYYLPLFGSIDNLFRPLKYGSGFLNSDLERVIKPNVKVLADCGLGACDIAKLFIHAPRILSAKPECFLLKVACAEGIGVPRGSGMFRQALHAVSYLSDDKITAKLDNLKKTLRWSDTEVGIAVSKCPILLRRSNDVLQRLSEFLIAEVGLEPTYIAHRPEMLTRSLEGRLRPRYNVLRFLMENGLLKRNQSYCTIVKWTEKEFLENFVCPHKEAAPYLAEDYAAACKGEVPARFR

SEQ ID NO: 3394 - protein, 431 aa, Myxococcus xanthus DK 1622
MNHAHSQALFARAQARIPGGVNSPVRAFRGVGGDPVFFREGAGAWLTDVDGNRYVDLVGSWGPLILGHAYPPILDAIIDAARRGSSYGAPHADEVEFAELICATMPAVEMVRLVSSGTEATVAAIRVARGFTGREHILKFEGCFHGAGDPFLVKAGSGVETLGLPDSPGVPSALAKLTLTAPFNDLAAVERIFAENGQDIACAIIEPVVGNMGVLVPKPGYLEGLQALCQKHGVLLVLDEVMTGFRLSRGGAQELYGLKPDLTTMAKVIGGGMPMGAYGGRRDIMEKVAPAGPVYQSGTLSGNPVAVAAGLACLKALAAPGTYARLEEVSRMLEVGLLAEAKAADVPVTVNRVGSMLTVFFTGEPVYDYTSAKKADTARFGKFFHAMLNESVYLPPSQFEAAFVSLAIGEPEVAHVLAAARKAFRSLGKTG

SEQ ID NO: 3395 - protein, 347 aa, Streptococcus orisratti
IKKAYRRMSKKYHPDINKEPGAEQKYKDVQEAYETLGDEQKRAAYDQYGPAGANGSFGGGAGGFGGFDGGAGFGGFEDIFSSFFGGGGSMRNPNAPRQGDDLQYRVNLSFEEAIFGAEKEVTYNREAECTTCHGSGAKPGTSPVTCSRCHGQGVINVDTQTPLGMMRRQVTCDVCHGTGKEIKNPCTTCHGTGHEKEKHKVSVKIPAGVETGQQIRLQGQGEAGFNGGPYGDLFVVINVLPSTKFERNGSTIYYNMDISFVQAALGDTVDIPTVHGPVEMNIPAGTQTGKTFRLKGKGAPKLRGGGQGDQHVTVNIVTPTKLNDAQKRRFELLLLRVVTGRNPRKKA

SEQ ID NO: 3396 - protein, 312 aa, Streptococcus mitis
NKEPGAEEKYKEVQEAYETLSDDQKRAAYDQYGAAGANGGFGGAGGFGGFDGAGGFGGFEDIFSSFFGGGGASRNPNAPRQGDDLQYRVNLTFEEAIFGAEKEVKYNREASCSTCNGSGAKPGTSPVTCGRCHGAGVINVDTQTPLGMMRRQVTCDVCHGRGKEIKDPCTTCHGTGHEKQAHSVHVKIPAGVETGQQIRLAGQGEAGFNGGPYGDLYVVVSVEASDKFEREGTTIFYSLNLNFVQAALGDTVDIPTVHGDVELVIPEGTQTGKKFRLRGKGAPSLRGGAVGDQYVTVNVVTPTGLNERQKAA

SEQ ID NO: 3397 - protein, 196 aa, Zea mays
SSARLEDRGFETATVADVLKSKGKSADGSWLWCTTEDSVYDAVKSMTQHNVGALVVVKPGQNKSIAGIVTERAVHHSTFGIKESQLFRALYSRYNRNCIKLKYTYYLRKIIVQGRSSKSTKVGDIMTEENKLITVNPDTKVLQAMQLMTENRVRHIPVIDGTGMLGMVSIGDVVRAVVAEHREELNRLNDYIQGGY

SEQ ID NO: 3398 - protein, 128 aa, Salmonella enterica
CHMSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGIKNKIHPGEAMDKNLY

SEQ ID NO: 3399 - protein, 216 aa, Arabidopsis thaliana
MDPQLMEVSQQFERFKAAFIIKDFDTCSSLLSQLKVLFPFSPNSMNRIPPSPQENLIMGLNLLRLLVQNRIAEFHTELGLLSSATLENPCIKHAVELEQSFMEGAYNRVLSARQTAPDETYVYFMDLLAKTIRDEIAGCSEKAYDHLSISEGCKMLLFSSDQQLLTYVNEEHPEWEVKDGLVVFQKTRETAPCKEIPSLQLINQTLSYTRELERIL

SEQ ID NO: 3400 - protein, 320 aa, Streptococcus mitis
DINKEPGAEEKYKEVQEAYETLSDDQKRAAYDQYGAAGANGGFGGAGGFGGFDGAGGFGGFEDIFSSFFGGGGASRNPNAPRQGDDLQYRVNLTFEEAIFGAEKEVKYNREASCSTCNGSGAKPGTSPVTCGRCHGAGVINVDTQTPLGMMRRQVTCDVCHGRGKEIKDPCTTCHGTGHEKQAHSVHVKIPAGVETGQQIRLAGQGEAGFNGGPYGDLYVVVSVEASDKFEREGTTIFYNLNLNFVQAALGDTVDIPTVHGDVELVIPEGTQTGKKFRLRGKGAPSLRGGAVGDQYVTVNVVTPTGLNDRQKAALKEFAA

SEQ ID NO: 3401 - protein, 319 aa, Streptococcus mitis
NKEPGAEEKYKEVQEAYETLSDDQKRAAYDQYGAAGANGGFGGAGGFGGFDGAGGFGGFEDIFSSFFGGGGASRNPNAPRQGDDLQYRVNLTFEEAIFGAEKEVKYNREASCSTCNGSGAKPGTSPVTCGRCHGAGVINVDTQTPLGMMRRQVTCDVCHGRGKEIKDPCTTCHGTGHEKQAHSVHVKIPAGVETGQQIRLAGQGEAGFNGGPYGDLYVVVSVEASDKFEREGTTIFYNLNLNFVQAALGDTVDIPTVHGDVELVIPEGTQTGKKFRLRGKGAPSLRGGAVGDQYVTVNVVTPTGLNDRQKAALKEFAAA

SEQ ID NO: 3402 - protein, 127 aa, Salmonella enterica
FMPKPMFGDNGSGMHCHMSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDG

SEQ ID NO: 3403 - protein, 402 aa, Thiobacillus denitrificans ATCC 25259
MELRLAEVFAHLREAEAEAGAPLCAYLYDLAALDAHAAALAASLPPGCDLFYAIKANSDLPILQTLAPHVAGFEVSSGGELAWVRAHFAEIPVIFSGPGKLDDELRQALEHGVDCLHVESRHELQRLAEIAARLGRTAPVALRVNLTLDALAETPLMMGGKPTPFGIPTEQLPACLDWLRERPEIRLRGLHFHLLSHQLDAAAHLRLVAAYLAQTRRWCEAHGLALDHVNVGGGIGINYREPARQFDWPAFSAGLASLLHEAGLPGVRVRFELGRYVTAACGYYAMQVVDIKHSHGKTFVVGRGGSHHFRTPYAQGHSHPFHVLPVDDWPYAFARPQAADQRVSVVGQLCTPKDLLAFDAPVESVRCNDVLVFPYAGAYAWHISHHDFLRHPHPAQWYLPVE

SEQ ID NO: 3404 - protein, 320 aa, Streptococcus mitis
RYHKEPGAEEKYKEVQEAYETLSDDQKRAAYDQYGAAGANGGFGGAGGFGGFDGAGGFGGFEDIFSSFFGGGGASRNPNAPRQGDDLQYRVNLTFEEAIFGTEKEVKYNREAGCRTCNGSGAKPGTSPVTCGRCHGAGVINVDTQTPLGMIRRQVTCDVCHGRGKEIKDPCTTCHGTGHEKQAHSVHVKIPAGVETGQQIRLAGQGEAGFNGGPYGDLYVVVSVEASDKFEREGTTIFYNLNLNFVQAALGDTVDIPTVHGDVELVIPEGTQTGKKFRLRGKGAPSLRGGAVGDQYVTVNVVTPTGLNDRQKAALKEFAA

SEQ ID NO: 3405 - protein, 147 aa, Salmonella enterica
ATFMPKPMFGDNGSGMHCHMSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGIKNKIHPGEAMDKNLYDL

SEQ ID NO: 3406 - protein, 125 aa, Salmonella enterica
LAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGIKNKIHPGEAMDKNLYD

SEQ ID NO: 3407 - protein, 1357 aa, Francisella tularensis subsp. tularensis SCHU S4
MCYMNDLLNHSGEYPISKEIMNISKYWLIDEKEAMTKLVEKAHMSSVQKAQVRERAYGLVEKVRKNRLKKSGIDAFMIEYDLSSEEGIVLMCLAEALLRVPDKYTIDLLIKDKLTSAAWKNHVGMEKHLFVNAATWSLMLTGKILKDPHRSYRKVFQNFLKKTSEPVIRQAMKQAMKIVGKQYVLGETIEEALKVSEAKVARGYSYSYDMLGEAAMTMDDAEYYYSQYLHAIHELAKYATNTEIKKNPGISIKLSALHPRYEVAKHQRVHTELYPKLLKLTQLAKDYNVGMNIDAEETERLQISLELVERLAHEPSLEGFNGIGIVVQAYQKRAPYVLDYLANLAKKTNRRFMIRLVKGAYWDAEIKHAQEQGLAGYPVFTRKYHTDVSYQACVKQLFENHQYIYPQFATHNAQTVAVVFELANGNRDFEFQCLHGMGDALYDNVVGKEGYEDIPCRIYAPVGGHKHLLAYLVRRLLENGANSSFVNRIVDENLPIEELIEDPVKKAIDHGCGQHPNIPYPKDIVSPRLNSQGHNTNDFAVLADMYKQIEKYTHKNTYKAKPIVSGIDLDKTITESVINPNTNEVIGSVINADAKIAKRALKNAQSAFEEWSNTPATKRADILEKFADLLEQDTNKFIAIAMIEAGKTLANAIDEVREAVDFCRYYAAQARKEFNGPIELPALSDHLKQIEFTGRGAMVCISPWNFPLAIFLGQITAVLAAGNTVVAKPAEQTPIIAYKAVKLLFKAGLPKNVLQFTPGDGATVGSALVKSPVCKGVIFTGSTEVAAIINQTLANKSSEIVLFIAETGGQNAMIVDSSSLPEQVTADVIRSAFDSAGQRCSALRILCLQEDIADNYIKMIVGAMKELKIGDSKYIDTDVGPVIDKEAADNLNAYIEEKKSQFKLIYQAQPNQDTQKGTFVMPTAFEIDKISDLGREQFGPILHILRFKANQLDKLINDINATGYGLTVGVHSRINEVMNYVKNNLKAGNIYVNRNIVGAVVGVQPFGGQGKSGTGPKAGGPYYMHRLANEKLSGVGAVEEIYNPEKIAEDEKQTNKLIKDKYTITNIVAGEKAKKDKYTNLKAANGKTIGKKYVASVNTVDNAIEIASKEVEIWNHVNAEQRAATIEKFLELLEKERHLIASSLVVESNISVEDAHIQIDKTIQQVAYYCLQAKKEFAHPQLLPGPTGEIDELSLKGRGVVVSMCSSSDLLIRFVGQTAAALLAGNTVVAKPAYTGNLTAYNIVKLMLKAGIDSKVLHLVLSDDEEITSALLFNSKVALVAFSGSVSAVKQVHQALVLRRGAIIPFVAESVAKNGKCTSLAIETASPLYLRRFVVEKTVSVDTTASGGNASLMSLEE

SEQ ID NO: 3408 - protein, 2186 aa, Yarrowia lipolytica CLIB122
MTPSLPIFPPLNPEDKLMTLELQDGTAVQGYSFGADKPVAGELVFQTGMVGYPESITDPSYQGQILIVTFPLVGNYGVPSREAVDEVVKGLPKHFESNKIHVAGLVVASYTEEYSHFLAESSLGAWLKEQDIPAIYGVDTRRMTKHIREEGSMLGRLCIDNAVPEWVDPNKLNLVAEVSIKEPKLYTPPADRAIHVNGKPVRILAVDVGMKYNQIRCFVNRGVELLVVPYDYDFLNEEYDGLFLSNGPGDPSVLKETAARIAKAVEAKKTPIFGICLGHQLLSRSTGATTLKMKFGNRGHNIPCTNLLSGRCYITSQNHGYAVDAKSLTGGWEELFVNSNDGSNEGIYHKDLPFFSVQFHPESTPGPRDTEFLFDVFIKAVVEHKTSGVLKAIEFPGGTIEENRAAHPRVQVKKVLVLGSGGLSIGQAGEFDYSGSQAIKALKEEGIYTVLINPNIATIQTSKGLADKVYFLPVTPEFVRKVIKYERPDAIYVTFGGQTALNVGIEMKDEFEGLGVKVLGTPIDTVITTEDRELFARSMEEIGEKCAKSATASSKEEALAVVEEIGYPVIVRAAYALGGLGSGFADNEAELIELCNKAFAGSPQILVERSMKGWKEIEYEVVRDAFDNCITVCNMENFDPLGIHTGDSIVVAPSQTLSDEDYNMLRTTAVNVIRHLGVVGECNIQYALNPFSKEYCIIEVNARLSRSSALASKATGYPLAFIAAKLGLNIPLNEIRNSVTQVTCACFEPSLDYVVVKIPRWDLKKFTRVSTLLSSAMKSVGEVMSIGRTFEEAIQKAIRSTDYQNLGFNETEALMSIDIDSELQTPSDQRLFAIANALHSGYTVDKIWELTNIDKWFLNKLDGLVKFAKGLTKYNNSNLPVNIMREAKQLGFDDRQIAKYTGSNELAVRLKRVEAGVTPFVKQIDTVAAEFPAFTNYLYMTYNADSHDLTFDDHGTMVLGSGVYRIGSSVEFDWCAVRAVRTLREQGAKTIMVNYNPETVSTDYDEADRLYFEVINMERILDIYELERSSGVVISMGGQTSNNIALQLYRQNVNILGTSPEMIDSAENRYKFSRMLDTIEVDQPAWKELTSIDEAEAFAEKVSYPVLVRPSYVLSGAAMNTVYTRDDLASYLNQAVEVSRDYPVVITKYIENAKEIEMDAVAKDGKLIMHVVSEHVENAGVHSGDATLIVPPQDLDPETVRRIVVATAKIGKALQVTGPFNIQFIAKDNEIKVIECNVRASRSFPFVSKVTGVDLIEMATKAICGFPVSPYPLEELPQDFVAVKVPQFSFSRLSGADPILGVEMASTGEVATFGKNKYEAYLKALLATGFKLPKKNILLSVGSYKEKVELMPSIKRLHELGFKLFATAGTADFIQEHGVPVQYLDVLNEGADEEKSEYSLTQHLANNMIDLYINLPSSNRFRRPANYMSKGYRTRRLAVDYAVPLVTNVKNAKLLTEALARNMTLDVSATDFQSSHNTVTLPGLVNVAGVVPDIAIAGSSDIADFTKVSLRSGFTFSRLLPMGVSESIIDLASLQTAQANAEGHSFTDYNLSVAATAHNANEVGKVTGKVGSLVLPFSKLGDNTTKVAAISEHFGAWPANKPIVTDATTTDLASILLLASLHNRPIHVTGVVDKNDIVLVAMAKERGLAVTCDVSVFALFFAREDYPEAHSLPTQEDQDALWANLATIDCFSVGILPSQMAKELGQPVVAGLGVAETLPLLLSAVADKRLTVEDIEARLYTNPVRIFELVEQPDTSIVVNLGRKYTFKSKGLWSPMAGKPATGSVERVIVGGQTVVLEGDLNGASTGKAISIHPQAAPVEAAPATQEMVHSPTTPRMARFSFSSDVRPFANNHVESSVVGAIPPEVSAPSILNKLRRNPFLGQHILSVNQFSKENLHDIFALANELRQAVKRVGVLDILKGRLLTTLFYEPSTRTATSFDAAMQRLGGRVIAVNVDASSYKKGETLQDTLRSVACYSDAIALRHPDPESANIAGRFSPVPVINGGNGSVEHPTQALLDMYTIREEVGTLNGTTITFMGDLRYGRTVHSLVRLLTHYKVNIRLVCPPELTLPDELKTLLKSQGKLDLESATLTPEIVSTTDVLYCTRVQKERFTNEKEFEAIKESYLVDNKVLKDAKPHMCVMHPLPRNAEINPEVDFDARAAYFRQMRHGLFVRMALLAMVMGPVQ

SEQ ID NO: 3409 - protein, 220 aa, Bacillus thuringiensis serovar konkukian str. 97-27
MDLKQIAGEYAATFVKDGMKVGLGTGSTAYWTIQKLGQRVKEGLSIQAVPTSKETEALAQQLNIPLISLNDVQSLDLTIDGADEIDSNLQLIKGGGGALLREKIVASSSKELIIIVDESKVVTRLGTFPLPIEIIPFAWKQTESKIQSLGCQTTLRLKNNETFITDNNNMIVDCIFPNHIPTPSDLHKRLKMITGVVETGLFVNMTSKAIIGTKNGIQEL

SEQ ID NO: 3410 - protein, 428 aa, Neisseria gonorrhoeae FA 1090
MSAIVDIFAREILDSRGNPTVECDVLLESGVMGRAAVPSGASTGQKEALELRDGDKSRYSGKGVLKAVEHVNNQIAQALIGIDANEQSYIDQIMIELDGTENKGNLGANATLAVSMAVARAAAEDSGLPLYRYLGGAGPMSLPVPMMNVINGGEHANNSLNIQEFMIMPVGAKSFREALRCGAEIFHALKKLCDSKGFPTTVGDEGGFAPNLNSHKEALQLMVEAAEAAGYKAGEDVLFALDCASSEFYKDGKYHLEAEGRSYTNAEFAEYLEGLVNEFPIISIEDGMDENDWEGWKLLTEKLGKKVQLVGDDLFVTNPKILAEGIEKGVANALLVKVNQIGTLSETLKAVDLAKCNRYASVMSHRSGETEDSTIADLAVATNCMQIKTGSLSRSDRMAKYNQLLRIEEELAEAAYYPGKAAFYQLGK

SEQ ID NO: 3411 - protein, 123 aa, Salmonella enterica
LAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGIKNKIHPGEAMDKNL

SEQ ID NO: 3412 - protein, 256 aa, Triticum aestivum
  misc_feature (206)..(206): Xaa can be any naturally occurring amino acid
  misc_feature (219)..(219): Xaa can be any naturally occurring amino acid
VILEQVCTKKQAPTGPEFPGYRRPTRPRSSTIVASLGTPAPSNSSSFRPKLIRNTPVQAAPVAPALMDAAVERLKTGFEKFKTEVYDKKPDFFEPLKAGQAPKYMVFACADSRVCPSVTLGLEPGEAFTIRNIANMVPSYCKNKYAGVGSAIEYAVCALKVEVIVVIGHSRCGGIKALLSLKDGADDSFHFVEDWVKIGFPAKKKXQTECASMPFKDQXARPQKEAGNVSLQNLLTYPFGKEGGVQRKPLSSLGGH

SEQ ID NO: 3413 - protein, 494 aa, Bacillus cereus G9241
MLTKNIELKPKVKAFLNEEIKMFINGEFVPSISGKTFETYNPATEDVLAVVCEAQEEDIDVAVKAARSAFESGPWAEMTTAERAHLIYKLADLIEEHGEELAQLEALDNGKPYQVALDDDIAATVENYRYYAGWATKIIGQTIPISKDYLNYTRHEPVGVVGQIIPWNFPLVMSSWKMGAALATGCTIVLKPAEQTPLSLLYTAKLFKEAGFPDGVVNFVPGFGPEAGAAIVNHHDIDKVAFTGSTVTGKYIMRQSAETIKHVTLELGGKSPNIILEDADLEEAINGAFQGIMYNHGQNCSAGSRVFVHRKHYETVVNELVKMANNVKLGAGMEKETEMGPLVSKKQQERVLHYIEQGKAEGATIAAGGERAFEKGYFVQPTVFIDVTDDMTIVKEEIFGPVVVVLPFDSTEEVIERANRSSYGLAAGVWTQNIKTGHQVANKLKAGTVWINDYNLENAAAPFGGFKQSGIGRELGSYALDNYTEVKSVWVNIK

SEQ ID NO: 3414 - protein, 298 aa, Bacillus cereus G9241
MKKIKGAFPVLITPMDEFQEINWNGVKQNVNYFIEQKVSGIIINGSTGEFVSLSKEERFKMVETVLKEVNGRIPVIVGTAAETTKETIEYTKHAEAHGADCVLIINSYYCKPKEEEIYFHFKEISNAVNIPIMLYNNPFTSGVDMSTELMLRIGKDCENVTHIKESSGDIRKARDLVRQGEGAFQVFCGSEDLVMESYLVGATGWVSVAGNIIPGLVTKMYEHFHNGELEKAWEINDAILPLCEFLEGSGKYVQIVKRSMELHGQAGGPSRYPRLGLTEEEDQKLQTIISKIAAHAAV

SEQ ID NO: 3415 - protein, 190 aa, Zea mays
  misc_feature (51)..(51): Xaa can be any naturally occurring amino acid
TYGVTVMRSGGGSSQPACSTHSRPALQAFAVQIKRIAGRHGGAASPTCTAXAMRKATIFLMALALTLIPHEQTVATPPQPLPLQLRRSRFLAANNVNFSPPPPPSFYDCSKKPPSICLSPGSPGATCCRGTCVDTEYSSQHCGNCNKMCKLAQACCQGNCVNTLTDEKNCGGCGVKCRTKCTNGYCDYAA

SEQ ID NO: 3416 - protein, 631 aa, Escherichia coli O157:H7 EDL933
  misc_feature (575)..(575): Xaa can be any naturally occurring amino acid
  misc_feature (580)..(580): Xaa can be any naturally occurring amino acid
  misc_feature (603)..(603): Xaa can be any naturally occurring amino acid
  misc_feature (611)..(611): Xaa can be any naturally occurring amino acid
  misc_feature (620)..(620): Xaa can be any naturally occurring amino acid
MSATKLTRREQRAQAQHFIDTLEGTAFPNSKRIYITGTQPGVRVPMREIQLSPTLIGGSKEQPQYEENEAIPVYDTSGPYGDPQIAINVQQGLAKLRQPWIDARGDTEELTVRSSDYTKARLADDGLDELRFSGVLTPKRAKAGRRVTQLHYARQGIITPEMEFIAIRENMGRERIRSEVLRHQHPGMSFGARLPENITAEFVRDEVAAGRAIIPANINHPESEPMIIGRNFLVKVNANIGNSAVTSSIEEEVEKLVWSTRWGADTVMDLSTGRYIHETREWILRNSPVPIGTVPIYQALEKVNGIAEDLTWEAFRDTLLEQAEQGVDYFTIHAGVLLRYVPMTAKRLTGIVSRGGSIMAKWCLSHHQENFLYQHFREICEICAAYDVSLSLGDGLRPGSIQDANDEAQFAELHTLGELTKIAWEYDVQVMIEGPGHVPMQMIRRNMTEELEHCHEAPFYTLGPLTTDIAPGYDHFTSGIGAAMIGWFGCAMLCYVTPKEHLGLPNKEDVKQGLITYKIAAHAADLAKGHPGAQIRDNAMSKARFEFRWEDQFNLALDPFTARAYHDETLPQESXKVAHXCSMCGPKFCSMKISQEVRDYAAXQTIEMGIXDMSENFRAXGGEIYLRKEEA

SEQ ID NO: 3417 - protein, 891 aa, Ralstonia eutropha JMP134
MASVMPIPSSDNDIDAQETREWLDALEGVIAHEGPERAHFLIEQLIRRAHDAGIYLPFSANTAYLNTIPLETQARSPGDQELEHRIRSYIRWNAIAVVLRAGRDTNVGGHIASFASAATLYEVGFNHFWHAPSSQHGGDLVFFQGHSAPGFYARAFLEGRLSEAQMDNFRQEVGGQGISSYPHPWLMPDFWQFPTVSMGLGPIMGIYQARFMKYLQDRGFGDHHARKVWVFCGDGEMDEPESRGALGMAGREHLDNLVFVINCNLQRLDGPVRGNGKIIQELESEFRGAGWNVIKVVWGSKWDALLARDKNGILAQRMMTCVDGDYQTFKSKDGAYVREHFFNTPELKALVSDWSDDDIWQLNRGGHDPHKVFAAYQAAANHTGQPTVILAKTIKGYGMGEAGEAQNITHQQKHMRVETLARFRDRFRLPLSDEQLADLSYLKFEEGSPEHVYLHQRRQALGGYLPSRRRTGPELPVPPLSAFDTQLKASGEGREVSTAMSFVRILNVLLRDKALGRRIVPIVSDESRTFGMEGLFRQIGIWSQQGQTYTPQDASQLSFYKESKDGQILQEGINEAGAMADWIAAATSYSTHGEPMIPFFIFYSIFGFQRFGDLAWAAGDQRARGFLLGGTAGRTTLNGEGLQHEDGHSLVWGGTIPNCISYDPTFAYELAVIVQDGLRRMLQEQEDVYYYITVMNENYEHPAMPEGAENDILKGMYAFRRAGEGTGPRVQLLGAGTIFREVIAAADMLEQDWGVQADLWGCPSFTELAREGNAAARWNLLHPDETPRQSHVEHCLADTRGPVIASTDYVRMLAEQIRPFVPRAYTVLGTDGYGRSDTREKLRDFFEVDRRWIVLSALKALVEEGSVERGVLRQAIYKYGIDPEKRNPLLA

SEQ ID NO: 3418 - protein, 138 aa, Propionibacterium acnes
MSDEERTLVLLKPDAVKRRLMGEIIGRYEAKGLTVRAMELSTIDTKIARKHYAEHVGRDYYAALEEFITSGPLVAMVLEGRRAISVVRAMNGTTDCAEALPGTIRGDFGTEKNHNLVHASDCLESAEREIGLWFPHLV

SEQ ID NO: 3419 - protein, 526 aa, Dechloromonas aromatica RCB
MNPIDSPAWRALAAHAEAIRPLHLRDLFATDPQRFELFSLHHDGLLLDYSKQRVSVETMALLRAYAETADVTGWRRRMLDGESINHTEGRAVRHMSLRAGDQAPAEVRAALARQQAFCESIHNGVWRGFSGERITDVVNIGIGGSDLGPRMAALALSARQQPDIAVHFIANVDSADIAPLLASLNPRTTLFIVASKTFTTLETLTNARTARDWLLATAGQESAIARHFVAISTNLELTKQFGIADDNVFEFWDWVGGRFSIWSAIGLSLALAIGWKNFEQLQAGARAMDRHFIDTPADENLPLTLALLSLWNTNFLGASTEAMLPYSQSLHLFPAYLQQLEMESNGKQIDRDGKPLNIATSPVIWGESGTNGQHSFYQLFHQGGHLIPADFVALREADFPLPGHHASLLANCLAQSAALAFGQTAEEVRAAGIPEALIPYKVFPGNQPSNTLLLPSLDPYTLGQLLALFEHKVFCLGVLWNLNAFDQWGVELGKQLAGQLTPLIEGNGDLSAFDSSTRGLITALKG

SEQ ID NO: 3420 - protein, 335 aa, Oryza sativa (indica cultivar-group)
MSTTAKLAGLLRDEQGPVAFNDAVDEDAVPVEPLTEHDDAIFAMPAAHCDNMQFRCYRGFWISEMWAPGVVAVHRSFAPRADDVIVASLQKSGTTWLKALTLATMARGAWPPSSHDHPLRRLNPHLCVPSLEVLYTQGRDALLDMLPSPRLLSTHMPLSLLPPSTCKIVYICRDQKETAVSLWHFMKRRHPDLTFSEVHEAFCNGICMGGPAWDNILEFWYASNAEPTRVLFLTYEKVLQDPCDAVKKLAQFLGQPFSGAEEEAGVVTEITDLCSIDNLRNQKANKYGFIGGKISHESFFRKGMAGDWTNHMTLEMAERLDSILREKLDGSGLIV

SEQ ID NO: 3421 - protein, 247 aa, Burkholderia xenovorans LB400
MVQPATQRAAQSSVQTAAQTGTRAAAHSADGPLPVPPNLVALTQPSGQKRLTGSASNQSYWPLSQYFETQRNEAYCSVATSVMALNALGIRRPESTQYPDFPFFSQDDFFRGIDPQVANAAQVSREGMTLDQLGTALQAFPIDVRKYHASDLSLHQFRDLVRTTTGHDDRFVLLNFRRIEIGETGGGHWSPLAAYDATSDSALLLDVARYKYPAVWVPVAQLYAAALAVDSVSGLSRGIVIVGKRVN

SEQ ID NO: 3422 - protein, 344 aa, Idiomarina loihiensis L2TR
MSSVNTINRIAIITSGGDAPGMNAALRAVVLAAENYGIEVMGFRHGYEGLLTNDFVKLDREDVEHILQYSGTIIKSARSERFKSEEGGREAATNLDAHQIDAFIVIGGDGSFRGAEHLANFWKGPIIGIPGTIDNDLFGTDNTIGYDTAVETAMDALDKIRDTAEAMDRVFIVEVMGRNAGYIGISSAMACGAERMILPELQKDKPLTVDALVKHIESVQRVRGDSSYVMVLCENQWPGGAVRLAEQLEDRLNLPCRPCLLGHVQRGGRPTAMDRILGTRLGVHAVELVRQGKTAVMAGVTANELSETPLIDTWTKRKKLSEELINIQQSLFNPIKKDRNKSTQ

SEQ ID NO: 3423 - protein, 440 aa, Dechloromonas aromatica RCB
MPMSTSCPHQPYCEMREQTDMRFISHLTRNTFAIILAGGRGTRLKQLTDFRSKPAVPFAGKFRILDFTLSNCVNSGIRKIGVATQYKAHSLIRHIQRGWSFLDGRFDEFIQLLPAQQQIDETQWYQGTADAVYQNLHFLRRYQPDHILVVAGDHIYKMDYGRMLAHHVKHHADMTVACIDVPLDEAREFGVMGVDEQDRVIDFVEKPQNPPAIPGQPDRALASMGIYIFNTKFLFEQLERDAMTKGSNRDFGKDIIPYIVPRYRVFAHRFADSCVGSDNHRPYWRDVGTIDAYWEANMEMTKVTPELNVYDRDWPIWTYQEQIPPAKFVFDDEDRRGTAVDSLIAGGCIISGASVKRSLLFSSVNVHSWASVEDSVVLPDVDIGRHAVLKRCVIDKHCRIPEGMVIGVDPEEDRKRFHVSPKGITLVTAEMLGQGAAEGR

SEQ ID NO: 3424 - protein, 621 aa, Dechloromonas aromatica RCB
MQHADALYLFNEGRNNQAYRLLGAHADISGTTFRVWAPNASRVSVVGDFNGWHGDVHQLHPLGESGVWEIAVAEAHTGNLYRFEITNRHTGDKLIKSDPYGRGFELRPGSAAYVVPPSMHVWGDADWLQQRAGWDWQQAPVNIYEVHPGSWMRHPDGKPYLWGELAERLIPYALAQGYTHLELLPITEHPLDESWGYQTTGYFAPTSRYGSADELRAFVDACHQAGLGVLLDWVPGHFPQDDWALARFDGTALYEHEDPRLGLHADWGTHIFNYGRHEVRSFLMSSAHWWLSEFHFDGLRVDAVASMLYLDYSRKHGEWLPNKFGGRENLEAIDFLKQLNAMVHGDFPGALTIAEESTAWPMVSRPTYVGGLGFSMKWNMGWMNDSLRYFHRDPIYRRWHHSELTFGQIYAYSENYVLPFSHDEVVHGKGSLLGKMPGDTWQRYANLRLLLAWQVLTPGKKLMFMGCEFGQQGEWSEGRELDWGSLANPENAAAQRLSADLNRLYRDLPALHTQDFSALGFEWIDCNDSEHSVLSWLRWGKDGSFVVVVFNFTPVPQPAYRLGVPEAGTYVELLNTDSAFYGGSNLGNGGALTATKGEWMGRPANLEVTIPPLGAVVLRRE

SEQ ID NO: 3425 - protein, 318 aa, Streptococcus mitis
DINKEPGAEEKYKEVQEAYETLSDDQKRAAYDQYGAAGANGGFGGAGGFGGFNGAGGFGGFEDIFSSFFGGGGASRNPNAPRQRDDLQYRVNLTFEEAIFGAEKEVKYNREASCSTCNGSGAKPGTSPVTCGRCHGAGVINVDTQTPLGMMRRQVTCDVCHGRGKEIKDPCTTCHGTGHEKQAHSVHVKIPAGVETGQQIRLAGQGEAGFNGGPYGDLYVVVSVESSDKFEREGTTIFYNLNLNFVQAALGDTVDIPTVHGDVELVIPEGTQTGKKFRLRGKGAPSLRGGAVGDQYVTVNVVTPTGLNDRQKAALKEF

SEQ ID NO: 3426 - protein, 141 aa, Medicago truncatula
FKDTIDLFVERYKGKNISVVAGIEARGFIFGPPIALAIGAKFVPLRKPKKLPGKVISQEYILEYGRDCLEMHVGAVETGERAIVVDDLIATGGTLGAAMNLLERVGAEVVECACVIELPELKGRERLNGKPLYVLVEYFDI

SEQ ID NO: 3427 - protein, 318 aa, Streptococcus mitis
DINKEPGAEEKYKEVQEAYETLSDDQKRAAYDQYGAAGANGGFGGAGGFGGFNGAGGFGGFEDIFSSFFGGGGASRNPNAPRQGDDLQYRVNLTFEEAIFGAEKEVKYNREASCHTCNGSGAKPGTSPVTCGRCHGAGVINVDTQTPLGMMRRQVTCDVCHGRGKEIKDPCTTCHGTGHEKQAHSVHVKIPAGVETGQQIRLAGQGEAGFNGGPYGDLYVVVSVEASDKFEREGTTIFYNLNLNFVQAALGDTVDIPTVHGDVELVIPEGTQTGKKFRLRGKGAPSLRGGAVGDQYVTVNVVTPTGLNDRQKAALKEF

SEQ ID NO: 3428 - protein, 357 aa, Medicago truncatula
MAQSTKLFHRFDHIRTFVNARVKWVRDDYLDTAVLKEKNLKHVISLKNHIVSSPSKSLSLYNASMLKASLNLPMITIKLVEKYHHVFMQFQPSPGLPPRIKLTAQALALHKEEMEVHNSRTNQEDAAQRLARLLMLAGMARLPIYVIEKLKWDMGLPHDYVTTLLAYYPDYFDVCVVEDPLSGKEVLALELVSWRKELSVSELEKRVMGFNYDADKRRHDIQFPMFLPKSFALEKRVKTWVEGWQTLPYISPYENAFHLDSNSDQAEKWTVAILHELLSLLVSKKTESENLICYGECLGLGSRFKKALVHHPGIFYLSNKIRTQTAVLREAYRNEFLVKNHPVMGTRYWYIHLMTKA

SEQ ID NO: 3429 - protein, 128 aa, Salmonella enterica
GSGMHCHMSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGIKNKIHPGEAM

SEQ ID NO: 3430 - protein, 322 aa, Streptococcus oralis
PDINKEPGAEEKYKEVQEAYETLSDDQKRAAYDQYGAAGANGGFGGAGGFGGFDGAGGFGGFEDIFSSFFGGGGASRNPNAPRQGDDLQYRVNLTFEEAIFGTEKEVKYNREASCRTCNGSGAKPGTSPVTCGRCHGAGVINVDTQTPLGMMRRQVTCDVCHGRGKEIKDPCTTCHGTGHEKQAHSVHVKIPAGVETGQQIRLAGQGEAGFNGGPYGDLYVVVSVEASDKFEREGTTIFYKLNLHIVQATLGDTVEIPTVHGDVELVIPEGTQTGKKFRLRGKGAPSLRGGAVGDQYVTVNVVTPTGLNDRQKAALKEFAAA

SEQ ID NO: 3431 - protein, 321 aa, Streptococcus oralis
QIQQEPGAEEKYKEVQEAYETLSDDQKRAAYDQYGAAGANGGFGGAGGFGGFDGAGGFGGFEDIFSSFFGGGGASRNPNAPRQGDDLQYRVNLTFEEAIFGTEKEVKYNREASCRTCNGSGAKPGTSPVTCGRCHGAGVINVDTQTPLGMMRRQVTCDVCHGRGKEIKDPCTTCHGTGHEKQAHSVHVKIPAGVETDQQIRLAGQGEAGFNGGPYGDLYVVVSVEASDKFEREGTTIFYKLNLNIVQATLGDTVEIPTVHGAVELVIPEGTQTGKKFRLRGKGAPSLRGGAVGDQYVTVNVVTPTGLNDRQKAALKEFAAA

SEQ ID NO: 3432 - protein, 401 aa, Xanthomonas campestris pv. campestris str. ATCC 33913
MLSDSIIDVLTSGIAGLGVWGMLAVLLVFTQLTIFAVTLYLHRSQAHRGVDFHPVIAHFFRFWTWLTTSMITREWVAIHRKHHAKVETEEDPHSPQTKGIGQVFWRGVELYREARAQRADIEQYGKGAPNDWIERHLYTPHANAGPIALLVVNSVLFGLPGIALWAIQMAWIPFWAAGVVNGLGHWWGYRNFESADTSTNLTPWALWIGGEELHNNHHAFPSSARFSMRRWELDIGWIAIRCLQALGLAKVLRVAPSLDIRPNIAVPDADTLKALLSHRFQAMTDYQRNVLKPALREEAAATGAKLRQLLPRRLRKGLVDDGRWLKPDAREQLQHWVAQRPRMRTLVEYRARLTAVLEARSHDASERLKQLQQWCHEAEASGNAALQAYAARLKGYALSGT

SEQ ID NO: 3433 - protein, 313 aa, Streptococcus oralis
INKEPGAEEKYKEVQEAYETLSDDQKRAAYDQYGAAGANGGFGGFDGAGGFGGFEDIFSSFFGGGGASRNPNAPRQGDDLQYRVNLTFEEAIFGTEKEVKYNREASCRTCNGSGAKPGTSPVTCGRCHGAGVINVDTQTPLGMMRRQVTCDVCHGRGKEIKDPCTTCHGTGHEKQAHSVHVKIPAGVETGQQIRLAGQGEAGFNGGPYGDLYVVVSVEASDKFEREGTTIFYKLNLNIVQATLGDTVEIPTVHGAVELVIPEGTQTGKKFRLRGKGAPSLRGGAVGDQYVTVNVVTPTGLNDRQKAALKESQL

SEQ ID NO: 3434 - protein, 125 aa, Salmonella enterica
MPKPMFGDNGSGMHCHMSLSKNGTNLFSGDKYAGLSEQALHYIGGVIKHAKAINALANPTTNSYKRLVPGYEAPVMLAYSARNRSASIRIPVVASPKARRIEVRFPDPAANPYLCFAALLMAGLD

SEQ ID NO: 3435 - protein, 487 aa, Escherichia coli CFT073
MLPLRINPTFLLPSNKFKEFEMDQKLLTDFRSELLDSRFGAKAISTIAESKRFPLHEMRDDVAFQIINDELYLDGNARQNLATFCQTWDDENVHKLMDLSINKNWIDKEEYPQSAAIDLRCVNMVADLWHAPAPKNGQAVGTNTIGSSEACMLGGMAMKWRWRKRMEAAGKPTDKPNLVCGPVQICWHKFARYWDVELREIPMRPGQLFMDPKRMIEACDENTIGVVPTFGVTYTGNYEFPQPLHDALDKFQADTGIDIDMHIDAASGGFLAPFVAPDIVWDFRLPRVKSISASGHKFGLAPLGCGWVIWRDEEALPQELVFNVDYLGGQIGTFAINFSRPAGQVIAQYYEFLRLGREGYTKVQNASYQVAAYLADEIAKLGPYEFICTGRPDEGIPAVCFKLKDGEDPGYTLYDLSERLRLRGWQVPAFTLGGEATDIVVMRIMCRRGFEMDFAELLLEDYKASLKYLSDHPKLQGIAQQNSFKHT

SEQ ID NO: 3436 - protein, 397 aa, Francisella tularensis subsp. tularensis SCHU S4
MASLNKKIQNVSTSPTNAMAALAKQIKDQGNDVISLAIGEPGFSTPDIIKAAGIEAINKDITKYTNVDGLKELREAIVARYKREYGIEFAADQVCVTSGAKHSLHNIFNCILEAGDEAIFFAPYWVSYPDMIALTGAKPVVVETKFENNFEIDVTDLEKHITAKTKAVIINSPNNPTGLIYSKKCIEDLANLLIKYPNIWIIGDDIYDQLYFKDRVTLITEVAPDLADRYVIASGVSKNFAMTGWRVGFTIAPKLLNDALKKFQSQSATCACSISQYAAITAMNMPAQDLQYFVESYKQKAQFVTKYLEAMPYVDVKSAEGTFYLFPDLRKLLEHTNFSTDVELCNALLREEYVAMMPGVAFGLSGFARISCANEMPELEEAMTRVARFINKHVSTK

SEQ ID NO: 3437 - protein, 562 aa, Arabidopsis thaliana
  misc_feature (74)..(74): Xaa can be any naturally occurring amino acid
MISEKPLGEESIRQDLEVLTVSRRLVKSVSQKLKKKIHKTEVVEDEEVARGAVNCLSISVGCRVADTGEDFEEXLSNKRWSSASEEGKGLMTICGTEEIRLDCFSYGVRERFWKNNNRRYLADLGQDYRKHVYLPDDILEMCLMRLPLTSLLNAHLVCKKWQSMANTQRFLQMRREGSFQTPWLFLFAALKDGCSSGDIHGYDVSQDKWHRIETDLLKGRFMYSVTSIHEEIYIVGGRSMDRNSFKSHRGILVFSPSIKAWRKIASMRHARSLPIVGATEVTSEFSTMQTKQNRQDRRFHLSRVGGESDVYEDPHRLSVRRQNRNSADQNGTKSHRLIRQKLDRLNRNSSKRFVLIAIGGTGLFDEPLDSGEIYDSATNTWSEMQRLPMGFGVVSCGIICNGIFYAYSENDKLSGYDIERGFWITIQTSPIPPRVHEFYPKLVSCNHRLFMLSVSWCDEGDGQIGRRNKAVRKLWELDLVYLTWTEVSVHPDAPMDWNATYVSDQNILMGIEMFKIFGQVLSFFTVCDVLTEEASWRHVSRNQRSQKLNLSCTNKTIALLHL

SEQ ID NO: 3438 - protein, 419 aa, Rhodopirellula baltica SH 1
MPSFTRRRVHLAMPPTFSVSSRVDNATETAFVAPTTRDKSKDAIVAPQPQLNHGTSVPTLTPLSPLDQIRLVRETMLREAEAIQKAAAIASADAAEAAAWISRCEGSIVLTGVGKAGLIAQKLVATLASTGSPAHFLHPIEAVHGDLGRVQSKDLVIAFSNSGRSEEVVRVVEYLKHQACGIIAVTADRENPLAELADHVVPIGRHREACPDGLAPTSSTSVMLAVGDAIAVLASRLCGFTPNDFARFHPGGALGRKLTDVRQAMRPLAECRLAPQTISIREAMMIGGAGRRSGAILLLDESERLAGIFTDSDLARLLQHRQETSLDEPIELFMTKQPICIADDERLPRAVEILSQRKISELPVVDSDHRPIGMIDITDLVATGDVRQTVSSSQGSIQSNPDDSSGEDGPRCIPITSGD

SEQ ID NO: 3439 - protein, 279 aa, Oryza sativa (indica cultivar-group)
MDPKVAVALALSLIGGLSTSLGALLAILNCAPNNKTLGMLQGFATGLMLSMSFFDLAYDAVNAIGFLKGNLWFFAGALLFSTIAEVFPEPDCNLADENDKHLENKTGNNNIAGKELMMRHRRRVIFSVVVTAIVAGVSLQNFPVGTAAFLGTTKGFRVGLNLSLAIALHYIPEGISVALPAYFATCSKWQAFKLATLSGFAEPLGVIIVAYLFPSNLNPEILEGLLGLVGGVMAFLTLYEMLPIAFEYAGRKDAVKAVFVGMAFMSMRGCTFAKAGMSA

SEQ ID NO: 3440 - protein, 337 aa, Brucella suis 1330
MTKMTMIEAIQNAHDIAMERDQKVVVFGEDVGYFGGVFRCTAGLQKKYGKERCFDAPISELGIVGTAIGMAVYGLRPCIEVQFADYVYPAYDQIVSEAARLRYRSAGEFTCPIVIRMPSGGGIYGGQTHSQSPEALFTHVSGLKTVMPSTPADAKGLLLAAIEDPDPVIMFEPKRLYNGPFDGHHDKPVTSWKKHDLGEVPEGYYTVPLGKAAIRREGSDVTVLAYGTMVHVALAAAEETGVDAEVIDLRTLLPLDTETIMASVKKTGRCIIVHEATLTCGYGAELAALVQRDCFYHLEAPIMRVTGWDTPYPHAQEWAYFPGPDRVGRALVSIMEA

SEQ ID NO: 3441 - protein, 463 aa, Pseudomonas putida KT2440
MNTVGSDGNLAQGFKPRHVTMLSIAGIIGAGLFVGSGHAIAAAGPATIISYFVAGTLVVLVMRMLGEMAVAHPDTGSFSTYADQAIGRWAGYTIGWLYWWFWVLVIPIEALAAGHVLNAWFPQVDSWIFALASVLLLAGTNLFSVAKYGEFEFWFAILKVTAILGFIGLGFAALMDWLPNREVSGLSGLMAEYGGFAPKGWSAVVGAFITVMFSFIGTEAVTIAASESSDPSRNIAKATRSVIWRISTFYILSIFVIISVVPWNDPQLAVVGSYQRALEIMNIPNAAFMVDLVVLVAVTSCMNSSIYIASRMMFSLAKRGDAPAFLNKTSKVGVPRAAVFGSTLIGAAIAVLNYFAPKGVFEFLLASSGAIALLVYMVIAISQLRMRRRLERENTELKFRMWLFPYLTWAVIIFIAGALAVMMYTPEHRAEVSSTLGLAIVISFLGIVTSRGHAQPVAARSMG

SEQ ID NO: 3442 - protein, 464 aa, Brucella suis 1330
MSEISCKLLIIGGGPGGYVCGIRAGQLGIDTVLVEKTRLGGTCLNVGCIPSKALIHAADEFHRLTTFAAKSPLGITTQNPAIDFARTLEWKDGIVHRLNSGVAGLLKRSRVRMFQGQARFQDGKTVLVDTDTGRQTIHAENIVIATGSVPVEIQALPFGGNIISSTEALSLEKIPERLAVVGGGYIGLEIGTAFAKLGSRVTVVEATDRILPQYDAELTRPVMARLKTLGVEVLTGTSAKGLSADGKALEIRTQDGAVKAIEADKILVTVGRKPQTDGWGLSEIRLDMDGRFIRIDDRCRTSMRGIYAIGDVTGEPMLTHRAMAQGEMVAEIIAGGKHAWDKRCIPAVCFTDPEIVTVGLSPDEARKAGHNIQTGLFPFQANGRAMTMERDDGIVRVVARADNHVILGIQAVGAGISELSAAFAQAVEMGARLEDIAATIHAHPTLGEGFAEASMKALGHALHV

SEQ ID NO: 3443 - protein, 309 aa, Dechloromonas aromatica RCB
MLLGGDLGGTKTLLALAEVIDGRIEIVRQQRYASLDYASFDDLLAEFIAGHPAINTACFGVAGPTDGRHAKLTYLPWQLTASELEQKFAIGRVSLINDFAAAANGLPLVDDQDILTLHTGQPEEHAPRVILGAGTGLGVAGLIWESDRYRVIPGEGGHFGFSPQTAQQGELWAWLLAQNGRVTVEDIVSGPGLSRIFAFLSGQTRAPEEIGRAALAGIDPSANAALQLWLECYGAFAGDLAMHWLARGGVYLAGGIAAKLLPHIDASSFTAAFLAKREHSELVKSMPIRLLTVEDLGLRGTLARAAQQD

SEQ ID NO: 3444 - protein, 392 aa, Corynebacterium glutamicum
MKALTWQASNTVNVEEVPDPQIQEPTDAVIRVTSTAICGSDLHLYEVLTPFMDKGDIIGHEPMGIVEEIGSAVTHIKPGDRVVIPFNISCGHCFMCRQGLQSQCETTQVREYGTGAQFLGYSRLYGSVPGGQAEYLRVPHADYGAIKVPNVGEDERYLFLSDVVPTAWQAVDYAAVPDGGTLAVLGLGPIGQMSARIGKHLGYRVIATDAVPERRAMAERYGIETLDSSEDGVAEQLKDLTDGRGPNSVVDAVGMEAHGSPVASAVQAAVGKLPSPLDRKAMERAGVDRMSALYTAIDSVRRGGTISISGVYGGMKDPMPMLTMFDKQIQLRMGQCNVRSWTETLLPLVDDPSDPLGVLDLKTHTAPLEEAPAMYEKFQKKQDGCIKVVLKP

SEQ ID NO: 3445 - protein, 285 aa, Clostridium acetobutylicum ATCC 824
MNFPNTFPKQHQNHQPGYEYEMNPAPIYYDEKYNKSRGLLKGKTAIITGGDSGIGRAVSVAYAHEGADVVIIYYDEHQDADETKKIIDGLGRKCTLMPGDIGDTNFCNYAIENTIRAYDKIDILVNNAAMQYPQNSIADISNEQFDRTFKTNVYGTFYMTRAAISKMKAGSSIINTTSVVAFKGNETLIDYSMTKGAILAFTKSLSTSLVKSGIRVNAVAPGPIWTPLISASFDENKVSEFGSNVPLERPGQPVECAGAYVFLASEMSSYITGQTIHVNGGEIVM

SEQ ID NO: 3446 - protein, 321 aa, Streptococcus oralis
DINKEPGAEEKYKEVQEAYETLSDDQKRAAYDQYGAAGANGGFGGAGGFGGFDGAGGFGGFEDIFSSFFGGGGASRNPNAPRQGDDLQYRVNLTFEEAIFGTEKEVKYNREASCRTCNGSGAKPGTSPVTCGRCHGAGVINVDTQTPLGMMRRQVTCDVCHGRGKEIKDPCTTCHGTGHEKQAHSVHVKIPAGVETGQQIRLAGQGEAGFNGGPYGDLYVVVSVESSDKFEREGTTIFYKLNLNIVQATLGDTVEIPTVHGAVELVIPEGTQTGKKFRLRGKGAPSLRGGAVGDQYVTVNVVTPTGLNDRQKAALKEFAAA

SEQ ID NO: 3447 - protein, 436 aa, Brucella suis 1330
MNITIEETLDQAGTGSFQRGLLGIFGLVWAADAMQVLAVGFTGAAIAKTFGLTVPQALQTGTLFFLGMLVGAALFGRLADKYGRRRILLITVACDALFGLLSAFAPDFGSLLALRFLTGLAVGGTLPVDYAMMAEFLPAKNRGRWLVMLEGFWAVGTVVIAIAAWATSVAGVEDAWRYIFIVTAAPALIGIWLRFRVPESPMHLLKSGRVEEAKAVINLVLSRNGKPELPPGAKLLAPRLVTNERLLSPNLRQRTLTSLAIWFLVSVSYYGIFTWIPAKLASDGFGFVRGYGFLVVVALAQLPGYALAAYGVEAWGRRKTLIGFLFVSAAACALFTVATSSSVVGASILIMSFALLGTWGALYAFTPELYPTALRASGMGAAGAMARLGGLLAPSAMAVVINQSFYTAVAMFAGLLALAGIIAFFINVETRQRALN

SEQ ID NO: 3448 - protein, 326 aa, Streptococcus oralis
SKYHPDINKEPGAEEKYKEVQEAYETLSDDQKRAAYDQYGAAGANGGFGGAGGFGGFDGAGGFGGFEDIFSSFFGGGGASRNPNAPRQGDDLQYRVNLTFEEAVFGTEKEVKYNREASCRTCNGSGAKPGTSPVTCGRCHGAGVINVDTQTPLGMMRRQVTCDVCHGRGKEIKDPCTTCHGTGHEKQAHSVHVKIPAGVETGQQIRLAGQGEAGFNGGPYGDLYVVVSVETSDKFEREGTTIFYNLNLNFVQAALGDTVEIPTVHGDVELVIPEGTQTGKRFRLRGKGAPSLRGGAVGDQYVTVNVVTPTGLNDRQKAALKEFAAA

SEQ ID NO: 3449 - protein, 306 aa, Zea mays
  misc_feature (133)..(133): Xaa can be any naturally occurring amino acid
MGSDFKSIPLIDIGPLVEKIDDPSMANDKDLLQVVRLLDDACKEAGFFYVKGHGIDESLMREVRNVTREFFQLPYEEKLKIKMTPQSGYRGYQRIGENITKGKPDMHEAIDCYTPIRPGKYGDLAKPMEGSNXDISRKIMRGIALALGGAIDAFEGDTAGDPFWVLRLIGYPVDIPEEQRTDTGCGAHTDYGLLTLVNQDDDICALEVQNRSGEWIYATPIPGTFVCNIGDMLKVWTNGIYQPTLHRVVNNSQHYRVSVAFFYESNFDAAVEPVEFCREKTGGAAKYEKVVYGEHLVQKVLTNFVM

SEQ ID NO: 3450 - protein, 322 aa, Streptococcus oralis
FTQISQEPGAEEKYKEVQEAYETLSDDQKRAAYDQYGAAGANGGFGGAGGFGGFDGAGGFGGFEDIFSSFFGGGGASRNPNAPRQGDDLQYRVNLTFEEAIFGTEKEVKYNREASCRTCNGSGAKPGTSPVICGRCHGAGVINVDTQTPLGMMRRQVTCDVCHGRGKEIKDPCTTCHGTGHEKQAHSVHVKIPAGVETGQQIRLAGQGEAGFNGGPYGDLYVVVSVEASDKFEREGTTIFYKLNLNIVQATLGDTVEIPTVHGDVELVIPEGTQTGKKFRLRGKGAPSLRGGAVGDQYVTVNVVTPTGLNDRQKAALKNSQL

SEQ ID NO: 3451 - protein, 242 aa, Thiobacillus denitrificans ATCC 25259
MAALTDQVVVVTGGGRGLGASICRALSREGAKIAVMDVDGKAARREAAALTDKGADALALETDVGSEAQVKAAIAEVVARFGRLDALVNNAGIDKTCSVEELACDEWERILRTNLSGPFMLAKYAAEQMRAQGNGGQIVNIASTAAKRAWANASAYHASKWGLVGLSQALHVELRPEGIKVTTVIAGGMRTPFLLERFPDLDPGLLQDPDNVADTVRYLLTLPAESVIAEIMVLPMRETSWP

SEQ ID NO: 3452 - protein, 317 aa, Streptococcus oralis
EPGAEEKYKEVQEAYETLSDDQKCAAYDQYGAAGANGGFGGAGGFGGFDGAGGFGGFEDIFSSFFGGGGASRNPNAPRQGDDLQYRVNLTFEEAIFGTEKEVKYNREASCRTCNGSGAKPGTSPVICGRCHGAGVINVDTQTPLGMMRRQVTCDVCHGRGKEIKDPCTTCHGTGHEKQAHSVHVKIPAGVETGQQIRLAGQGEAGFNGGPYGDLYVVVSVEASDKFEREGTTIFYKLNLNIVQATLGDTVEIPTVHGDVELVIPEGTQTGKKFRLRGKGAPSLRGGAVGDQYVTVNVVTPTGLNDRQKAALKEFAAA

SEQ ID NO: 3453 - protein, 135 aa, Arabidopsis thaliana
MDKFWTFLTALHSGAGPIVMLLYPLYASVIAMESTTKVDDEQWLAYWIIYSFLSLTELILQSLIEWIPIWYTVKLVFVAWLVLPQFQGAAFIYNRVVREQFKKHGVLRSTHSKPTKPNILHSIFPHREGHEAHSH

SEQ ID NO: 3454 - protein, 124 aa, Salmonella enterica
GSGMHCHMSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGIKNKIHP

SEQ ID NO: 3455 - protein, 612 aa, Rhinanthus minor
SGKPFYAIIHRVTASLIIDFEPVKPHEVPMTAAGALQSYKLASKAIARLQALSGGSIERLCETMVQEVFELTGYDRVMTYKFHEDDHGEVLTEITKPGLEPYVGLHYPATDIPQAARFLFMKNKVRMICDCRANHVRVIQDENLPMDLTLCGSTLRAPHSCHLQYMENMNSIASLVMSVVVNEGNEEAAPDETPQQLDKRKRLWGLVVCHNTSPRFVPFPLRYACEFLAQVFAIHVNKEIEMENQMLEKNILRTQTLLCDMLLRDAPLGMVSQSPNVMDLVKCDGSILLHKNQKYRLGITPSDFQIRDIVSWLDEYHRDSTGLSTDSLYDAGFPGALALGDVVCGMAAVRITDRDWLFWFRSHTASEIRWGGAKHELGERDDGRKMHPRSSFKAFLEVVKTRSLPWKDFEMDAIHSLQLILRNASSKEMEERKDLEGVEIQARLNELQIDGVQELEAVTSEMVRLIETASVPIFAVGVDGLVNGWNTKIADLTGLPVDKAIGLHFLSLVEESSAEAVSKMLELALEGKEEQNVHFEIKTHGPNSDSSPISLIVNACASRDFRENVVGVCFIAQDITTQKSVMDKFTRIEGDYRAIVQNPNPVIPPIFGTDEF

SEQ ID NO: 3456 - protein, 314 aa, Streptococcus oralis
ISQEPGAEEKYKEVQEAYETLSDDQKRAAYDQYGAAGANGGFGGFDGAGGFGGFEDIFSSFFGGGGASRNPNAPRQGDDLQYRVNLTFEEAIFGTEKEVKYNREASCRTCNGSGAKPGTSPVTCGRCHGAGVINVDTQTPLGMMRRQVTCDVCHGRGKEIKDPCTTCHGTGHEKQAHSVHVKIPAGVETGQQIRLAGQGEAGFNGGPYGDLYVVVSVEASDKFEREGTTIFYKLNLNIVQATLGDTVEIPTVHGAVELVIPEGTQTGKKFRLRGKGAPSLRGGAVGDQYVTVNVVTPTGLNDRQKAALKEFAAA

SEQ ID NO: 3457 - protein, 484 aa, Hypocrea jecorina
  misc_feature (171)..(171): Xaa can be any naturally occurring amino acid
MPESLALPNDFEWGFATAAYQIEGAVKEGGRGPSIWDTYCHLEPSRTNGANGDVACDHYHRYDEDFDLLTKYGAKAYRFSLSWSRIIPLGGRLDPVNEEGIEFYSKLIDALLRRGITPWVTLYHWDLPQALHDRYGGWLNVEEVQLDFERYARLCFERFGDRVQNWITINXPWIQAIYGYATGSNAPGRSSINKHSTEGNTATEPWLAGKAQIMSHARAVAVYSRDFRPSQKGQIGISLNGDYYEPWDSNEPRDKEAAERRMEFHIGWFANPIFLKKDYPESMKKQLGERLPALTPADFAILNAGETDFYGMNYYTSQFARHLDGPVPETDYLGAIHEHQENKDGSPVGEESGLAWLRSCPDMFRKHLARVYGLYGKPIYITENGCPCPGEENMTCEEAVNDPFRIRYFDSHLDSISKAITQDGVVVKGYFAWALLDNLEWSDGYGPRFGVTFTDYTTLKRTPKKSALVLKDMFAARQRVKVAA

SEQ ID NO: 3458 - protein, 612 aa, Schwalbea americana
SGKPFYAIIHRVTGSLIIDFEPVKPHEVPMTAAGALQSYKLAAKAITRLQALPSGSLERLCDTMAQEVFELTGYDRVMVYRFHDDDHGEVFTEITKPGLEPYAGLHYPATDIPQAARFLFMKNKVRMICDCRLNHVKVVQDGNLGFDLTLCGSTLRAPHSCHVQYMENMNSIASLVMSVVVNEGEEESSGPGLDTSQLDKRKRLWGLVVCHNTSPRFVPFPLRYACEFLAQVFAIHVSKELELENQMLEKNILRTQTLLCDMLLRDAPLGIVTQSPNVMDLVKCDGALLLHKGIKYRLGLTPTDFQLRDLVSWLDEYHRDSTGLSSDSLYDGGFPGALALGDAICGMAAVRITDKEWLFWFRSHTAAEIRWGGAKHESAEKDDGRKMHPRSSFKAFLEVVKTRSLPWKDYEMDAIHSLQLILRNTSLKEADDKDLGGREIQEKLGELQIDGMHELEAVTSEMVRLIETASVPIFAVGVDGLVNGWNTKIADLTGLHVDEAIGKHFLGLVEETSADAVSKMLESALEGKEEQNVHFEIKTHGLRSESGPISLIVNACASRDVKDSVVGVCFIAHDITAQKSVMDKFTRIEGDYRAIIQNPNPLIPPIFGTDEF

SEQ ID NO: 3459 - protein, 607 aa, Scrophularia arguta
SGKPFYAIIHRVTGSLVIDFEPVKPHEVPMTTAGALQSYKLAGKAINRSQSLPSGSVERLCDTMVQEVFELTGYDRVMTYKFHDDDHGEVFTEVTKPGLEPYAGLHYPATDIPQAARFLFMKNKVRMICDCRAEHVKVVQDEKLPFDLTLCGPTLRAPHSCHLQYMENMNSIASLVMSVVINEGAEEVSEPSSPQKRKRLWGLVVCHNTTPRFVPFPLRYACEFLAQVFAIHVNKELELENQMLEENILRTQTLLCDMLLKDAPLAIVSQSPNVMDLVKCDGAALLYKNKRYRLGLTPTDFQIRDLLSWLDTYHRDSTGFSTDSLYDAGFPGSLALGDAVCGMAAVKITNKDWLFWFRSHTAAEIRWSGAKHEPGEKDDGRKMHPRSSFRAFLEVVKTGSLPWKDYEMDAMHSLQLILRNAFREADAKDYETEAIHTRLNDLRVDGIHELEAVTSEMVRLIEAASVPILAVDVDGVVNGWNTKIAALTGLTIDQAIGRDFLMLVEDSCADRVSKMLELALQGKEETNVEFEIKTHGSRSGSDPITLIVNACASRDVKENVIGACFIAQDITDQKSMMDKSTRIEGDYRAIVQNPNPLIPPIFGTDEF

SEQ ID NO: 3460 - protein, 203 aa, Prochlorococcus marinus str. MIT 9303
MSSKLRLGVAGPVGSGKTALVEAICRRLRDQLQLAVVTNDIYTQEDAEFLTRVGALEPERIRGVETGGCPHTAIREDCSINRAAVEDLERNFPDLDVVLVESGGDNLAASFSPELVDLCIYVIDVAAGDKIPRKGGPGITRSDLLVINKIDLADHVGADLEVMKRDATRMRGERPWCFTNLHSGDGLESVLQFLLQQLPNRPE

SEQ ID NO: 3461 - protein, 294 aa, Burkholderia xenovorans LB400
MFSGIWLPIVTPLRNGEVDIDALQRLADYYSRTEIAGIVALSTTGEAALLQDAERLTVLQALSDVVRSRLPMLIGVGGSSTRDVLHDIQRYERWDCAGYLVSAPSYICPDQAGVRWHFEQVAGATGRPVVLYNVPHRTGVSIAPDTVARLVECGNIVAIKECVKEHFSPLSALPINVLCGTDEALDDCLHHGGTGGILASAHVCADLLVAFQDLLQAGRDVDARNLFASLLPVLRLLFAAPNPSAIKAMLAFDHSLSDETRMPVSRASAQLVERLSTARDRLQDLRAEFAGVMN

SEQ ID NO: 3462 - protein, 344 aa, Bacillus thuringiensis serovar konkukian str. 97-27
MTRTVSMSTAINEAMKISMRRDENVILIGEDVAGGAQVDHLQDDEAWGGVLGVTKGLVQEFGRNRILDTPISEAGYMGAAMAAAATGLRPIAELMFNDFIGSCLDQVLNQGAKFRYMFGGKAKVPVTVRTMHGAGFSAAAQHSQSLYALFTSIPGIKVVVPSTPYDAKGLLLAAIEDDDPVIFFEDKTLYNMKGEVPEGYYTIPLGKADIKREGSDVTIVAIGKQVHTALAAAEQLAKKGLEVEVIDPRSLSPFDEDTILSSVEKTNRLIVIDEANPRCSIATDIAAIVADKGFDLLDAPIKRITAPHTPVPFSPPLEKLYLPTPEKVIETVSEMIGDQSLLHV

SEQ ID NO: 3463 - protein, 459 aa, Bacillus thuringiensis serovar konkukian str. 97-27
MRILVVIGGGPAGYVAAITAAQNGKEVILIDEANLGGTCLNVGCMPTKSLLESAEVHDIVRKANHYGITLNNGSISIDWKQLQARKSQIVTQLVQGIQYLMKKNKIKVIQGKAKFETDHRVRVTNGNKEDVVDGDQFIIAAGSEPAELPFAPFDGKWILNSSHAMSLENIPKSLLIVGGGVIGCEFASIYSRLGTKVTIVEMAPQLLPGEDKDIAQILKEKLESDGVEIFTGAALKGLNNYKKQASFEYKGSIQEANPEYVLVSVGRKPRAQGLDLEKAGVQFSNKGISVNEHMQTNRSHIYAAGDVIGGIQLAHVAFHEGTTAALHASGEDVKVNYHAVPRCIYTAPEIASVGLSEKLAREQYGDILIGEFPFSANGKALIIGEQTGKVKVIVEPKYQEIVGISIIGPRATELIGQGTVMIHTEVTADIMRDYIAAHPTLSEAIHEALLQAIGHAVHA

SEQ ID NO: 3464 - protein, 103 aa, Triticum aestivum
  misc_feature (32)..(32): Xaa can be any naturally occurring amino acid
  misc_feature (44)..(44): Xaa can be any naturally occurring amino acid
  misc_feature (58)..(58): Xaa can be any naturally occurring amino acid
  misc_feature (62)..(62): Xaa can be any naturally occurring amino acid
  misc_feature (76)..(76): Xaa can be any naturally occurring amino acid
  misc_feature (87)..(87): Xaa can be any naturally occurring amino acid
  misc_feature (95)..(95): Xaa can be any naturally occurring amino acid
SPKFAHRVVGYLEEEAVHSYTEFLKDLDDGKXDKVPAPGIAIDXTGRLPANATLKGLXSTLXRRQQRSTTANLNNXQSGVLQQGINXKATPAPFXTLKLGVFC

SEQ ID NO: 3465 - protein, 543 aa, Candida tropicalis
MSSSPSIAQEFLATITPYVEYCQENYTKWYYFIPLVILSLNLISMLHTKYLERKFKAKPLAVYVQDYTFCLITPLVLIYYKSKGTVMQFACDLWDKNLIVSDPKAKTIGLKILGIPLIETKDPENVKAILATQFNDFSLGTRHDFLYSLLGDGIFTLDGAGWKHSRTMLRPQFAREQVSHVKLLEPHMQVLFKHIRKHHGQTFDIQELFFRLTVDSATEFLLGESAESLRDESVGLTPTTKDFDGRNEFADAFNYSQTNQAYRFLLQQMYWILNGSEFRKSIAIVHKFADHYVQKALELTDEDLEKKEGYVFLFELAKQTRDPKVLRDQLLNILVAGRDTTAGLLSFLFFELSRNPEIFAKLREEIENKFGLGQDARVEEISFETLKSCEYLKAVINETLRIYPSVPHNFRVATRNTTLPRGGGEGGLSPIAIKKGQVVMYTILATHRDKDIYGEDAYVFRPERWFEPETRKLGWAYVPFNGGPRICLGQQFALTEASYVTVRLLQEFGNLKQDPNTEYPPKLQNTLTLSLFEGAEVQMYLIL

SEQ ID NO: 3466 - protein, 519 aa, Candida apicola
MIIGLSDAFALGGIALSFLVAYQFIYFYFIYSPRAKKLGCAPPVIVFSFPLGLPALYKFATAMLHDNLLEYISIRIADMKVRTGFQTLAGQRWLVTLEPENIKTVLATSFKDYSLGFRYDIMYGLLGNGIFTLSGDGWKHSRALLRPQFSREQVSHLESMRTHINLMINNHFKGGQVVDAQALYHNLTIDTATEFLFGESTNTLDPDLAQQGLPGPKGLVTGEQFAEAFTSALEILSVRVIVGAAWFLIWTPKFWRSCKVCHNFIDYFVYKALATPMEKDQEADRYVFIRELTKETSDPRVIRDQALNILLAGRDTTAGLLSFITYYLGAYPEVYAELREAVLSEFGSTDVETPTFEQLKQCKVLQNVIREVLRLHPNVPLNFRQAIVDTKLPTGGGPNGDQPVFVPKGQNVFYSTYSMQRRTDIWGPDATTFRPDRWNEPREALASGWDYIPFNGGPRICLGQQFALTEASYTIVRICQEFSRIEVLHPDVITSKNSMKQRMRLTQTASGGVITRFIR

SEQ ID NO: 3467 - protein, 487 aa, Berberis stolonifera
MDYIVGFVSISLVALLYFLLFKPKHTNLPPSPPAWPIVGHLPDLISKNSPPFLDYMSNIAQKYGPLIHLKFGLHSSIFASTKEAAMEVLQTNDKVLSGRQPLPCFRIKPHIDYSILWSDSNSYWKKGRKILHTEIFSQKMLQAQEKNRERVAGNLVNFIMTKVGDVVELRSWLFGCALNVLGHVVFSKDVFEYSDQSDEVGMDKLIHGMLMTGGDFDVASYFPVLARFDLHGLKRKMDEQFKLLIKIWEGEVLARRANRNPEPKDMLDVLIANDFNEHQINAMFMETFGPGSDTNSNIIEWALAQLIKNPDKLAKLREELDRVVGRSSTVKESHFSELPYLQACVKETMRLYPPISIMIPHRCMETCQVMGYTIPKGMDVHVNAHAIGRDPKDWKDPLKFQPERFLDSDIEYNGKQFQFIPFGSGRRICPGRPLAVRIIPLVLASLVHAFGWELPDGVPNEKLDMEELFTLSLCMAKPLRVIPKVRI

SEQ ID NO: 3468 - protein, 294 aa, Candida glabrata CBS 138
MSSIFKALSGKSKKEASKTDGGNGKLYMNKQRTLLISSRGVNYRHRHLIQDLHSLLPHTRKEPKLDTKKDLQQLNEIAELYNCNNIMFFEARKHQDLYLWMSKPPNGPTIKFYVQNLHTMDELNFTGNCLKGSRPILSFDNRFDTTPHYQLIKEMMIHNFGVPPTSRKRKPFIDHVMSFSIVDDKIWVRTYEISHSARNKSEYEEGEEDNDISLVEIGPRFVMTVILVLEGAFGGPKIYENKQYVSPNAVRAQMKQQAANEAKSRADAAVERKIKKREAVLAADPLSNEVLFKD

SEQ ID NO: 3469 - protein, 364 aa, Arabidopsis thaliana
MSALKNYGLISIDSALHFPRSNQLQSYKRNAKWVSPIAAVVPNFHLPMRSLEDKNRTNTDDIRSLRVITAIKTPYLPDGRFDLQAYDDLVNTQIENGAEGVIVGGTTGEGQLMSWDEHIMLIGHTVNCFGGRIKVIGNTGSNSTREAIHATEQGFAMGMHGALHINPYYGKTSIEGMNAHFQTVLHMGPTIIYNVPGRTCQDIPPQVIFKLSQNPNMAGVKECVGNNRVEEYTEKGIVVWSGNDDQCHDSRWDHGATGVISVTSNLVPGLMRKLMFEGRNSALNAKLLPLMDWLFQEPNPIGVNTALAQLGVARPVFRLPYVPLPLSKRIEFVKLVKEIGREHFVGDRDVQVLDDDDFILIGRY

SEQ ID NO: 3470 - protein, 375 aa, Shewanella sp. MR-7
MRILETIMNKPPIIWLNVILFSLTFLSAIILVPWYGLTQGFGASEWIAFVVLAFASGLSITAGYHRLWSHKAYKAHPAVRFLYALGGALALQNSALHWASDHRVHHKHVDDNDKDPYSAKMGFWYSHIGWMLREYQAQRYHDYQNVRDLQNDRIVMWQHKHYLALVILMNIGLPALLGWFTGNIAGMLLMAGLLRLVVVHHCTFFINSLAHVWGNQPYTDKNTARDNGFLAMLTYGEGYHNFHHIFENDYRNGIKWWHYDPTKWLIKALSWVGLATDLRTSPQERIESARLQMQLLHAKNKVIHLPNADEIIEKIQQEYELMKEHLLEYYQAKKALLEAKRKQLVDQQLLLQVEELKTRFLTQQKSWKSLTASYS

SEQ ID NO: 3471 - protein, 136 aa, Corynebacterium diphtheriae
MTERTLILIKPDGVERGLIGEIIARIERKGLKISALDLRVADRETAEKHYAEHADKPFFGELVNFITSAPLIAGVVEGPRAIEAWRQLAGGTDPVAKATPGTIRGDFALEVSTNVVHGSDSPESAEREISIWFPNL

SEQ ID NO: 3472 - protein, 290 aa, Arabidopsis thaliana
MAGIDTQKQLLSLIRDFTSERSRGEQRVVGLKKRIEILQSEVEAANSEVEHAKRIKEVAEEELNGYEVELSLNDSTIQSLEVMFGKLFILFVIYRDQFISQMEELNKEIREFQKTVDSSLADEDSTGITANIKAFEDCSGDDLEAIKNLLSDVHSQLAKEEEGYLAEQKMQEQLQKEFDEYEKKMSLIEAITEKTNSVQVDLPFFQKNSSLDRKQADVRVGTDIGFTRGGAAKEMPMSTMPSREFGSFELTSSGRSSRYFDCYDNSEETDDDQRTRSHLAMKARRICQHD

SEQ ID NO: 3473 - protein, 242 aa, Burkholderia xenovorans LB400
MCDRHLSHLCSPARRNLLLAGASSITLAGLSRHDAMAAEPAAANAPNSIPPAEALGRLMQGNARYAANTSLNKDYSAGRAARVSAQYPIAAIVGCADSRVAPELAFDQGPGDLFVVRVAGNFVNDDILASLEYGVEFLGVPLIMVLGHTQCGAVSATVKVLHDSVRLPGHLPELVRAIEPAVRMANAEHGADLAAQATIDNVRLNTNRLTVSKPLIGQYVKSGKVKVVGGIYDLATGRIALI

SEQ ID NO: 3474 - protein, 403 aa, Chlamydia muridarum Nigg
MDKLSIKDLSPEGKKVLVRVDFNVPIKDGKILDDVRIRSAMPTINYLLKRDAAIILVSHLGRPKGDMFEEAYSLAPIVPVLEGYLGHHVPLSPDCVGEVARQAVAQLSPGRVLLLENVRFHRGEEHPEEDPSFAVELAAYADFYVNDAFGTSHRKHASVYRVPQMFPDRAAAGFLMEKELEFLGQHLLVEPKRPFTAILGGAKVSSKIGVIEALLSRVDNLVLAGGMGYTFLKAMNQQVGNSLVEETGIPLAKRVLEKARTQGVKIYLPVDAKVARRCETGEDWQELSIQEGIPEGFSGFDIGSKTIALFSEVIQDSATVFWNGPVGVYEVPPFDQGSKAIAQCLASHSSAVTVVGGGDAAAVVALAGCTSQISHVSTGGGASLEFLEKGYLPGTEILSPARS

SEQ ID NO: 3475 - protein, 211 aa, Burkholderia xenovorans LB400
MQEIIEGFIRFQREVFPQQSGLFKRLSTAQSPSTLFVTCSDSRVVPELLTQTEPGSLFVIRNAGNIVPSYGPEPGGVSATVEYAVAVLRVRDIVICGHSNCGAMTAISTCMNLDHLPAVAGWLRHADAAKAINASRTYHSDAECLEALVKDNVIAQLANIRTHPSVAVGLANKTLQLHGWIFDIESGVMLALDGRTGKFLPLVDNPDIYAV

SEQ ID NO: 3476 - protein, 320 aa, Streptococcus oralis
INKEPGAEEKYKEVQEAYETLSDDQKRAAYDQYGAAGANGGFGGAGGFGGFDGAGGFGGFEDIFSSFFGGGGASRNPNAPRQGDDLQYRVNLTFEEAIFGTEKEVKYNREASCRTCNGSGAKPGTSPVTCGRCHGAGVINVDTQTPLGMMRRQVTCDVCHGRGKEIKDPCTTCHGTGHEKQAHSVHVKIPAGVETDQQIRLAGQGEAGFNGGPYGDLYVVVSVEASDKFEREGTTIFYKLNLNIVQATLGDTVEIPTVHGAVELVIPEGTQTGKKFRLRGKGAPSLRGGAVGDQYVTVNVVTPTGLNDRQKAALKEFAAA

SEQ ID NO: 3477 - protein, 315 aa, Streptococcus oralis
PDINKEPGAEEKYKEVQEAYETLSDDQKRAAYDQYGAAGANGGFGGAGGFGGFDGAGGFGGFEDIFSSFFGGGGASRNPNAPRQGDDLQYRVNLTFEEAIFGTEKEVKYNREASCRTCNGSGAKPGTSPVTCGRCHGAGVINVDTQTPLGMMRRQVTCDVCHGRGKEIKDPCTTCHGTGHEKQAHSVHVKIPAGVETDQQIRLAGQGEAGFNGGPYGDLYVVVSVEASDKFEREGTTIFYKLNLNIVQATLGDTVEIPTVHGAVELVIPEGTQTGKKFRLRGKGAPSLRGGAVGDQYVTVNVVTPTGLNDRQKAA

SEQ ID NO: 3478 - protein, 543 aa, Clostridium acetobutylicum ATCC 824
MNNLKGLELLRNPFLNKGTAFTLEERKKYDLTGLLPCAVMTLEEQEKVVYEKLKSIDDALDKHFYLMNIYDTNRILFYYVVKKHIVELLPIVYTPTIGDAVINYSKNYDTPKDAVFLSINHPENIKKSIEAVSNDLDDIKLIVVTDGEGVLGIGDWGVQGVDISIGKLAVYTVAAGLNPRNVLPIVIDAGTNNEALLNDPFYVGNKHKRVTGEKYYSFIDEFVKTCTSLFPDVLLHWEDFGRGNASTILEKYRNNICTFNDDIQGTGVMMVAALNSVAKVTNTPIKNHKILVFGGGTAGIGVSDQILLEKIRSGLTLDEALKDFYIVDRQGLITEDMQDLTEGQKKYSRKKGEFKKPLKDLAEIVAEVKPTVLIGTSGVHGAFTEAVVKNMAKSTERPAIMPISNPTKLAEAKAEDIIKWSDGNALVVTGSPSSPVEYKGVTYTIGQANNALLYPGLGLGIVVSKSKTVSDGMLAAAAHGVSSLIDLSVKGAPMLPVISKLREASKLVATAVVKEAVKENLNRAPIVDAENAVENEIWEPYYR

SEQ ID NO: 3479 - protein, 381 aa, Arabidopsis thaliana
MSASSSSFEQPQVITCNAAVAWRAGEPLVMEEVEVSPPQPLEIRIKVVCTSLCRSDLSAWESQSLLPRIFGHEAAGIVESIGEGVTEFEKGDHVLAVFTGECGSCRHCISGKSNMCQVLGMERKGLMHSDQKTRFSIKGKPVYHYCAVSSFSEYTVVHSGCAVKVDPLAPLHKICLLSCGVAAGLGAAWNVADVQKGSSVVIFGLGTVGLSVAQGAKLRGAAQILGVDINPAKAEQAKTFGVTDFINSNDLSEPIPQVIKRMTGGGADFSFECVGDTGIATTALQSCSDGWGMTVTLGVPKAKPEVSAHYGLFLSGKSLKGTLFGGWKPKSDLPSLIDKYMNKEIMIDEFITHNLSFDEINKAFVLMREGKCLRCVLHMPK

SEQ ID NO: 3480 - protein, 317 aa, Streptococcus oralis
EPGAEEKYKEVQEAYETLSDDQKRAAYDQYGAAGANGGFGGAGGFGGFDGAGGFGGFEDIFSSFFGGGGASRNPNAPRQGDDLQYRVNLTFEEAIFGTEKEVKYNREASCRTCNGSGAKPGTSPVTCGRCHGAGVINVDTQTPLGMMRRQVTCDVCHGRGKEIKDPCTTCHGTGHEKQAHSVHVKIPAGVETDQQIRLAGQGEAGFNGGPYGDLYVVVSVEASDKFEREGTTIFYKLNLNIVQATLGDTVEIPTVHGAVELVIPEGTQTGKKFRLRGKGAPSLRGGAVGDQYVTVNVVTPTGLNDRQKQRLKNSQLQ

SEQ ID NO: 3481 - protein, 123 aa, Salmonella enterica
MPKPMFGDNGSGMHCHMSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAG

SEQ ID NO: 3482 - protein, 315 aa, Streptococcus oralis
GAEEKYKEVQEAYETLSDDQKRAAYDQYGAAGANGGFGGAGGFGGFDGAGGFGGFEDIFSSFFGGGGASRNPNAPRQGDDLQYRVNLTFEEAIFGTEKEVKYNREASCRTCNGSGAKPGTSPVTCGRCHGAGVINVDTQTPLGMMRRQVTCDVCHGRGKEIKDPCTTCHGTGHEKQAHSVHVKIPAGVETGQQIRLAGQGEAGFNGGPYGDLYVVVSVEASDKYEREGTTIFYKLNLNIVQATLGDTVEIPTVHGAVELVIPEGTQTGKKFRLRGKGAPSLRGGAVGDQYVTVNVVTPTGLNDRQKAALKEFAAA

SEQ ID NO: 3483 - protein, 419 aa, Vibrio vulnificus CMCP6
MPVKTTQNKNIHTALRCLDSAQQIEQKLNPNYAPPKRTLPKSPFISDKTLKKRWDVVNCHATQGQLLDQHTLEHMALYQKNIEHFVGTVKVPVGLAGPLRVNGLFASDDYLIPLATTEAALVASYSRGANLITAAGGATAMLVNEGVTRTPVFAFTNLVSAGQFVAWVTTHYERFKQIAESTTSHGTLSDININMEGNHVYLMFEYQTGDASGQNMVTIATNAVFQSILETCPIDIKEAFLDGNLSGDKKANSKTLTSVRGKKVIAEVTLSREMVEKYLHTTPEKMVKFGQMTTTGAALSGGIGVNAHYANALTALYLACGQDAACVAESAIGITRMELTADGHLYASVTLPNLMVGTVGGGTGLPSQKACLDILGLYGQGNARALAEVCAALCLAGELSIVGAFAAGHFSRAHHKLAR

SEQ ID NO: 3484 - protein, 319 aa, Streptococcus oralis
HKEPGAEEKYKEVQEAYETLSDDQKRAAYDQYGAAGANGGFGGAGGFGGFDGAGGFGGFEDIFSSFFGGGGASRNPNAPRQGDDLQYRVNLTFEEAIFGTEKEVKYNREASCRTCNGSGAKPGTSPVTCGRCHGAGVINVDTQTPLGMMRRQVTCDVCHGRGKEIKDPCTTCHGTGHEKQAHSVHVKIPAGVETGQQIRLAGQGEAGFNGGPYGDLYVVVSVEASDKYEREGTTIFYKLNLNIVQATLGDTVEIPTVHGAVELVIPEGTQTGKKFRLRGKGAPSLRGGAVGDQYVTVNVVTPTGLNDRQKAALKEFAAA

SEQ ID NO: 3485 - protein, 115 aa, Salmonella enterica
GMHCHMSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDG

SEQ ID NO: 3486 - protein, 614 aa, Sopubia cana
FYAIIHRVTGCIVIDFEPVKPHEVPMTAAGALQSYKMAAKAIARLQALPNGSLERLCQTMAQEVFELTGYDRVMVYRFHDDDHGEVFAEITKPGLEPYLGLHYPAIDIPQAARFLFMKNKVRMIWDCRANRVKVVQDEALSSDLTLCGSTLRAPHSCHLRYMENMNSIASLVMSVVINEGTDEDSPISSSPSHPDKRIRIWGLVVCHHTSPRFIPFPLRYACEFLSQVFAIHVTKELELQNQMLEKSILKTQTVLCNMLLRGSPLSIVTQSPTVMDLIKCDGSILLYKGTMHRLGMAPSELQIQDIISWLDEYHSDSTGMSTDSLLEAGFPGAAALGDAFCGMAAVRITVRDWLFWFRAHTAAEVRWGGAKHEKEDEDDGRRMHPRSSFKAFREVVKARSVLWRDFEMDAIHTLQLILRSVCEKEEEEERERRKDVVVAGEIEARLNEMHINGAKEMDAVISEMVRLIEMASVPILAVGVNRMVNGWNTKIADLTGLPVDGAIGRQFLELIEEDSADVVRRMLELALQGQEERNVQFEIKTHGPRANSGSISLVVNACTNRDVEDNIVGVVFIAQDVTTERSMMDKFTRIEGDYRAIVQNPNPLIPPIFGLDEF

SEQ ID NO: 3487 - protein, 373 aa, Bacillus licheniformis ATCC 14580
MLNLKKRIALLPGDGIGPEVLDAAVDVLKSVAEHYQHEFEFEYGLIGGAAIDEAGAPLPEETVAACKAADAILLGAVGGPKWDQNPSELRPEKGLLAIRKQLDLFANLRPVKVFESLAGASPLKTEYIEGVDFVIVRELTGGLYFGKPSEQYVNQNGEEEAVDTLFYKKSEMERVIREAFQMAQSRKGKVTSVDKANVLESSKLWRKTAEEVAKEFPDVKLEHMLVDNAAMQLIYAPGQFDIIVTENMFGDILSDEASMLTGSLGMLPSASLSSSGLHLYEPVHGSAPDIAGQNIANPLAAILSAAMMLRTSFGLEAEAQAVEHAVDQVLRAGKRTKDLAKGSEHCTTQSITGEVKAALADDNAISNIMTAYV

SEQ ID NO: 3488 - protein, 120 aa, Salmonella enterica
SGMHCHMSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGIKNK

SEQ ID NO: 3489 - protein, 397 aa, Neisseria gonorrhoeae FA 1090
MQNYLTPNFAFAPMIPERASGSRVWDTEGREYIDFSGGIAVNALGHCHPALVDALNAQMHKLWHISNIYTTRPAQELAQKLVKHSFADKVFFCNSGAEANEAALKLARKYARDRFGGGKSEIVACINSFHGRTLFTVSVGGQPKYSKDYAPLPQGITHVPFNDIAALEAAVGEQTCAVIIEPIQGESGILPATAEYLQAARRLCDRHNALLILDEVQTGMGHTGRLFAYEHYGVVPDILSSAKALGCGFPIGTMLATEKIAAAFQPGTHGSTFGGNPMACAVGSRAFDIINAPETLHNVRSQGQKLQTALLDLGRKTGLFSQVRGMGLLLGCALDTPYRGRSSEIAATSLKHGVMILVAGADVLRFAPSLLLNDEDIAEGLRRLEHVLTEFAAANRP

SEQ ID NO: 3490 - protein, 130 aa, Salmonella enterica
MPKPMFGDNGSGMHCHMSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGIKNK

SEQ ID NO: 3491 - protein, 283 aa, Triticum aestivum
  misc_feature (237)..(237): Xaa can be any naturally occurring amino acid
  misc_feature (250)..(250): Xaa can be any naturally occurring amino acid
  misc_feature (261)..(261): Xaa can be any naturally occurring amino acid
  misc_feature (267)..(267): Xaa can be any naturally occurring amino acid
  misc_feature (270)..(270): Xaa can be any naturally occurring amino acid
  misc_feature (273)..(273): Xaa can be any naturally occurring amino acid
  misc_feature (281)..(281): Xaa can be any naturally occurring amino acid
MSSGRYMAYSPSPSTTPHSPRISGLRASSAAVADQEKYLAELLAERHKLNPFVPVLPHSIRLLNQEILRVSTLLENASLLNQSGFEHGSPLTSGGLYSNGAATDMNGWTSAFQSESSSAYSWLGGSQGSSSGLIVKKTMRVDIPVDKYPTYNFVGRILGPRGNSLKRVEATTDCRVLIRGRGSIKDPAREEMMRGKPGYEHLNEPLHILVEAELPVEIIDARLMQAREILEDLLRQXGRVQDFFKKQQLXRELAMLNGTSXRKGSKXGPXPFXKTWDEKAXKG

SEQ ID NO: 3492 - protein, 542 aa, Prochlorococcus marinus str. MIT 9303
MTVSSPTKKFLQGKKLNKIEQNKAFKDGLDVGDELETFAQVGWEQVDKTDLELRLKWYGMFWRPKTPGKFMLRLRIPNGVLNSHQIKVVASIVGRYGEDGSCDITTRQNLQLRGVLLSDLPEILRRLEEAGLNTIQSGFDNPRNVTGNPLAGIDPLEIVDTRPYTTELQNFLTNQGKGNHEFSNLPRKWNTAVAGARDNFLLHNDIIFHPVEHDGVMGFGVWLGGILSSQMNDYALPLNAWVKPNEICRLTGTIITLWRDNGERNNRPKGRFRMYLDSVGIEAFRTMVAEQFGPLTPDPGSVFNDKPRSFYGIHPQKQTGLHYAGMHVPVGRLSAEDLQDLASASLNYGSGEIRLTEDQNIILVGLSTTNLDKFQADPLLQRFPLEPGSIAAGTVSCTGNTYCSFALTNTKDQAMAMAHELDAELILPEEIKVHWTGCPNSCGQAYMGAIGLTGTKARAPNGGQGMVEAYDLSLEGRQGPDARIGTLHRKGIPGSELKDVLRELLIERFGAQPRSQPKQNSDPFSNFMNWFSNLGENSSPSP

SEQ ID NO: 3493 - protein, 471 aa, Striga asiatica
SGKPFYAIIHRVTGSLVIDFEPVKPHEVPMTAAGALQSYKLAAKAITRLQALPSGSLEKLCETMAQEVFELTGYDRVMVYKFHEDDHGEVFAEVTRPGLEPYLGLHYPATDIPQAARFLFMKNKVRMICDCRAAHVKVVVQDEGFSSNLTLCGSTLRAPHSCHLRYMENMNSIASLVMSVVINEGTDEESSTATSSSSSSHHHPDKQKRLWGLVVCHHTSPRFVPFPLRYACEFLSQVFSIHVGKELELLNQTLEKNILKTQTMLCDMLLRGNPLAVVTQSPTVMDLVKCDGAVFLYKGKNHRLGLSPSDLQIFDIVSWLDEFHRDSTGMTTDSLLGAGFPGAGALGDAFCGMAAVRITGRDWLFWFRSHTAAEVQWGGAKQEKGEEDDGRKMHPRSSFKAFLEVVKARSVAWREFEMDAIHSLQLILRNACDKEEEEEARRKDMVVAGEIQSRLNELHIDGAKEMEMVTS

SEQ ID NO: 3494 - protein, 258 aa, Blastopirellula marina DSM 3645
MTLSALFDLSGRTALVTGGSKGIGKAIARGLAEAGASVCITARHQQELETAAQEIGAGLDVRVAWRICDMADRAAVDALADGVLEEFGQVDILFNNAGTNQPQLLVETTDESWDHVLEINFTSCMRLARKLAPGMIERRWGRIIHLSSVLAVVSNPGRGNYSGTKGALSAMTRAHALELGPHGITVNCLAPGPIATDLPMSLLNDEQKQRFAERTAVLRWGETKDLVGPALLLASDAGAYITGTTLLVEGGMICRTFD

SEQ ID NO: 3495 - protein, 1285 aa, Candida glabrata CBS 138
MEQQDLVENKLSFSKIPRVGLHVRDLSITASKTDSVLVHPLSLDLPSGSVMAIMGGSGSGKTTLLNVLASKISSGLTHSGEISYILEADKNNVDDSSSEASFDLNATYKENVTLAYVPQQDVLCSRLTCRETLMYAADLKLDASKVEKTLIVNQLIDELGLKDCADTLVGDNSHRGLSGGEKRRLSMGTQMVSNPSVMFLDEPTTGLDAYSAYLVVKTLKKLAKEDGRTFILSIHQPRSDILFLFDYVCILSKGNVVFCNQMNELIPYFKSISYDVPDLVNPADYFIDLSSVDGRTEDSLAITSERLEMLVSHWRKYEEKTLSYKPINHKYEIQLKSMTGRLPFWKQVSVLTRRNYKLNFNDTNTLIATFAEPVVMGAIVGWIYFKPDTSNIGGLRTLISCLYASVILQSYLYLLFDTYRLCEQDIALFDRERAEGAVSGIAFIVARKLALFITDDILMTILYTSITYFMFGLEKNASKFFFQYAVNLLAQLICSALAMVSVAVSRDFAKASLVGNLSFTLFSMSCGFFVNAKLMPVYVRWTKYIAFTWYGFGSLLSNTFSDSYCNGGEGFECQGNQVVRQYGFPLHWRTLPMWILFCWFVGFFMLSIIILTWNKVDITLQNEVNKKKHKKSDIKDDASNLTEESDIKDTDDSISTNQRDDMTNKLAHITVVAQDVDLEVKYTKLYNRKNHKIFEYENKKILQNVSAVFKPGMINAIMGPSGSGKSSFLNLISGRLESSLLVKFNTAGTIKLNDTPISQDMFKHLCSYVSQDDDHLLAMLTVRETFDFAAALRLKHLSKDDKRSRTDSLIAILGLKHCENTIIGNEFIKGISGGEKRRVSMGIQLLSDRPILLLDEPTSGLDSFTSSTILEILENLCSEHNKTVILTIHQPRSELFMKFGNILLLAKSGRTAFNGSPEEMIKHFDLMGYKCPSFTNIADFFLDLISVNTQNEQNEIHSKTRVENILSTWRAERLRLSAEKSIVTEEEHTLETFEDEYGQYFSKPAGLKLAYMVNLRRQYTTTIRNFDSLMARIAQVPGLGGIFALYFAPLKHNYTSISNRLGLAQESTSLYFVGMLANLAVYPPERDYFYEEFKDGVYGVAPFYLAYMTLELPLTTIAAIVYSALTVFGCGMPRTAGNFFANVYCALMIVSCGEALGIMTNTLFKRPGFVVNCISVILSIGTQLSGLMSLHMSRVLKGINYINPVWYTSIIVINFAFPDNLNFTCKDGPQNADGSCVLKTGRDVLDAYGLHRNTKNFLGVVICVTFCYRLLAYLMLKAKLEWLKW

SEQ ID NO: 3496 - protein, 590 aa, Eucommia ulmoides
MDLRRRPPKPAATNGRNHHLHHQGNSSSPAIDCSPSPIPKASDALPLPLYLTNGIFFTLFFSVAYYLLHRWRDKIRNSTPLHVLTLSELAAIVSLIASFIYLLGFFGIDFVQSFIARASHDPWDVDDDERFILEEDRRRGPCTAALDCLVGPVAPSISDVRKLMDPPAPLPSVEDEQMVKSVISGTVPSYSLESKLGDCYRAASIRREAIQRITGKSLSGLPLEGFDYEAILGQCCEMPIGFLQIPVGIAGPLLLNGCEYSVPMATTEGCLVASTNRGCKAIYASGGATSILLRDGMTRAPVVRFPSAKRASELKFFLEDPLNFETLSMVFNKSSRFARLQGIQCSIAGKNLYMRFTCSTGDAMGMNMVSKGVQNILEFLQNDFPDMDVIGISGNFCSDKKPAAVNWIEGRGKSVVCEAIISEDIVRKVLKTTVPALVELNMLKNLAGSAVAGALGGFNAHAANIVSAVFIATGQDPAQNIESSHCITMMEAVNDGKDLHISVTMPSIEVGTVGGGTQLASQSACLNLLGVKGANKESPGSNSRLLAAIVAGSVLAGELSLMSAIAAGQLVNSHMKYNRSNRDFTKVTSS

SEQ ID NO: 3497 - protein, 300 aa, Glycine max
MRATAEFQGSVLNLRGVQVHSMEGSSMEQELDLFQKHVTERFLELSSVESGELLSLSWVRKLLDSFLCCQEEFRVILHNHRDQVMKHPPLDRMVGEFFERSVKALDVCNAIRDGIEQIRQWQKLLEIVLCALDHKRSIGEGQFRRAKKALVDLAIGMLDDKDSSSSGSIAHRNRSFGRNNASKDHHHNNSFGHFRSLSWSVSRNWSAARQLQALGNNLSPPKATDIVATNGLALPIFTMSYVMVFVMWALVAAIPCQDRGLGLHFSFVALINYAPLFHTRKKKKKTIVCLLMLNICHLRS

SEQ ID NO: 3498 - protein, 397 aa, Desulfitobacterium hafniense Y51
MYRSALPGESYLQNNFLEGVGMKAIVYEGIRDVKVKNVGDPGIQKPDDIIVKVTSTAICGSDLHLIHGMVPGMPEGFVLGHETMGIVEEVGGDVHKVKKGDRVIVPFPIACGHCWYCEHDLWSQCDNANPEAEVGAYFGYSNTFGGYDGGQAEYLRVPYANVGPKVVPEELTDEQVLFLTDILPTSYWGVEIGGVKKGDTVVVLGCGPVGLLTIKWAIFQGAKRVIAVDHISYRLDHAYRYYGVEVINFEDHDNTGEYIKEITHGGADVVIDCVGMDGKASTFEKIETLLKLQGGSKSAIEIATQAVRKGGTVALVGVYGSKYNLFPLGDFFSRNITLKMGQCPAHSYVEPILELIKTGRFDATDIITHRLSLDKGEHAYEIFDEKKDNCIKVVLKP

SEQ ID NO: 3499 - protein, 475 aa, Zea mays
MGALLLFAVCLLAPIVLACAVRGRKRRAAAPAPAPACGKKALPLPPGSMGWPYVGETLQLYSSKNPNVFFARKQNRYGPIFRTHILGCPCVMVSSPEAARFVLVTQAHLFKPTFPASKERMLGPQAIFFQQGDYHARLRRLVSRAFSPQAIRASVPAVEAVALRSLRSWDGRLVNTFQEMKLYALNVALLSIFGEEEMRYIEELKQCYLTLEKGYNSMPVNLPGTLFHKAMKARKRLSAIVAHIIEARRERPRPRGSDLLASFLDGREALTDAQISDNVIGVMFAARDTTASVLTWMVKFLGDHPAVLKAVIEEQQEIARSKGSSGDEPLTWADTRRMRVTSRAIQETMRVASILSFTFREAVEDVEYQGYLIPKGWKVLPLFRNIHHSPDHFPCPDKFDPSRFEVAPKPNTFMPFGNGTHSCPGNELAKLEMLVLFHHLATKYRWSPSKSESGVQFGPFALPLNGLPMTFARKD

SEQ ID NO: 3500 - protein, 398 aa, Zea mays
MLSALMDYLKSCWGPASPAGRPRKGSDATGRQDGLLWYKDGGQVVDGEFSMAVVQANNLLEDHSQVESGPLSTSEPGLQGTFVGVYDGHGGPETARYINDHLFNHLRRFASEHKCMSADVIRKAFRATEEGFISVVSNQWSLRPQLAAVGSCCLVGVVCSGTLYVANLGDSRAVLGRLVKGTGEVLAMQLSAEHNASYEEVRRELQASHPDDPHIVVLKHNVWRVKGIIQITRSIGDVYLKKPEFNREPLHSKFRLQETFRRPLLSSDPAITVHQIQPTDKFIIFASDGLWEHLSNQEVVDMVQSSPRNGIARKLVKSAVQEAAKKREMRYSDLKKVDRGVRRHFHDDITVIVVFFDSNAMTTAAWSRPSVSLRGGGFPIHSNTLAPFSVPTELNNSY

SEQ ID NO: 3501 - protein, 410 aa, Roseovarius nubinhibens ISM
MLDKITGEGRMLQDLLAAGAVDRLDPADRARAQRLTTQTLRAMERADRLISRHVKKKPPLTIRNILRLATVELAYGGDAHGVVGEAVTLAGEGQRSQNYKGLVNAVLRKIAEEAPRSWNDLRVPRLPGWLRGPLLDAYGPGAVNGMEAAHFAGAPLDLTAKTDAAALAEATGGTLLPSGSVRLTDPGQVSALPGYAEGAFWVQDAAAAMPVRILDPKPGENVLDLCAAPGGKTLQIAASGASATALDLSAQRMQRVQENLERTGLAASCETGDALRHTGGPYDAILLDAPCSATGTLRRHPDLPFAKDGSDIGRLITLQGEMLDHALSLLKPGGRLMFCTCSLLPDEGECHVEEALLRHEGLVVDREALAQPGIDPAWITEEGGLRLRPDYWADQGGMDGFYMALLRKPG

SEQ ID NO: 3502 - protein, 254 aa, Xanthobacter autotrophicus Py2
MPASRRVLIAGNWKMNGLKSSLAEIEALAAGYDGDLKAKLDLLVCPPATLLISAAERLAGSGVQLGGQNCHPAPAGAHTGGISAEMLKDAGVTSVIVGHSERRTNLSESDAVVMAKVKAAWCFGLLPIVCVGETAEERDAGEAVGVVTRQVHQSLPEGCTASNLVIAYEPVWAIGTGRTPTPEDVANIHGTIRSVLRSQFGAEADGIRILYGGSVKPDNAATLMAVADVDGALVGGASLKAADFLAIARATPAR

SEQ ID NO: 3503 - protein, 543 aa, Clostridium acetobutylicum ATCC 824
MNNLKGLELLRNPFLNKGTAFTLEERKKYDLTGLLPCAVMTLEEQEKVVYEKLKSIDDALDKHFYLMNIYDTNRILFYYVVKKHIVELLPIVYTPTIGDAVINYSKNYDTPKDAVFLSINHPENIKKSIEAVSNDLDDIKLIVVTDGEGVLGIGDWGIQGVDISIGKLAVYTVAAGLNPRNVLPIVIDAGTNNEALLNDPFYVGNKHKRVTGEKYYSFIDEFVKTCTSLFPDVLLHWEDFGRGNASTILEKYRNNICTFNDDIQGTGVMMVAALNSVAKVTNTPIKNHKILVFGGGTAGIGVSDQILLEKIRSGLTLDEALKDFYIVDRQGLITEDMQDLTEGQKKYSRKKGEFKKPLKDLAEIVAEVKPTVLIGTSGVHGAFTEAVVKNMAKSTERPAIMPISNPTKLAEAKAEDIIKWSDGNALVVTGSPSSPVEYKGVTYTIGQANNALLYPGLGLGIVVSKSKTVSDGMLAAAAHGVSSLIDLSVKGAPMLPVISKLREASKLVATAVVKEAVKENLNRAPIVDAENAVENEIWEPYYK

SEQ ID NO: 3504 - protein, 220 aa, Thermoanaerobacter tengcongensis
MKITAVLFDLDGTIIDTNQLIIKSFVYTVEKHLGYKIGAEEVIPYFGEPLPLTLQRFSKDKWEIMLKTYRDYNEKYHDRYTKIREDVKEVLARLKEEGIKTAVVTSKRRELAKRGLKLFELDKYFDVLVGLEDTEKHKPEPDPVLKALELLKSPREEALMVGDSPYDILSARSAGVRSVAVKWSVLPFELLKKEKPDYFIEDMWQLLKIIKGCDEDEHEQ

SEQ ID NO: 3505 - protein, 319 aa, Streptococcus oralis
DINKEPGAEEKYKEVQEAYETLSDDQKRAAYDQYGAAGANGGFGGAGGFGGFDGAGGFGGFEDIFSSFFGGGGTSRNPNAPRQGDDLQYRVNLTFEEAIFGTEKEVKYNREASCRTCNGSGAKPGTSPVTCGRCHGAGVINVDTQTPLGMMRRQVTCDVCHGRGKEIKDPCTTCHGTGHEKQAHSVHVKIPAGVETGQQIRLAGQGEAGFNGGPYGDLYVVVSVEASDKFEREGTTIYYKLNLNIVQATLGDTVDIPTVHGAVELVIPEGTQTGKKFRLRGKGAPSLRGGAVGDQYVTVNVVTPTGLNDRQKAALKEFA

SEQ ID NO: 3506 - protein, 448 aa, Streptococcus agalactiae 2603V/R
MTITAEDIRREVKEKNVTFLRLMFTDILGVMKNVEIPATDEQLDKVLSNKAMFDGSSIEGFVRINESDMYLYPDLDTWIVFPWGDENGAVAGLICDIYTAEGEPFAGDPRGNLKRNMKRMQEMGYKSFNLGPEPEFFLFKMDENGNPTLDVNDKGGYFDLAPTDLADNTRREIVNVLTQMGFEVEASHHEVAVGQHEIDFKYDDVLKACDNIQLFKLVVKTIARKHGLYATFMAKPKFGINGSGMHCNMSLFDNEGNNAFFDPEDPRGMQLSEDAYYFLGGLMKHAYNYTAIINPTVNSYKRLVPGYEAPVYVAWAGRNRSPLIRVPASRGMGTRLELRSVDPTANPYLALSVLLGSGLEGIENKIEAPEPIETNIYAMTVEERRQAGIVDLPSTLHNALEALEEDEVVKAALGTHIYTNFLDAKRIEWASYATYVSQWEIDNYLDLY

SEQ ID NO: 3507 - protein, 1344 aa, Oryza sativa (indica cultivar-group)
MKTFILQQMVQKGRAKRSSNFNRKEDIQLCISWQSISSDPIIGNEQPGKAYWQRIAEHYHANRDFESDRNANSLEHRWGNIQKEVSKFQGCYEQIERRHPSGIPHQELRPMLRHIPCQCKMKTFILQQMVQKGRAKRSSNFNRKEDIQLCISWQSISSDPIIGNEQPGKAYWQRIAEHYHANRDFESDRNANSLEHRWGNIQKEVSKFQGCYEQIERRHPSGIPHQELLRNSPKFQTLESHKRPRSRKSSTLIESAGEEDEEGDDARKSTTPDLLQPSAKKRPMGRKQAKEKMKNGEDGPYKEAMKDLLDAKEKEAKVKEERWKETKEIQERQLLFAEPTASPSSRELAQRLLKKNAEHESRLRRSAQSKVPSDPNIWFQMRENYEKIILADHDFSEKREIEYLLWQLHYKRIEEFRAHIVSAGKNNANPDRIKRIRSSVRSFLSEATGFYHDLMLKIRSTYGLPLGYFSEGPDSSVVPDKDGKKVVGVKKGLLSCYRCLIYLGDLTRYKGLYGDVDYASREYAAASIYYKEAASLCPSNGNPHHQLAILASYAGDEVTAIYRYFRSLAVDNPFSAARENLILAFDKNHDIYAQLSGNSKVPNAKSLPSRSVGRARGRGETRFQPKGSSTEENSKEREHSIQEILKAFYIRFVRLNGILFTRTSLETFGELSATVISDLQILLSSGPYEELNFGVEAAENALSVVKLIAILIFTVHNANKDADNQSYAEIVQRRVLLQNAFAAAFEFVGYLLKRCAELHDVASSIYLPAILVFIEWLACHPDFVASSEMDEKQADARSFFWSQCVPFMNKLILTGLAHVDGDNDETCFFDMGTYEEGETGNRLALWEDVELRGFSPLVPAQGILDFSTKQGFGSDGGTKEKKARVERILAAWKALLNFVQIDQLRIYFDASSKKFLMASEPPPPASSVPLVVSSNAQTTNHIQQEPEVSSKIGSVAEDLGVLQSKAQLFLDGDDDEEIVFKPPVSEKLPRVTSEQTSNELLQPVVVSDVNWSNDGAPPPMTFQSNGPVLTPNVYVQSLPISSLGWAANAGQHVIPDVGARSTSDIFESLKAPDHNWVSTGAPLVGSLDTVPMASFSNIISDQRTPPSSLGCFSNPDNTAILPGQDSFLLSALNNVNIGASGFLDQRVNGGLSGLQSVGNVPQVSAQATMNSTNPMIGQYKHTEVTIPSAFYSVLPSVVSSDGVSKKNPVSRPGRHVGPPPGFNNAPPKRQDDSILAGNGQHVQTNDGIWLDGYRSSLDYVNNQRFAHSNVTTASSTFTTPFPFPGKQAFSMHPRGSDEKQWQDFHLFGPTKQLPELNFQQGNQQNGPLAEQLPAQSAWSGNYLV

SEQ ID NO: 3508 - protein, 203 aa, Rhizobium leguminosarum bv. viciae
MKSRNGPLRVGIGGPVGSGKTALTEKLCKAMRDDYSVAVVTNDIYTTEDAEALVRMQALPSDRIVGVETGGCPHTAIREDATINLQAIAGLNQRIPDLDVVFIESGGDNLAATFSPDLADITIYVISVCQGEEIPRKGGPGITRSDLLVINKKDLAPYVGADLEVKDRDATRMRASRPFVFSDMKRGDGVSSIVSFLREQGGL

SEQ ID NO: 3509 - protein, 320 aa, Streptococcus oralis
NKEPGAEEKYKEVQEAYETLSDDQKRAAYDQYGAAGANGGFGGAGGFGGFDGAGGFGGFEDIFSSFFGGGGASRNPNAPRQGDDLQYRVNLTFEEAIFGTEKEVKYNREASCRTCNGSGAKPGTSPVTCGRCHGAGVINVDTQTPLGMMRRQVTCDVCHGRGKEIKDPCTTCHGTGHEKQAHSVHVKIPAGVETGQQIRLAGQGEAGFNGGPYGDLYVVVSVEASDKFEREGTTIFYKLNLNIVQATLGDTVEIPTVHGAVELVIPEGTQTGKKFRLRGKGAPSLRGGAVGDQYVTVKVVTPTGLNDRQKATLKEFAAAG

SEQ ID NO: 3510 - protein, 398 aa, Streptococcus agalactiae 2603V/R
MAKLTVKDVDLKGKKVLVRVDFNVPLKDGVITNDNRITAALPTIKYIIEQGGRAILFSHLGRVKEEADKEGKSLAPVAADLAAKLGQDVVFPGVTRGAKLEEAINALEDGQVLLVENTRFEDVDGKKESKNDEELGKYWASLGDGIFVNDAFGTAHRAHASNVGISANVEKAVAGFLLENEIAYIQEAVETPERPFVAILGGSKVSDKIGVIENLLEKADKVLIGGGMTYTFYKAQGIEIGNSLVEEDKLDVAKDLLEKSNGKLILPVDSKEANAFAGYTEVRDTEGEAVSEGFLGLDIGPKSIAKFDEALTGAKTVVWNGPMGVFENPDFQAGTIGVMDAIVKQPGVKSIIGGGDSAAAAINLGRADKFSWISTGGGASMELLEGKVLPGLAALTEK

SEQ ID NO: 3511 - protein, 353 aa, Streptomyces sp.
MTETHAIAGVPMRWVGPLRISGNVAETETQVPLATYESPLWPSVGRGAKVSRLTEKGIVATLVDERMTRSVIVEATDAQTAYMAAQTIHARIDELREVVRGCSRFAQLINIKHEINANLLFIRFEFTTGDASGHNMATLASDVLLGHLLETIPGISYGSISGNYCTDKKATAINGILGRGKNVITELLVPRDVVENNLHTTAAKIVELNIRKNLLGTLLAGGIRSANAHFANMLLGFYLATGQDAANIVEGSQGVVMAEDRDGDLYFACTLPNLIVGTVGNGKGLGFVETNLARLGCRADREPGENARRLAVIAAATVLCGELSLLAAQTNPGELMRAHVQLERDNKTAKVGA

SEQ ID NO: 3512 - protein, 319 aa, Streptococcus oralis
EPGAEEKYKEVQEAYETLSDDQKRAAYDQYGAAGANGGFGGAGGFGGFDGAGGFGGFEDIFSSFFGGGGASRNPNAPRQGDDLQYRVNLTFEEAIFGTEKEVKYNREASCRTCNGSGAKPGTSPVTCGRCHGAGVINVDTQTPLGMMRRQVTCDVCHGRGKEIKDPCTTCHGTGHEKQAHSVHVKIPAGVETGQQIRLAGQGEAGFNGGPYGDLYVVVSVEASDKFEREGTTIFYKLNLNIVQATLGDTVEIPTVHGDVELVIPEGTQTGKKFRLRGKGAPSLRGGAVGDQYVTVNVVTPTGLNDRQKAALKEFAAAGD

SEQ ID NO: 3513 - protein, 336 aa, Streptococcus agalactiae 2603V/R
MVVKVGINGFGRIGRLAFRRIQNVEGVEVTRINDLTDPNMLAHLLKYDTTQGRFDGTVEVKEGGFEVNGQFVKVSAEREPANIDWATDGVEIVLEATGFFASKEKAEQHIHENGAKKVVITAPGGNDVKTVVFNTNHDILDGTETVISGASCTTNCLAPMAKALQDNFGVKQGLMTTIHAYTGDQMILDGPHRGGDLRRARAGAANIVPNSTGAAKAIGLVIPELNGKLDGAAQRVPVPTGSVTELVATLEKDVTVEEVNAAMKAAANDSYGYTEDPIVSSDIVGISYGSLFDATQTKVQTVDGNQLVKVVSWYDNEMSYTSQLVRTLEYFAKIAK

SEQ ID NO: 3514 - protein, 318 aa, Streptococcus oralis
KEPGAEEKYKEVQEAYETLSDDQKRAAYDQYGAAGANGGFGGAGGFGGFDGAGGFGGFEDIFSSFFGGGGTSRNPNAPRQGDDLQYRVNLTFEEAIFGTEKEVKYNREASCRTCNGSGAKPGTSPVTCGRCHGAGVINVDTQTPLGMMRRQVTCDVCHGRGKEIKDPCTTCHGTGHEKQAHSVHVKIPAGVETGQQIRLAGQGEAGFNGGPYGDLYVVVSVEASDKFEREGTTIYYKLNLNIVQATLGDTVDIPTVHGAVELVIPEGTQTGKKFRLRGKGAPSLRGGAVGDQYVTVNVVTPTGLNDRQKAALKEFAAA

SEQ ID NO: 3515 - protein, 121 aa, Salmonella enterica
KNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGIKNKIHPGEAMDKNL

SEQ ID NO: 3516 - protein, 288 aa, Streptococcus oralis
EPGAEEKYKEVQEAYETLSDDQKRAAYDQYGAAGANGGFGGAGGFGGFDGAGGFGGFEDIFSSFFGGGGASRNPNAPRQGDDLQYRVNLTFEEAIFGTEKEVKYNREASCRTCNGSGAKPGTSPVTCGRCHGAGVINVDTQTPLGMMRRQVTCDVCHGRGKEIKDPCITCHGTGHEKQAHSVHVKIPAGVETGQQIRLAGQGEAGFNGGPYGDLYVVVSVEASDKFEREGTTIFYKLNLNIVQATLGDTVEIPTVHGDVELVIPEGTQTGKKFRLRGNGAPSLRGGAV

SEQ ID NO: 3517 - protein, 491 aa, Striga gesnerioides
SGKPFYAIIHRVTGSLVIDFEPVKPHEVPMTAAGALQSYKLAAKAITRLQSLPSGSLERLCETMAQEVFELTGYDRVMVYKFHEDDHGEVFAEVTRPGLEPYLGLHYPATDIPQAARFLFMKNKVRMICDCRAAHVKVVQDECFSSDLTLCGSTLRAPHSCHLRYMENMNSIASLVMSVVINEGTDEESSASSSSSSHPDKEKRLWGLVVCHHTSPRFVPFPLRYACEFLSQVFSIHVGKELELLNQTLEKNILKTQTLLCDMLLRGNPLAVVTQSPTVMDLVKCDGAVFLYKGKNHRLGLAPSDLQILDIVSWLDEYHRDSTGMTTDSLLGAGFPGAAALGDAFCGMAAVRITGRDWLFWFRSHTAAEVQWGGAKQEKGDEDDGRKMHPRSSFKAFLEVVKARSVPWRDFEMDAIHSLQLILRNACDKEEEEEARRKDMVVAGEIQSRLNELHIDGAKEMEMVTSEMVRLIETASVPILAVGVEGLVFRV

SEQ ID NO: 3518 - protein, 390 aa, Zea mays
MESENEKLRKALATLLRVVQKRSCDIVDVVKSAFQPFNSPLVDELNRALVEIDDLAKDHEDVAVQTQWEVENMANCQVNEHRRQEEAVEELLIEDGSEDELLIDEESPINYEDLGGYDDVLFIYIMFDLPLLHRMGGDWNQVMSQYGSFLSQIDEQPMGTQHSEFPVDGQAEGSRTPGVPKKPTQRTKLANFTADEDTRVCHAWLAVSCDPIINTGQKRQGFWSRITEAYNSRRGTLPERSTKSLMSRWDTIKTQCSTFAGYMMAVLRQNPSGLTDADKIFISQTSLAASRFAAIEKKPFHFLHCWAILKDQPKWMDIHMGQQNQHGNANPTQSNTVDVDAEESVPTSFTSKRPLGRDSSKEKAKRTKSVDTSSSDSEFMTRMGDLYLER

SEQ ID NO: 3519 - protein, 852 aa, Bacillus thuringiensis serovar konkukian str. 97-27
MQITKRLINKTVLLLTLIVMLSSVFSFQNVKAVSNSKTTEVIIHYKEQSGNTKDWNLWIWGENSNGKSYEFTGEDEFGKYAKINIDGDYNRLGFIIRTNEWEKDGGDRWIENIKDGRAEVWILSSDEKVYNSKPSSDLSIQKATIDSFHEITVTTNVPFYIKEKKIEMEGIKIKSISPYDINSGDITNKVKIITEQKIDLKQTYKVKIENLADTNTEIGKVIRTEEFDKLFYYGGNDLGNIYTPQHTKFRVWAPTASEAKLVTYKKWNDKIGTEINMQQGEKGTWKAELKGNQKGLYYTYKVKIGDKWTEAVDPYARAASVNGDKGAVVDLEETNPKRWNTNKKPKLKNPEDAIIYELHVRDLSIQPESGIKQKGKYLGVTEKGTKGPEGVKTGLDHMKDLGVTHVQLLPIFDYASVNEEKVNEPQYNWGYDPKNFNVPEGSYSTNPYEPTVRITELKQMIQTLHDNNLRVVMDVVYNHMYNAAESNFHKLVPGYYYRYNEDGTFANGTGVGNDTASERKMMRKFMIDSVTYWAKEYNLDGFRFDLMGIHDYETMNEIRKAVNQIDPSIILHGEGWNLNTPLAAELKANQKNAEKMKGIAHFNDNIRDGLKGSVFEEKENGFVNGKENMEDRIKKGITAGIDYDRNTSTYQDPEQVLTYVEAHDNHTLWDKLELTNPGDSEEARKQMHKLSSSILLTSQGIPFLHAGQEFMRTKYGDHNSYKSPDSINQMDWLRRAAFNNEVDYMKGLIELRKKYPAFRMTSAEQIKTHVSFIDAPKNTVAYTIEGNKNEYFTVAHNANKEAGEITLPSKGPWKVLVDGKQAGSKPLYVVHDNKIKVPALSSLVLKTEKPIK

SEQ ID NO: 3520 - protein, 220 aa, Brassica napus
  misc_feature (202)..(202): Xaa can be any naturally occurring amino acid
AVRRFLEDFRSAGEEEKEVVREAIRHMYSPDLRAGWGIHIVQEEKLLAKKEERESLDSAIDELVLIGMRRETAAELIYRERCVPVNDGPSWAKYMSVSGSSEDEHDIISLQYTEDGLLSVDENRQGHAAAFGDDIAIECLATEFKREIYVVQAHGSDGMVEEENCVFFLPHKPRSEVIESPVFLFMKGTGWCGGGADHYEPXLIASPSQIISQEKVAFVL

SEQ ID NO: 3521 - protein, 324 aa, Triticum aestivum
VGFPPGTCQGNFPPGGAIYPLELSIIREKFSAGCPFRFWLLHKQWVLPHTFACLLLLYPGFSGNAFVTPKYSAPPRHSHVSFAVSAAARSSGHRLAFAVCAASASVAPAPAETEADAEDEQPVGPKTRLIAMNIPWDFTPDDIRVLFEKQGTVVDVELSMHSSKKNRGLAFVTMGSEEEALSALKNLNLSTLNDRTIKVDFAKPKKKQPAVPSVPVEKNVVFVGNLTWRVRSRHLRELFASTPGVQSVEVIFHTTTPRRSAGYAFVSFSSKEEAEAAISTFNGKELMGRSINVMFKEDTVKKNKSSDSEEEKLEEAESSEESDS

SEQ ID NO: 3522 - protein, 158 aa, Arabidopsis thaliana
MSSNKILLTSSDGESFEIDEAVARKFLIIVHMMEDNCAGEAIPLENVTGDILSKIIEYAKMHVNEPSEEDEDEEAKKNLDSWDAKFMEKLDLETIFKIILAANYLNFEGLLGFASQTVADYIKDKTPEEVREIFNIENDFTPEEEEEIRKESAWTFNE

SEQ ID NO: 3523 - protein, 419 aa, Ralstonia eutropha JMP134
MHDEQPRGATANVPTSTIVIVGAGQAGGWAAQTLRNEGFTGRLVLIGDESHPPYERPPLSKAVLAGEAEPSSTQLLRPDAFEALGLEWWPDIPVNHIDRHAKRLEMTDGKTLAYDKLILCTGGRARTLTVPGADRARVHTLRTIGDALSLAQEFRPGRSVAVIGGGWIGLEVAATARQRGAEVTVIEAQGRLCERSVPPEISEHLLGLHATHGVHIRLGVHISGIARGADGRPALTLADGDTLTCDAIVAGVGLVPNDDLARDAGLDCDGGIIVDERCCTSDPDIFAAGDVAVTPNPWAGRRMRLESWQNAQEQGIAAARAALCLPVVYQPLPWFWSDQYDMNLQIYGVPLPSHRIVTRGMPGDNSFALFYLEDDVIKAALGANAARDLRFARRLIEQSKPVDVKRLADADVPMGKLSA

SEQ ID NO: 3524 - protein, 118 aa, Oryza sativa
MAAMEIESVKCECCGLREDCTQDYIASVRASFYGQWLCGLCCEAVRDEAGRKKAHPGVEEAVRAHMAFCRMFRSNPAVRVADGMRQMLRRRSGDMSKPDTSKKYSTVQVVDESSVSLY

SEQ ID NO: 3525 - protein, 427 aa, Pseudomonas putida KT2440
MSRSEALFAQAQKHIPGGVNSPVRAFKSVGGTPLFFKHAEGAYVVDEDDKRYVDYVGSWGPMILGHGHPDVLDSVRRQLEHGLSYGAPTAMETEMADLVCSIVPSMEMVRMVSSGTEATMSAIRLARGYTGRDAIIKFEGCYHGHSDSLLVKAGSGLLTQGVPSSAGVPADFAKHTLTLPFNDIAAVEKTLAEVGQTVACIIVEPVAGNMNCVPPAPGFLEGLREQCDKHGVVLIFDEVMTGFRVSLGGAQGHYGIKPDLSTFGKIVGGGMPVGCFGGKREIMGCIAPLGPVYQAGTLSGNPLAMAAGLTTLKLISRPGFHAELTDYTSRMLDGLQQRADAAGVPFVTTQAGAMFGLYFSGADDIVTFEDVMASDAERFKRFFHLMLDGGVYLAPSAFEAGFTSIAHGDKELQITLDAAEKAFAALK

SEQ ID NO: 3526 - protein, 143 aa, Dechloromonas aromatica RCB
MKTLKQLLAGRNRPLAVVAPSDTVYHALTVMAQHEVGALLVLDGEQLVGIFSERDYARKIILQGKTSKETLVREIMSDRVAYVTPGSTLDECMALMTEKRFRHLPVLDEQGGIVGMISIGDLVKETISDQKFLIAQLEHYIAG

SEQ ID NO: 3527 - protein, 220 aa, Dechloromonas aromatica RCB
MPLFQKAVFLTTVANLRDLPQDSVREVAFAGRSNAGKSSAINTLAGRVRLAFVSKTPGRTQHLNYFTLDEGKYFVDLPGYGYAKAPEAIRSQWEGLIGPYLSKRDQLAGLVVIMDIRRPMTDLDLRLIDWFRPTGRPIHILLSKSDKLSRQDQTKALRSVKAEVATWGDADLYSVQLFSSLKKAGVEEAERVLASWLDIEIKQKENKGPPDKGSPGAKMP

SEQ ID NO: 3528 - protein, 441 aa, Rhodococcus sp. RHA1
MTVSSGDPDVHASRSAQLFERADLVIPGGVNSPVRAFHSVGGTPRFIKEASGYTLTDVDGNDYVDLICSWGPMILGHAHPAVVEAVQKAAATGLSFGAPTEGEIELAEEIVGRVAPVEKVRLVNSGTEATMSAVRLARGFTGRTKVLKFSGCYHGHVDALLADAGSGLATFGLPTSPGVTGAQAEDTIVVPYNDLDAVAQAFAANEGRIACVITEAAAGNMGAVAPQPGFNEGLRKLTSDNGALLIMDEVMTGFRVSSAGWFGLDGVAGDLYTFGKVMSGGLPAAAFGGRADVMAHLAPAGPVYQAGTLSGNPVAVAAGLASLRAADQGVYDALERNSATLRTLLSDALTAESVPHRVQTAGTMLSVFFSEDPVTNYAEAKAAQTWRFPAFFHGLLSRGVYPPPSAFEAWFVSAAMDDRAFSIIADALPHAAKAAAAAVQP

SEQ ID NO: 3529 - protein, 319 aa, Streptococcus oralis
NKEPGAEEKYKEVQEAYETLSDDQKRAAYDQYGAAGANGGFGGAGGFGGFDGAGGFGGFEDIFSSFFGGGGASRNPNAPRQGDDLQYRVNLTFEEAIFGTEKEVKYNREASCRTCNGSGAKPGTSPVTCGRCHGAGVINVDTQTPLGMMRRQVTCDVCHGRGKEIKDPCTTCHGTGHEKQAHSVHVKIPAGVETGQQIRLAGQGEAGFNGGPYGDLYVVVSVEASDKFEREGTTIFYKLNLNIVQATLGDTVEIPTVHGDVELVIPEGTQTGKKFRLRGKGAPSLRGGAVGDQYVTVNVVTPTGLNDRQKAALKEFAAA

SEQ ID NO: 3530 - protein, 216 aa, Azoarcus sp. EbN1
MPIFRNARFEVSIAKSGALPPPEGAEIAFAGRSNAGKSSAINTLADHTRLAFVSKTPGRTQLINFFRLDCGAVLVDLPGYGYAKVPENIRRQWQGLLEHYLRKRENLIGLVLIMDSRHPLTPLDRQMIDWFVPGGRPIHVLLTKCDKLSRNEAAATLASVRREVAALGPQISVQLFSSLKKIGMEEVEHKVAGWLGLPSDDLPAIPTPAQLRAAGK

SEQ ID NO: 3531 - protein, 317 aa, Streptococcus oralis
EPGAEEKYKEVQEAYETLSDDQKRAAYDQYGAAGANGGFGGAGGFGGFDGAGGFGGFEDIFSSFFGGGGASRNPNAPRQGDDLQYRVNLTFEEAIFGTEKEVKYNREASCRTCNGSGAKPGTSPVTCGRCHGAGVINVDTQTPLGMMRRQVTCDVCHGRGKEIKDPCTTCHGTGHEKQAHSVHVKIPAGVETGQQIRLAGQGEAGFNGGPYGDLYVVVSVEASDKFEREGTTIFYKLNLNIVQATLGDTVEIPTVHGDVELVIPEGTQTGKKFRLRGKGAPSLRGGAVGDQYVTVNVVTPTGLNDRQKAALKEFAAA

SEQ ID NO: 3532 - protein, 206 aa, Zea mays
MVGMAVVGQWTLCVASPSPRVKSATCNSNSCPTTVNLRSELSAFRPQFRLFSRVSPTRRRRLCASSSADSGIFLPHLVASMEQVEETYIMVKPDGIQRGLVGEIISRFEKKGFKLIGLKMFQCPKELAQEHYKDLSAKSFFPSLIEYITSGPVVCMAWEGVGVVASVRKLIGKTDPLQAEPGTLEEILLNNPEELVHGSESPETKA

SEQ ID NO: 3533 - protein, 220 aa, Azoarcus sp. EbN1
MTQDELKKAAAIAALDYVENGMIVGVGTGSTVNHFIDGLAGIKGRIAGAVSSSEASARRLQAHGIPVLDLNDITDLPVYVDGADEIDGGFCMIKGGGGALTREKIVAAVARRFICICDASKKVACLGRFPLPVEIIPMARAYVERELVRIGGRPELREGFVTDNGNLIVDVHGLMITSPRALETELNQIVGVVTNGLFARRGADVLLLATLAGVERQVAN

SEQ ID NO: 3534 - protein, 328 aa, Streptococcus oralis
LSKKYHPDINKDPGAEEKYKEVQEAYETLSDDQKRAAYDQYGAAGANGGFGGAGGFGGFDGAGGFGGFEDIFSSFFGGGGASRNPNAPRQGDDLQYRVNLTFEEAIFGTEKEVKYNREASCRTCNGSGAKPGTSPVTCGRCHGAGVINVDTQTPLGMMRRQVTCDVCHGRGKEIKDPCTTCHGTGHEKQAHSVHVKIPAGVETGQQIRLAGQGEAGFNGGPYGDLYVVVSVEASDKFEREGTTIFYKLNLNIVQATLGDTVEIPTVHGDVELVIPEGTQTGKKFRLRGKGAPSLRGGAVGDQYVTVNVVTPTGLNDRQKAALKEFAAA

SEQ ID NO: 3535 - protein, 580 aa, Cryptococcus neoformans var. neoformans B-3501A
MRSSSVLSLSWTAPRSHRRTVALLPIRQQRNTTIMRAMSNIIGGTESKVPSGTRPLSTRAHAVLSALNIPADNAAPIPGVFDGQWKGSGEEITSKCPATGEILARVKGASVEETQAAIAKSKEAYRIVRSMPAPKRGEVIRQIREALEAKVSELGDLVSLEMGKIKSEGKGEVQEFIDVCDFATGLSRTMTGRVLPSERPEHVIYEIPNPLGVVGILSAFNFPVAVYGWNLTVALASGNSTIWKPAPSTPLTAIAVARLIQPVLEKNGLPGATAALVCGGIDVGKIIVGSEDIPLVSFTGSEKVGKEVGKAVNDRFGKTILELGGNNAVIVDKDADLPLALQSVLFAAVGTAGQRCTSTRRLILHKSIAQEFLSKLLPVYDAQAPSPHLMVGDPLQTSTLIGPLHNEAAVKKYEATLQAVTSRGGEILTQRSGRINGMNKEVEGGNWVWPTVVRPKKDDPCWKEEVFAPILFVTEFETLEEAIEINNSVPQGLSSALFTSDLRSLGKWLGPEGSDCGIVNVNVGTSGAEIGAGFGGNKSTGWGRESGGDAWKQYVRWSAATVNYSSKVSLAQGVTFGIDA

SEQ ID NO: 3536 - protein, 322 aa, Pseudomonas sp. BG33R
MQPQAFYRAVADDFSAVDGIIKQQLTSKVPLVSKIGDYITSAGGKRLRPLLVLLCGKALGREGDDLRLLAATIEFLHTATLLHDDVVDMSGMRRGRETANAMWGNAPSVLVGDFMYSRSFEMMVELGSMPVMKILSQATRIIAEGEVLQLSKVRDASTTEETYMEVIRGKTAMFFEASTHSAAALCGATAEQAEALRTFGDNLGVAFQLVDDLLDYKGDAETLGKNVGDDLAEGKPTLPLIYTMREGTPEQAALVRKAIQKGGIEDLEAIRAAVEASGSLEYTAQLARDYVARAIQCLEALPASEYRDALVELSEFAVARTH

SEQ ID NO: 3537 - protein, 286 aa, Streptococcus oralis
AAGANGGFGGAGGFGGFDGAGGFGGFEDIFSSFFGGGGASRNPNAPRQGDDLQYRVNLTFEEAIFGTEKEVKYNREASCRTCNGSGAKPGTSPVTCGRCHGAGVINVDTQTPLGMMRRQVTCDVCHGRGKEIKDPCTTCHGTGHEKQAHSVHVKIPAGVETGQQIRLAGQGEAGFNGGPYGDLYVVVSVEASDKFEREGTTIFYKLNLNIVQATLGDTVEIPTVHGDVELVIPEGTQTGKKFRLRGKGAPSLRGGAVGDQYVTVNVVTPTGLNDRQKAALKEFAAA

SEQ ID NO: 3538 - protein, 118 aa, Salmonella enterica
MSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGIKNKIHPG

SEQ ID NO: 3539 - protein, 607 aa, Strobilanthes attenuata
SGKPFYAIIHRVTGGLIIDFEPVKPHEVPMTAAGALQSYKLAAKAITRLQSLPSGSMERLCDTMVQEVFELTGYDRVMIYKFHDDDHGEVFSEVTKPGLEPYSGLHYPATDIPQAARFLFMKNKVRMICDCRANHVNVVQDEKLTLDLTLCGSTLRAPHSCHLQYMENMISIASLVMSVVVNEGDEEASNSSQPEKRKRLWGLVVCHHSSPRFVPFPLRYACEFLAQVFAIHVNKELELENQMLEKNILRTQTLLCDMLMRDAPLGIVSQSPNVMDLVKCDGAVLLYKGKMYRLGLSPIDFQTRDIVSWLDEYHRDSTGLSTDSLYDAGFPGALSLGDAVCGMAAVKITDKDWLFWFRSHTAAEIRWGGAKHEPSEKDDGRKMHPRSSFKAFLEVVKTRSLPWKDYEMDAIHSLQLILRNAFKEAEGDNMEANVIHTRLSDLQIDGIQELEAVTSEMVRLIETASVPILAVDVDGLVNGWNTKIADLTGLTVDKAIGRHFIGLVEESSADIVSKMLELALQGKEERNVQFEIKTHGPGSEAGPISLVVNACASRDVKENVVGVCFIAQDITAQKTMMDKFTKIEGDYRAIVQNPNPLIPPIFGTDEF

SEQ ID NO: 3540 - protein, 327 aa, Streptococcus pneumoniae
LSKKYHPDINKEPGAEDKYKEVQEAYETLSDDQKRAAYDQYGAAGANGGFGGAGGFGGFNGAGGFGGFEDIFSSFFGGGGSSRNPNAPRQGDDLQYRVNLTFEEAIFGTEKEVKYHREAGCRTCNGSGAKPGTSPVTCGRCHGAGVINVDTQTPLGMMRRQVTCDVCHGRGKEIKYPCTTCHGTGHEKQAHSVHVKIPAGVETGQQIRLAGQGEAGFNGGPYGDLYVVVSVEASDKFEREGTTIFYNLNLNFVQAALGDTVDIPTVHGDVELVIPEGTQTGKKFRLRSKGAPSLRGGAVGDQYVTVNVVTPTGLNDRQKVALKEFAT

SEQ ID NO: 3541 - protein, 326 aa, Zea mays
FGSSIATSLLFSAFESWLVAEHNKRGFDPQWLSITFSKAIFLGNGLIAIVSGLFANLLAENLGFGPVAPFDAAACFLAIGMAVIMSSWSENYGDPSDSKDLMAQFKVAAKAIASDEKIALLGAIQSLFEGSMYTFVFLWTPALSPNEEDIPHGFIFATFMLSSMLGSSVASRLLARKLKVEGYMQIVFSISAVTLVLPVVTNILVPTSSVKGGSISIGGSLQLLGFCTFEACVGIFWPSIMKMRSQYIPEEARSTIMNFFRIPLNLFVCVVLYNVNAFPITVMFGMCSIFLFMAAILQRRLMVVSDLHKSSTKAQEMIGEDEPLNP

SEQ ID NO: 3542 - protein, 389 aa, Thiobacillus denitrificans ATCC 25259
MTARRPRTATRADAIAPFHVMDILARAQALEAAGRDIIHLEIGEPDFATPGPIVEAGIAALRAGHTRYTGALGLPALRRAIAEFHRTYWGTPVEAERVVVTPGASGALLLVLGLLAGPGDEVLMADPGYPCNRNFAQFCDARAVEIPVDAASGFQLTREAIERHATPATRAVLIANPSNPTGTTIDPEALADIHAWCAARGIALIVDEIYLALTYDGDTHSAARWDDVFVINSFSKCFLMTGWRLGWLVAPAWALAALERLAQNLFLAPPTPAQHAALAGFEPATLAILETHKAELRARRDFLLPALRARGFAIPVIPHGAFYLYADCSALAADSQVLAGLLLEQAGVATTPGVDFGRHDPARYLRIAYTQPKPRLDEALARIDRFLRP

SEQ ID NO: 3543 - protein, 612 aa, Tozzia alpina
SGKPFYAIIHRVTASLIVDFEPVKPHEVPMTAAGALQSYKLASKAISRLQSLPSGSMGRLCETMAQEVFELTGYDRVMIYKFHEDDHGEVLTEITKPGLEPYVGLHYPATDIPQAARFLFMKNKVRMICDCRANHVRVIQDESLPLELTLCGSTLRAPHNCHLQYMENMNSIASLVMSVVVNEGNEEAGPGDSSQHPDKRKRLWGLVVCHNTSPRFVPFPLRYACEFLAQVFAIHVNKELELENQTLKKNILRTQTLLCDMLLRDAPLGIVSQSPNVMDLVKCDGAILLHKNQKHRLGITPSDFHIRDIVSWLDEYHRDSTGLSTDSLYDAGFPGALALGDVVCGMAAVRITDRDWLFWFRSHTASEIRWGGAKNELGEKADGRKMHPRSSFKAFLEVVKTRSLPWKDFEMDAIHSLQLILRNASSKEVEGRKDLEGVEIQARLNELQIDGVQELEAVTSEMVRLIETASVPIFAVGVDGLVNGWNTKIADLTGLPVDKAIGVHFLSLVEESSAEAVSKMLELALKGKEEQNVHFEIKTHGPNSDSSPISLIVNACTSRDVRENVVGVCFIAQDITTQKSVMDKFTRIEGDYRAIVQNPNPIIPPIFGTDEF

SEQ ID NO: 3544 - protein, 121 aa, Salmonella enterica
GSGMHCHMSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGIKNK

SEQ ID NO: 3545 - protein, 609 aa, Triphysaria pusilla
SGKPFYAIIHRVTGSMIIDFEPVKPHEVPMTAAGALQSYKLAAKAITRLQALPSGSMERLCDTMVQEVFELTGYDRVMIYKFHDDDHGEVLSEITKPGLDSYAGLHYPATDIPQAARFLFIKNKVRMICDCRANHVKVIQDDNLPFDLTLCGSTLRAPHSCHLQYMENMNSIASLVMSVVVNEGDEDGPNSSSHPDKKKRLWGLVVCHNTSPRFVPFPLRYACEFLAQVFAIHVNKEIELENQMLEKNILRTQTLLCDMLLRDAPLGIVSQSPNVMDLVKCDGAVLIHKTKKYRLGMTPSDFQIRDIVSWLDEYHRDSTGLSTDSLYDAGFPGALALGDAVCGMAAVRITDTDWLFWFRSHTASEIRWGGAKHEPDDKDDGRKMHPRSSFKAFLDVVKTRSLPWKDFEMDAIHSLQLILRNSSNKEAEKRDVDGKEIHARLNDLQLDGKRELEAVTSEMVRLIETASVPIFAVDVDGLVNGWNTKIADLTGLPVDKAIGKHFLALVEDSFAEAVNKMLGSALQGNEEQNVQFEIKTHGPKSDSNPISLIVNACASRDVKENVVGVCFIAQDITTQISMMDKFTRIEGDYRAIVQNPNQLIPPIFGSDEF

SEQ ID NO: 3546 - protein, 224 aa, Francisella tularensis subsp. tularensis SCHU S4
MFFNKKNNQDELKKLAATEAAKSITTEITLGVGTGSTVGFLIEELVNYRDKIKTVVSSSEDSTRKLKALGFDVVDLNYAGEIDLYIDGADECNNHKELIKGGGAALTREKICVAAAKKFICIIDESKKVNTLGNFPLPIEVIPMARSYIARQIVKLGGQPVYREQTITDNGNVILDVYNLKIDNPLKLETELNQITGVVTNGIFALKPADTVIMATKDSNIVVL

SEQ ID NO: 3547 - protein, 418 aa, Neisseria gonorrhoeae FA 1090
MNAAQLDHTAKVLAEMLTFKQPADAVLSAYFRKHKKLGRQDRHEIAETAFAALRHYQKISTALRRPHAQPRKAALAALVLGRSTNISQIKDLLDEEETEFFGNLKARKTEFSDGLNTAAELPQWLVEQLQQHWSEEEILAFGRSINQAAPLDIRVNTLKGKRDKVLPLLQAESPDAEATPYSPWGIRLKNKIALNKHELFLDGTLEVQGEGSQLLALLVGAKRGEIIVDFCAGAGGKTLAVGAQMANKGRIYAFDIAEKRLANLKPRMTRAGLTNIHPERIGSEHDTRIARLAGKADRVLVDAPCSGLGTLRRNPDLKYRQSAETVAKLLEQQHSILDAASKLVKPQGCLVYATCSVLPEENELQIKRFLSEHPEFEPVNCAELLQNLKVDLDTGKYLRLDSARHQTDGFFAAVLQRK

SEQ ID NO: 3548 - protein, 322 aa, Prochlorococcus marinus str. MIT 9303
MVPEQLARQAGHRTDQAMGMISGTTSLIGLLGQPVHHSLSPVMQNAALTAMNLDWCYMAMPCETNDLANVLCALRSINCLGLNITIPHKQDVAKTCRELSPLAKRLKAVNTLIPHVDGGWTGTNTDVAGFIAPLQESKCEWHGRRAVVLGCGGSARAVVAGLQDLKLAQIMVVGRRSDALKRFLDDLQPNPASSESDCQVLLQGILQQDPALVEQLTKADLVVNTTPVGMSQNRSETSTPRAPMPLGKNIWQNLSPKTTLYDLIYTPKPTAWLTLGTEHGCHCIDGLEMLVQQGAASLRLWSGNNQVPVEEMRKAALGWLTV

SEQ ID NO: 3549 - protein, 271 aa, Zea mays
MTTARLVSTSPTRLPSTSASPIHRTSLCAVGRAPAFSARPLGFSLRLKPSPAMAAAGVGGNGPPTAHGDSIGSSRIGEVKRVTKETNVHVKINLDGTGVAECSTGIPFLDHMLDQLASHGLFDVYVKATGDTHIDDHHSNEDIALAIGTALLEALGDRKGINRFGHFTAPLDEAAVEVILDLSGRPHLSCGLDIPTQRVGTYDTQLVEHFFQSVVNTSGMTLHIRQLAGKNSHHIIEASFKAFARALRQATEYDLRRQGTVPSSKGVLSRS

SEQ ID NO: 3550 - protein, 401 aa, Oryza sativa (indica cultivar-group)
MEGWVATVAYTGTALACAAAATVVALRLVYRHLLHYAEPTHQRFIVRIILMVPSLCADSIIQSRPHGSSCDLSASDTSYMLVYAVMSFLSLVLPGSAIYFNSIREIYDAWVIYNFFSLCLAWVGGPGAVVVSLTGRSLKPSWFMMTCCFSAVPLDGRFIRRCKQGCLQFVILKPILVVITFILYAKGKYEDGNFSVNQSYLYITIIYTISYSMALFALALFYVACRDLLQPYNPVPKFIIIKSVVFLTYWQMLIAAIGHQFAFSYKEYAGSNARPFGGFRGSLFHALKFNDFYHDTVHQFAPTYHEYVLYSNEEEDEPTKYSSASVVSTVQDIQLVEVSVVDSKAPLASVILTHEADKTMPSHGMEETVAPSEPYDLSNLVDVELSNYSAEVPAIPDVGKQ

SEQ ID NO: 3551 - protein, 323 aa, Streptococcus pneumoniae
KYHPDINKDPGAEDKYKEVQEAYETLSDDQKRAAYDQYGAAGTNGGFGGAGGFGGFNGAGGFGGFEDIFSSFFGGGGSSRNPNAPRQGDDLQYRVNLTFEEAIFGTEKEVKYHREAGCRTCNGSGAKPGTSPVTCGRCHGAGVINVDTQTPLGMMRRQVTCDVCHGRGKEIKYPCTTCHGTGHEKQAHSVHVKVPAGVETGQQIRLAGQGEAGFNGGPYGDLYVVVSVEASDKFEREGTTIFYNLNLNFVQAALGDTVDIPTVHGDVELVIPEGTQTGKKFRLRGKGAPSLRGGAVGDQYVTVNVVTPTGLNDRQKVALKEFA

SEQ ID NO: 3552 - protein, 325 aa, Streptococcus pneumoniae
HPDINKDPGAEDKYKEVQEAYETLSDDQKRAAYDQYGAAGTNGGFGGAGGFGGFNGAGGFGGFEDIFSSFFGGGGSSRNPNAPRQGDDLQYRVNLTFEEAIFGTEKEVKYHREAGCRTCNGSGAKPGTSPVTCGRCHGAGVINVDTQTPLGMMRRQVTCDVCHGRGKEIKYPCTTCHGTGHEKQAHSVHVKVPAGVETGQQIRLAGQGEAGFNGGPYGDLYVVVSVEASDKFEREGTTIFYNLNLNFVQAALGDTVDIPTVHGDVELVIPEGTQTGKKFRLRGKGAPSLRGGAVGDQYVTVNVVTPTGLNDRQKVALKEFAAAGD

SEQ ID NO: 3553 - protein, 677 aa, Azoarcus sp. EbN1
MPPAAHTNPRNVTPPVFNPVTGAIRALAMDAVQQANSGHPGAPMGMAEIAEVLWRHHLRHNPANPQWADRDRFVLSNGHGSMLIYALLHLTGYDLPIEELKRFRQLHSKTPGHPEYGYTPGVETTTGPLGQGLSNAVGMAIAEKVLAAEFNRPGHAIVDHHTYVFVGDGCLMEGISHEVCSLAGTLGLGKLIAFYDDNSISIDGDVAGWFTDDTPKRFEAYGWHVVRDVQGHMSAEIDDAIRAAKAETRRPTLICCKTVIGAGSPAKQGGHDCHGAPLGAAEITAARAHIGWTHAPFEIPADVYAEWDAREAGKAREADWNATFAAYAESFPEAAAEFERRMKGELPASWAQHVDSVLAKFGEKAETIATRKASQNSIEAFAPALPELIGGSADLASSNLTLWSGSKGVSKDSGGNYIYYGVREFGMAAIANGIGLHGGLIPYTATFLMFSEYARNALRMAALMKLRQVFVFTHDSIGLGEDGPTHQPVEQTATLRLIPNMDVWRPCDTVETAVAWANAIERRDGPSSLLFSRQNLPFQARNPEQVAAIRRGAYVLSEAANGKPQAVVIATGSEVGLAMAAQQALAGDDIHVRVVSMPSTNVFDRQEAAYKASVLPLGVPRVAVEAGVTGLWHKYVGLEGAVVGIDTFGESAPAGDLFRHFDITADAVARAVRSVLL

SEQ ID NO: 3554 - protein, 338 aa, Azoarcus sp. EbN1
MTIKVAINGYGRIGRCTLRALYELGLRDQFEIVAINASGDLATNAHLTRYDTTHGRFATPVATEGDNLMIVGDDRIPFFSTKDPLAVNWGEFGVDVLLECTGAYASKAKAEVLLKQGAKKVLISAPGGDDVDATIVYGVNHDVLTRDMTVVSNASCTTNCLAPVAKVLQDNIGIEQGLMTTVHAYTNDQVLVDVRHKDLRRARAAAQNIIPTKTGAAKAVGLVLPALKGKFDGFALRVPTMNVSLVDLTFTASRATSKEEITVLMKEAANGPMKGVLAVNEEPLVSMDFNHDSHSSVFDATQTRVMDGTLVKVLAWYDNEWGYSCRMLDAARVFHQAK

SEQ ID NO: 3555 - protein, 293 aa, Streptococcus pneumoniae
HPDINKEPGAEDKYKEVQEAYETLSDDQKRAAYDQYGAAGANGGFGGAGGFGGFNGAGGFGGFEDIFSSFFGGGGSSRNPNAPRQGDDLQYRVNLTFEEAIFGTEKEVKYHREAGCRTCNGSGAKPGTSPVTCGRCHGAGVINVDTQTPLGMMRRQVTCDVCHGRGKEIKFPCTTCHGTGHEKQAHSVHVKIPAGVETGQQIRLAGQGEAGFNGGPYGDLYVVVSVEASDKFEREGTTIFYNLNLNFVQAALGDTVDIPTVHGDVELVIPEGTQTGKKFRLRSKGAPSLRGGA

SEQ ID NO: 3556 - protein, 394 aa, Azoarcus sp. EbN1
MNVKKLADLDVAGKRVFIRADLNVPQDEAGNIVEDTRIRASLPSIRYCLERSATVMVTSHLGRPTEGECRAEDTLAPIAVRLGELLGKPVRLIRDWVEGGFEVRAGEVVLLENCRCNKGEKKDNEELAKKMAALCDIYVNDAFGTAHRAEATTHGIARFAPVACAGMLMGAEIDALTKATENPARPLVAIVGGAKVSTKLTILKTLAEKVDQLIVGGGIANTFLLASGKRIGESLAEPELVKEAQAIMDMMKARGAEVPLPVDVVVADEVSALARANRIPVDEVGPHDRILDVGPKSSAKLAEIIAHAGTIVWNGPVGVFEHNQFAGGTKMMASAIAHSEAFCIAGGGDTLAAIAKFHIAQDIGYISTGGGAFLEFLEGKKLPAIAALEARFAD

SEQ ID NO: 3557 - protein, 540 aa, Prochlorococcus marinus subsp. pastoris str. CCMP1986
MSKFSSKNINKTKVPESPVVLAILDGWGHREENLDNAIKNANTPIMDSLWHAYPHTLINASGADVGLPNGQMGNSEVGHLTIGSGRIIQQELVRITNVVKNNQLTQVNELKEMANSIKKKKGTLHITGLCSDGGVHSHIDHLLGLIKWASEEHIEKVAIHIITDGRDTPAKSAYKYIRQIEDCIKKFKVGEIASICGRYWIMDRNLIWERTEKAFVNLTDPNGKKIDISPADYLNKSYNANITDEFLEPIRISKDFLKDEDSLICFNFRPDRARQIIKALSEKEFDNFKRKSIPDVDILTFTQYEANLPVKIAFPPESLNNFIGQIVSENGLKQYRTAETEKYPHVTYFFNGGVEVPSPGEQRHLIPSPRVATYDMAPEMSAEELTISCSNAIKTGQYSFVVINFANPDMVGHTGNMAAAIKAIETVDRCIGKIVNATGEMGGSILITADHGNAELMKGPDGEPWTAHTINKVPLIFIEGEKRKIPNMGNEIYLRENAGLADIAPTLLQLLNLPIPKEMTGKSLIKEIELKGFNKVVQHV

SEQ ID NO: 3558 - protein, 322 aa, Streptococcus acidominimus
PDINKEPGAEDKYKEVQEAYETLSDDQKRAAYDQYGAAGANGGFGGAGGFGGFNGAGGFGGFEDIFSSFFGGGGSSRNPNAPRQGDDLQYRVNLTFEEAIFGTEKEVKYHREAGCRTCNGSGAKPGTSPVTCGRCHGAGVINVDTQTPLGMMRRQVTCDVCHGRGKEIKYPCTTCHGTGHEKQAHSVHVKIPAGVETGQQIRLAGQGEAGFNGGPYGDLYVVVSVEASDKFEREGTTIFYNLNLNFVQAALGDTVDIPTVHGDVELVIPEGTQTGKKFRLRGKGAPSLRGGAVGDQYVTVNVVTPTGLNDRQKVALKEFAAA

SEQ ID NO: 3559 - protein, 836 aa, Geobacter sulfurreducens PCA
MKAVIMAGGFGTRIQPLTSSIPKPMIPLLNRPIMLHIVELLKKYEITDLVMLLYHQPAVIKNFFRDGTDFGVKITYVTPLQDMGTAGAVKCAEKYLDERFIVISGDLLTDFNLQKIIDFHEEKEALATITLTSVKDPLQFGVVITDKEKRISQFLEKPGWGEVISDTINTGIYVLEPEIFSHIPAEENYDFSQDLFPKLLEKQQSLFGYTAKGYWRDIGNTDSYREAHHDIFKGKVNVRIDEPKQDLVGKDLRLGSDVNLDEHVTLEGTVVIGDNSQVFESAHIKDTVIGRNCTIEAGVRLSRCVIWDNVYVKRGAKLNDSVLCGNVRVGNGVVMEEGVIVADDTSIGEESYIKRDVKIWPRKVIEAGATVTGNLIWGEKWKKALFEGALIKGLTNMELTPEFVAKLGCAYGTTLPKGSFVISGRDAYRSSRMLKRSFIGGLLSSGVNVRDLTMVPMPVLRYKLRSFGEVGGIQFRQALDDPASTEIIFLDGDGLDFSSSMGKNVERIFFKENFRRAHHTEPGGLTEIPQQVMDFYREGFLHAIGKTPLQKKAFKVVIDFNHSPASQLLPGILTQMGCEVISLNAYVDEERGVQALSDRGQSLSQLSKIVATLEANAGFWLDPTVEGVIMVDETGTVHEGADILLLMVGLALKAGEKGVFAIPVSAPSAIERMAQERGCAVTRTKSADRSMIEAALSSEVILAGSMDGRFAFPRFQAAFDGMFAIAKSIEMAARSGASISATAAEIPRRAFLHTRVPCVWDMKGGIMRKMSEDSLDKEASFIDGIKVHFGEDWALVLPDQYQPHVHIVAEARDPKAAQKLLTEYQKKVEQWKKELS

SEQ ID NO: 3560 - protein, 323 aa, Streptococcus pneumoniae
HPDINKDPGAEDKYKEVQEAYETLSDDQKRAAYDQYGAAGTNGGFGGAGGFGGFNGAGGFGGFEDIFSSFFGGGGSSRNPNAPRQGDDLQYRVNLTFEEAIFGTEKEVKYHREAGCRTCNGSGAKPGTSPVTCGRCHGAGVINVDTQTPLGMMRRQVTCDVCHGRGKEIKYPCTTCHGTGHEKQAHSVHVKVPAGVETGQQIRLAGQGEAGFNGGPYGDLYVVVSVEASDKFEREGTTIFYNLNLNFVQAALGDTVDIPTVHGDVELVIPEGTQTGKKFRLRGKGAPSLRGGAVGDQYVTVNVVTPTGLNDRQKVALKEFAAA

SEQ ID NO: 3561 - protein, 134 aa, Salmonella enterica
MPKPMFGDNGSGMHCHMSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGIKNKIHPG

SEQ ID NO: 3562 - protein, 118 aa, Salmonella enterica
NGSGMHCHMSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDG

SEQ ID NO: 3563 - protein, 162 aa, Glaucocystis nostochinearum
PTPGHLIDTIKDLILANDIGIMVEPGRSIVGNTGMLVNKVTGVKTNGNKNFIVTDGSMAELIRPSLYDAFMYIDFIEPVSGAEKEFDIVGPVCESADFLGKDRMLPTPPEGAGIAVFDAGAYSYCMSSNYNMKMRPPEYLVDGDKVTLIRKGESLDEWMKHF

SEQ ID NO: 3564 - protein, 397 aa, Burkholderia mallei ATCC 23344
MSQVKRLTDLIAEGKLSGKRVFIRADLNVPQDDHGNITEDTRVRASVPAIQAALDAGAAVMVTSHLGRPTEGEFKPEDSLAPVAKRLAELLGRDVPLVANWVENGVEVAPGQVVLLENCRVNKGEKKNSDELAQKMAKLCDVYVNDAFGTAHRAEATTHGIAKYAPVACAGPLLAAELDALGKALGNPKRPLVAIVAGSKVSTKLTILKSLAEKVDQLIVGGGIANTFMLAAGLAIGKSLAEADLVGEAKAIIDEARKRGASVPIPTDVVVAKEFSPTAAATVKKVADIEADDMILDIGPDTAKALAGQLEKAGTIVWNGPVGVFEFDQFGNGTKTLADAIASSAAFSIAGGGDTLAAIAKYGIHDKVSYISTGGGAFLEFLEGKKLPAVEVLETRA

SEQ ID NO: 3565 - protein, 122 aa, Salmonella enterica
MSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGIKNKIHPGEAMD

SEQ ID NO: 3566 - protein, 473 aa, Arabidopsis thaliana
MSSSVPNSDRKIVTGPAGYILEDVPHFSDDFPDHPTYPNPLQDNAAYSVVKQYFVDEDDTVPQKIVVHPDSPRGTHFRRAGPRQRVYFESDDVLACIVTCGGLCPGLNTVIREIVCGLSYMYGVKRILGIDGGYRGFYARNTIHLDLKTVNDIHRSGGTILGTSRGGHNTTKIVDSIQDRGINQVYIIGGDGSQKGAAAIFEEIRKRKLKVAVAGIPKTIDNDIPIIDRSFGFDTAVEEAQRAINAAHVEATSFENGIGLVKLMGRYSGFIAMHATLASRDVDCCLIPESPFFLEGSGGLFEFIDKRLKESGHMVIVIAEGAGQDLLSESMKESTTLKDASGNKLLQDIGLWISQRIKDHFAKKMTLTLKYIDPTYMIRAVPSNASDNVCCTLLAQSAVHGVVAGYNGFTVGLVNGRHTYIPFNRITEKQNKVVITDRMWARLLSSTNQPSFMKQADKIHSNQLVGEPGTMKW

SEQ ID NO: 3567 - protein, 378 aa, Epifagus virginiana
VPMTAAGALQSYKLAAKAITRLQALRGGSMERLCDTMVQEVFELTGYDRVMIYKFHDDDHGEVSAEITKPGLEPYVGLHYPATDIPQAARFLFMKNKVRMICDCRANHVKVVQDENLPFDLTLCGSTLRAPHSCHLQYMENMNSIASLVMSVVVNEGNEDEPNSSSGPEKRKMLWGFLVCHNTSPRFVPFPLRYACEFLVQVFAIHVNKELELKNQMLEKNILRTQTLLCDLLLRDAPLGIVSQSPNVMDLVKCVGAILLYKNTKYRLGLTPSDFQIGDIVSWLDEYHRDSTGLSTDSLYDAGFPGALALGDALCGMAAVRITDKDWLFWFRSHTAAEIQWGGMKHEPDEKDDGSKMHPRSSFKAFLEVVKTRSLPWK

SEQ ID NO: 3568 - protein, 511 aa, Zea mays
MDVVSWFSQVSVVVGVLAVCWTVVWQNLQHIHLQQFFARSFNRRARRLAAVVDPYLSVTFEEYEGGRIKSSDAFDEIKSYLTTASTRDVRHLRAESGGGGRRDAAATDRDKLVFSMAKGEEVADTFRGAMVWWSAAGVPPPSDTVPWSRASRAERRFFRLEFHEGHRDLVLNEYLPYVRRQGRAVMAKNRQRRLYTNILREGFDDGFYRDVWTHVPFEHPKTFDKLAMDPAKKKDIIDDLNMFKQSKDYYDRVGKPWKRGYLLYGPPGTGKSTMVAAMANHLGYDVYDFELTSVKTNTDLRKLLIETKSKSIMVFEDIDCSLQVTGKRKSKEEEEGSKDGNGDNPSAAKQKEEEEDAKSSSKVTLSGLLNFIDGIWSACGEERLVVFTTNHVDKLDPALIRTGRMDKKIEMSYCDFESFKFLARMHLRDDVVEAHGEQCDRVRALLQEVNMVPVDVGEHLTPRSPDEFEDAGPCLARLVTALEKAKKEADILPRPQAQPDVSGIVVDAGSK

SEQ ID NO: 3569 - protein, 739 aa, Oryza sativa (japonica cultivar-group)
MEVADLENPTSRSSSQKSSRRSGSRRSQKSAGQQSSPTVFPEKKGKSKSSRQKHLVFDNKDSKKAKNNEQKNDVVDEKSNFSGYEIYSGKLFFDKKNRITGDQISANGKADISDVRLTSKALIWGSSLLSLEDVISVSYSSGVQHFIVHAYPSKKYLFGKTHRVRKDLRFIAPTVEEAISWVTCFAEQNIYVNMLPLPPTSSTEQDLDGPLSGALFDHPPIKCRTPPRILVILNPRSGHGRSCKVFHDKAEPIFKVPSDTLIMQASTYCSALAGFHMEVVKTTHAGHAKSLASTFDFSAFPDGIVCVGGDGIVNEVFNGLLSRSDRAEAVSIPVGIIPAGSDNSLVWTVLGVKDPISASLLIVKGGFTALDILSVEWIQSGLIHFGTTVSYYGFISDVLELSEKYQKKFGPLRYFVAGILKFFCLPSYFYELEYLPSSKEMTGHGKGIGQENFVSDVYTNVMRSRSKREGIPRASSLSSIDSIMTPSRMSLGDVDTSGSTAASTEPSEYVRGLDPKAKRLSLGRSNIVSEPEEVLHPQPHHSSFWPRTRSKTRTERNSVGVTTNDTRLSWAAPSIHDKEDISSTISDPGPIWDSEPKWDNGPKWDTELTWESDHPIELPGPPEDNEIGPSVELVPNLDDKWVVRKGHFLGVLVCNHSCKTVQSLSSQVIAPKANHDDNTLDLLLVGGKGRWKLLKFFILLQFGRHLSLPYVEYVKTRDFSFEYQWQIFRIPVYYLGPLK

SEQ ID NO: 3570 - protein, 140 aa, Brassica napus
  misc_feature (21)..(23): Xaa can be any naturally occurring amino acid
  misc_feature (25)..(26): Xaa can be any naturally occurring amino acid
  misc_feature (28)..(29): Xaa can be any naturally occurring amino acid
  misc_feature (31)..(31): Xaa can be any naturally occurring amino acid
  misc_feature (34)..(34): Xaa can be any naturally occurring amino acid
  misc_feature (37)..(37): Xaa can be any naturally occurring amino acid
  misc_feature (41)..(41): Xaa can be any naturally occurring amino acid
  misc_feature (47)..(47): Xaa can be any naturally occurring amino acid
  misc_feature (51)..(51): Xaa can be any naturally occurring amino acid
  misc_feature (54)..(56): Xaa can be any naturally occurring amino acid
  misc_feature (58)..(59): Xaa can be any naturally occurring amino acid
  misc_feature (62)..(62): Xaa can be any naturally occurring amino acid
  misc_feature (64)..(65): Xaa can be any naturally occurring amino acid
  misc_feature (71)..(71): Xaa can be any naturally occurring amino acid
  misc_feature (76)..(76): Xaa can be any naturally occurring amino acid
  misc_feature (90)..(91): Xaa can be any naturally occurring amino acid
  misc_feature (95)..(95): Xaa can be any naturally occurring amino acid
  misc_feature (97)..(97): Xaa can be any naturally occurring amino acid
  misc_feature (102)..(102): Xaa can be any naturally occurring amino acid
  misc_feature (104)..(104): Xaa can be any naturally occurring amino acid
  misc_feature (118)..(118): Xaa can be any naturally occurring amino acid
  misc_feature (129)..(129): Xaa can be any naturally occurring amino acid
  misc_feature (131)..(131): Xaa can be any naturally occurring amino acid
  misc_feature (134)..(134): Xaa can be any naturally occurring amino acid
  misc_feature (137)..(137): Xaa can be any naturally occurring amino acid
SRFSQFYPTLLQILFVIIKSXXXLXXDXXMXPAXESXSSVXPSSSSXKKAXRFXXXKXXAGXLXXWDIVVXDIAAXCINHIMDLCIECQXXQASXTXEECTXAXGVCNHAFHFHCIGXWLKTRHVCPLXNXRVXFQXYGH

SEQ ID NO: 3571 - protein, 447 aa, Xanthobacter autotrophicus Py2
MAGGKQSIQDLLDGEPIRGRQWLVFLMCFFVAALDGFDTQCIAYTGPAIAKAFGMAPADMTYIFISGTLGMAIGAMALGSIGDKIGRRTAILGAMLLFGVFSLAIAFATSPTQIVMLRFLTGLGMGGATPVLLALSAEYAPGRARGTVLTGVLLGLPLGAVLGGLLASGWMPVIGWQGIYLVGGSLPLVMLVVCLIVLPESPQLLVARGKPGDLERSRSLVEKILKRPVPAGTQFVPAEKVAKGSVAALFAPAYRIRTIAVWATYLFNWIAWFMLLLWLPTVLTTSGLPAATAAFGTVTVNTAFIICAIPLSLVLPKVNARLLLLGMFALGIAICIGLALAGTNWTAVFILVAAAGFGVGGQQLALNYLISGIYPTELRATGTGWAIGIGRTGAIVGSATGGWFLQMGGVPGYYLGIAVPLAIAALAVALIRSRPSAQPEGALSAAH

SEQ ID NO: 3572 - protein, 210 aa, Candida glabrata CBS 138
MSQQVGASIRRKLVIVGDGACGKTCLLIVFSKGQFPEVYVPTVFENYVADVEVDGRRVELALWDTAGQEDYDRLRPLSYPDSNVVLICFSIDLPDSLENVQEKWIAEVLHFCQGVPIILVGCKVDLRNDPQTLEQLRAEGLQPVATADGQNVADQIGATGYYECSAKTGYGVREVFEAATRASLMGKQKNTGKKNKKNSGEKKKRKCVLL

SEQ ID NO: 3573 - protein, 321 aa, Streptococcus pneumoniae
PDINKDPGAEDKYKEVQEAYETLSDDQKPAAYDQYGAAGTNGGFGGAGGFGGFNGAGGFGGFEDIFSSFFGGGGSSRNPNAPRQGDDLQYRVNLTFEEAIFGTEKEVKYHREAGCRTCNGSGAKPGTSPVTCGRCHGAGVINVDTQTPLGMMRRQVTCDVCHGRGKEIKYPCTTCHGTGHEKQAHSVHVKVPAGVETGQQIRLAGQGEAGFNGGPYGDLYVVVSVEASDKFEREGTTIFYNLNLNFVQAALGDTVDIPTVHGDVELVIPEGTQTGKKFRLRGKGAPSLRGGAVGDQYVTVNVVTPTGLNDRQKVALKEFAA

SEQ ID NO: 3574 - protein, 325 aa, Streptococcus pneumoniae
HPDINKEPGAEDKYKEVQEAYETLSDDQKRAAYDQYGAAGANGGFGGAGGFGGFNGAGGFGGFEDIFSSFFGGGGSSRNPNAPRQGDDLQYRVNLTFEEAIFGTEKEVKYHREAGCRTCNGSGAKPGTSPVTCGRCHGAGVINVDTQTPLGMMRRQVTCDVCHGRGKEIKYPCTTCHGTGHEKQAHSVHVKIPAGVETGQQIRLAGQGEAGFNGGPYGDLYVVVSVEASDKFEREGTTIFYDLNLNFVQAALGDTVDIPTVHGDVELVIPEGTQTGKKFRLRSKGAPSLRGGAVGDQYVTVNVVTPTGLNDRQKVALKEFATAGD

SEQ ID NO: 3575 - protein, 393 aa, Candidatus Desulfococcus oleovorans Hxd3
MPNESQLLDTGLRGVKIAKTRISHVDGEAGKLVYRGFLINDLAESATYEEVAHLLLHEKLPNSDELTAFSRKLAGFRAIGPDIRQSMEKISAQAHPMDVLQAMIPLLATGDSDRDAMTRETTLSSGTRLVAVMATIVAAWHRIRSGRTPIDPDPALGHGANFLYMLTGRRPDTETARFFDVCLVLHAEHSFNASTFTARQVASTRAHMYAAVSAAIGSLSGELHGGANSRVMQVLLDIGSVDAIEAHIKKILDTGGKIMGLGHAVYKTGDPRANVLSDMSRRLGDLSGNPLWYDLTVALEQKGRAAFKKNRGLDIYPNIDFYSASVYYYMGIPIDLFTPVFAISRVAGWVAHVIEEQFGGAGSKPALYRPSAEYVGEYCGPEECAFIPVSDRK

SEQ ID NO: 3576 - protein, 322 aa, Streptococcus pneumoniae
PQISQEPGAEDKYKEVQEAYETLSDDQKRAAYDQYGAAGANGGFGGAGGFGGFNGAGGFGGFEDIFSSFFGGGGSSRNPNAPRQGDDLQYRVNLTFEEAIFGTEKEVKYHREAGCRTCNGSGAKPGTSPVTCGRCHGAGVINVDTQTPLGMMRRQVTCDVCHGRGKEVKYPCTTCHGTGHEKQAHSVHVKIPAGVETGQQIRLAGQGEAGFNGGPYGDLYVVVSVEASDKFEREGTTIFYNLNLNFVQAALGDTVDIPTVHGDVELVIPEGTQTGKKFRLRSKGAPSLRGGAVGDQYVTVNVVTPTGLNDRQKVALKEFATA

SEQ ID NO: 3577 - protein, 298 aa, Streptococcus bovis
PGAEEQYKKVQEAYETLGDEQKRAAYDQYGPAGANGGFNGGAGGFGGFDGAGFGGFEDIFSSFFGGGGGMRNPNAPRQGDDLQYRVNLTFEEAVFGVEKEVAYNRESTCSTCSGSGAKPGTSPVTCSRCHGSGVINVDTQTPLGMMRRQVTCDVCHGTGKEIKEPCHTCHGTGHEKKTHKVSVKIPAGVETGQQIRLQGQGEAGFNGGPYGDLFVIINVLPSNKFERNGSTIYYTMNISFVQAALGDTVEVPTVHGDVEMTIPAGTQTGKTFRLRGKGAPKLRGGGQGDQHVTVNIVT

SEQ ID NO: 3578 - protein, 322 aa, Streptococcus mitis
PDINKEPGAEEKYKEVQEAYETLSDDQKRAAYDQYGAAGANGGFGGAGGFGGFNGAGGFGGFEDIFSSFFGGGGASRNPNAPRQGDDLQYRVNLTFEEAIFGAEKEVKYNREASCRTCNGSGAKPGTSPVTCGRCHGAGVINVDTQTPLGMMRRQVTCDVCHGRGKEIKDPCTTCHGTGHEKQAHSVHVKIPAGVETGQQIRLAGQGEAGFNGGPYGDLYVVVSVEASDKFEREGTTIFYNLNLNFVQAALGDTVDIPTVHGDVELVIPEGTQTGKKFRLRGKGAPSLRGGAVGDQYVTVNVVTPTGLNDRQKAALKEFAAA

SEQ ID NO: 3579 - protein, 132 aa, Salmonella enterica
SGMHCHMSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGIKNKIHPGEAMDKNLY

SEQ ID NO: 3580 - protein, 111 aa, Salmonella enterica
SLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGIK

SEQ ID NO: 3581 - protein, 116 aa, Salmonella enterica
LAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGIKNKIHPG

SEQ ID NO: 3582 - protein, 632 aa, Desulfovibrio desulfuricans G20
MCGIAGYIGRRCLPDDAVRRCHAAMRHRGPDGSGTFRRCTADGRHVLLLHARLSILDPDPRSGQPMQRGGGVLAFNGELYNFSEVRERLERGGLAFDTTGDTEVLLRALDPQGRSLLCGGHAAEDLLHGMAGALDACEGMWAFAYFDASRGTLVLGRDRFGEKPLYYLRDDDGGLYFGSEPKLLAALTGRPLRPDTEHLRRYLVNGYKSLYKTRQTFFAGLRQVPAGTMLAADAGGLRGLCYWERPHAAHDPVQEDMSFADAVRGTRERLIRSVELRLRADVPLAFCMSGGIDSNSLICIARRVFGYDVHGFTVMNTDARYEERECVEHVVRELGLRHTSVSPSVAGFLDGLRTLVRAHDAPVLTISYYVHWLLMQRIRQQGYAISISGTAADELFTGYYDHHNLYLAAMYGSGALYDKALENWRRHVAPVVRNPYLQDPEVFVHAPQERGHIYLHNDRFAGALRQPFDEPFTEHAYHAVPLRNRMLNELFHEAVPVILHEDDLNAMYHSVENRSPFLDRDLFDFSLRIPVRHLVRDGMAKAVLREAMRGIVPDMILDNRRKVGFNAPVLDFLDVRDSAVRAQVLADSPVWDFVRRDAVAQLLDGRSLGNSESKFLFNILCCKMFLEDCADA

SEQ ID NO: 3583 - protein, 496 aa, Physcomitrella patens
MAGTGFYESILDNDVFKYYADGEWKVSSSGKSVGITNPSTLKVQYKVQACTQDEVNKAVESAQAAQKIWAKTPLWKRAEALHRFAAILKDNKNEIAEALVKEIAKPHKDALTEVVRSGDLISYSAEEGIRILAEGKFLVSDSFPGNGRNKYCLASKIPLGVVLAIPPFNYPVNLAVSKIAPALIAGNAVVLKPPTQGAVSALHMVHCLHMAGFPKGLVSAITGKGSEIGDLMTMHPGINCISFTGGDTGIAISRKAGMVPLQMELGGKDCCLVLEDADLELAANNVIKGGYSYSGQRCTAVKVICVMESVAEELVSKIVQKMTKLTVGMPEDNCDITPVVSQSSANFIQGLVEDAQAKGAKFHQEWKREGNLIWPLLIDNVTPDMRIAWEEPFGPVIPVIRIKTVEEGIHHCNANNFALQGCVFTKDINKAILVSDAMESGTIQINAAPARGPDHFPFQGLRDSGIGSQGITNSIQMMTKTKSTVINLPTESYTMG

SEQ ID NO: 3584 - protein, 349 aa, Nicotiana attenuata
MMIRGATRMTRTVMGHMGPRYFSTAILRNDAGTGVMTGAAGFMHGVPVNPSEKVLWHIPVMGSRSASTMALNDKQHDKKVENGGTAASGGGDGGDEKSVVSYWGVPPSKVTKEDGTEWKWNCFRPWETYKADLTIDLTKHHAPTTFLDKFAYWTVKALRYPTDIFFQRRYGCRAMMLETVAAVPGMVGGMLLHCKSLRRFEQSGGWIKALLEEAENERMHLMTFMEVAKPNWYERALVFAVQGVFFNAYFVTYLVSPKLAHRIVGYLEEEAIHSYTEFLKELDKGNIENVPAPAIAIDYWRLPKDSTLRDVVLVVRADEAHHRDVNHFASDIHYQGQQLKDSPAPIGYH

SEQ ID NO: 3585 - protein, 482 aa, Ralstonia eutropha JMP134
MHNLNTFYIGGEWVKPADGATLADLVNPATEAVIGTVAMGGAADVDRAVAAARDAFASWSRSSREERLALLRRISDGYKARIGEIAEAISTEIGAPIWLCREYQAPMGLVQIQAAIAALEAFEFVTVKGTTQVVREAVGVAALITPWNWPVNQIAAKVAPALAAGCTVVLKPSEIAPLDARIFAEIVQEACQATSTPAGVFNMLFGTGPTVGAALSRHPDVDMVSITGSTRAGVDVAMQAAPTVKRVAQELGGKSPNVILDDADLKAAVSQGVVSCMLNSGQTCTAPTRMLVPRAQYQMAIAIAQATVQALTVGDPSSPDSKLGPSSNRAQYERVQRMIEAGIQEGARVVAGGPGRPEGLAQGFYNRPTVFADVSNDMTIAREEIFGPVLSMIPYDNEAEAIRIANDTPYGLAAYVWSGNPARARRVAGELRAGSVQINGAKMDFAAPFGGYKTSGNGREFGAYGLAEFLEYKSVAGCTVDE

SEQ ID NO: 3586 - protein, 571 aa, Oryza sativa (japonica cultivar-group)
MAALRDVLLSIAQTPHRLRRRALVTWTPAQETSEVRDRSGARMKRRLEWYDLVGLGVGGMLGAGVFVTTGRVARDTAGPAVFASYVIAASPRSSPPSATPSELVGFFGGANILMEYVLSNAAVARSFTDYLASTCGITEPDAWRIQVDGIAKGYNALDFPAVALILVLTLCLCYSTKESAMLNMVITVFHLLFFVFIILAGLWNGSARNLVSPHGLAPYGVRGVLDGAAIVYFSYIGYDSASTMAEEIRDPARALPVGIAGSVLVVSALYCLMSLALCAMLPYTEIAESAPFSAVFREKAGWEWAGSVVGAGASLGIVASLLVAMLGQARYLCVIARARLVPAWLAKVHPSTGTPMNATIFLDRANGSIKYTNNFTEVKVLTTVSDHENCNAGLCTASIALFTELQVVFEMISIGTLLVFYLVANALIYHRYAKLGANRSLHVLLFLLILTLSSLGFSLSRRIHGQCRWGMALFGATSVTITAMFHCAVRRDMPEPPSEWMVPLMPWPAAASVFLNVFLMTTLKVMSFQRFGLWSFVIIVFYVCYGVHSTYSAEENEAVNAMIHHANMDIS

SEQ ID NO: 3587 - protein, 229 aa, Listeria monocytogenes EGD-e
MKLVLIRHGQSEWNKLNLFTGWHDVDLSQEGVVEAMTAGKRIKEAGLEFDVAFTSVLTRAIKTLNYVLEESDQMWVPVHKSWRLNERHYGALQGLNKQETAEKYGADQVQKWRRSYDTLPPLLEENDERQAKNDRRYQLLDTHAIPSGENLKVTLERVIPYWMDTIAPEIKEGRRVVIAAHGNSLRALVKFLEGISDDEIMDLEIPTGVPLVYELNADLKPVNKYYLDK

SEQ ID NO: 3588 - protein, 767 aa, Rickettsia akari str. Hartford
MDEMNRINYAEALEYHEKDKPGKIAITATKSLVTQQDLSLAYSPGVAAPCLEIAKNLEDVYKYTARGNLVAVISNGTAVLGLGNLGAAASKPVMEGKAVLFKKFADIDAIDLEVNTEDPEEFINAVKYLSYSFGGINLEDIKAPECFIIEEKLKSLMDIPVFHDDQHGTAIITAAGLINAAYLTNRKLEDLKIVVNGAGAAAIACIDLLIALGADKSKIILCDTKGVVYKGRLEGMNKWKELYASDTKFRTLAESLNNADVFIGLSVKGVVTKEMVKRMANNPIIFAMANPDPEITPEDIKFVRDDAIIATGRSDYNNQINNVMGFPYIFRGALDVRATTINMEMKIAAAKAIADLARRPVPEEVSKAYSGRKMVFCKEYIIPVPFDPRLITVVAAAVAVAAIESGVAKVKDLSIGKYRKELGSRLNPTANYMNFLAEKIHNAPLKRIVFAEGEEEEVISAALMMRDEKYGHPIIIGRVERIEATLKKIGQYVSLDGIQIMNASLTDSLEKYIDYLYKRLQRKGYLYRDCAKLVETDKDIFAACIVACGDGDALLTGVTKSYIDSLENIMKVISPKHNRRILGYSIMIAKDNNIIISDNCITAYPNSLELAQIATQTAEIAKNMGITPRVAFLSCSSFGNASKATTARICEAVNILDNFSKDKKELSGMKVDFEYDGEMSVKVALDGDLRKLYKFCRLSGSANILIMPGLNSASISTELLQEFSSNSFIGPITNGFEKPVQILQATATANEILKIATFACVEAIKEV

SEQ ID NO: 3589 - protein, 527 aa, Myxococcus xanthus DK 1622
MAIPIQMPSLSPTMTEGKIVKWLKKQGDKVSSGDAVAEVETDKSNLEIEAYDDGYLLQVLVGEGEMAKVGAPIAYIGAKGEKVGAGKQVAPAAAPPEQKPQPAPAAPAPQAAAKPASSGGGDNRIAIQMPSLSPTMTEGKIVKWLKKQGDKVSSGDAVAEVETDKSNLEIEAYDNGTLAEIVVGENQMAKVGAPIAYLTAKGAKAAPAAPAAQPKPPAPAPEKPAAAKPAAAPAQAGGRRLRASPVAKRIAREKGLDLTQVSGSGPSGRVVKRDIEEALARGPAAVPAAKKAPAAQPAPGVRPEPTVLPLSSMRKVIAQRMTEVKPGVPHFYLTIEVDMEAASKVREEAKAMDLKVSVNDLIVKAVAMAVRRYPKINVSLQGDKVVQFHSVDVGIAVALEEGLITPILRDADQKGLQAIASGVRELAERARKRALKPEEYTGGSITVSNLGMYGIDQFVAVINPPQASILAVGAVSEKAVVRDGQLAVRKMMTATLSCDHRVIDGAIGAEFLRELRGLLEHPTRLLF

SEQ ID NO: 3590 - protein, 444 aa, Bacillus anthracis str. Ames
MARYTKEDIFRLAKEENVKYIRLQFTDLLGVIKNVEIPVSQLTKALDNKMMFDGSSIEGFVRIEESDMYLYPDLDTWVIFPWTAEKGKVARLICDIYNADGTPFEGDPRNNLKRVLKEMEALGFSDFNLGPEPEFFLFKVDEKGNPTLELNDNGGYFDLAPMDLGENCRRDIVLELEEMGFEIEASHHEVAPGQHEIDFKYANAIRSCDDIQTFKLVVKTIARKHGLHATFMPKPLYGVNGSGMHCNLSLFKNGENVFFDQNGDLQLSDDARHFIAGILKHAPAFTAVANPTVNSYKRLVPGYEAPCYVAWSAQNRSPLVRIPASRGISTRVEVRSVDPAANPYLVMATLLAAGLDGIKNKLTPPAAVDRNIYVMTKEEREEAGIVDLPATLAQALVTLQSNEVISNALGDHLLEHFIEAKEIEWDIFRTQVHQWERDQYMSLY

SEQ ID NO: 3591 - protein, 462 aa, Oryza sativa (japonica cultivar-group)
MGMLRWGAHLLLLLLAAATWTCAGAGAGVTSEYRRKLEATVDMPLDADVFRVPPGYNAPQQVHITLGDQTGTAMTVSWVTANELGSNTVRYGSSPEKLDRAAEGSHTRYDYFNYTSGFIHHCTLTGLTHATKYYYAMGFDHTVRTFSFTTPPKPAPDAPFKFGLIGDLGQTFDSNSTLAHYEANGGDASLFVGDLSYADNYPLHDNNRWDTWARFVERSAYQPWIWTAGNHELDYAPELGETVPFKPFTHRYPTPYRAAGSTEPFWYSVKIASAHVIVLASYSAYGKYTPQWTWLQEELATRVDRKLTPWLIVLMHSPWYNSNNYHYMEGETMRVQFERWLVDAKVDVVLAGHVHSYERSRRFANIDYNIVNGKATPAANVDAPVYITIGDGGNIEGIANNFTVPQPAYSAFREASFGHATLEIKNRTHAHYAWHRNHDGAKAVADAVWLTNRYWMPTNDDV

SEQ ID NO: 3592 - protein, 310 aa, Streptococcus mitis
EKYHPDINKEPGAEEKYKEVQEAYETLSDDQKRAAYDQYGAAGANGGFGGAGGFGGFDGAGGFGGFEDIFSSFFGGGGASRNPNSPRQGDDLQYRVNLTFEEAIFGAEKEVKYNREASCRTCNGSGAKPGTSPVTCGRCHGAGVINVDTQTPLGMMRRQVTCDVCHGRGKEIKDPCTTCHGTGHEKQAHSVHVKIPAGVETGQQIRLAGQGEAGFNGGPYGDLYVVVSVEASDKFEREGTTIFYNLNLNFVQAALGDTVDIPTVHGDVELVIPEGTQTGKKFRLRGKGAPSLRGGAVGDQYVTVNVVTPT

SEQ ID NO: 3593 - protein, 341 aa, Dechloromonas aromatica RCB
MTGPRQPPKIPRFFKELPAVTLEQLYALIGPDMKAVDAVIRDRLYSDVVLVRQVAEYIISSGGKRMRPALVLLAAGALDYQGTRHQEMAAVVEFIHTATLLHDDVVDESALRRGRDTANAMFGNAASVLVGDFLYSRAFQMMVAVDNMRVMQVLSDATNVIAEGEVLQLMNCHDADVDEARYMQVIHYKTAKLFEAAAQLGAILGQATPEVEKALTAYGMHLGTAFQLIDDVLDYSGQEADTGKHIGDDLAEGKPTLPLIYVMQHGTPEQAACVRKAIEEGGRDDFPQVLDAIRNSGALDHAKARAIQEAELAKSAIQCLGDSNYKKALLQLTLFAVERNH

SEQ ID NO: 3594 - protein, 251 aa, Rhodococcus sp. RHA1
MNGMSTGTLVLLRHGESEWNALNLFTGWVDVHLTDKGIAEGKRAGELLLEHNLLPDVLYTSLLRRAISTANIALDTADRHWIPVIRDWRLNERHYGALQGRNKAQVKEKYGDEQFMLWRRSYDTPPPPIEAGSEYSQDTDPRYANLDKVPLTECLKDVVVRLIPYWEDTISADLKAGKTVLITAHGNSLRALVKHLDGISDEDIAGLNIPTGIPLRYDLDENLKPLNPGGTYLDPEAAAAGAAAVANQGGK

SEQ ID NO: 3595 - protein, 530 aa, Rhodococcus sp. RHA1
MSFKSPFPDVEIPNLSVYDFLFGQVDPADLDRPALIDGASGAVTTYQSLVAQIDGVAGALAARGLAVGEVVGLHSPNVPAFASVFHGILRAGGVATTINALYTAEDIAKQLTDSKAKFLFTVSPLLPQAKDAAAKVGIPVANVIVLDGADGHPSLKDLLAEGAPAPEVSFDPATQLAVLPYSSGTTGRPKGVMLTHRNLVANVCQINPRMGIGADDKLLAVLPFFHIYGMTVLLNAALFNRASLVTMPKFDLVEFLSIVSGQKCTYVFIAPPVAVALAKHPLVDEYDLSSVHSIFSGAAPLDQELGKAVANRLGCRVRQGYGMSEMSPVSHAIPFDRDDIALDSVGPSIANMECKLVDPGTGEEVAYPADGVSAPGELWCKGPNIMAGYLGNDEATAETLDADGYLHTGDIATVDSEGVVTIVDRMKELIKYKGYQVPPAELEALLLTHPQIADAAVIGVLDDEGEEVPKAFVVRQPGADLDEAAVIAFVAERVSPHKKVRKVEFIDLVPKSAAGKILRKDLRASEAGRS

SEQ ID NO: 3596 - protein, 292 aa, Burkholderia xenovorans LB400
MPVVDAAWEEWLSSNVARGCSPDSMIDAMVQAGFATDAARVAVHKTFGQNPANPAFAAAAATEAALAKAAPQTYQYDDPPVARGNLIRAYDRDVRVVMRCERPQVIVFADVLSPDECAEMIERSRHRLKRSTTVNPATGKEDVIRNRTSEGIWYQRGEDPFIERMDRRISSLMNWPVENGEGLQILHYGTTGEYRPHFDYFPPDQPGSAVHTAQGGQRVATLVIYLNDVPDGGETIFPEAGMSVAASQGGAVYFRYMNDRRQLDPLTLHGGAPVLAGDKWIMTKWMRERAYG

SEQ ID NO: 3597 - protein, 470 aa, Glycine max
MAVSAITGARLTLGIGLAIPLSSPTRSRTVAMAVSVDPKTDNKLTLTKSEEAFAAAKELMPGGVNSPVRAFKSVGGQPIVIDSVKGSRMWDIDGNEYIDYVGSWGPAIIGHADDQVLSALVETMKKGTSFGAPCLLENTLAELVINAVPSIEMVRFVNSGTEACMGALRLARAYTGREKIIKFEGCYHGHADPFLVKAGSGVATLGLPDSPGVPKAATFETLTAPYNDTAAVEKLFEANKGEIAAVFLEPVVGNAGFIVPKPDFHNFLRKITKENNTLLVFDEVMTGFRLSYGGAQEYFGITPDITTLGKIIGGGLPVGAYGGRRDIMEKVAPAGPMYQAGTLSGNPLAMTAGIQTLQRIKEPGTYEYLDKITGELVQGIIEAGKRAGHAICGGHIRGMFGFFFTEGPVYNFADAKKSDTDKFARFFWGMLAEGVYLAPSQFEAGFTSLAHTSDDIKKTIAAAEKVFREI

SEQ ID NO: 3598 - protein, 424 aa, Oryza sativa (japonica cultivar-group)
MNALAATSRNFRQAPRLLGLESKLEKSLLIPFPEIKVKRGRSVTPLSVQVECTIPKDDGTLASFIGFRVQHDNARGPMKGGIRYHPEVDPDEVNALAQLMTWKTAVAAIPYGGAKGGIGCAPGELSTSELERLTRVFTQKIHDLIGAHTDVPAPDMGTNSQTMAWILDEYSKFHGHSPAVVTGKPIDLGGSLGRDAATGRGVMYATEALLAEHGKSISGSTFVIQGFGNVGSWAARIIHEKGGKVIALGDVTGSIRNKNGLDIPALMKHRNEGGALKDFHDAEVMDSSELLVHECDVLIPCALGGVLNRENAPDVKAKFIIEAANHPTDPEADEILAKKGVTILPDIYANSGGVIVSYFEWVQNIQGFMWDEEKVNMELHKYMNNSFQHIKAMCKSHDCNLRMGAFTLGVNRVARATLLRGWEA

SEQ ID NO: 3599 - protein, 353 aa, Nicotiana attenuata
MMIRGATRMTRTVMGHMGPRYFSTAILRNDAGTGVMTGAAGFMHGVPVNPSEKALVTWVRHIPVMGSRSASTMALNDKQHDKKVENGGTAASGGGDGGDEKSVVSYWGVPPSKVTKEDGTEWKWNCFRPWETYKADLTIDLTKHHAPTTFLDKFAYWTVKALRYPTDIFFQRRYGCRAMMLETVAAVPGMVGGMLLHCKSLRRFEQSGGWIKALLEEAENERMHLMTFMEVAKPNWYERALVFAVQGVFFNAYFVTYLVSPKLAHRIVGYLEEEAIHSYTEFLKELDKGNIENVPAPAIAIDYWRLPKDSTLRDVVVVVRADEAHHRDVNHFASDIHYQGQQLKDSPAPIGYH

SEQ ID NO: 3600 - protein, 704 aa, Zea mays
MAEYGERYQGNGDQATAEGGYAQTEYAAGAGGSPPSDSNPSVFSDHADGRSSQPQHETQSHDSGSSKSQERDRERDKGKDRERGRDRVREKERGRDRDKDRERGDRDRDRDRHHRDRRERSEIREHRDRSDDRDRRRSHDSERRRDRDRDGHRRHRSRSPSKGRDRDRRSSSHSRSRSKSKRVSGFDQAPTQQAVPIVAAGVIPGQLPGVTAPIPGVGVLPNLYNLAAGQFNPHVIQPQAMTQQATRHARPVYVGGLPPTANEQTVAIFFNGVMAAIGGNTAGPGDAVPSQPPLWPRGFIQQHPLDCNMMRNINFSNASYGPTTMWAPIQTGNISSESTMLPATQSAVYWNHYMNFVRNPLGSVQGNPFPDSFSGTNTSTPLQGSNTIPSIPVNLESAAEHSVQDINSPIKTSAPVTKPKKTKEQNYTAAEDLLLCTTWLQISSDPIVHTGQRKKGLWARIEKRYNEQRGEYPCRMNRALSSRWDKIRADVGKFSGCYARVLREKQSGLTDDDKTSKAATLFAHEENKPFHFMHCWHKLKGEPKWESICQGPFRGLHGKAIGSSGGPFIGVEESDSGSAGLTGKRPLCRDSSKSERKKAASSTTTEYLSRLQELTEKLIQRIIEKGEKKYKYNEQDMELEKKRLDLEAKKLSIRKRELRLKELSMAEQQLEMLERTREDEVDPEVWSMMKERKKHLQQFIFSFC

SEQ ID NO: 3601 - protein, 206 aa, Arabidopsis thaliana
MESNHPHFKLILGSSSIARRKILTDMGYQFTLMSADIDEKSIRKEKPEELVLALAEAKAEAIMQRIPDGENIEEDKSTLLITCDQVVVYEDAVREKPSSVEEAREYIRGYSKGHTATVSSVAVTNLKTGVRKGGVDRVEIYFNEIPEETIEKLIEEGMVLKVAGALLIEHPLILPCVKEVVGTTDSVMGLPKELTEKLIKEVLAST

SEQ ID NO: 3602 - protein, 584 aa, Candida glabrata CBS 138
MNGSILRTSRSLRPWLLPINTRLAHTTAVQSHVTTPIFYPNAKPHLGHLYSSLLCDIYHRWQVLNGDSAALFTTGTDEHGLKIQLAAEKNNCESPKAFVDKLYPEFVELDKTYDISYTRFIRTTDPDHIENVKLLWNLCLENGYIYKGKHEGWYSISDETFYPSSKVIKDPNNPNKYINTESLNEVIHQSEENYYFKLSSFKEKLINHITEFPDFVHPPSKRDQILRDLKNDPNITKDISISRPATRLQWGIEVPNDPSQKVYVWFDALCNYISSIGGIEAVKQNKRALSNHILGNSDITVYQPTNVWKDTVHVIGKDIEKFHIIFWPSFLLAANLPLPKQIVVHSHWLCNGFKMSKSLGNVVEPMKISSHYGTDMVRWFLMENSKVEEDGDFQEEKLFATTELFVSKWGNLINRCCGAKFNIERSVHKYARNSEEVLADFEKIYIDNDMIIQARSLIQDVDQLILNAGKYYEKFQYNLLIKDIWKIINSTNSLFQYAEPWKKLGEQQDIIIFLCADISRVLAILTQPIIPQLSHKLLDHLKVDQERRTIDYANIGHDQSYAVEANIKNRPVPIARVLGLIGIE

SEQ ID NO: 3603 - protein, 330 aa, Magnaporthe grisea 70-15
MTTSSSAIRTIKRLMMAEVPRLDFSRFSQGTKQEKEEFGEALTKALIEHGFVKLSRKFFNLPAPALQRIACVPGPNPQRGWCGQGTELVSKTRKENYAGHDDVTKLMDAREHFDAGPLEDAQFPNLWPDENDLPGFRETIANHYQICKKVAHQLMAAVEIGMGLSAGVLVDRCRQEASEISLNRYPQIASETLAEGHTKRIWPHTDYGVITLLFQDGVGGLELEDRTRPGEFLPVTPTAPGGRAEMVVNASDTFERWTNGVVRAGLHRVTLPCDEKRAVVPERYSCAFFQKASRETSAGPLPQFVTEDNPARYDEITALQFQQRRNRLHY

SEQ ID NO: 3604 - protein, 471 aa, Gloeobacter violaceus PCC 7421
MADLQKEGGLDGGLKRTLGPINLISLGVGAIIGAGIFVITGQAAAQYAGPAITISFILAAFACAFAGLCYAEFAALLPISGSAYTYAYATLGELVAWIIGWDLIIEYALSAATVAVGWSGYVVSFLRDFGIVMPPQFTASFGQPVTLADGTTAAGLLNVPAVLIILALSLLLVVGVSESASVNGIIVVVKVAVIVAFLVFGASYIDTANWTPFIPEPVEPGRYGYFGILRAAGVIFFAYIGFDAVSTAAQEAKNPQRDMPIGILGSLVVCTVLYILVALVLTGIVDYRQLGVPDPIAVGVDAIGLGWLTFIVKIGAIAGLTSVMLVTLYGQTRIFYTMSRDGLLPPLFSAIHPRFKTPYLSTMLLGLFVSVVAGLVPLGILGELVSIGTLFAFIVVSAGVLFLRYRQPDLPRPFRCPLVPWVPLASIVACLALMSGLPADTWLRLFAWLGLGLLVYFVYGRVHSKLQSRRA

SEQ ID NO: 3605 - protein, 242 aa, Zea mays
  misc_feature (70)..(70): Xaa can be any naturally occurring amino acid
RVPSLVLTARSLKQLDSAADFSRDYDGACLQMRMSYSPAAHFFLFLVQWTDCSLAGALGLLRILIYKLRXQVYVDGSTTMSTHERKASIRKFYAVIFPSLMQLPKGISDVDDRRQKAACTERYRRRDEDEGKRPVSEADIEREEECGICMEMNGKVVLPSCSHAMCIKCYRQWRSRSQSCPFCRDSLKRVNSGDLWMLTDCRDVVDMATVTRENIRRLFMYVEKLPLVAPDNIFYAYDSHVK

SEQ ID NO: 3606 - protein, 772 aa, Roseovarius nubinhibens ISM
MSWGRGADKDWETDLLEQANDMSKPKFTREEALAFHLEPTPGKFEITATVPMTTQRDLSLAYSPGVAVPCEAIAAAPETAYDYTNKGNLVAVISNGTAVLGLGNLGALGSKPVMEGKAVLFKRFADVNSIDIELDTEDPEKFIEAVRLMGPTFGGINLEDIKAPECFIIEQRLKEVMDIPVFHDDQHGTAVICAAGLINALHLSGKKIEDVKIVLNGAGAAGIACIELLKSMGARHENCIVCDTRGVIYQGRTDGMNQWKSAHAVKTELRSLEEAMVGADVFLGVSAKGAVTQEMVKSMAKDPVIFAMANPDPEITPEEAHEVRSDAIVATGRSDYPNQVNNVLGFPYLFRGALDVHARAINDEMKIACAEALARLAREDVPDEVDMAYGRKMSFGRDYIIPAPFDPRLIHTIPPAVARACMDTGAARRPIVDMEAYELTLKSRMDPTASMLRSINARARAAQARMIFAEGDDPKVLRAAVQYQRAGFGEALVVGREADVKAKLEASGLGDAVSELQIVNAANTEHLAEYKAFLYKRLQRKGHDRHDVHRLAARDRHVFASLMLAHGHGDGLVTGATRKSSHVLDLINHVFDADAEHGAVGVTAVMHKGRVVLIADTLVHEWPDETDLANIAERSAGVARHLGLEPRVAFVSFSTFGYPRSERSEKMHLAPNVLEARGVDFEFEGEMTVDVALNLQAQKSYPFQRLTGPANILVVPARHSASISVKLMQEMAGATVIGPILAGVDKSIQICSSTSTANDILNMAVLAACKVG

SEQ ID NO: 3607 - protein, 129 aa, Triticum aestivum
  misc_feature (36)..(36): Xaa can be any naturally occurring amino acid
  misc_feature (66)..(66): Xaa can be any naturally occurring amino acid
  misc_feature (71)..(71): Xaa can be any naturally occurring amino acid
  misc_feature (85)..(85): Xaa can be any naturally occurring amino acid
  misc_feature (88)..(88): Xaa can be any naturally occurring amino acid
  misc_feature (95)..(95): Xaa can be any naturally occurring amino acid
  misc_feature (103)..(103): Xaa can be any naturally occurring amino acid
MAKFGEGDARWIVQERADGANVHNWHWAERDCLDWXSRALLSKLLRGLPVLSGEGGSPSAPPPSDXSDGEXTSTSRKGQVIPRYXSLXSPWEPMXNRSGVVKXTGPLRYLLQNSPPIFVKPGKLNEPRF

SEQ ID NO: 3608 - protein, 799 aa, Zea mays
MMEEDMENGRSYQERPRTFSTVRSKSSIPLALRLLMRINPRALIILSLLVFSGVLYVGASTSPIVVFVFCICTLSLFFSLYLTKWVLAKDEGPPEMSEISDAIRDGAEGFFKTQYGTISKMAFILAFVILGIYLFRTTTPQQEASGLGRATLAYITVASFLLGALCSGIAGFVGMWVSVRANVRVSSAARRSAREALQIAVRAGGFSAIVVVCMAVFGVAILYSTFYVWLGVDSPGSMKVTDLPLLLVGYGFGASFVALFAQLGGGIYTKAADVGADLVGKVEQGIPEDDPRNPAVIADLVGDNVGDCAARGADLFESIAAEIISAMILGGTMAQRCKIEDPSGFILFPLVVHSFDLVVSSVGILSIRGTRDSGLISPIEDPMAIMQKGYSVTIMLAVLTFGASTRWLLYTEQAPSAWLNFALCGLVGIVTAYAFVWISKYYTDYKHEPVRLLALSSSTGHGTNIIAGVSLGMESTALPVLVISVAIISAYWLGQTSGLVDESGNPTGGLFGTAVATMGMLSTAGYVLTMDMFGPIADNAGGIVEMSQQPESVREITDVLDAVGNTTKATTKGFAIGSAALASFLLFSAYMDEVASFAQLPFKEVDIAVPEIFVGGLLGSMLIFLFSAWACSAVGKTAQEVVKEVRRQFIERPGIMDYKEKPDYGRCVAIVASASLREMIKPGALAIISPMAVGVVFRILGHYTGQPLLGAKVVASMLMFATVAGILMALFLNTAGGAWDNAKKYIETGALGGKGSESHKAAVTGDTVGDPFKDTAGPSLHVLIKMLATITLVMAPIFL

SEQ ID NO: 3609 - protein, 338 aa, Acremonium chrysogenum
MGSVPVPVANVPRIDVSPLFGDDKEKKLEVARAIDAASRDTGFFYAVNHGVDLPWLSRETNKFHMSITDEEKWQLAIRAYNKEHESQIRAGYYLPIPGKKAVESFCYLNPSFSPDHPRIKEPTPMHEVNVWPDEAKHPGFRAFAEKYYWDVFGLSSAVLRGYALALGRDEDFFTRHSRRDTTLSSVVLIRYPYLDPYPEPAIKTADDGTKLSFEWHEDVSLITVLYQSDVQNLQVKTPQGWQDIQADDTGFLINCGSYMAHITDDYYPAPIHRVKWVNEERQSLPFFVNLGWEDTIQPWDPATAKDGAKDAAKDKPAISYGEYLQGGLRGLINKNGQT

SEQ ID NO: 3610 - protein, 328 aa, Amycolatopsis lactamdurans
MKMPSAEVPTIDVSPLFGDDAQEKVRVGQEINKACRGSGFFYAANHGVDVQRLQDVVNEFHRTMSPQEKYDLAIHAYNKNNSHVRNGYYMAIEGKKAVESFCYLNPSFSEDHPEIKAGTPMHEVNSWPDEEKHPSFRPFCEEYYWTMHRLSKVLMRGFALALGKDERFFEPELKEADTLSSVSLIRYPYLEDYPPVKTGPDGEKLSFEDHFDVSMITVLYQTQVQNLQVETVDGWRDLPTSDTDFLVNAGTYLGHLTNDYFPSPLHRVKFVNAERLSLPFFFHAGQHTLIEPFFPDGAPEGKQGNEAVRYGDYLNHGLHSLIVKNGQT

SEQ ID NO: 3611 - protein, 278 aa, Gossypium barbadense
ISHELMETVERLTKEHYRKCMEQRFKEMVASKGLEAVQSEINDMDWESTFFLRHLPESNMSEIPDLEEDYRKVMKEFAVELEKLAEQLLDLLCENLGLEPGYLKKVFYGSKGPTFGTKVSNYPPCPKPDLIKGLRAHTDAGGIILLFQDDKVSGLQLLKDGQWIDVPPMKHSIVINLGDQLEVITNGKYKSVMHRVIAQTDGTRMSIASFYNPGSDAVIYPAPALLEKEADKSQVCPKFVFEDYMKLYAGLKFQAKEPRFEAMKPVESAVNLGPIATV

SEQ ID NO: 3612 - protein, 132 aa, Brassica napus
GDLLNLVNLNLSGNQLTSLPSSFSRLINLEELDLSSNSLSVLPETISSLVSLKKLDVETNNIEEIPHSISGCSSLKELRADYNRLKALPGAVGKIATLEILSVRYNNIRQLPTTMSSMANLKELDVSFNELE

SEQ ID NO: 3613 - protein, 331 aa, Penicillium chrysogenum
MASTPKANVPKIDVSPLFGDNMEEKMKVARAIDAASRDTGFFYAVNHGVDVKRLSNKTREFHFSITDEEKWDLAIRAYNKEHQDQIRAGYYLSIPEKKAVESFCYLNPNFKPDHPLIQSKTPTHEVNVWPDEKKHPGFREFAEQYYWDVFGLSSALLRGYALALGKEEDFFSRHFKKEDALSSVVLIRYPYLNPIPPAAIKTAEDGTKLSFEWHEDVSLITVLYQSDVANLQVEMPQGYLDIEADDNAYLVNCGSYMAHITNNYYPAPIHRVKWVNEERQSLPFFVNLGFNDTVQPWDPSKEDGKTDQRPISYGDYLQNGLVSLINKNGQT

SEQ ID NO: 3614 - protein, 525 aa, Synechococcus sp. WH 5701
MVCRQAGTCSNPGQPDCCYELLNPAAPMASAPLPLEPSPIRFGTDGWRGILGVDVTLERLLVVAAAAARELERAAPAELTSREVVIGYDRRFLAPELAEAIASAVRGADLEPLLTDSAVPTPACSWAVVERRALGALVITASHNPPEWIGLKIKGHFGGSVEEAFTAAVEKRLEAGGITVPIPGDTPRFDGWDGYLKGLRQLVDTSALRRGLETIGLRVIVDPMHGSAAGGLPALLGGSSGTSEGAADGSGEGCIEEIRSWRDPLFGGHPPEPLAPYLQELIAAVRASGEAGRPAVGIVFDGDGDRIAAIDERGRYCSTQLLMPLLIDHLARARALPGAVVKTVSGSDLMQLVAEGLGRPVIEKPVGFKYIASEMIAGGVLVGGEESGGVGFGLHLPERDALFAALLVLEALVEGGLPLGERLDRLQVAHGGASAYDRLDLRLKDMASRERLERQLAQEPPTSVAGWPVQEVVSTDGVKLRLGDSHWLMLRFSGTEPLLRLYSEAPSGERVSEILAWARQFAEAA

SEQ ID NO: 3615 - protein, 411 aa, Yersinia pestis CO92
MAELPAKRRFTRIDRLPPYVFNITSELKMAARRRGEDIIDFSMGNPDGPTPPHIVEKMCSVAQREDTHGYSTSRGIPCLRRAISRWYADRYQVDIDPENEAIVTIGSKEGLAHLMLATLDHGDTVLVPNPSYPIHIYGAVIAGAQVRSVPLTEGIDFFGELERAIRETIPKPKMMILGFPSNPTAQCVELDFFERVVALAKQYDVLVVHDLAYADIVYDGWKAPSIMQVPGAKDIAVEFFTLSKSYNMAGWRIGFMVGNPELVSALARIKSYHDYGTFTPLQVAAIAALEGDQQCVRDIAEQYRQRRNALVRGLHEAGWMVDNPKASMYVWAKIPEPYAHLGSLEFAKRLLAEAKVCVSPGIGFGDYGDTHVRFALIENQDRIRQAVRGIKSMFRADGLLKPGKSSPNEMA

SEQ ID NO: 3616 - protein, 323 aa, Yersinia pestis CO92
MTTYALVGDVGGTNARLALCAVATGEILQAKTYSGLEYESLEDVIKQYLSEHQAKVTDACIAIACPITGDWVAMTNHTWAFSIAAMQQNLGLDHLEVINDFTAVSMAIPVLPAQDVLQFGGTQPQPGKPVAVYGAGTGLGVAHLVNVDRRWISLAGEGGHVDFAPNSEEEDQILAVLRQELGHVSAERVLSGPGLVNLYRAIVISDARLPEKLAPKDITARALADSCTDCRRALSLFCVIMGRFGGNLALNLSTFGGVYIAGGIVPRFMEFFKASGFRAAFEDKGRFKDFLQDIPVYMITHPQPGLLGAGAYLRQKLGYELSS

SEQ ID NO: 3617 - protein, 518 aa, Funaria hygrometrica
RSSTKKSRKERRPNPFAQDGYHGNLQILKNQPKARILDKYVLGRELGRGEFGITYLCTDKETQEIFACKSISKKKLRTAVDVEDVRREVAIMKHLPEHPHVVTLKGAYEDDNAVHLVMELCEGGELFDRIIARGHYTERGAAQVTRTIVEVVQACHRQGVMHRDLKPENFLFANKNENSPLKAIDFGLSVFFKPGEKFSEIVGSPYYMAPEVLKRNYGPEVDVWSAGVILYILLCGVPPFWAETEQGVAQAILRGILDFKRDPWPKVSDSAKSLVRHMLEPDPKARYIAQQVLDHPWLQNAKKNPNVPLDAVRSRLKQFSAMNKLKKRALQVIAEHLGGEEIDGLKEMFEKLDSDNTGAITFEKLKMGLIEIGSQLTEHEVRLLMEAADVDGNGTLDYGEFVAATVHLQRLDDDEHLRRAFDVFDVNESGFIEVEELREAVGQSLMGSPSESDVVQAILSEVDLDKDGRISYEEFAVMMRRGTDWRKASRQYSRDRFNSLSMRLLRDGSLNPPSYSMR

SEQ ID NO: 3618 - protein, 174 aa, Enterococcus faecium
LYLGNRHARVEGETYYEFIDQFVQSATELFPELLLHWEDFGRGNAAAILEKYEDQITTFNDDIQGTGIVVLAGVLGGLNISGEQLKDQIILTFGAGTAGVGIANILLDEMIRQGVPEEEARQHFYQVDKQGLLFEDTEGLTPGQIPFARKRSEFINADELTNLEAVVKAIHPTI

SEQ ID NO: 3619 - protein, 494 aa, Mannheimia succiniciproducens MBEL55E
MTKDLNVFDKHYGLLINGEWTDGSEGKTLTAHNPANGAELATFIDATDADVDAAVTAAQEAFKTWKHTTAAERAAILNKIADVIDENTELFALQETLDNGKPIRETRAADIPLAADHFRYFAAVIRSEEGSANQLDDEDLSLILREPIGVVGQIIPWNFPFLMAAWKIAPALAAGCTVVIHPSSSTSLSLLSLAQKINHLLPKGVFNVITGKGSKSGEYMLHHTGFNKLAFTGSTEIGRKIGVAAAEMLIPSTLELGGKSANIFFDDMPFDKALEGAQKGILFNQGQVCCAGSRIFVQENIYDKFIAALKEEFKKVKVGLPWEDDTQMGAQVNSNQIKVISKYVDIAREEGCEIIIGGEKATDPALAKGEFFQPTLILAPDNTKRVAQEEIFGPVAVVIKFKEEADVIHMANDSEYGLGGAVWTHNINRALRVARALETGRVWVNCYNRLPAGAPFGGYKTSGIGRETHKMMLDAYTQVKNIFISTREEREGMY

SEQ ID NO: 3620 - protein, 518 aa, Triticum aestivum
  misc_feature (239)..(239): Xaa can be any naturally occurring amino acid
  misc_feature (272)..(272): Xaa can be any naturally occurring amino acid
  misc_feature (290)..(290): Xaa can be any naturally occurring amino acid
MPGGGFAVSAPSGVEFEAKITPIVIISCIMAATGGLMFGYDVGISGGVTSMDDFLREFFPAVLRRKNQDKESNYCKYDNQGLQLFTSSLYLAGLTATFFASYTTRRLGRRLTMLIAGVFFIIGVIFNGAAQNLAMLIIGRILLGCGVGFANQAVPLFLSEIAPTRIRGGLNILFQLNVTIGILFANLVNYGTSKIHPWGWRLSLSLAGIPAAMLTLGALFVTDTPNSLIERGHLEEGKXAVLKRIRGTDNVEPEFNEIVEASRIAQEVKHPXFRNLLQRPGTAPQLVIAXVLLQIFQQFTGINAIMFYAPVLFNTLGFKSDASLYSAVITGAVNVLATLVSVYAVDRAGRRALLLEAGVQMFLSQVVIAVVLGIKVTDKSDNLGHGWAILVVVMVCTYVASFAWSWGPLGWLIPSETFPLETRSAGQSVTVCVNLLFTFLIAQAFLSMLCHLKFAIFIFFSAWVLVMSVFVLFFLPETKNVPIEEMTDKVWKQHWFWKSFMDDDDHHHNIANGKNATV

SEQ ID NO: 3621 - protein, 388 aa, Candidatus Phlomobacter fragariae
VAIPKANGYQSLHTSMIGPHGVPIEVQIRTEDMDQMAEMGVAAHWAYKEQGESSTTTQIRAQRWMQSLLELQQSAGNSFEFIESVKSDLFPDEIYVFTPEGRIVELPTGATPVDFAYTVHTYIGHACVGARVDRQPFPLSQSLSTGQTIEIITAPGAMPNAAWLNFVVSSKARAKIRQLLKNLKREDSVSLGRRLLNHALGKGKKLGDIPQENINKELARMKLHSVDDLLAEVGLGNTMSVVVAHNLLGNASINNVITDNSDNRSKLPIKGAEGVLITFAKCCRPIPGDPIVAHISPGKGLVIHHESCRNIRGYQKEPEKFMQVEWDEGVNNNFIAEIKVDMINHQGALANLTAAINSANSSIQSMNTEEKDGRVYCAFIRLTAKDRN

SEQ ID NO: 3622 - protein, 301 aa, Arabidopsis thaliana
MAKEGGLGENSRWSLGGMTALVTGGSKGIGEAVVEELAMLGAKVHTCARDETQLQERLREWQAKGFQVTTSVCDVSSRDQRVKLMETVSSLYQGKLNILVKYTYISFVLLGIGIHKNPIMLCFLLWIYTYVGQQCGNVNIKPTTEYTAEDFSFVMATNLESAFHLSQLAHPLLKASGSGSIVLISSAAGVVHVNVGSIYGATKGAMNQLARNLACEWASDNIRTNSVCPWYITTPLSNDFFDEEFKKEAVRTTPMGRVGEANEVSPLVAFLCLPSASYITGQTICVDGGATVNGFSFKTMP

SEQ ID NO: 3623 - protein, 93 aa, Zea mays
MGFIMEFAENLILRLMEDPDKRDQVRREHAYKMKERCERTKAAWSLPLRPYSFWTFDRFNSQLSWDLQISQAAGRRDPYDDLITRHSGSPPSS

SEQ ID NO: 3624 - protein, 464 aa, Bacillus anthracis str. Ames
MDKNLKKDLKIRHITMISIGGVIGAGLFVGSGAVVHSAGPGSIVSYALAGLLVVFVMRMLGEMAAINPTSGSFATYAREAIGPWAGYTIGWLYWFFWVIVIAIEATAGAGIIQYWIPEIPLWLLSLILTILLTLTNVFSVKSFGEFEYWFSFIKVISIVLFLCLGLAVILGFVPGTEAPGTSNLVGQGGFMPNGISSVLLGITVVIFSFMGSEIVAVAAGESAEPVKAVKTATNSVIWRILVFFIGSIAVVVTLLPWNSANILKSPFVAVLEHIGIPAAAQIMNFIVLTAVLSCLNSGLYTNSRMLFSMAERGDAPKAFLKLNSSGVPVRAVLFGTFFAYIGVVFSYISPDKVFLFLVNASGGIALLVYLVIAISHLKIRKKMGRVEQQNLKVKMWFFPYVTYVTIAAIIAVLIAMLAIESLRSQALLTMLVTVLIIISYFIFNRNKNSTVLNTKSKNEESVRF

SEQ ID NO: 3625 - protein, 329 aa, Streptomyces clavuligerus
MPVLMPSAHVPTIDISPLFGTDAAAKKRVAEEIHGACRGSGFFYATNHGVDVQQLQDVVNEFHGAMTDQEKHDLAIHAYNPDNPHVRNGYYKAVPGRKAVESFCYLNPDFGEDHPMIAAGTPMHEVNLWPDEERHPRFRPFCEGYYRQMLKLSTVLMRGLALALGRPEHFFDAALAEQDSLSSVSLIRYPYLEEYPPVKTGPDGQLLSFEDHLDVSMITVLFQTQVQNLQVETVDGWRDIPTSENDFLVNCGTYMAHVTNDYFPAPNHRVKFVNAERLSLPFFLNGGHEAVIEPFVPEGASEEVRNEALSYGDYLQHGLRALIVKNGQT

SEQ ID NO: 3626 - protein, 680 aa, Geobacter sulfurreducens PCA
MEQYAVYFALVCAAAAVVYGLASAQWILGLPQGNERMRQIAAAVQEGAGAYMKRQYTIIAVVGVVMFIALFATLGMKTAVGFAIGAIFSGLTGFIGMFVSVRANIRTTEAAKSGIHKALNVAFKGGAITGMLVVGLGLLGVAGYYLVLQQLMPGAPVKDIVSQLVGLGFGGSLISIFARLGGGIFTKGADVGADLVGKVEAGIPEDDPRNPAVIADNVGDNVGDCAGMAADLFETYAVTLIAAMLLGAIAFNNFSGAVTYPLILGGISIIASIIGTFFVKLGASQKIMPALYKGLIASGVIACIAFYFVTVQMFPEGNPTGYSATNIFISAIVGLVVTGAIFWITEYYTATEYAPVKHIAQASTTGHATNIIAGLGVSMKSTAMPIIVIAAGIIVAFQCAGVYGIAIAAVSMLSLTGIVVAMDAYGPITDNAGGIAEMAELDDSVRAVTDPLDAVGNTTKAVTKGYAIGSAGLAAVILFTSYVDELKLAGQNIEFSLADPYIIVGLFLGGMLPYYFAALCMEAVGKAGGSVVEEVRRQFREIKGIMEGTGKPDYAACVDIVTKSALKEMVIPGIIPIAAPVIIGFTLGPKALGGVIVGTIVTGIFVAISMTTGGGAWDNAKKYIEDGYHGGKGGEAHKAAVTGDTVGDPYKDTAGPAVNPMIKIINIVSLLIVPLLAKMG

SEQ ID NO: 3627 - protein, 328 aa, Solanum lycopersicum
MAVNGASSSGLIVSFGEMLIDFVPTVSGVSLAEAPGFLKAPGGAPANVAIAVTRLGGKSAFVGKLGDDEFGHMLAGILKTNGVQAEGINFDKGARTALAFVTLRADGEREFMFYRNPSADMLLTPAELNLDLIRSAKVFHYGSISLIVEPCRAAHMKAMEVAKEAGALLSYDPNLRLPLWPSAEEAKKQIKSIWDSADVIKVSDVELEFLTGSNKIDDESAMSLWHPNLKLLLVTLGEKGCNYYTKKFHGTVGGFHVKTVDTTGAGDSFVGALLTKIVDDQTILEDEARLKEVLRFSCACGAITTTKKGAIPALPTASEALTLLKGGA

SEQ ID NO: 3628 - protein, 109 aa, Azoarcus sp. EbN1
MDTQEVIREQVTTNPVVLYMKGTPQFPQCGFSSTAVQILKNSGVPKFFSVNVLENDEIRNGIKQFANWPTIPQLYVNGEFVGGCDIMREMYENGELQEVLKSAGATQQG

SEQ ID NO: 3629 - protein, 369 aa, Arabidopsis thaliana
MATNFKSLLPVIGTDETLNSLFSANVALIIKVFILNLKETKMHETMVFVDISPLVVKCDDANMAEDAGVAEVVGKLDRACRDAGFFYVIGHGISEDFIRKVRVMSHQFFELPYEEKLKIKITPAAGYRGYQRIGLNLTNGKQDMHEAIDCYKEFKQGKHGDIGKVMEGANQWPENPQEYKELMEEYIKLCIDLSRNILRGISLALGGSPYEFEGKMLTDPFWIMRILGYPVTRLIFFTYSGAHTDYGLLSLINQDDDKTALQVRDLAGDWIPVIPIPGSFVCNIGDMLKILSNGVYESTLHRVINNSPRYRVCVGFFYETNFDAAVEPLDIFKEKYPGKGTSQVFKRVVYGEHLVHKLQTTFQNLVEHS

SEQ ID NO: 3630 - protein, 329 aa, Streptomyces jumonjinensis
MPILMPSAEVPTIDISPLSGDDAKAKQRVAQEINKAARGSGFFYASNHGVDVQLLQDVVNEFHRNMSDQEKHDLAINAYNKDNPHVRNGYYKAIKGKKAVESFCYLNPSFSDDHPMIKSETPMHEVNLWPDEEKHPRFRPFCEDYYRQLLRLSTVIMRGYALALGRREDFFDEALAEADTLSSVSLIRYPYLEEYPPVKTGADGTKLSFEDHLDVSMITVLYQTEVQNLQVETVDGWQDIPRSDEDFLVNCGTYMGHITHDYFPAPNHRVKFINAERLSLPFFLNAGHNSVIEPFVPEGAAGTVKNPTTSYGEYLQHGLRALIVKNGQT

SEQ ID NO: 3631 - protein, 514 aa, Oryza sativa (indica cultivar-group)
MGSASASSLPASAGFGENLVLILDFGSQYTHLITRRVRQLGVLSLCVSGTAPLASLAGLRPRAVVLSGGPHSVHASGAPTFPEGFLEFAAGAGAHVLGVCYGMQLLVQSLGGAVEAGEKQEYGKMEVEVTARSSALYGEGEVGKRQTVWMSHGDEVVRLPEGFEVVARSVQGAVAAVENREKRFYGLQYHPEVTHSPQGMETLRRFLFDVCGIKADWKMQDVLDEEIRTIQSMVGPDEHVICALSGGVDSTVAATLVHKAIGDRLHCVFVDNGLLSKLKGVKDPEMKRKIIGREFIAVFDDFAHKLEQKIGKRPGYLVQGTLYPDVIESCPPPGSGRTHSHTIKSHHNVGGLPKDMKLKLIEPLKLLFKDEVRKLGSILNVPESFLKRHPFPGPGLAVRVLGDVTEGNALEVLRQVDEIFVQAIKDAGLYDIIWQAFAVFLPVQTVGVQGDQRTHSNAVALRAITSEDGMTADWYYFEREFLVDVVNKICNNVRGVNRVVQDITQKPPATVEWE

SEQ ID NO: 3632 - protein, 134 aa, Arabidopsis thaliana
MGSLETCLLFFVMVMFMSSTMSRASTSVVIYNDLGGGLPLRHHCKSREDDLGYQSLAPGRSWSFGFTPDIFGRTLFYCRFSWGAESHIFDIYKQSRDKEFQEFGCKKCEWKIRKNGPCKFYKKTGMFDHCYSWD

SEQ ID NO: 3633 - protein, 365 aa, Arabidopsis thaliana
MKLTVKTLKGSHFEIRVLPSDTIMAVKKNIEDSQGKDNYPCGQQLLIHNGKVLKDETSLVENKVTEEGFLVVMLSKSKSGGSAGQASVQPVSATTSSTKPAAPSTTQSSPVPASPIPAQEQPAAQTDTYGQAASTLVSGSSLEQMVQQIMEMGGGSWDKETVTRALRAAYNNPERAVDYLYSGIPQTAEVAVPVPEAQIAGSGAAPVAPASGGPNSSPLDLFPQETVAAAGSGDLGTLEFLRNNDQFQQLRTMVHSNPQILQPMLQELGKQNPQLLRLIQENQAEFLQLVNEPYEGSDGEGDMFDQPEQEMPHAINVTPAEQEAIQRLEAMGFDRALVIEAFLACDRNEELAANYLLENSGDFED

SEQ ID NO: 3634 - protein, 343 aa, Sinorhizobium meliloti 1021
MKAIVIHTAKDLRVEECAVEKPGPGEVEIRLAAGGICGSDLHYYNHGGFGTVRLKEPMILGHEVSGHVAALGEGVSDLAIGDLVAVSPSRPCGACDYCLKGLPNHCFHMRFYGSAMPFPHIQGAFRERLVAKASQCVKAEGLSAGEAAMAEPLSVTLHATRRAGEMLGKRVLVTGCGPIGTLSILAARRAGAAEIVAADLSERALGFARAVGADRTVNLSEDRDGLVPFSENKGTFDVLYECSGAQPALVAGIQALRPRGVIVQLGLGGDMALPMMAITAKELDLRGSFRFHEEFATAVKLMQGGLIDVKPLITHTLPLGEALKAFEIASDKGQSMKTQIAFA

SEQ ID NO: 3635 - protein, 409 aa, Yersinia pestis CO92
MLNGRAVDTSRRPLRKIKLSLMGPAFIAAIAYIDPGNFATNIQAGATFGYTLLWVVVWANVMAMLVQLLSAKLGIATGKNLAEHIRDRFPRPVVWAYWVQAEIIVMATDLAEFIGAAIGFKLLFGVTLLQGAVLTGIATFLILMLQNRGQKPLELVIGGLLLFVAAAYIVELIFSQPDIAALGRGMLIPNLPDGNAVFLAAGVLGATIMPHVIYLHSALTQTGGEESKTERYASTKFDVAIAMTIAGFVNLAMMATAAAAFHFNGYENIAEIEEAYITLQPLLGNAAATVFGLSLIAAGLSSTVVGTLAGQVVMQGFVRFYIPMWVRRIVTMLPSFIVILAGMDATQILVMSQVLLSFGIALALVPLLVFTGNKELMGELVDTKTTQILGKLVVLIVVGLNAYLLISLL

SEQ ID NO: 3636 - protein, 172 aa, Sinorhizobium meliloti 1021
MAPHSARRGIVLMGVAGCGKSAIGAALATRLGATYVDGDDLHPPENIARMSRGEPLTDDDRWPWLTLVGRRLAAPDGVLIIGCSALKRRYRDHIRNEAGAPVTFVHLSGTKVLITARMGARAGHFMPVSLIESQFAALEPPTTDENVITVDIDQPLEVLVDEIAVKLEETPS

SEQ ID NO: 3637 - protein, 508 aa, Synechococcus sp. WH 5701
MKLNKVEKAKAEACGLDLAPRLAELGAAGWESLAEATLTIHLKWLGIFFRPVTPGRFMVRLRLPNGVLSADQLEVLADVVDRCGEHGSADITTRQNIQLRGLLLEDMAPLMSALESVGLTSRQSGHDNPRNVTGNPLAGLDPEEFLDTRPLVDAIQEALLGPEGPRNLPRKFNVAVGGAPDSFLLHNDLAFLPAHHGGELGFTVMVGGFFSAQRNELAIPLGLWLRGELLPAFSLAVLRHYEREGSRENRNKTRLMYLIDALGLEDYRSQVLDTFAEFVGVEEAAATPSHDGSHLVSQAPRDICGVHAQKQEGLHWVGLHVPMGRLEAASMLELARLAREYGSGELRLSESQNALIANVPEGRLDALLVEPLLERYQVSPGPLQAEAVSCTGNRYCSFALIPTKSTAQAVVDELERRLELPHGVRTHWTGCPNACGQPYMGQIGLMGAKTRVDGQMVEAAKIFLGGAMDANPKLAALHDKGVPLSQLPDVLETLLVEHYGARPRTDAS

SEQ ID NO: 3638 - protein, 467 aa, Arabidopsis thaliana
MKALCDRFVPQQCSSSSKSDTHDKSPLVSDSGPSDNKSKFTLWSNVFTSSSSVSQPYRESSTSGHKQVCTTRNGWTAFVKRVSMASGAIRRFQERVLGPNRTGLPSTTSDVWLLGVCYKISADENSGETDTGTVLAALQLDFSSKILMTYRKGFEPFRDTTYTSDVNWGCMIRSSQMLFAQALLFHRLGRAWTKKSELPEQEYLETLEPFGDSEPSAFSIHNLIIAGASYGLAAGSWVGPYAICRAWESLACKKRKQTDSKNQTLPMAVHIVSGSEDGERGGAPILCIEDATKSCLEFSKGQSEWTPIILLVPLVLGLDSVNPRYIPSLVATFTFPQSVGILGGKPGASTYIVGVQEDKGFYLDPHEVQQVVTVNKETPDVDTSSYHCNVLRYVPLESLDPSLALGFYCRDKDDFDDFCLRALKLAEESNGAPLFTVTQTHTAINQSNYGFADDDSEDEREDDWQML

SEQ ID NO: 3639 - protein, 478 aa, Clostridium perfringens SM101
MIYEKLDNFRSDFLWGSASAAYQVEGGWDQDGKGKSIWDIYTKKEGTTYKNTNGDIAVDHYNRYKEDVSLMAEMGLKAYRFSIAWTRIYPNGRGKVNEEGLKFYENLIDELIKNDITPIVTLYHWDLPQHLQDLYGGWESREIINDFNNYCVTLFKRFGNKVKYWVTLNEQNVFLTLGYLTALHPPGVKDQKRMLQANHIANLANAKVIESFRKYVSNGMIGPSFAFNPNYAYSCNPQDVLAAENAEDLNCNWWLDVYCKGVYPTFALRYYERLGIAPIIEDGDLELLARVKPDFIGINYYQTTTVAMNSLDGVGASEGMNNTGKKGTTKESGIPGVYKNVKNPYLETTNWDWNIDATGLRTGLRRLTSRYGLPILITENGLGEFDKLEDNIVNDDYRIKYLKEHIIACKEAITDGVELLGYCTWSFTDLLSWLNGYQKRYGFVYIDRDENDEKDLRRIKKKSFYWYKDVISSNGENL

SEQ ID NO: 3640 - protein, 277 aa, Roseovarius nubinhibens ISM
MDHPKIPLAGVIGSPIAHSRSPQIHGHWLKKYGIKGFYIPMDVAPDNLDRVIRTLPQAGFVGVNVTIPHKEKVLEIADLITDRAALIGASNTLIFRKDGKIHADNTDGYGFMKNLESAGSNWQPGDGPAALLGAGGAARAVIAALLDAGVPEILISNRTRVRADALQEEFGKRLHVFDWVQAGNMMDDAKLVVNTTSLGMMGKQPLRVPLDGLRPGTLVTDLVYAPLKTRLLEVAEEMGCHTVDGLGMLLHQAVPGFERWFGTRPEVDRATRAAALA

SEQ ID NO: 3641 - protein, 102 aa, Glycine max
  misc_feature (59)..(59): Xaa can be any naturally occurring amino acid
  misc_feature (70)..(70): Xaa can be any naturally occurring amino acid
ASSPAAHLMGCLFRYRAGVLKRNGLKRSCGQPGTHARTWAVLSGVHSLVRGIVKRLRGXDDVINAGCAGXSTGLALSLPGAPLALVLSCLTLEALSLMMEGL

SEQ ID NO: 3642 - protein, 554 aa, Haemophilus influenzae R2846
MKGNTMKNINPTHTQAWKSLEAHKAELSNTTIQDLFKQEKNRFDDYSLTFNNQILVDFSKNNINQTTLSHLRQLAQECALDSAKEAMFTGEKINRTENRAVLHTALRNRTNTPVLVDGKDVMPEVNAVLAKMKDFCQRIISGEWKGYTGKAITDVVNIGIGGSDLGPYMVTEALRPYKNHLNMHFVSNVDGTHIAETLKKVNPQTTLFLVASKTFTTQETMTNAQSARDWLLKAAKNESAVAKHFAALSTNAKDVEKFGIDTNNMFEFWDWVGGRYSLWSAIGISIALSIGFENFEELLNGAHEMDKHFRSAPIEQNIPTTLALVGLWNTNFLGAQTEAILPYDQYLHRFAAYFQQGNMESNGKYVDRDGNVINNYQTGPIIWGEPGTNGQHAFYQLIHQGTTLIPCDFIAPAQTHNPLADHHNKLLSNFFAQTEALAFGKTKEEVEAEFIKAGKSLDDVKNIVPFKVFTGNKPTNSILVQKITPFILGALIAMYEHKIFVQGVIFNIFSFDQWGVELGKQLANRILPELTDSEKVASHDSSTNGLINQFKAWR

SEQ ID NO: 3643 - protein, 289 aa, Listeria monocytogenes EGD-e
MENRISGTTRLLGLIGTPIDHSKSPIMYNYSFQKAGLDYAYLAFDTPIQKVADTIKAIKTFNLRGANVTMPCKSEVLKHMDDLSPAARMIGAVNTIVNEDGKLTGHITDGLGFIANLRDASVDVAGKKMTIIGAGGAATAIQVQCALDGAKEITIFNIKDAFYDKAKQTVASIKQEVPNCIVHIYDLNDTEKLNAEITTSDILVNATLVGMHPNEHETPISDTSVFRKELIVADIIYNPKKTQLLLDAEAAGCKTVGGLGMLLWQGAEAYKLFTGKDMPVSEVKDLYFN

SEQ ID NO: 3644 - protein, 446 aa, Vibrio fischeri ES114
MFGFLRSTTSNDNTLSDTQVNESYRYWRLHIMIGMYIGYAGFYFTRKTFNYAAPAMITDLGLDKGDLGLIGTLFYISYGLSKFLSGTISDRSNPRYFMGLGLIATGLINIAFGFSSSLAAFISLWVLNAWFQGWGWPSCSKLLTTWYSRSERGFRWAIWNTAHNIGGALIPILVGYLTLHYSWREGFILPGIIGVAIGLIVCWRLRDKPTTMGLPSVGKWRNDPLELAQENHGQGLSYREILKTYVFSNKYIWLLAFSYVLVYIVRTAVNDWGNLYLTEEHNYSLINANAALSLFEIGGFVGSLVAGWGSDKLFGGNRGPMNILFAIGIFLSVSALWLMPLTNFVFQAAGLFSVGFFVFGPQMLIGMAAAECSHKDSAGAATGFVGLFAYMGAALSGYPLAVILETYGWTGFFITISTCAAVIGLLLLPFLQAQSPQKPIETRVRL

SEQ ID NO: 3645 - protein, 464 aa, Vibrio fischeri ES114
MLKFLDQVRKPTLDLPVEVRRKMWFKPFLQSYLVVFIGYLTMYLIRKNFNVAQNDMISTYGLSMTDLGLIGLGFSITYGIGKTVVSYYADGKNTKQFLPFMLILSGLAMLGFSFSMGGGSASLFMMVAFYALSGFFQSTGGPSSYSTITKWTPRNKRGSYLGLWNMSHNVGGAGAAGVALFGANYLFDGNVIGMFVFPSIIAIIVGFIGMRFGSDSPEAYGLGKVEELFDEEISEEDTAAEENQMTKKEIFVEYVLKNKVIWLLCFANIFLYIVRIGIDQWSTVYAYQELGLSKETAISGFTLFEVGALVGTLMWGYLSDLANGRRALVACVSLGLIIVSLEFYQHATSEFMYLASLFVLGFLVFGPQLLIGVAAVGFVPKKAISVADGVKGTFAYLIGDSFAKLGLGMIADGTPIFGLTGWKGTFAALDTSAAICIFLLVFVAIAEEKKIRHAKKMHLAAKQA

SEQ ID NO: 3646 - protein, 388 aa, Oryza sativa (japonica cultivar-group)
MMASSSSSSSLCDNHLLQDDLIPWPSMPFAPAPNTFGLNHQWSQPPMLSSSTDQLSSYELESLQSVESQLAAAAPPTLSPHLQAHQLSTVLMMQELGFQWSSCAAPADQHSIASSTNNNSNVMMNEEELRPRPDQSLISNPRSCSATTLLPPPHLHLDGAVLPSINVSRLQKLAAGDEPLQICCKRQAAAAAVVGHSSIRDEHVPCPYAGPPAHLIQGPSNTLQMKRNTNAAAQGRGGRHGSSTEHRSSTALPPSSKKPRLESHSSSMLPSFKVRKEKLGDRIAALQQLVSPFGKTDTASVLMEAIGYIKFLQDQVETLSGPYLRSSKNSKKLACRAAQQQRKGTSNGGDAAAKLDLRSRGLCLVPLSCTSYVTNENGVWPPPNFRGN

SEQ ID NO: 3647 - protein, 333 aa, Azoarcus sp. EbN1
MRRVTLTQFLIEQQRAGRTSPDLRLLIEVVARAVKAIAVNVSKGALADLLGEAGTDNVQGEAQKKLDVIANEILLQANEWGGHLAAMASEEVEEVHQIPFDYPKGGYLLLFDPLDGSSNIDVNISVGTIFSVLRFPEGIQEPNEQCFLQPGREQVAAGYALYGPSTLLILTVGNGVHGFTLDREMGSFVYTHPFMTVPVDTQEYAINASNARHWEPPVQRYVAELQQGRTGPRGKDFNMRWVASMVADVHRVLTRGGIFMYPLDEKCRDQGGKLRLMYEANPMAMIVEQAGGSATTGRQRILDVQPAKLHQRVPVILGSTHEVERVTAYHREG

SEQ ID NO: 3648 - protein, 724 aa, Synechococcus sp. WH 5701
MECDSRCTTCPVPAPAKAQCPYCGVGCGLELKPPAADANSPDLPDAAEAIWTVRGDRQHPSSLGQVCVKGATVAETLGRNRLSTPLWREQRDQPFQAISWERAFTILVERIQAIQAEQGSSGIAMYGSGQFLTEDYYVANKLIKGALGTNNFDANSRLCMSSAVSGYKLSLGSDGPPCCYDDLDLAGTVVLIGTNTAECHPVLFQRLLKRKRRQKDALQLIVVDPRATATSDAADLHLAIRPGTDLVLLHGVGHLLLQLGAVDPERVAATADGFAELAALWAGWTPERVCALCGIEEEALRRLAAIWAASAGVLSLWSMGVNQSVEGTATVTGIINLHLVSGQIGKPGAGPFSLTGQPNAMGGREAGGLAALLPGYRSIHEASHRAAIEQHWGFPPGAISERDGLSVWEQIEAMERGELGLWWVAATNPLVSLPWLDRVRQAVARCPLVVLNEAYAGTETEAVAHLVLPAAQWSEKAGVMTNSERRVTLSQAFRQPPGEARPDWSIFAEVGRRLGFAKQFAYGSSAEVYAEFAAITAGRICDHSGLSHDLLAEHGPQQWPFPAGTAPGGGQARLHTQGVYHTANGKARLLAQQPLGLGEPPDASFPLVLTVGRYLGHWHTMTRTIHVERVRRSHPEPLLEINPADAERCQLVDGGQARVSSRRGSLSVKVQITERIRPGTVFLPMHWGAAQEQACEANRLMHALGCPVSKQPELKAAAVQVERA

SEQ ID NO: 3649 - protein, 575 aa, Yersinia pestis CO92
MISGILVSPGIAFGKALLLKEDEIVINRKKISADQVEQEVERFKAGRAKAAEQLEAIKTKAGVSLGEEKAAIFEGHIMLLEDEELEQEIIALIKDEHASADAAAYSVIEGQAKALEELDDEYLKERAADVRDIGKRLLKNILGLNIVDLSAIQDEVILVATDLTPSETAQLNLDKVLGFITDIGGRTSHTSIMARSLELPAIVGTSNVTKQVKNDDYLILDAVNNKVYLNPTADVIEQLKAVKNQYITEKNELAKLKDLPAITLDGHQVEVVANIGTVRDIAGAERNGAEGVGLYRTEFLFMDRDSLPTEEEQFQAYKAVAEAMGSQAVIVRTMDIGGDKDLPYMNLPKEENPFLGWRAIRIAMDRKEILHAQLRAILRASAFGKLRIMFPMIISVEEVRELKAELELLKSQLREENKAFDETIEVGVMVETPAAAVIARHLAKEVDFFSIGTNDLTQYTLAVDRGNELISHLYNPMSPSVLGLIKQVIDASHAEGKWTGMCGELAGDERATLLLLGMGLDEFSMSAISIPRIKKIIRNTNFEDVKVLAEQALAQPTAKELMDLVTTFIEEKTLC

SEQ ID NO: 3650 - protein, 354 aa, Oryza sativa
  misc_feature (66)..(66): Xaa can be any naturally occurring amino acid
MTETNTTTGLHAGSAAARQQVAGEAVFPINDLKHVNRDWHSCRAAGRKKQQPPPPGMAFVPSEFAXAGVGRKRQPAPPVEIRRVWAHNVEEEFRIIRNAIDHFPYVSMDTEFPGVIHRPTKHPALLTAGDRYDLLRRNVDALHLIQVGITLAASPTAAPALAFEINLSDFDQRVHRHAAESVQLLAEHGVDLAAHRRHGVRASALAPLLMSSGLVCSHGAVKWVTFHSAYDFAYLVKLLMGRKLPRSMAEFLNLVRVFFGDEVYDVKHMMRHCGGELYGGLERVAAALQVKRAAGRCHQAASDSLLTWDVFRRMRELYFLKHGVEAYQGVLFGLELDMDMPSNKTPSLPLVAAR

SEQ ID NO: 3651 - protein, 671 aa, Zea mays
  misc_feature (110)..(110): Xaa can be any naturally occurring amino acid
  misc_feature (178)..(178): Xaa can be any naturally occurring amino acid
MFTCRCAVVVVVALAVLLLPAAATQLVYCDDSTYADNSTFQANLNLLSAALPANASASPAGFATGAVGTAPEQVNGMALCRGDTNASSWSSCVAAAFRYAQAQQGCLSHXGATVYLDDCTLRFAGIRFLDFLREDQWLVPELVPAIEPASGSVNATDAWFGAAVAGIFTALVDRAAGXNATRKYFATAEMDFDPKLYGLAQCAPDLTPAQCQGCLGDLQSRVTAQFLSGRPLGNNAFMVWCSLRYSVSPFYAGRAMLQLPAPPAPPPTSTPTLHSSGRKVNAAGISAGIACVVVLMLILSVFFFIRFRLRIKVKKNDHSLKKIGRAQCTIFDLLTLEEATEHFAEKNKLGEGGFGIVYKGILSDGQEIAVKKLLGRAGSGLDQLQNEVQVLAELQHKNLVGLQGFCSHHNDTLLVYEYIKNGSLDTILFDDREGNALNWEQQYNIIFGIAKGILYLHEDSSMRIIHRDLKANNILLDDNMEPKIADFGLARLLGEGHTHTQTGRVVGTFGYMAPEYASHGSVSPKIDIFSFGVLILEIVTRRSNCSSDDHSTVNLLSDVWDHWKKGTMPQMLHRSLDEFARSQALRCIHIGLLCVQPEPDDRPDISAVVFMLTRDSIELQPPGQPAFFFGRESPSALRLDGQSSYVYHRDGFKLGQGVSVNGVTLSELYPR

SEQ ID NO: 3652 - protein, 142 aa, Oryza sativa (japonica cultivar-group)
IFGIYMIKDKDNVTLDDVLQPGTDMLAAGYCMYGSSCTLVLSTGNGVNGFTLDPSLGEFILTHPNIKIPNRGKIYSVNEGNAKNWDAPTAKFVEKCKFPQDGSPSKSLRYIGSMVADVHRTLLYGGIFLYPADQKSPNGKLR

SEQ ID NO: 3653 - protein, 168 aa, Glycine max
MGGCVLKLVDSVLFLFFLLIAVVAPLIDAQTCLPLSYFPDILVQLKEQYTNDYGDYLVAEKPHFFVGLVWLELLFQWPLALLSLYAMLTSKPWFNTTCLIYGVSVTTSMVAILSEMMNSKRASEKLLTIYAPFLGLGVLALLRGLLTCSSKSSSALGKRSALARKKRA

SEQ ID NO: 3654 - protein, 472 aa, Oryza sativa
MAASPTGSSSSAPAAAAAAAMAAAAAAEATDGPTLSVVSKRLRALRKKHNRILQMEESLAGGRKLNKEQEGVLRSKPAVVALIDELERMRAPLAAALAEELSSRPAPSSSAAPPPPASSSAAGAADSSVVEDLLALIYFGTLFDLKPQTEFVATMVARAQERDCCITYDYVTEDAADLLHQSDLDKVSALAALAASRPAAAVGVSHRDALQSCAQHARLWLRRADEPIHPESSITYAAVRAKLDKIMASDYYTAQPEMPEMGAAVDLSAAVQESMVVSPEAPAVEESQAEGHKDEKEASEATEIYNDNQPNVADAQNVEDEAPVNPSEEFSAAEVEQEKFEADVEEQERNADQQFTSRRPYQNQRGGGGRGGGRRGYQNGGRGGRGGRGMGGGGYQNGRGGGGGGGYQNGRGGGEGGGYYYNEPGYYQQRGYSNRGRGGRSGGGNSYYNNQGGGSQGGGHAHPGRVELGANA

SEQ ID NO: 3655 - protein, 548 aa, Gloeobacter violaceus PCC 7421
MTSTFAPTPLTQRAAWQALAAHYEQIREIHLRALFAEDPSRGERFALEAEGFYLDYSKNRLTDETLRLLSVLAEESDLRGRIEAMFSGEKINTTEQRSVLHTALRAPRGATVIEDGENVVPEVHAVLDRMAEFADRVRGGEWRGYTGRRIRTVVNIGIGGSYLGPDMAYDALKHYSDRDLKVRFAANVDGSNFAEVIHDLEPDETLFIVCSKTFTTLETMTNAHSARQWCLAALGDEQAIAKHFVAVSTNAAEVEKFGIDTAHMFGFWDWVGGRYSMDSAIGLSTMIAVGPEHFRAMLAGFHAMDEHFRTAPFERNLPVLMALIGLWYNNFFGAQTLAVLPYDYYLGKLPAYLQQLDMESNGKHVDIDGQPVTYQTGPIIWGQPGTDGQHSFYQLIHQGTKLIPCDFIGFCQTLNPIAPHHDQLMANFFAQTEALAFGKTEAEVRAEGVADWLLPHRVFEGNRPTNTLLAERLTPEVLGKLIALYEHKVFTQGVIWNLDSFDQWGVELGKVLAGRIIPELESAEEPELAHDSSTNALIRRYRRAKRQN

SEQ ID NO: 3656 - protein, 255 aa, Solanum chacoense
MASPREENVYMAKLAEQAERYEEMVEFMEKVVAALDGEELTVEERNLLSVAYKNVIGARRASWRIISSIEQKEESRGNEDHVASIKKYRSQIENELTSICNGILKLLDSKLIGSAATGDSKVFYLKMKGDYYRYLAEFKTGTERKEAAENTLSAYKSAQDIANGELAPTHPIRLGLALNFSVFYYEILNSPDRACNLAKQAFDEAIAELDTLGEESYKDSTLIMQLLRDNLTLWTSDMQDDGTDEIKEPSKADNE

SEQ ID NO: 3657 - protein, 398 aa, Fulvimarina pelagi HTCC2506
MTFQFRTIDDADVTGKRVLVRVDFNLPMKDGKVTDATRIDRALPTIAELADKGARVILLAHFGRPKGKPNPEMSLKPIAPVLSDRLGKPVGFADDCIGPVAAGIIEMLKDGDVVLLENTRFHAGEEANEAEFAESLASLGDIYVNDAFSAAHRAHGSTEGIAHHLPSYAGRTMQAEIEALQAGLEAPEKPVVAIVGGSKVSTKIDVLTNLLDRVDYLVIGGGMANTFLAAKGVDIGKSLCEHDLADTARSVMSRAEEKGCEILLPTDAVVARHLRSGAPTETVPVEETPEDMMILDAGPLSLKAVVARLDLAKTLVWNGPLGAFEVEPFDEATVGAARHAAELTRAGKLVSIAGGGDTVAALNQAGVSDDFSYISTAGGAFLEWMEGKALPGVEVLKE

SEQ ID NO: 3658 - protein, 938 aa, Azoarcus sp. EbN1
MKTKATCPYCGVGCGVLIEHDGRRITGVAGDPEHPANFGRLCTKGATLHLSARPETRLLYPELRAARGLARERVGWDTAIATAAERFAATIREHGPDSVAFYISGQLLTEDYYVFNKLVKGLIGTNNIDSNSRLCMSSAVAAYKQTLGADAPPCSYEDFAQTDCLLIAGANPSYAHPVAFRRIEDAKAARPEMKIIVVDPRRTDTAATADLHLAILPGTDIWLYNAMLNVLLWEGYVDNAFIREHTEGFEALRDHVRDVTPAIAAEVCGLGRRGAEDIVTAARWWGEAKAAMSLWCQGLNQSTHGTHNGTALIALSLATGKIGRPGCGPFSLTGQPNAMGGREVGGMANLMSGHRDLANPEHRAEVARLWGVEDVPSTPGLTAIELFDAAYDGRIKALWIACTNPAQSLPEQERVREALARCDFVVLQEAYCNTETAPFADLLLPAATWGEKEGTVTNSERRITRVHRALTPPGEARADWRIVCDFAHELGPRIGKEAARLFPYAVPSEIFAEHAASTAGRDLDITGLSYDLLDSAGPQQWPFPKAANVVDAANRTRLYADGRFPTADGRAHFVVPTQALTAERADARYPLHLTTGRLRDQWHGMSRSGKVARLYNHVDEARIEMHADDLALRGLKSGDLVHVRSRRGDVVLRAEASSEIRSGQAFIAMHWGGNSLNSAGANALTLRDFDPYSKQPELKHAAVQVEKAVLPFQALIMRGEPGAAGDEEGSGNDDAAPIEIAGKVTAGDLMANAAGLALERAAALAPWLERFSYASLALAGRDHPAVVLRIAHHQPIPPEWLAELDALLGLDDEHCLAYSDTRRGITKRARIDDGLLVGLRLTGETAAAGWLRDVLVERQPTADLRRWILAPLANPPEAAKTRGRIVCTCLNVSESDIAAAIAGGAGFDDLQAKLRCGTTCGSCVPQIRRLVAAGQRAA

SEQ ID NO: 3659 - protein, 255 aa, Oryza sativa (indica cultivar-group)
MVLCSMRKSFKDSLKVLEADIQHANTLASDFSRDYDGACLQMRMSYSPAAQFFLFLVQWTDCSLAGALGLLRILIYKVYVDGTTTLSTHERKASIREFYAVIFPSLMQLHKGISDVDDRRQKAICTERYRRRDEDESKRHVSEIDVEREEECGICMEMNNKVVLPNCSHAMCMKCYRQWRSRSQSCPFCRDSLKRVNSGDLWMLTDDRDVIDMATITRENLRRLFMYIEKLPLVAPDNIFYAYDSHRMFLVVGCG

SEQ ID NO: 3660 - protein, 536 aa, Arabidopsis thaliana
  misc_feature (386)..(386): Xaa can be any naturally occurring amino acid
MNPPVDLPYIPDDLLLNCLARVSRLYYPILSLVSKRFRSLVASLELYEIRKLLGHREKCLYLNLRFSSESEPRWFTLCRRPTRSPNPNFNSGWFASCFIPHTMKKEKKSSDNNLMVPVPTSNFITPPSELTRITNGSNIYIVRVFTNGAFSSRFLFMDCRSHTLHEVPRMDKTKKKPFMIRVLDGKIYVIEGCKNPDYSNLIERFDLKTQTWEHVPSPSAEIRGSYITGSLVYDGKLYLFGDKRVVYKPKENKWDVVGLEMPLRWTPSYISCVVDNVIYSYGRSRVLMWYNTEERLWRYLKGLKKLPKLPKDCTCVRLLGYSGKVVVLWEKNVGGGDPQKKMIWCAEIALERRSANKIYGKIEWCDVVLTLPSSASVGKLAPVAVXNLVYKPKEKTWDVVGFEINFHWIPHDSFCVIDKVIIYYYNRHSRLLEWYDPEGSSWGILNGLEELLPKLPRVLVSRHVRLVDYGGKVAIFWEKEVRPLIGYNKITIWCAEIALERRNAQEIYGKIEWCNVVLTLPSSCSIDELNAVSIIV

SEQ ID NO: 3661 - protein, 376 aa, Oryza sativa (japonica cultivar-group)
MADEDIQPIVCDNGTGMVKAGFAGDDAPRAVFPSIVGRPRHTGVMVGMGQKDAYVGDEAQAKRGILTLKYPIEHGIVNNWDDMEKIWHHTFYNELRVAPEDHPVLLTEAPLNPKANREKMTQIMFETFNCPAMYVAIQAVLSLYASGRTTGIVLDSGDGVSHTVPIYEGYTLPHAILRLDLAGRDLTDHLMKILTERGYSLTTSAEREIVRDIKEKLAYVALDYEQELETSRSSSSVEKSYEMPDGQVITIGSERFRCPEVLFQPSLVGMESPGIHEATYNSIMKCDVDIRKDLYGNVVLSGGSTMFPGIADRMSKEITSLAPSSMKVKVIAPPERKYSVWIGGSILASLSTFQQMWISKGEYDESGPGIVHMKCF

SEQ ID NO: 3662 - protein, 176 aa, Gossypium barbadense
LFSFILILTHFLLKSSIRIQVLGWICVAISVSVFAAPLNIMARVIRTESVEFMPFTLSFFLTLSAVMWFAYGLFIKDLCVALPNVLGFILGMLQMLLYAIYRHSEKVNIEEKKLPAEQMKSINVVLTTLGASEVHPVVLDIHTDDTKEEDNKNNEPTGEPDKQTDVKMEDANESPV

SEQ ID NO: 3663 - protein, 548 aa, Yersinia pestis CO92
MGKTIVIVGGVAGGASAAARLRRLNEYDNIIILERGEYISFANCGLPYYIGGVITERDKLLIQTPEKMKDRFNIDVRTENEVVDIDSASKTITVINHKVGKEEFIQYDTLILSPGARPFIPDIAGLSVNGPVFTLRNMSDTDNIKAYLISATPEAVTVIGGGFIGLEMAENLVSSGLKVTIIELSNQILSPLDYEMAAIVEKHLKDNGIDVIKNDAVVQFDESAHQIHLKSGKIITTDMVILAIGVEPENDLAKKAHLDLGIRGSILVNEKLQTSVADIYAIGDAIQVVDYINGQATYIPLAWPANRQGRLLADIINGRDVRYHGTLGTAIAKVLDLSAACTGNNERLLKRLAIPYQVVHIHGMSHASYYPGAHQISLKLLFSPENGRILGAQAVGQGGTDKRIDVLATAIKGRLTIYDLPDLELAYAPPYSSAKDPVNMLGYVAENISNGDVMTKQWHEVDAFMADGGIIIDVRDEAEFISGSIKTAVNIPLSELRQKLALIPQDKKILVTCQVGLRGYIAARILSQYGYTVANLDGGYLTFNYANA

SEQ ID NO: 3664 - protein, 447 aa, Zea mays
MGAASPAMWAGLVLVVLLAVSGPAVAAGLPRFAEAPEYRNGEGCPAPVAGAGVCDPGLVHIAMTLDAHYLRGSMAAIYSLLKHASCPESLFFHFLAAAEGGGAPAASGLRAVVAASFPSLSFEIYPFRADAVAGLISASVRAALEAPLNYARNHLAGLLPRCVPRAIYLDSDVLAVDDVRWLWETRLPAAAVVAAPEYCHANFSRYFTDAFWDDPVLGARVFAGRRRAPCYFNTGVMVIDLRRWRVGNYRQRIERWMEMQKEKRIYELGSLPPFLLVFAGEIEAVDHRWNQHGLGGDNVFGSCRPLHNGPVSLMHWSGKGKPWDRLDAGKPCPLDHTWKAYDLYIGENDSSSSGPSRAATAAAASQLPPSAVQDSEFYTLRFVDPSQTLANVRFLCSPAVELEMQINLSFTLPFTGDGSSGSRPQECSRKGTYHLKLKHEKNIKAVF

SEQ ID NO: 3665 - protein, 273 aa, Glycine max
MSILPKGDSVQIREVWNDNLEEEFALIREIVDEYNYVAMDTEFPGVVLRPVGNFKNINDYNYQTLKDNVDMLKLIQLSLTFSDENGKLSTCGTESPCIWQFNFREFNVSEDIFASDSIELLRQCGIDFKKNSENGIDVNRFGELLMSSGIVLNDSVRWVTFHSGYDFGYLLKLLTCRSLPDTQAGFFDLIKMYFPMVYDIKHLMKFCNSLHGGLNKLAELLEVERVGVCHQAGSDSLLTSCTFRKLRDTFFSGSTEKYAGVLYGLGVESGQTN

SEQ ID NO: 3666 - protein, 126 aa, Oryza sativa (japonica cultivar-group)
MSAMETDINAPPPPAPAPAGAGEGSSSAAGPSSRKPNKRFEIKKWNAVALWAWDIVVDNCAICRNHIMDLCIECQANQASATSEECTVAWGVCNHAFHFHCISRWLKTRQVCPLDNSEWEFQKYGH

SEQ ID NO: 3667 - protein, 265 aa, Mycobacterium sp. JLS
MPTAVPNAFDLTGQVALVTGSSSELGIGFASARLLGQFGASVMVTGTTERAAERARELQSEGIAARSHVADLMDPEAARGLVEATEAAFGRLDIVVNNAGLASVHIPERPNPLMVMSDEEWRLALRRNVDSAFFVTRAALPGMVERGYGRIVNVASTAGILTAYTGDVGYHTAKAAMLGMTRSVAVDYARNGVTANVVVPGWIATAAQLPSEVVAGNATPIGRSATAAEVAAGIAFLAAPGASYVTGTTLAIDGANSIAGATAAE

SEQ ID NO: 3668 - protein, 487 aa, Burkholderia sp. 383
MNSHSLDLGGNAGGPASARPPAAAAGVDADASALPARRVTLGDFMDDLPVGALHRFVVWVIGIGLFFDMYEIFLVSTIGSALQNEYGLSRQSTDFKLLLASAFIGMFVGAMCLGSLADRIGRRKAFLLTLTWYSAFSLVGAFSVNADMLVACRFLTGIGVGAIYPVADSFLSEILPKEKRGRLAAWAYTTSYVAVPLVGFLALWLNPLHVGGVAGWRIILAIGSLGAVYVMLVQHRLPESPRWLLAQGRTADAHAALRRFAEGTGVRVPEQFAEPVEPQRPLGLGERIALLRREPYGARYLMLAIFHLFQGFGYYGFGTLAGTVVKSRGFDVTDSTLFIALSFIGYPVGSLLSIPLLNRIERRTLVIVSILSIAVFGLCFAYSGNTVLIVGFGFLTTCASNVFSNAYHVYQAEIFPARVRSTAIGSTYALSRIVSGVLPFVLLPVLASYGAGAMFGVISVALGIVAVTLRVLGPLTTRRSQDEINPV

SEQ ID NO: 3669 - protein, 1172 aa, Oryza sativa
  misc_feature (758)..(758): Xaa can be any naturally occurring amino acid
MATSLSSAPTQLRPSPSPSHHRLLHRSSLLPFPRRHHHRRRRCGALSIARASASAKDGVTVRRFPAAPTEGGRLAGVRKIMILGAGPIVIGQACEFDYSGTQACKALAEEGYEVVLVNSNPATIMTDPDLAHRTYIGPMTPPLVERIIAAERPDALLPTMGGQTALNLAVSLADSGALDRLGVRLIGASLPAIRAAEDRQLFKQAMDRIGLKTPPSGIGTTLEECISIAEDIGEFPLIVRPAFTLGGTGGGIAYNRAEFEDICRAGLAASHTQQVLVEKSLLGWKEYELEVMRDMADNVVIICSIENIDPMGVHTGDSITVAPAQTLTDKEYQRLRDYSVAIIREIGVECGGSNVQFAVNPADGEVMVIEMNPRVSRSSALASKATGFPIAKMAAKLSVGYTLDQIPNDITKKTPASFEPSIDYVVTKIPRFAFEKFPGSEPVLTTQMKSVGEAMALGRTFQESFQKAVRSLETGFAGWGCAPIKELDWDWEKLKYSLRVPNPDRIPAIYAAFKKGMRIQDIHEISFIDKWFLTELKELVDVEQFLISRGLDQLSKDDFYQVKRRGFSDTQIAFATSSSETDVRLRRLALEVAPTYKRVDTCAAEFEANTPYMYSSYEYECESVPTNKKKVLILGGGPNRIGQGIEFDYCCCHASFALREAGYETIMMNSNPETVSTDYDTSDRLYFEPLTVEDVTNVIDLERPDGIIVQFGGQTPLKLALPIQQYLEDKKLVSASGTGLVKIWGTSPDSIDAAEDRXRFNAILEELGIEQPKGGIARSESDALSIASEVGYPVVVRPSYVLGGRAMEIVYNDEKLIKYLATAVQVDPERPVLVDKYLIDAIEIDVDALADSVGNVVIGGIMEHILQAGIHSGDSACSLPTRTVSAKCLDIIRSWTTKLAKRLNVCGLMNCQYAITTSGEVFLLEANPRASRTVPFVSKAIGHPLAKYASLVMSGVTLPELGYTQEVVPKHVSVKEAVLPFEKFQGCDILLGPEMRSTGEVMGIDYEFSGAFAKAQIAAGQKLPLNGTVFLSLNDLTKRHLAEIGRGFRELGFNIIATSGTAKVLQLEGIPVEPVLKIHEGRPNARDMLKNGQIQVMVITSSGDALDSKDGLQLRRLALAYKVPIITTVDGARATIDAIKSLKNKSIETLALQDYFQTTDASQNLQAAQSAS

SEQ ID NO: 3670 - protein, 823 aa, Azoarcus sp. EbN1
MKKMKLVMIGNGMAGVRTLEELLKHAPDLYDITVFGAEPHGNYNRILLSPVLAGEMTLPEIMLNDLGWYRDNGITLHAGKRITKIDRVRRRVIAGDGTEAEYDRLLVATGSTPFIPPIPGKELPGVLAYRDIADTEAMIDAAARYRHAVVIGAGLLGLEAANGLMLRGMDVTVVHLADWIMERQLDRAAADMLQASLEAKGMKFLLAKQTDALVEGGGDKNNAGRVAGVRFKDGGEIPADLVVVAAGIRPNYALAESAGLHCGEGRVRGIVVSDTMQTITDPRIYAVGECVAHRGVAYGLVAPLFEQGKVCANHLANFGIGRYEGSVTSTKLKVTGIDVFSAGDFSGGADTEEIVLHDRQGGVYKRIVLRNNRIVGSVLYGDTADGAWYFQLMKDGQDIGAIRDHLMFGQNNLGDAGHKGENKAAAMPDSAEVCGCNGVCKGTIVKAIKEKGLFTIDDVKKHTKAASSCGSCTGLVEQILASTIGGAYQAVSVHDKAVCACTELSHGDVRKAIRDHKLLTIPAAMDMMAWKTPNGCATCRPALNYYLISTWPHEAKDDPQSRFINERAHANIQKDGTYSVVPRMLGGLTTPAELRRIADVAEKYQIPTVKVTGGQRIDLLGIRKDDLPKVWQDLGMPTGHAYGKSIRTVKTCVGSEHCRFGTQRSMAMGVDLERMLFGMWSPHKVKLAVSGCPRNCAESGIKDVGVIGVDSGWELYVAGNGGIKTEVAQFLCKVATREEVLEYSAAFLQLYREEGFYLERTVHYVHRVGLEHVKKRVVEDAVNRKALYERLLYAVQDYTDPWAERYAADAAQALRAQFETLEA

SEQ ID NO: 3671 - protein, 403 aa, Zea mays
MEPGLASRVARSAAQPLSGCLSRHSLSPWLKIQNHIYPMPSLCHKVPSTGKCHASMTTSYMETSDVTDLDWENLGFGLIETDFMYVAKCGTDGIFSKGEVLPFGPIALSPSAGVLNYGQGLFEGLKAYRKTDGSILLFRPEENAIRMLSGAERMCMPAPTVEQFVDAVKQTVLANKRWVPPTGKGSLYIRPLLIGSGAVLGLAPAPEYSFIIFVSPVGNYFKEGLSPINLIVEDKFHRASPGGTGGVKTIGNYASVLKAQKIAKGKGYSDVLYLDAVHDKYLEEVSSCNIFVVKDNVISTPAIKGTILPGITRKSIIEVAQSKGFKVEERLVCVDELINADEVFCTGTAVVVSPVGSVTYMGKRVEYGNQGVGVVSQQLYKSLTSLQMGNVEDWMGWTMQLNQ

SEQ ID NO: 3672 - protein, 401 aa, Glycine max
MEGKLSRAAKKITSSSIQELSQLAQRCNAINLAEGFPDFPSPPHLKNAAVSAINSDFNQYRHVQGVCDLLAKMVKQMHGLDIDPVTDVAICCGQSEAFAAAIFATIDPGDEVILFDPSYETYEGCVAMAGGVPIHVPLDPPQWTLDPSKLLRSFTEKTKAIVLNSPHNPTGKVFTKEELEIIAGECCSRNCLAITDEVYEHITYDNLKHISLASFPGMLERTVITSSLSKSFSVTGWRVGWAIAPAFLASAIRNIHGRVTDSAPAPFQEAALTALRSPPEYFESLRRDYQSKRDYIIKLLDGVGFKIVFIPQGSFFLFAELPDNWLLSDVEFVKKLIIEAGVVAVPGQGFFHTNLSSNEVSSLNYQKRYVRFAFCKSDTTLTTVAERLGKLLDAAGHLALH

SEQ ID NO: 3673 - protein, 372 aa, Robiginitalea biformata HTCC2501
MKLKIALLPGDGIGPEVAAQAVACLQAVEEAFGHQFEFTKAPVGAIAIDQTGNPLPDDTLELCKQSDAVLFGAIGDPKYDNDPESKVRPEQGLLRLRKELGLFSNIRPVKVFPTLIDKSPLRKERIENTDFVIYRELTGGIYFGEKFLSEDGNTASDLCIYSEEEISRIAHLAFKAAKGRRKKLTLVDKANVLESSRLWRRVVTRIGESYPDVELHYLFVDNAAMQMILNPSQFDVILTENMFGDILSDEGSVIGGSIGLLPSASVGESSAMFEPIHGSYPQATGKNIANPIASILSAAMLLDHFGLDEEAAAVVRSVNKALKKGMVTPDLDPKSKHGTDDVGQFIAGHISDSDDFKGLNQENIGLGKSTII

SEQ ID NO: 3674 - protein, 255 aa, Listeria monocytogenes str. 4b H7858
MEIPMIICANFEIYFKIKAPTAQKSKKRKVRKKQDIQRTIITTSLNLEGGNYMYKAIIFDVDGTILDTERAVLHSLQAVLAEEGLSYELDELRFVLGITGAAAVEQLNILDPEKVLDKWIEREATFIEEVEVFEGIHKVLHAIPESGVVTSKNALEMEKGFYPFNIQDHFQAIVCASDTENHKPHPDPLLKGLEILGREPHEVLYVGDSSYDMKCAHAAGAHFGLALWGAKTTDGFEKAELVFEKPEDILAYVSK

SEQ ID NO: 3675 - protein, 470 aa, Acidithiobacillus caldus
MTRLLIIGGSDAGISAALRAHELDPQTEVSVLLADEYPNYSICGLPFYLSGETPDHRQLAHRTAFDGIEILTNHRAVSVHPAAKTVDVVRGANGSVKTLRYDHLVIATGAVPVRPQGLPGLDLPGVYLLHTMGDGFAVHSRLMGGETRSAIIIGAGYIGVEMADALRHRGIDVTLVSHTDPVFPSVDPSFGRLIGEELSRHGVRVVVGCTVERIEAADNRRGLTVSGSGGFTASADLVLVATGARPDTTLAAAAGIALGPSGAIRVTQRMETTLPGIWAAGDCAETWHRILQRPAYLPLGTTAHKQGRVAGENAVGGERLFAGSVGTQTVKVFELAIARTGLREAEARTADFDPVTIETETWDHKAYYPGAQKLRVRVTGDRRTGRLLGAQILGPWRSEVSKRIDVFATALFHGMGVEDLNDLDLSYTPPFGSPWDAVQMGAQAWTSVMKNEVASCSPPIDPQILGRSTP

SEQ ID NO: 3676 - protein, 423 aa, Arabidopsis thaliana
MDGVSSLPNELLCHILSFLTTKEAALTSILSKRWRNLIAFVPNLYIDDTVFLHPEEGKRDRPEIIQSFMDFVDRILALQGNYPIKKCSLKCLTEVDSVRVDAWISNVLARGVTDLDLLIILDSRVDNFDILLLALPALEELALVDVIWKDEDVIVSSPSLKTLTIYDIYCFSNLSFDTPSLVYFKYYGCVPQDYPLVNMKNLFDARIIFMLQLPGAREPDDDHWFDQNVALRYSNVWKLFLGLQNVPNLYLSPDTLKVLSLYCESMPVFKNLKSLAIKSGKERGWQAIPVLLRNCPHLETLVIEGVLHNVTDKCGDACDCISREDKGRSLTSCPVKMLEIRGFRGTMKEMTMMKHFLDYFLCLKAMNIYVEENDPTELRFPEVSKCIMQMMEEYNKLSSCNVELLVTDYFYFSEKWTAKGRIL

SEQ ID NO: 3677 - protein, 397 aa, Streptomyces coelicolor A3(2)
MLGIVLAGGEGKRLMPLTAARAKPAVTFGGTYRLVDFVLSNLVNGDILRICVLTQYKSHSLDRHITTTWRMSSLLGNYVTPVPAQQRLGPRWFLGSADAILQSLNLVHDEQPEYVAVFGADHVYRMDPRQMLAQHIESGAGVTVAGIRVPRAESPSLVITPGSDGQTVTGFLEKPPNPPGLGHDPGCVFPSMGNYVFTTKALVEALHRDAEDPDSVHDMGGSILPQLTDRGEAALYDFSANHVPGETTRDQGYWRDVGTLDAYYDAYMDLIAERPAFNLYNRDWPVYTHSTQLSPARFNAGGIASESIISAGCLIRGQVTRSVLSPGVVVDPGAVVQGSVLHNVHIGRGAVVRGAVLDKNVQVPPGATIGVNPQRDGELYTVSKGGVIALGKGQRVP

SEQ ID NO: 3678 - protein, 319 aa, Glycine max
  misc_feature (113)..(113): Xaa can be any naturally occurring amino acid
  misc_feature (224)..(224): Xaa can be any naturally occurring amino acid
  misc_feature (226)..(226): Xaa can be any naturally occurring amino acid
MAILIACFPFLGIFFLTLRQTYVKGKASSLAAPALSPEPGWEVLDACAAPGNKTVHLAALMKRKGKIIACELQRERIKRLKDTIKLSGASNIQVLNDDFLNQNPKDPSYSKVXAILLDPSCSGSGTAASRLDHLLPSKAAGQDTDTERLNKLATFQRKALQHALLFPAVERIVYSTCSINQIENEDVIKSVLPIAESNGFQLAKPFPEWQCPVSTSVEGSECPXRXDPAKHGEGFFIALFTRKDATFQGDQIKMKLEFPTALPKLKTREERRNVYRLLAQTHSKRGYMIVKLLSLGGRIEGIKEVAKDIILYFTLLMSV

SEQ ID NO: 3679 - protein, 339 aa, Desulfovibrio desulfuricans G20
MKKVRVGINGFGRIGRQVLKTIWERHRDTVDVVAVNDLFDINTNAHLLSHDTNYRGFAPEVSVDGDIMRVGGDFVIKNYAERDPRAIPWGAMDVDIVIESTGIFTSGPKAAMHLEAGAKKVVISAPAKEEDITVVLGVNHQDYDPAKHRIISNASCTTNCLAPVVKVMHENFGIQKGVMTTVHSYTNDQRILDQPHRDMRRARAAACNMIPTSTGAAKAVALVIPEMKGRFEGYSVRVPTPTVSLVDFVAILERETTTEELRATLKNAAQGSLNGILGYSELPLVSSDFIGDPHSGIVEADFTLVQTGNLAKVYVWYDNEWGYSCRVADLVEYMRERGL

SEQ ID NO: 3680 - protein, 158 aa, Acidithiobacillus caldus
MKVRDLMTPNPIQIAPETAVAEIARILIEHRINGVPVTDTEGRLLGIVTEGDLVHRAADERLEPRESVWKENFYRSVFRRRTPETDKTEGRTAAQVMTREVLTVAPEDHVTVAARLLADHNIKSLPVIENERLIGIISRFDLIKRLASNRGFNPMSKD

SEQ ID NO: 3681 - protein, 455 aa, Yersinia pseudotuberculosis IP 32953
METTLMTKHYDYLAIGGGSGGIASINRAAMYGKKCALIEAKQLGGTCVNVGCVPKKVMWHAAQIAEAIHLYGPDYGFNTTVNHFDWKKLIANRTAYIDRIHQSYERGLGNNKVDVIQGFARFVDAHTVEVNGETITADHILIATGGRPSHPDIPGAEYGIDSDGFFELDEMPKRVAVVGAGYIAVEIAGVLNGLGTETHLFVRKHAPLRTFDPLIVETLLEVMNTEGPKLHTESVPKAVIKNADGSLTLQLENGTEVTVDHLIWAIGREPATDNLNLSVTGVKTNDKGYIEVDKFQNTNVKGIYAVGDNTGAVELTPVAVAAGRRLSERLFNNKPDEHLDYSNIPTVVFSHPPIGTIGLTEPQAREKFGDDQVKVYTSSFTAMYSAVTQHRQPCRMKLVCVGAEEKIVGIHGIGFGMDEILQGFAVAMKMGATKKDFDNTVAIHPTAAEEFVTMR

SEQ ID NO: 3682 - protein, 310 aa, Aeropyrum pernix K1
MLEHLVQAVAVGHALVDLRLYVERIPGVDEEAVIKDETRSVGGSAANVAVVLRRLGVQSGIIGKIGLDDFGRIAVDNLMREGVDISGLRVSLRDRTGFSVVVRDKEGSITIYSFKGAAEKLEPGEIDADAIGRSKHVHVASLRPDTTLKTVEIAKKRSITVSWDPGRVLSKMGAERLANIISKVDIIFVNRNEAKNLTGYHDYRQAARHLKKLGPKIVVIKLGASGSYILYSDGEVFVPAIKPERVVDTTGAGDSYAAGFIAGLLRGYTIEKASLYATIVASIKVSRLGSNAAPSHEEVVEKARELGVEI

SEQ ID NO: 3683 - protein, 200 aa, Mycobacterium sp. MCS
MTAWKALKEGNERFVAGRPEHPSQSIDYRASLAEGQRPTTVVFGCGDSRVAAEIIFDQGLGDMFVVRTAGHVIDSAVLGSIEFAVTVLEVPLIVVLGHDSCGAVKATLAALDEGVVPGGYVRDIVERVTPSILLGRRDGLSRVDEFEERHVNETAVQLRDRSSAIASRIEAGKVAIAGVTYHLADGRAQLRAHLGDIGEA

SEQ ID NO: 3684 - protein, 341 aa, Oceanobacillus iheyensis HTE831
MNTKRIAITGFGRIGRMIFRQAIQNDQFEVVAINASYPAETLAHMVKYDSVHGIFDGDVKALEGYLEIDGKKVEIVNNRQPELLPWKKLDIDIVIEATGKFNSKEAAGLHIKAGAKKVIITAPGKQVDKTIVMGVNEAAYIPESDDVISNASCTTNCLAPVVKVIDDHFTIKNGLMTTVHAFTNDQKNLDNPHKDLRRARGCTQSIIPTTTGAAKALGEVLPHLNGKLHGMALRVPTPNVSLVDLVIDVEENVTVEQLNQLFKDASKGYMKGVLEYSDEPLVSIDYTTSDFSAIIDGLSTIVMEGKKIKVIAWYDNEWGYSKRVLDLALYVGDRLKKEMKV

SEQ ID NO: 3685 - protein, 565 aa, Shewanella sp. MR-4
MSEQKLALNEYLKTDSDYLRGTIKEGLDSSVTGSFSDGDQQLIKFHGFYQQDDRDLRNERKEQKLEPLYSFMLRARVPGGVCTPKQWLGVDEIASTLTSSNSIRLTTRQTFQYHGIPKRNLKTIIQGLDREALDSIAACGDVNRNVMCNPNPVESKLHAQAYEVAKKLSDHLLPHTRAYAEIWLDEEKLLTTEDETVEPVYGKTYLPRKFKMAVAVPPDNDVDVYTNDLGFIAVAENGELVGFNLTAGGGMGSTHGEVETFPRLADDFGFIKTEDVMKFAEAVMTVQRDWGNRTNRKRSRLKYTIVDHGYEKFKAEVEARAGVKFEPKRDVVIGDRGDRYGWVEGVDGKWHLTLFIESGRIKDVPGKSLQTGMREIAKIHKGDFRMTSNQNMIIAGVAPEDKATIEGLARKHGLLGQVLTQTRGHSIACVALPTCPLAMAEAERYFPEFIDHIDALQAKNGISDQAIVVRMTGCPNGCARPFAAEIGLVGKAPGRYNLYLGANFEGTRLNKMYRENIQEAEILAELDALFARYAIERNAGETFGNFTVRTGVVKAVIDAAKDFHG

SEQ ID NO: 3686 - protein, 808 aa, Robiginitalea biformata HTCC2501
MKISYKWLRQFIEMDWPAEKTAELLTDLGLEVEGITPFESVPGGLKGIVVGEVKSCEKHPNADKLSLCQVDIGTDKPVQIVCGAHNVAKGQKVPVATIGTTLYTADGEPWKIKKGKIRGEASHGMICAEDEIGLGDSHDGILVLDTDAAPGTPCAELFRLEEDEVFEIGLTPNRADAMSHYGVARDLRAGLKQQKISKELITPSVSNFHVDNRSGRIEVQVEKPELAPRYCGVTISNLIVQESPDWLRNRLRAIGLSPINNVVDATNYVLHELGQPLHAFDADRIHGKKILVKTVKAGTKFMTLDGEERILHEEDLMICDAEKPMCIAGVFGGINTGVTMDTRNIFLESAYFDPVSIRKTAKRHGLNTDASFRFERGIDINNVEYALLRAAILIRDIAGGEISSDAVDLYPKKMPDHNVFLTYEKIYRLVGTEIPRDTVISILASLDIQVKSVTESGLGLVIPFYRVDVRREVDVIEEILRVYGYNNIPDKSQFTASIEPPAGVAPHKLQDRISGRLAALGFDEILGNSLCNPAHNALLGGDPEGEVALMNPLSQELSALRRDLLFSGLGAISHNLNRRQQDLRLYEFGQIYSREGTQWEERERLALLLTGNQHPDHWENTAKPQGFFDLKAVVAHVLDSLGAGPREEMPVTDQRFSEALEISMGKRAVVRLGSVHPDILRAFDIRQEVLYADIDWPLLLQRVQGAEISYTEIPRHPEVRRDLALLLDESVSFRQLHDLALKTNRKILRDVRLFDVYTGDKLPAGKKSYALSFFLQDPKKTLADKQIDSVMGSLQKAFEKELGAELRG

SEQ ID NO: 3687 - protein, 621 aa, Zea mays
MSPNLDSAIKSQVPALLLRRLFGASRRDEAKQLQRTPAPVGRRRVFVQTETGCVLGMDLDRGDNAHTVKRRLQLAFNMPTGGTSLTFGDRVLENDLSFLRPDSPLLLTRNSINRSCSTPCLCPVSKDFEHKDCSGLVEMLGCSSSCARVKRLVDDVVTAIRSGVDPVPISSGLGGSYYFRNVLGDRVAIVKPTDEEPFAPNNPKGFVGRALGQPGLKRSVRVGETGFREVAAFLLDHDNFANVPATALVKITHSIFNINCPVNGGNLAPAHDQQQQVNSKIASFQQFIAHDFDASDHGTSSFPVAAVHRIGILDIRIFNTDRHAGNVLVRKLNGGTGRFGCQTELFPIDHGMCLPENLEDPYFEWIHWAQASIPFSEEELEYIRNLDPRKDVQMLRRELPMIREACLHVLALCTIFLKEAAAFGLCLAEIGEMMTREFRGMEEEPSQLELMCMEARKRVAEWEPFSATAEHGEDTDFQFSVDMLGEYSDVVRSPRFNGSGSKVSSFRSPLSKLVESVDEGSDGHEDQNESDRVLYAGWNTSSVPSKAMGHSGNASKSAMNRSADEQLPSSMCFVRLSDMSADEWDVFLEKFQELLKETLHESARAAAGQRMKQRLGTSCKF

SEQ ID NO: 3688 - protein, 392 aa, Neisseria meningitidis FAM18
MAFLKLTEQNVQGKTVLIRADMNVPFKDGKISDDTRIRASLASIQYCMDNGASVIVMTHLGRPTEGEFHPEDDVAPVAAHLGGLLGKNVKVLNDWRENKPALNAGDVVMLQNVRINKGEKKNDLELGKAYASLCDVFVNDAFGTAHRAQASTEAVAQAAPVACAGVLMAGELDALGKALKQPARPMVAIVAGSKVSTKLTILESLADKVDQLIVGGGIANTFLLAEGKAIGKSLAEHDLVEESKKIMAKMAAKGGSVPLPTDVVVAKAFTADAEAVVKDIADVAEDDMILDIGPKSAAELADLLKAAGTVVWNGPVGVFEFDQFAGGTKALAEAIAQSKAFSIAGGGDTLAAIAKFGVTDQIGYISTGGGAFLEFLEGKELPAVAALEKRGA

SEQ ID NO: 3689 - protein, 261 aa, Brassica napus
  misc_feature (245)..(245): Xaa can be any naturally occurring amino acid
MSVVDYEADIYLDARPTYPADWYSKLAALSPHHHLAWDAGTGNGQAATGIAEHYDRVIATDVSETMLHLGKPHRKVTYHHTPSSMTEDEMVDLIGGENSVDLITVATAVHWFDLPRFYAIAKRLLRKPGGIIAVWSYTTEMAVSPEFDPVMTRFTEKTMPYFKFPECQYVVDGYKSLPFPFESVGLGSEGKPMELEMKRTVSFEGFLRMVRSWSAIGAAKEKGVELLSEDVVKELETAWGGSELXRTIVYKTFMLAGTVRN

SEQ ID NO: 3690 - protein, 620 aa, Synechococcus sp. WH 5701
MIDTPSSTADVIEGLLADLHRRYSLLEDGAPADYIPELAKANPSDFGISITTVDGRVYEVGDTRKPFTIQSISKPFAYGLALKLFSGEYLATKVGVEPSGDAFNAISLDQKTGRPRNPMINAGAIATTAQIWNHDPHQAEALMLDFFSELAGRRLSIDQAVFQSERATGHRNRAIGHLLRNFGIIEDDPEDSLDLYFKQCSITVTCHDLAVMAATLACQGHNPFTGARPLTPEITVRMLALMATCGTYDFAGQWLYDVGMPAKSGVGGGVLAVVPGRLGISTYSPPLDVLGNSVRGIAVCNELSDSLGLSLFNQYPQTSSTIRRSYKGSQRQSRRWRAADQAKLLQGRRDAVRIVHAQGVLDFAAIERLLSELSEIMSDAWILVLDVAHVTELPEESRELFLNELTSLRRRGVIVLMARGRHLSLPRTLSVAGGVEEMPQFDQLDQALECAEDLLLESRKDEDPDPPFSTEIDQTLGFLGMLQPTHRQTLADLMQCRNFAKGEHVVKKGDPGHELFLVREGRFTITVELRGSDGQTYASRLATFEPGMCFGEIAFLSGTPRTANVTADLDGSCWVLERHDFDNLRQWEPDAVTELLLALTRDLGTKLALTSYQLTLMEHL

SEQ ID NO: 3691 - protein, 615 aa, Saccharomyces cerevisiae
MSSISLKEIIPPQPSTQRNFTTHLSYDPTTNAIAYPCGKSAFVRCLDDGDSKVPPVVQFTGHGSSVVTTVKFSPIKGSQYLCSGDESGKVIVWGWTFDKESNSVEVNVKSEFQVLAGPISDISWDFEGRRLCVVGEGRDNFGVFISWDSGNSLGEVSGHSQRINACHLKQSRPMRSMTVGDDGSVVFYQGPPFKFSASDRTHHKQGSFVRDVEFSPDSGEFVITVGSDRKISCFDGKSGEFLKYIEDDQEPVQGGIFALSWLDSQKFATVGADATIRVWDVTTSKCVQKWTLDKQQLGNQQVGVVATGNGRIISLSLDGTLNFYELGHDEVLKTISGHNKGITALTVNPLISGSYDGRIMEWSSSSMHQDHSNLIVSLDNSKAQEYSSISWDDTLKVNGITKHEFGSQPKVASANNDGFTAVLTNDDDLLILQSFTGDIIKSVRLNSPGSAVSLSQNYVAVGLEEGNTIQVFKLSDLEVSFDLKTPLRAKPSYISISPSETYIAAGDVMGKILLYDLQSREVKTSRWAFHTSKINAISWKPAEKGANEEEIEEDLVATGSLDTNIFIYSVKRPMKIIKALNAHKDGVNNLLWETPSTLVSSGADACIKRWNVVLE

SEQ ID NO: 3692 - protein, 798 aa, Kineococcus radiotolerans SRS30216
MATGASMQPGSFTPGYGAVDLTTCEREPIHIPGAIQPHGVLLAVERGDHRVVVASANAAGFFGRPLPEVLSSSLADLLGADLTERVRGADLLDNLDEVLHARLPGPGGSAGADAVEADVVLHVSGERLVVEIEPSPPHTAPVSYRATRGAIARLAGTRGIEGLCERLVREVRVLTGFDRVMAYRFDAQWNGEVIAEDRREDLDTFLGLHYPASDIPAQARRLYTLNWMRLIADVDYVPSPLHPLLDPGTGAPLDLSHSVLRSVSPIHVEYLKNMGVGASMSISLIVEGRLWGLVACHHYSGAHRPGYDAQSAAEFLSQTASQLIGERARSQERDGALAAQELLSDITAAVSASGREPLTTLIEEPRLLQLLDAGGAALWTGHELLTSGQVPPSAQLRRIAALLARADGAPTFTDHLPTLDPGLAEVAQTAAGALRVGIDGTGWLLWLRPERPRLLDWSGDPHHAEITRVEGLEVRISPRKSFEKWSEVVRGRSTTWRSWHAATADRLRTQVTGIMLGRSRGQIAIAESLQRAVVLDEAPHVPGVEVLARYRPAEGSQLGGDWWDVLPLEAGRVAIVVGDVAGHGVHAAAAMAQLRTALRAYLLEGHSPASALDRLDTLVSTLLGNHTATALIAVVHPAGDHADGGGVDPGRDPGPRVDDGAATIELASAGHLPPLLVDAAGTSVVHVPSRPMLGLGFGPTAGLVSESVRAPLPPGAVLLMYTDGLVERRDAGLEETTGVLAETATRAAADLLPRSRGGMAAVADRLLTAVPGDAGDDTTLVLVRPAHPAAEPAARTEG

SEQ ID NO: 3693 - protein, 1384 aa, Mycobacterium tuberculosis CDC1551
MSFVLVSPETVAAVATDLKRIGASLAHENASAAASTTAVVSAAADEVSTAVAALFSQHAQGYQAAAAQVAAFHSRFVQALTAGAGAYAFAEAANASPLQSAMGAVSASAQTLLSRPLIGNGANATTPGGNGGDGGWLFGSGGNGAPGAAGQSGGNGGSAGLWGNGGAGGAGGSGGAAGGNGGNGGWLFGAGGTGGIGGTGAPGAMGGTGGNGGNGALLIGGGGLGGAGGMGGTGGGTGGTGGNGGNGALLIGAGGVGGAGGIGGQGTGAGGAAGAGGTGGNGGAGGLFMNGGDGGAGGQGGDGAAGDAAASAGGTGGKGGQGGDGGTGGAGGAGPVLFGHGGAGGMGGQGGTGGMGGAGGDGTTVIAAGTGGEGGTGGAAGAGGAAGARGALTSGGLAGGVGAGGTGGTGGTGGNGADAAAVVGFGANGDPGFAGGKGGNGGIGGAAVTGGVAGDGGTGGKGGTGGAGGAGNDAGSTGNPGGKGGDGGIGGAGGAGGAAGTGNGGHAGNTGDGGDGGTGGNGGNGTGGVNGADNTLNPDTPGGAGEPGGAGGAGGAAGGPGGTGGTGGNGGNGGNGGNGGNGGNGGNGGNAGNNSTNAPVGGEGGAGGDGGAGGAGGAANGGTAGSQGTGGVGGDGGAGGNGGGGKAGTGNSGNFGVDGEAGFSGGAGGNGGVGGAAGANGGTGGSGGNGGDGGAGGIGGAGGNGIPGTGTEPAGGTGAKGGDGGDGGAGGAGGNAGGAGGNGGAGGQGGNAGQGGAGGAGGNAVIPGDGVGKAPHGDAGGSGGDGGKGGQGGSGGTGGSGAPIGGGAGGTGGSGGHAGKGGAGGIGAQGTTITVPGNGGNAGDGGNAGAGGNGGSGDFGGNTTSGASGSGGNGGNAGTAGSGGAGGTGGTGLSGGNGGNGGNGGNGGDGGNGAHGTVGAQFVPATSLPTPNGGAGGNGGTGSNGGAPGPAGAPGPTTGGNAGSQGIGGDGGNGGDGGKGGDGADAVNVVFMPTEPQAATGTAGSAGDPTGGNGGPGTPGSPMVAPPPPTPITQVQQGGDGGAGGTGSTNANDGTATGGKGGEGGVGSILGGPGGNGGTGGNASATGTNGVANAGNGGKGGDGGQFGAGGNGGAGGSVTDGSAGSTAGNGGNGGNATNGTIAGQPAGGNGSAGGKGGDGGNIAAGATGTAGNGGNGGNGNDGAVNAGTGGSGGNGGNAGGGGANGGDGGAGGAGGAGGRGGKGIDGGFGGDGGNGGSNNGTGAGGNGGNGGTGGVGSVGAAGGDGGNGGTGGFAGFGGTAGNGGSGGTGGAGGDGGTGGDGGNGGTGVIAGGGGTGGNGGASGAGGAGGTGGFAGNGNAGGNGGTGGASEDGDNGNAGSGATGGTGGNGGTGGDGGAAGLGGVA

SEQ ID NO: 3694 - protein, 468 aa, Arabidopsis thaliana
MTSSEPLDLVVTVVSAKHLKNVNWRNGDLKPYVVLYLDQDHPLSTRSDDSSSIKPVWNERITLPLTRSVHESVLNIEVFHSNSSDLAKTLVGSVRFPLARLIDSDGSMIPELINSLELVRPSGRPQGKIRLKLAIKDRPIPPPQHPPPRPQSQPLDYYSAPQGNHYYSPSPPPPPPPQAPITAPSPQRDYREFSQSPSPSPYAFTDHYYSGYYYPPPPPRSMYDRASNYGLPSGPSAPVDAFSSIDHKQPPLAPPRFSNYGPPPSGPSAPVDAFLVTEYKPQAPPMGSRLSSYGVPNGPSAPVDYSPYDHRQLQKTMGGLSLEEERAAAESRRLMKGICIHKATGIKRSNLNTRPVQRDASAKQTAIKGPYGKSPGCTTSCGLRLPRKTEVTAAKLIKHLGCKFAKGLRLVVMRKKKRSPPSKVSSFSGRSQPPIIPINNDSHRSEAIEDCIQFINSSSSFTRSNSTS

SEQ ID NO: 3695 - protein, 358 aa, Mannheimia succiniciproducens MBEL55E
MHCLLSELKENRVKSTALFLFNYIKNCIMTTTNNLMDIKTIQALVSDDMQKVNEEILAQLNSDVPLINQLGYYIIHSGGKRIRPMIANLAAKALNYQDNKHITCAAFIEFLHTATLLHDDVVDESDMRRGNPTANAEFGNAASVLVGDYMHTRSFQMMTELGSLRILQVMSAATNVIAEGEVQQLMNVRDPDTTEQNYMKVIYSKTARLFEVSTQTVAILADAGAAIEEGLQNYGRYLGTAFQLVDDILDYSANAATLGKNIGDDLAEGKPTLPLLHAMRHGNPQQAELIRNIILQGGNRDALDEVLTIMHEHKSLDYAMEHAKQEAQKAVDALAPLPDNIYKRAMISLAYLSVDRAY

SEQ ID NO: 3696 - protein, 373 aa, Oceanobacillus iheyensis HTE831
MTASTKGLEGIVATQSSISSIIDDQLSYVGYRIDDLAENSSFEEIIYLLWNQKLPNKSELDELKSQLAENMDIPDAIINHLRSYDLNTVHPMAALRTAISLLGLYDNEADVMDEQANKRKAVRIQAQIATIVTTFSRIRKGQEPVKPKKDLSYAENFIYMLNGKEPEDIEVEAINKALVLHADHELNASTFTARVCVATLSDIYSGITAAIGALKGPLHGGANENVMKMLTEIGEEENAIPYIKEKLANKDKIMGMGHRVYRTGDPRAKFLREMSKELTKLTGQEKWYNMSVKIEDYIKENKGLPANVDFYSASVYHSLGLDHDIFTPLFAVSRTSGWIAHILEQYENNRLIRPRAEYTGPELRDYVSIEQRG

SEQ ID NO: 3697 - protein, 319 aa, Oceanobacillus iheyensis HTE831
MKRIGVLTSGGDSPGMNAAIRAVVRKAIYHDLEVYGIKNGYQGLMDGNIEKMTLGSVGDIIHRGGTILFSARSEEFKTDEGQFRAIEQLNKHNIDGLVVIGGDGSFQGAKKLTEKGFPCIGVPGTIDNDIAGTDYTIGFDTSLNTIIDAVDKVRDTATSHERTYIIEVMGRDAGDLALWAGLAVGAESILIPEEKEDFSSIVQRLKNGHDRGKKHSIILLAEGVGSGFEFGKRIEEVAELETRVTVLGHIQRGGSPTGQDRVLASRLGARAIELLIDNQGGRMVGIQKNVLVDYTFDEVFNVEHTIDKGMYKLSKELSI

SEQ ID NO: 3698 - protein, 399 aa, Zea mays
MLAAVMDYFSTCWGPRSRAGHRGKGSDAAGRQDGLLWYKDAGQLVTGGFSMAVVQANQLLEDQSQVESGSLSLADYGPQGTFVGVYDGHGGPETSRFINDHLFNHLRRFATEHKSMSADVIRKAFQETEEGFLSLVIKEWSFKPQIASVGSCCLVGVICAGTLYVANLGDSRAVLGRLVKATGEVLATQLSAEHNACYEEVRQELQSSHPDDPRIVVLKHNVWRVKGLIQISRSIGDVYLKKPEYNREPLHSKFRLRETFQKPILSSEPQITEHRIQPNDQFVIFASDGLWEHLSNKEAVDLVQSSPRNGIARRLVKAAMQEAAKKREMRYSDLKKIDRGVRRHFHDDITVVVVFLDSDAMSKASWSKSPSVSLRGGGVTLPAKSLAPFSAPARLNSTY

SEQ ID NO: 3699 - protein, 224 aa, Triticum aestivum
  misc_feature (35)..(35): Xaa can be any naturally occurring amino acid
  misc_feature (75)..(75): Xaa can be any naturally occurring amino acid
  misc_feature (139)..(139): Xaa can be any naturally occurring amino acid
  misc_feature (144)..(144): Xaa can be any naturally occurring amino acid
  misc_feature (154)..(154): Xaa can be any naturally occurring amino acid
  misc_feature (209)..(209): Xaa can be any naturally occurring amino acid
WIPRAAGIRHEAYMFFSHTIKAQPHNMPALDKMLXYRIRLIDYEKITDENNNRLIAFGRYAGIAGAIDFLKGFGXYIMQMGFSTPFLNANCSYKYFNIEEAYEHLTLIGKRIREKYIPEELRPMIFAITGRGRTAKGCXKFYKXLPITHIGPDXVQGLCEDKTNPDHAKTIYLVNINSEDVIVPLDNTIKFDKQDYYKHPAKYRNTFHXKYLPYITALFHCIYW

SEQ ID NO: 3700 - protein, 533 aa, Candidatus Desulfococcus oleovorans Hxd3
MYLVCADEMRQMDRTTIEAFGIPGRVLMENAGRSATGWLLDTIPDALERRIAVIAGRGNNGGDGFVMARYLAQRGAEVTVFLLAEESKVSGDAKANLDLLSALNVPVICIPEEKSFARKKTALSHQHLFIDALLGTGLKFEVKGLFAKAIDFMNRSGRPVFAVDMPSGLDSDTGQPRGTCVKAAATATFGFAKPGQVLFPGAAFTGKLGVVDIGIPPFVADEADSRRWLLTPAMAAGYLRPREPDAHKGSAGHLLAVAGSAGKTGAAAMVGIAAMRSGAGLVTLAVPAGINAIVETLATEVMTLPVGDTDCRKFDETCMDSILEQTTGKKALAIGPGMGTGQAARNLLRGLMEKSDAPMVIDADGLTCLADDPDLLSFSRDRAVFTPHPGEMARLCGMTVAQVQNDRIRCAQDFARTHHVHLVLKGAGTVIAHPDGTVFVNRTGNPGMASGGMGDVLTGVIAGLFCQGYETGIAARLGVFLHGLAGDIAGEETGKTGLLASDVSFTLPRALQTLESKDHDRFVDCFPTQIKLA

SEQ ID NO: 3701 - protein, 125 aa, Glycine max
MAGSGSSMLYSFLLFTVILSLQEMYRGKLASSELYTILGGFVSSILFLVLLTFIGNLQETIGARTGWGAVIVAEAVALIAASTVHRVCITTCFLFSAALLYEVNKISGSALSTSDSRIKKQSGRA

SEQ ID NO: 3702 - protein, 291 aa, Triticum aestivum
  misc_feature (140)..(140): Xaa can be any naturally occurring amino acid
MIEQVCTKKQAGTGPEFPGYRRPTRPRTRGPTRPTSHNSPHRQPQTEAGNLGAKEGSRASLHLLVVLREKEVSGSSFQQQMEKARNAHVIGIPVSSTAIGIEEPEFTSGDAKYSTSLRTGGKSGRRAADKFARGIREHLXVTLGPKLYETVRGKLSLGARILQAGGVEKVFRRWFSVEKGEKLLNASQCYLSTTAGPIAGMLFVSSERVAFRSDRSLALTSPKGDTVRVPYKVAVPLSRVKAAKPSENQHRPEQKYVQLVTDDGFEFWFMGFVSYQASLQHLEQAIAESHL

SEQ ID NO: 3703 - protein, 1715 aa, Mycobacterium tuberculosis CDC1551
MPRWPRRPVGSSPMSFVLIAPEFVTAAAGDLTNLGSSISAANASAASATTQVLAAGADEVSARIAALFGGFGLEYQAISAQVAAYHQRFVQALSTGAGAYASAEAAAAEQIVLGVINAPTQALLGRPLIGDGANATTPGGAGGAGGLLFGNGGAGAAGAPGQAGGPGGPAGLWGNGGPGGAGGSGGGTGGAGGAGGWLFGVGGAGGVSGAGGGTGGAGGPGGLIWGGGGAGGVGGAGGGTGGAGGRAELLFGAGGAGGAGTDGGPGATGGTGGHGGVGGDGGWLAPGGAGGAGGQGGAGGAGSDGGALGGTGGTGGTGGAGGAGGRGALLLGAGGQGGLGGAGGQGGTGGAGGDGVLGGVGGTGGKGGVGGVAGLGGAGGAAGQLFSAGGAAGAVGVGGTGGQGGAGGAGAAGADAPASTGLTGGTGFAGGAGGVGGQGGNAIAGGINGSGGAGGTGGQGGAGGMGGSGADNASGIGADGGAGGTGGNAGAGGAGGAAGTGGTGGVVGAAGKAGIGGTGGQGGAGGAGSAGTDATATGATGGTGFSGGAGGAGGAGGNTGVGGTNGSGGQGGTGGAGGAGGAGGVGADNPTGIGGTGGTGGKGGAGGAGGAGADATATGATGGTGFAGGAGGAGGQGGSSGAGGTNGSGGAGGTGGQGGAGGAGGAGADNPTGIGGAGGTGGTGGAAGAGGAGGAIGTGGTGGAVGSVGNAGIGGTGGTGGVGGAGGAGAAAAAGSSATGGAGFAGGAGGEGGAGGNSGVGGTNGSGGAGGAGGKGGTGGAGGSGADNPTGAGFAGGAGGTGGAAGAGGAGGATGTGGTGGVVGATGSAGIGGAGGRGGDGGDGASGLGLGLSGFDGGQGGQGGAGGSAGAGGINGAGGNGGDGGDGATGAAGLGDNGGVGGDGGAGGAAGNGGNAGVGLTAKAGDGGAAGNGGNGGAGGAGGAGDNNFNGGQGGAGGQGGQGGLGGASTTSINANGGAGGNGGTGGKGGAGGAGTLGVGGSGGTGGDGGDAGAGGGGGFGGAAGKAGGGGNGGVGGDGGEGASGLGLGLSGFDGGQGGQGGAGGNAGAGGINGAGGAGGTGGAGGDGAPATLIGGPDGGDGGQGGIGGDGGNAGFGAGVPGDGGDGGNAGFGAGVPGDGGIGGTGGAGGAGGAGADGDPSIDGGQGGAGGHGGQGGKGGLNSTGLASAASGDGGNGGAGGAGGNGGDGDGFIGGSGGTGGTGGDAGVGGLANTGGTAGNAGIGGAGGRGGDGGAGDSGALSQDGNGFAGGQGGQGGVGGNAGAGGINGAGGTGGTGGAGGDGAPATLIGGPDGGDGGQGGIGGAGGNAGFGAGVPGDGGIGGTGGAGGAGGAGADGDPSIDGGQGGAGGHGGQGGKGGLNSTGLASAASGDGGNGGAGGAGGNGGDGDGFIGGSGGTGGTGGDAGVGGLANTGGTAGNAGIGGAGGRGGDGGAGDSGALSQDGNGFAGGQGGQGGAGGNAGAGGINGAGGTGGTGGAGGDGQNGTTGVASEGGAGGQGGDGGDGGEGGGAGFGSGVAGAAGAGGNGGKGGDGGTGGTGGTNFAGGQGGAGGRGGAGGNGANGVGDNAAGGDGGNGGAGGLGGGGGTGGTNGNGGLGGGGGNGGAGGAGGTPTGSGTEGTGGDGGDAGAGGNGGSATGVGNGGNGGDGGNGGDGGNGAPGGFGGGAGAGGLGGSGAGGGTDGDDGNGGSPGTDGS

SEQ ID NO: 3704 - protein, 490 aa, Oryza sativa (japonica cultivar-group)
MALKSPVDFAGSITSGQKDPCCFGVPGCNPRCVRYNKKSRTCRLVTRAISVDRPQLDFSNSDWKKQFQEDFDRRFSLPHLKDVIDVEPRPTTFSLKSRTPLENVNGSMQGSWNGYVNDDDRALLKVIKFASPTSAGADCIDPDCSWVEQWVHRAGPRKQIYFEPQYVKAGIVTCGGLCPGLNDVIRQIVLTLEKYGVKNIVGIQHGFRGFFEDHLAEVPARRLDMLFVLGGNGTHAGANLIHEECRKRKLKVSIVGVPKTIDNDILLMDKTFGFDTAVEAAQRAINSAYIEAHSAFHGIGLVKLMGRSSGFITMHASLSSGQVDICLIPEVPFTLDGPNGVLQHLEHLIETKGFALICVAEGAGQEHLQQSNATDASGNMILGDIGVHLHQKIKAHFKEIGVHSDVKYIDPTYMVRAVRANASDAILCTVLGQNAVHGAFAGFSGITTGICNTHNVYLPISEVIKSTRFVDPNSRMWHRCLTSTGQPDFH

SEQ ID NO: 3705 - protein, 152 aa, Synechococcus sp. WH 5701
MAVERTFLAIKPDGVQRGLVGEILGRFERKGFKLVGLKQLVPSRELAESHYGVHRERPFFAGLVDFITSGPVVAMVWEGDGVIASARKLIGATKPLEAEPGTIRGDLAVNIGRNVIHGSDAPETAVFEIGLWFEPSELSDWTPADQVWRRED

SEQ ID NO: 3706 - protein, 297 aa, Saccharomyces cerevisiae
MTGEDFKIKSGLAQMLKGGVIMDVVTPEQAKIAEKSGACAVMALESIPADMRKSGKVCRMSDPKMIKDIMNSVSIPVMAKVRIGHFVEAQIIEALEVDYIDESEVLTPADWTHHIEKDKFKVPFVCGAKDLGEALRRINEGAAMIRTKGEAGTGDVSEAVKHIRRITEEIKACQQLKSEDDIAKVAEEMRVPVSLLKDVLEKGKLPVVNFAAGGVATPADAALLMQLGCDGVFVGSGIFKSSNPVRLATAVVEATTHFDNPSKLLEVSSDLGELMGGVSIESISHASNGVRLSEIGW

SEQ ID NO: 3707 - protein, 297 aa, Saccharomyces cerevisiae
MPIKETDKEVVLTHPADETTSVHILKYGATVYSWKLKSEEQLWLSTAAKLDGSKPVRGGIPLVFPVFGKNSTDEHLSKLPQHGLARNSTWEFLGQTKENPPTVQFGLKPEIANPELTKLWPMDYLLILTVELGSDYLKTAIEVENTSSSKELKFNWLFHTYFRIEDIEGTMVSNLAGMKLYDQLLKESYVDKHPVVTFNQETDVIYQNVSAERAIQIVDKGVQIHTLKRYNLPDTVVWNPWIEKSQGMADFEPKTGYQQMICIEPGHVHDFISLAPGKKWNAYQLLCKEELKYQAIQ

SEQ ID NO: 3708 - protein, 111 aa, Allium cepa
ELQGVVMEIVITFALVYTVYATAADPKKGSLGTIAPIAIGFIVGANILAAGPFSGGSMNPARSFGPAVAAANFAGHWVYWVGPLVGGALAGLVYGDIFIGTSYEPVAQDYP

SEQ ID NO: 3709 - protein, 331 aa, Candida albicans SC5314
MSGPVNSVSKQMNVDTDIITLTRFILQEQQTVAPTATGELSLLLNALQFAFKFIAHNIRRAELVNLIGVSGSANSTGDVQKKLDVIGDEIFINAMRSSNNVKVLVSEEQEDLIVFPGGGTYAVCTDPIDGSSNIDAGVSVGTIFGVYKLQEGSTGGISDVLRPGKEMVAAGYTMYGASAHLALTTGHGVNLFTLDTQLGEFILTHPNLKLPDTKNIYSLNEGYSNKFPEYVQDYLKDIKKEGYSLRYIGSMVADVHRTLLYGGIFAYPTLKLRVLYECFPMALLMEQAGGSAVTIKGERILDILPKGIHDKSSIVLGSKGEVEKYLKHVPK

SEQ ID NO: 3710 - protein, 444 aa, Streptococcus pneumoniae
MRGSHHHHHHMSIITDVYAREVLDSRGNPTLEVEVYTESGAFGRGMVPSGASTGEHEAVELRDGDKSRYGGLGTQKAVDNVNNIIAEAIIGYDVRDQQAIDRAMIALDGTPNKGKLGANAILGVSIAVARAAADYLEIPLYSYLGGFNTKVLPTPMMNIINGGSHSDAPIAFQEFMILPVGAPTFKEALRYGAEIFHALKKILKSRGLETAVGDEGGFAPRFEGTEDGVETILAAIEAAGYVPGKDVFLGFDCASSEFYDKERKVYDYTKFEGEGAAVRTSAEQIDYLEELVNKYPIITIEDGMDENDWDGWKALTERLGKKVQLVGDDFFVTNTDYLARGIQEGAANSILIKVNQIGTLTETFEAIEMAKEAGYTAVVSHRSGETEDSTIADIAVATNAGQIKTGSLSRTDRIAKYNQLLRIEDQLGEVAEYRGLKSFYNLKK

SEQ ID NO: 3711 - protein, 528 aa, Mesembryanthemum crystallinum
MAALKGGEDFGPFPVKEQLPGVDFCLNSNPPWHEAIALGFQHFLVMLGTTIMIPTILVPQMGGGPEEKALVIQTLLFVSGLNTLLQTMIGCRSSVVIGGSHAFIIPAISIIFSDQYGRIVDPYERFRVTMRAIQGAIMFASMLPVLVGVLGLWRIVVRFLSPLAAIPLVILTGLGLFQFGFPQLAKCVEVGLPALIVLVFISQYFSQLLKPFQVIGRRYAVILIVGLLWAFAAILTAAGAFNHSAPKTQFYCRTDRSGLISAAAWIRVPYPFQWGRPTLNVGNGFAMMAAAFVALVESTGTFITAARYGSATPLPPSVVSRGVSWLGVANFINGLFGAITGATASVENAGLLGLNQVGSRRVAQLSAVFMLFFSVLGKFGALLASIPLPIFAALYCVLFAYAASAGLSFLQFCNLNSFRSKFILGFSLFMGLSIPQYFNEFLLVTGRTPVFTRSVAFNSMLQVIFSSPATVAGIIALFLDLTLHRRHTATRRDSGRHWWKKFRTFDADTRSEEFYSLPWGLNKYFPSL

SEQ ID NO: 3712 - protein, 411 aa, Oceanobacillus iheyensis HTE831
MANLRDEALHLHKVKQGKLEINTKVPVKDAKDLSLAYSPGVAEPCKEIYDRKETVYDYTMKGNMVAVVSDGSAVLGLGNIGPEAALPVMEGKAVLFKGFAGVDAFPICVDTHDVEQIVQTVKLLEPNFGGVNLEDIAAPNCFIIEDRLKSETNIPIFHDDQHGTAIVTVAGLINALKLVGKKFSDIKVVANGAGAAGIAIIRLLQSFGVRDMIMCDSKGAIYEGRPYGMNTVKDSVAKYTNANKVEGSLSDVLEGADVFIGVSVGGALTKDMVRSMNDDAIIFAMANPDPEILPEDAKEAGARVIGTGRSDFANQVNNVLAFPGIFRGALDVRATRINEEMKVAAAEGIATLISDDELHDDYVIPSPFDERVAPLVASHVAKAAMSTGVARMNVDPEEVAEKTRKLTQQEK

SEQ ID NO: 3713 - protein, 291 aa, Clostridium perfringens SM101
MFKGSCVALITPFTEDGVNYEELRKLLEWHIKNHTDAILVCGTTGEGSTMTLEEKKEVIKFSVEVVNKRVPVIAGTGTNNTKASIELSKYAEEVGADMVLIITPYYNKTSQKGLYAHFSAINDAINIPIMLYNVPSRTGMNITPLMLDKLANLNNVVAIKEASGDLSQVAKMAELCGDRIAIYSGNDDQIVPILSLGGAGVVSVLANILPEETHNICEKYFLGEVIESRNLQLKYLSLANSLFIETNPIPVKTAMNLMNFNCGPLRLPLCEMEDSNLVILEENLKANGLIK

SEQ ID NO: 3714 - protein, 378 aa, Streptococcus suis 89/1591
MNNTEFYDRLGVSKNASPDEIKKAYRKLSKKYHPDINKDPGAEDKYKEVQEAYETLSDPQKRSAYDQYGPAGANGGFGGGAGGFGGFDGAGFGGFEDIFSSFFGGGGATRNPNAPRQGDDLQYAVNLKFEEAIFGVEREVSYNREATCRTCTGSGAKPGTSPVTCGRCHGSGVINVDTQTPLGTMRRQMTCDVCHGRGKQIKDPCATCHGTGHEKQAHTVTVKVPAGVETGQRIRLAGQGEAGFNGGPYGDLYVVIQVQPSDKFEREGTTIHYKLNLNFVQAALGDTVHVPTVHGDVDMVIPEGTQTGKTFRLKGKGAPSVRGGAIGDQYVTVNIVTPTGLNDRQKAALKEFAAAGNIDVKPHKKGFFDKVKDAFEDL

SEQ ID NO: 3715 - protein, 487 aa, Fulvimarina pelagi HTCC2506
MRAQPKASHFIDGAYVEDKNSEAFDCVYSATGETIATLHAATPAIIEKAMTSAAKAQGEWAEWTPVQRSRVLRRAADIIRERNQALSELETLDTGKPIQETIVADATSGADALEWFASIAATLSGESVPLGADFAYTIREPLGVCVGIGAWNYPTQIACWKAAPALACGNAMVFKPSELTPLCALKVAEIMHEAGAPAGLLNVVQGFGKVGAALTGHELCAKVSLTGSVETGPKVYAAAAEGMRHVTMELGGKSPILVFDDASLENAISGAMLGNFYSTGQICSNGTRVFVQRGIYEKFLDRLAERTRTIKLGDPLDPDTQLGPMVSFAQLQKVQGYLKKAGEEGARLVIGGGVPEGPAFAEGAYIEPTVYADVTDEMTIAKEEIFGPVMSVFPFETEEEALSRANQTPFGLAAGVFTSDLTRGHRVAKKLQAGICWINAYNLTPVEVPFGGVKKSGLGRENGKAAVEFYSQLKTVHVGMGPVESPY

SEQ ID NO: 3716 - protein, 294 aa, Rickettsia akari str. Hartford
MNNIFKGLITALITPFKDNKLDLYALERILKHQIKHDVDAILIAGSTGEGSSLSFEEYKLLLQTSVEIVNKRIPIISGCSSNNTAYAIELAAESTKIKVDGFMASPPSYVKPTQHGIYKHFEALHEACNLPIILYSAPTRSGVDFSDETILRLSALTRILALKDCGVDLGRPLRIRAIVKKDFNILTGNDEVVLAFNAQGGVGWTAVASNIAPDMCKELLEKWYKNDTKGALEIHQKLLPLYKALFLESNPIPIKYAAHYLGLCENEIRPPLTEASDSAKKQIENIITALSIKI

SEQ ID NO: 3717 - protein, 444 aa, Zea mays
MATITVVKARQIFDSRGNPTVEVDIHTSNGVKVTAAVPSGASTGIYEALELRDGGSDYLGKGVSKAVGNVNNIIGPALIGKDPTQQTAIDNFMVHELDGTQNEWGWCKQKLGANAILAVSLAVCKAGAVVSGIPLYKHIANLAGNPKIVLPVPAFNVINGGSHAGNKLAMQEFMILPVGAASFKEAMKMGVEVYHHLKSVIKKKYGQDATNVGDEGGFAPNIQENKEGLELLKTAIEKAGYTGKVVIGMDVAASEFYSEDKTYDLNFKEENNNGSQKISGDALKDLYKSFVAEYPIVSIEDPFDQDDWEHYAKMTTECGTEVQIVGDDLLVTNPKRVAKAIAEKSCNALLLKVNQIGSVTESIEAVKMSKKAGWGVMTSHRSGETEDTFIADLAVGLSTGQIKTGAPCRSERLAKYNQLLRIEEELGSEAIYAGVNFRKPVEPY

SEQ ID NO: 3718 - protein, 356 aa, Oryza sativa (japonica cultivar-group)
MAKKRKRSSDAAAAVEKPDEFAPQRPERTLFGFKEKPADDEEAEAEAASEGEEDAAAAAAAARFRNKEKVLVTCSRRINYRYRHLMQNVVSLLPHAKKDSKVESKQSKGNALNELLELRNCSSCLFFECRKQKDLYLWMVKSPGGPSVKFLVNAVHTMEELKLTGNHLKGSRPLITFSTNFDEQPHWQLVKEMLTQLSHVMNFMENWGNAIRDEVIHASFLIFATPKDHRKAKPFHDHVFVFSIVDDHVWFRNYQISVPHNEIDKVDKGGLDKMTLVEVGPRFCLNPIKIFGGSFGGPTLYENPFYVSPNQIRALEKRKKAGKYAKKVKAKVRRKMHEMENTLEPDEFAELWKGED

SEQ ID NO: 3719 - protein, 465 aa, Glycine max
MTISSLAPKAERKKSRKSKAVVNENAPLLPKSHVQESDAGFDDFNGASFSGAVFNLSTTIIGAGIMALPATLKQLGMIPGLLAIIIMALLTEKSIELLIRFTRAGKSASYAGLMGDSFGNYGKALVQICVIINNIGVLIVYMIIIGDVLSGTSSSGDHHYGILEGWFGVHWWTGRTFVVLFTTLAIFAPLASFKRIDSLRFTSALSVALAVVFLVIAVGIAVVKIFSGGIAMPRLFPVTTDVASFFRLFTVVPVFVTAYICHYNVHSIDNELEDSSQMRGVVQTALVLCSSVYVMISFFGFLLFGEGTLDDVLANFDTNLGIPFGSVLNDAVRISYAAHLMLVFPVVFFPLRLNIDGLLFSKSRPLVLDNFRFASLTIALIGVIFLGANFIPSIWDAFQFTGATAAVCIGFIFPAAITLRDRYNIATKSDKILSVIMIVLAVFSNVVAIYSDAYALIKQNKTSRE

SEQ ID NO: 3720 - protein, 526 aa, Mesembryanthemum crystallinum
MAALKGGEDFGPFPVKEQLPGVDFCLNSNPPWHEAIALGFQHFLVMLGTTIMIPTILVPQMGGGPEEKALVIQTLLFVSGLNTLLQTMIGCRSSVVIGGSHAFIIPAISIIFSDQYGRIVDPYERFRVTMRAIQGAIMFASMLPVLVGVLGLWRIVVRFLSPLAAIPLVILTGLGLFQFGFPQLAKCVEVGLPALIVLVFISQYFSQLLKPFQVIGRRYAVILIVGLLWAFAAILTAAGAFNHSAPKTQFYCRTDRSGLISAAAWIRVPYPFQWGRPTLNVGNGFAMMAAAFVALVESTGTFITAARYGSATPLPPSVVSRGVSWLGVANFINGLFGAITGATASNAGLLGLNQVGSRRVAQLSAVFMLFFSVLGKFGALLASIPLPIFAALYCVLFAYAASAGLSFLQFCNLNSFRSKFILGFSLFMGLSIPQYFNEFLLVTGRTPVFTRSVAFNSMLQVIFSSPATVAGIIALFLDLTLHRRHTATRRDSGRHWWKKFRTFDADTRSEEFYSLPWGLNKYFPSL

SEQ ID NO: 3721 - protein, 569 aa, Saccharomyces cerevisiae
MSFQIETVPTKPYEDQKPGTSGLRKKTKVFKDEPNYTENFIQSIMEAIPEGSKGATLVVGGDGRYYNDVILHKIAAIGAANGIKKLVIGQHGLLSTPAASHIMRTYEEKCTGGIILTASHNPGGPENDMGIKYNLSNGGPAPESVTNAIWEISKKLTSYKIIKDFPELDLGTIGKNKKYGPLLVDIIDITKDYVNFLKEIFDFDLIKKFIDNQRSTKNWKLLFDSMNGVTGPYGKAIFVDEFGLPADEVLQNWHPSPDFGGMHPDPNLTYASSLVKRVDREKIEFGAASDGDGDRNMIYGYGPSFVSPGDSVAIIAEYAAEIPYFAKQGIYGLARSFPTSGAIDRVAKAHGLNCYEVPTGWKFFCALFDAKKLSICGEESFGTGSNHVREKDGVWAIMAWLNILAIYNKHHPENEASIKTIQNEFWAKYGRTFFTRYDFEKVETEKANKIVDQLRAYVTKSGVVNSAFPADESLKVTDCGDFSYTDLDGSVSDHQGLYVKLSNGARFVLRLSGTGSSGATIRLYIEKYCDDKSQYQKTAEEYLKPIINSVIKFLNFKQVLGTEEPTVRT

SEQ ID NO: 3722 - protein, 922 aa, Candida albicans SC5314
MKSDFKFSNLLGTVYRKGNLVFNQDGTKLLSPVGNRVSCFDLIKSQSFTFDYQHRKNVQCIALNNQNTLMISIDEDGRAILVNFVSRVVLHHFNFKSKVNDIKFSPCGKYFAIAIDRFIQVWKTPDLTEDRQFAPFVRHRIYSGHFDEVLNISWSLDSRFFISTSKDMTAKIFSLNSDEKDVAMTFSGHRDYVINAFFSHDQEIIYTVSKDGALFKWEYTERPKPENEDSDSEDDATDKPMSWRITAKNFFYADGKLKCACFHPQSKLLVVGFTNGEFRLYEIEDFNLIQSLSMGQNAVNTVNINKTGEWLAFGSAKLGQLLVYEWQSESYILKQQGHFDSMNTLCYSPDGSRLVTGSDDGKIKIWDVRSGFCLMTFTEHTSAVTQVQFAKRGQVLFSSSLDGTIRAWDLIRFRNFKTFTATSRVQFNCLAVDPSGEVIVGGSQDTFEIYVWSVQTGQLLDSLTGHEGPISCLTFGKENSILASASWDKTIRIWNIFSRNQTVEPIEIQSDALCLTMRPDCKELAVSTLDGHVTIFDIEDAKQLHLIDGRKDIVNGRYLEDKFIAKNSNRGKYFSTIAYSFDGLTLLAAGNNNSICMYDIENEVLLKRFIVSENMSLDGTLQFLNSSKITDAGTNSDLIDRAGELSDLEDRVDNSLPGSHRGGDPSERRTRPEVRVTAVEFSPTTAAFAAASTEGLLIFSINQELIFDPFDLDVDVTPEATLESLKEKEYLVALVMAFRLNENYLIHRVIESIPLQDIKLVCQDLPVIYVNRVLNFIGELLTKKESPHIEYYLIMVKNLLIQHGRYISSNKFEFQSSMKLLSRFLNKTAKDVINVGKRNDHLLTYLTVSKDLKTASGHSEGEENIEMNEDSEAEDIDIDEDDDDEEGWLGPNGNSVKAANGIVFSGPADSSDEEDEDELIEV

SEQ ID NO: 3723 - protein, 443 aa, Yersinia pseudotuberculosis IP 32953
MWFFLKSRDNVPPVTDQTQIDSSYKYWRIQLMWTMYIGYAAFYFTRKSFNFIMPAMLTDLGLSMSDVGILGTLFYITYGCSKFVSGMISDRSNPRYFMGIGLVMTGIINILFGMSSSLLVLGALWILNAFFQGWGWPPCSKILTSWYSRSERGGWWAIWNTSHNFGGALIPLLVGVITLHFSWRYGMIIPGIIGVVIGLLMCWRLRDKPSTMGLPSVGKWRNDAMELIQESEGQGLSNKEIVKRYVLTNKYIWLLAVSYVLVYIVRTAINDWGNLYLTQEKGYSLLTANSAISLFEVGGFIGSLVAGWGSDKWFRGNRGPMNLIFAIGIFLSVASLWTLPSISFVLQAGCFFAIGFFIFGPQMLIGMAAAECSHKDAAGAATGFVGLFAYLGAALSGYPIARVMEIWHWNGFFVVISVAACLSAFFLLPFLRAQSPQLKQATT

SEQ ID NO: 3724 - protein, 232 aa, Sinorhizobium meliloti 1021
MFKKLCAEFLGTCWLVLGGCGSAVLASAFPQVGIGLLGVSFAFGLTVLTMAYTVGGISGGHFNPAVSLGLAVAGRVPAASLVSYVIAQVAGAIIAAAVLYVIATGKADFQLGSFAANGYGEHSPGGYSLTAALVTEVVMTFFFLIIILGSTHRRVPAGFAPIAIGLALTLIHLVSIPVTNTSVNPARSTGQALFVGGWALSQLWLFWIAPLFGAAIAGIVWKSVGEEFRPVD

SEQ ID NO: 3725 - protein, 335 aa, Mannheimia succiniciproducens MBEL55E
MKTLDEFIVDRQAEYPNAKGALTGILSSIRLVAKVIHRDINRAGLTNNILGFSGIDNVQGEHQMKLDLFAHNMMKQALMAREEVAGFASEEEENFVAFDTERGRNARYVILTDPLDGSSNIDVNVSVGTIFSIYRRVSPIGSPVTLEDFMQPGNRQVAAGYVVYGSSTMLVYTTGNGVNGFTYDPSLGTFCLSHENMQIPATGKIYSINEGQYLKFPMGVKKYIKYCQEEDAATNRPYTSRYIGSLVADFHRNLLKGGIYIYPHATNYPQGKLRLLYEGNPIAFLAEQAGGIASDGYNRVLDIQPSQLHQRVPLFVGSKQMVEKAQDFMHQFKED

SEQ ID NO: 3726 - protein, 109 aa, Oryza sativa
  misc_feature (98)..(98): Xaa can be any naturally occurring amino acid
MTIYIAREASKVWRKVTTETSVELSLLRQKWGLLLAGIVFHYIHGLAARGVHYLHRPGPLLLDLGFMALPWTFRPFIYHSKRFYSVLIWRRVLAFLVXASQVLRIITFY

SEQ ID NO: 3727 - protein, 256 aa, Zea mays
MASRKFFVGGNWKCNGTGEDVKKIVTVLNQAEVPSEDVVEVVVSPPFVFLQQVKGLLRLDFAVAAQNCWVRKGGAFTGEISAEMLVNLQVPWVILGHSERRALLGESSDFVADKVAYALTQGLKVIACIGETLEQREAGTTMDVVAAQTKAIAEKISDWTNIVLAYEPVWAIGTGKVATPAQAQEVHDGLRKWLHSNVSPAVAELTRIIYGGSVNGANCKELAAQPDVDGFLVGGASLKPEFVDIIKSATVKSSSA

SEQ ID NO: 3728 - protein, 1146 aa, Populus tremula
MASQSQRQSNQPAHNQAQSSGTSNMRQHHHPTESVSKAIAQYTVDAQLHAVFEQSGGTGKSFDYSKSVRTPNQSVPEEQITAYLSKIQRGGHIQPFGCMIAADEQSFRVIAYSENAKDMLGLTPQSVPSLEKQEILFVGADVRILFRPSSAVLLEKAFGAREITLLNPIWIHSKNSGKPFYAILHRIDVGIVIDLEPARTEDPALSIAGAVQSQKLAVRAISQLQSLPGGDIKLLCDTVVDSVRELTGYDRVMVYKFHEDEHGEVVAENKRVDLEPYIGLHYPSTDIPQASRFLFKQNRVRMIVDCHAIPVSVIQDEGLMQPLCLVGSTLRAPHGCHAQYMENMGSIASLAMAVIIYGNDEEAIGGRNSMRLWGLVVCHHTSARCIPFPLRYACEFLMQAFGLQLNMELQLASQLLEKHVLRTQTLLCDMLLRDSPTGIVTQSPSIMDLVKCDGAALYYQGQYYPLGVTPTEAQIKDIVEWLLTLHGDPTGLSTDSLADAGYPGAAFLGDAVCGMAVAYIAERDFLFWFRSHTAKEVKWGGAKHHPEDKDDGQRMHPRSSFKAFLEVVKSRSLPWENAEMDAIHSLQLILRDSFRDAEATNSKAVVHNQLKDMELQGMDELSSVAREMVRLIETATAPIFAVDVDGRINGWNAKVAELTGLSVEEAMGKSLVHDLVYKEYEEIVDKLIHRAVKGEEDKNVEIKLRTFCSEHQKKAVFVVVNACSSKDYMDNIVGVCFVGQDVTGQKVVMDKYVLIQGDYKAIVHSPNPSIPPIFASDENTCCLEWNTAMEKLTGWSRGEVVGKMLVGEVFGSCCRLKGPDALTKFMIALHNAIGGIDTDKLPFSFFDRNEKNVQTLLTANKRVNMKGDIIGAFCFLQIASPELQPSLKVQKQQEKKSFARMKELAYICQEIKNPLSGIHFTNSLLENTDLTEDQQQFLETSAACEKQILKIIRDIDLESIENGSLELEKAEFLLGSVINAVVSQAMLLLRERNLQLLRDIPEEIKTLAVYGDQARIQQVLADFLLNMVRYAPSSAGWVEIHVCPTLKQISDGHTLVHTEFRYLERVLQTRMLGLQHPPRSFLNCKLTLVMLHREGMVPKIQFQGLSVCQGRLIWLSFPENTTVALYPLTIWFLLLHRHQSRSITHT

SEQ ID NO: 3729 - protein, 217 aa, Sinorhizobium meliloti 1021
MTTKVVKLSPDDSVRQAAKLMFDHHVSGVPVVDDDGHLLGVISEGDLIRRAELCSEASVLMADMAIDPDDRANAFIRRCSWRVGDVMTANPVTIEEEAPLARVAGLMQERGIKRIPVVRDGELVGIVSRADLLQAIFSTKPDETAAGDEAIRRSILVRLGENTSLEELDVTVTVTEGIVHFWGQVETAGCRRAARIMAESVHGVRGIVEHFPDPYTQ

SEQ ID NO: 3730 - protein, 1146 aa, Populus tremula
MASQSQRQSNQPAHNQAQSSGTSNMRQHHHPTESVSKAIAQYTVDAQLHAVFEQSGGTGKSFDYSKSVRTPNQSVPEEQITAYLSKIQRGGHIQPFGCMIAADEQSFRVIAYSENAKDMLGLTPQSVPSLEKQEILFVGADVRILFRPSSAVLLEKAFGAREITLLNPIWIHSKNSGKPFYAILHRIDVGIVIDLEPARTEDPALSIAGAVQSQKLAVRAISQLQSLPGGDIKLLCDTVVDSVRELTGYDRVMVYKFHEDEHGEVVAENKRVDLEPYIGLHYPSTDIPQASRFLFKQNRVRMIVDCHAIPVSVIQDEGLMQPLCLVGSTLRAPHGCHAQYMENMGSIASLAMAVIIYGNDEEAIGGRNSMRLWGLVVCHHTSARCIPFPLRYACEFLMQAFGLQLNMELQLASQLLEKHVLRTQTLLCDMLLRDSPTGIVTQSPSIMDLVKCDGAALYYQGQYYPLGVTPTEAQIKDIVEWLLTLHGDPTGLSTDSLADAGYPGAAFLGDAVCGMAVAYIAERDFLFWFRSHTAKEVKWGGAKHHPEDKDDGQRMHPRSSFKAFLEVVKSRSLPWENAEMDAIHSLQLILRDSFRDAEATNSKAVVHNQLKDMELQGMDELSSVAREMVRLIETATAPIFAVDVDGRINGWNAKVAELTGLSVEEAMGKSLVHDLVYKEYEEIVDKLIHRAVKGEEDKNVEIKLRTFCSEHQKKAVFVVVNACSSKDYMDNIVGVCFVGQDVTGQKVVMDKYVLIQGDYKAIVHSPNPSIPPIFASDENTCCLEWNTALEKLTGWSRGEVVGKMLVGEVFGSCCRLKGPDALTKFMIALHNAIGGIDTDKLPFSFFDRNEKNVQTLLTANKRVNMKGDIIGAFCFLQIASLELQPSLKVQKQQEKKSFARMKELAYICQEIKNPLSGIHFTNSLLENTDLTEDQQQFLETSAACEKQILKIIRDIDLESIENGSLELEKAEFLLGSVINAVVSQAMLLLRERNLQLLRDIPEEIKTLAVYGDQARIQQVLADFLLNMVRYAPSSAGWVEIHVCPTLKQISDGHTLVHTEFRYLERVLQTRMLGLQHPPRSFLNCKLTLVMLHREGMVPKIQFQGLSVCQGRLIWLSFPENTTVALYPLTIWFLLLHRHQSRSITHT

SEQ ID NO: 3731 - protein, 1146 aa, Populus tremula
MASQSQRQSNQPAHNQAQSSGTSNMRQHHHPTESVSKAIAQYTVDAQLHAVFEQSGGTGKSFDYSKSVRTPNQSVPEEQITAYLSKIQRGGHIQPFGCMIAADEQSFRVIAYSENAKDMLGLTPQSVPSLEKQEILFVGADVRILFRPSSAVLLEKAFGAREITLLNPIWIHSKNSGKPFYAILHRIDVGIVIDLEPARTEDPALSIAGAVQSQKLAVRAISQLQSLPGGDIKLLCDTVVDSVRELTGYDRVMVYKFHEDEHGEVVAENKRVDLEPYIGLHYPSTDIPQASRFLFKQNRVRMIVDCHAIPVSVIQDEGLMQPLCLVGSTLRAPHGCHAQYMENMGSIASLAMAVIIYGNDEEAIGGRNSMRLWGLVVCHHTSARCIPFPLRYACEFLMQAFGLQLNMEFQLASQLLEKHVLRTQTLLCDMLLRDSPTGIVTQSPSIMDLVKCDGAALYYQGQYYPLGVTPTEAQIKDIVEWLLTLHGDPTGLSTDSLADAGYPGAAFLGDAVCGMAVAYIAERDFLFWFRSHTAKEVKWGGAKHHPEDKDDGQRMHPRSSFKAFLEVVKSRSLPWENAEMDAIHSLQLILRDSFRDAEATNSKAVVHNQLKDMELQGMDELSSVAREMVRLIETATAPIFAVDVDGRINGWNAKVAELTGLSVEEAMGKSLVHDLVYKEYEEIVDKLIHRAVKGEEDKNVEIKLRTFCSEHQKKAVFVVVNACSSKDYMDNIVGVCFVGQDVTGQKVVMDKYVLIQGDYKAIVHSPNPSIPPIFASDENTCCLEWNTALEKLTGWSRGQVVGKMLVGEVFGSCCRLKGPDALTKFMIALHNAIGGIDTDKLPFSFFDRNEKNVQTLLTANKRVNIKGDIIGAFCFLQIASPELQPSLKVQKQQEKKSFARMKELAYICQEIKNPLSGIHFTNSLLENTDLTEDQQQFLETSAACEKQILKIIRDIDLESIENGSLELEKAEFLLGSVINAVVSQAMLLLRERNLQLLRDIPEEIKTLAVYGDQARIQQVLADFLLNMVRYAPSSAGWVEIHVCPTLKQISDGHTLVHTEFRYLERVLQTRMLGLQHPPRSFLNCKLTLVKLHREGMVPKIQFQGLSVCQGRLIWLSFPENTTVALYPLTIWFLLLHRHQSRSITHT

SEQ ID NO: 3732 - protein, 374 aa, Triticum aestivum
MVHQAQGLLVQEVAADGELPSRYVLKEQQGRPAAAAAAQRAAPSIPTVDVSRLADADPSEADKLRSALDSWGLFAVTGHGMTDPFLDAILGAARGFFHLPTEAKQEYSNVVDADDGGRKFQPEGYGVDRVDTDEQVLDWCDRLYLQVRPDDARQLRFWPTHPPDLAELLKEFSVEGEKVAKLVVTAMARCLGFEDGFFVDKVGDRMPSYARFTYYPPCPRPDLVHGLKPHTDNSVVTVLLLDDQVGGLQVLKDGSWVDVPVLGDGRHQLLVVVGDEMEIMSNAAFRAPVHRVMAPGEEAERVSLAVFYQPEPDKVLEPSPELIDGDRPAMYKKLQAKVFADGFWDAFALGERTIDFLKVKVDAVDPPAAAVSGA

SEQ ID NO: 3733 - protein, 1146 aa, Populus tremula
MASQSQRQSNQPAHNQAQSSGTSNMRQHHHPTESVSKAIAQYTVDAQLHAVFEQSGGTGKSFDYSKSVRTPNQSVPEEQITAYLSKIQRGGHIQPFGCMIAADEQSFRVIAYSENAKDMLGLTPQSVPSLEKQEILFVGADVRILFRPSSAVLLEKAFGAREITLLNPIWIHSKNSGKPFYAILHRIDVGIVIDLEPARTEDPALSIAGAVQSQKLAVRAISQLQSLPGGDIKLLCDTVVDSVRELTGYDRVMVYKFHEDEHGEVVAENKRVDLEPYIGLHYPSTDIPQASRFLFKQNRVRMIVDCHAIPVSVIQDEGLMQPLCLVGSTLRAPHGCHAQYMENMGSIASLAMAVIIYGNDEEAIGGRNSMRLWGLVVCHHTSARCIPFPLRYACEFLMQAFGLQLNMELQLASQLLEKHVLRTQTLLCDMLLRDSPTGIVTQSPSIMDLVKCDGAALYYQGQYYPLGVTPTEAQIKDIVEWLLTLHGDPTGLSTDSLADAGYPGAAFLGDAVCGMAVAYIAERDFLFWFRSHTAKEVKWGGAKHHPEDKDDGQRMHPRSSFKAFLEVVKSRSLPWENAEMDAIHSLQLILRDSFRDAEATNSKAVVHTQLKDMELQGMDELSSVAREMVRLIETATAPIFAVDVDGRINGWNAKVAELTGLSVEEAMGKSLVHDLVYKEYEEIVDKLIHRAVKGEEDKNVEIKLRTFCSEHQKKAVFVVVNACSSKDYMDNIVGVCFVGQDVTGQKVVMDKYVLIQGDYKAIVHSPNPSIPPIFASDENTCCLEWNTALEKLTGWSRGEVVGKMLVGEVFGSCCRLKGPDALTKFMIALHNAIGGIDTDKLPFSFFDRNEKNVQTLLTANKRVNIKGDIIGAFCFLQIASPELQPSLKVQKQQEKKSFARMKELAYICQEIKNPLSGIHFTNSLLENTDLTEDQQQFLETSAACEKQILKIIRDIDLESIENGSLELEKAEFLLGSVINAVVSQAMLLLRERNLQLLRDIPEEIKTLAVYGDQARIQQVLADFLLNMVRYAPSSAGWVEIHVCPTLKQISDGHTLVHTEFRYLERVLQTRMLGLQHPPRSFLNCKLTLVMLHREGMVPKIQFQGLSVCQGRLIWLSFPENTTVALYPLTIWFLLLHRHQSRSITHT

SEQ ID NO: 3734 - protein, 1146 aa, Populus tremula
MASQSQRQSNQPAHNQAQSSGTSNMRQHHHPTESVSKAIAQYTVDAQLHAVFEQSGGTGKSFDYSKSVRTPNQSVPEEQITAYLSKIQRGGHIQPFGCMIAADEQSFRVIAYSENAKDMLGLTPQSVPSLEKQEILFVGADVRILFRPSSAVLLEKAFGAREITLLNPIWIHSKNSGKPFYAILHRIDVGIVIDLEPARTEDPALSIAGAVQSQKLAVRAISQLQSLPGGDIKLLCDTVVDSVRELTGYDRVMVYKFHEDEHGEVVAENKRVDLEPYIGLHYPSTDIPQASRFLFKHNRVRMIVDCHAIPVSVIQDEGLMQPLCLVGSTLRAPHGCHAQYMENMGSIASLAMAVIIYGNDEEAIGGRNSMRLWGLVVCHHTSARCIPFPLRYACEFLMQAFGLQLNMELQLASQLLEKHVLRTQTLLCDMLLRDSPTGIVTQSPSIMDLVKCDGAALYYQGQYYPLGVTPTEAQIKDIVEWLLTLHGDPTGLSTDSLADAGYPGAAFLGDAVCGMAVAYIAERDFLFWFRSHTAKEVKWGGAKHHPEDKDDGQRMHPRSSFKAFLEVVKSRSLPWENAEMDAIHSLQLILRDSFRDAEATNSKAVVHTQLKDMELQGMDELSSVAREMVRLIETATAPIFAVDVDGRINGWNAKVAELTGLSVEEAMGKSLVHDLVYKEYEEIVDKLIHRAVKGEEDKNVEIKLRTFCSEHQKKAVFVVVNACSSKDYMDNIVGVCFVGQDVTGQKVVMDKYVLIQGDYKAIVHSPNPSIPPIFASDENTCCLEWNTALEKLTGWSRGEVVGKMLVGEVFGSCCRLKGPDALTKFMIALHNAIGGIDTDKLPFSFFDRNEKNVQTLLTANKRVNMKGDIIGAFCFLQIASPELQPSLKVQKQQEKKSFARMKELAYICQEIKNPLSGIHFTNSLLENTDLTEDQQQFLETSAACEKQILKIIRDIDLESIENGSLELEKAEFLLGSVINAVVSQAMLLLRERNLQLLRDIPEEIKTLAVYGDQARIQQVLADFLLNMVRYAPSSAGWVEIHVCPTLKQISDGHTLVHTEFRYLERVLQTRMLGLQHPLRSFLNCKLTLVKLHREGMVPKIQFQGLSVCQGRLIWLSFPENTTVALYPLTIWFLLLHRHQSRSITHT

SEQ ID NO: 3735 - protein, 279 aa, Arabidopsis thaliana
MAGREILHKMKVGLCGSDTGRGKTKVWKNIAHGYDFVKDKAGHPMEDYVVSEFKKVDGHDLGLFAIFDGHLGHDVAKYLQTNLFDNILKEKDFWTDTKNAIRNAYISTDAVILEQSLKLGKGGSTAVTGILIDGKTLVIANVGDSRAVMSKNGVASQLSVDHEPSKEQKEIESRGGFVSNIPGDVPRVDGQLAVARAFGDKSLKIHLSSDPDIRDENIDHETEFILFASDGVWKVMSNQEAVDLIKSIKDPQAAAKELIEEAVSKQSTDDISCIVVRFQ

SEQ ID NO: 3736 - protein, 88 aa, Oryza sativa (indica cultivar-group)
MAPRVSNFTSIPPSIAKPVIRRLARKGGVKRISGLIYKETRGVLEIFLKNVIRDAITYTEHAHRKTVMAMDVVYALKLQGRTIYDFGG

SEQ ID NO: 3737 - protein, 412 aa, Cyanophora paradoxa
MAFVVGVPAIAGKAPAAQKNATCSQGKGFASFMGMKAVKNTPKFAYAAEEERSLFTVVDAQTAAGGETVAEATTMKVKVAVNGFGRIGRNFVRCLEGRKQTNLELVAINDTGGAKLSAHLLKYDSILGRFDADVKYVDDGAISVNGKTIKVVSTRDPTTLPWKELGVEIVIESTGVFIDGPGAGKHIAAGAKKVVITAPAKGSDIPTYVVGVNHKDYNPSTDHIVSNASCTTNCLAPFVKVLDEKFKIIKGTMTTTHSYTGDQRLLDASHRDLRRARAAAMNIVPTSTGAAKAVALVLPNLKGKLNGLALRVPTPNVSIVDLVVQVEKKTFADEVNAALREAANTDLKGVLVVSDEPLVSCDFRCTDQSSTIDASLTMVMGDDMVKVIAWYDNEWGYSQRVVDLAEIVAQSM

SEQ ID NO: 3738 - protein, 577 aa, Shewanella sp. MR-4
MHESQTTGSATQAVKTSRLSWFDDVLLLGIMAVLAGCGLIYEYLLSHYAGRILGALEAAIYTMIGLMIVSMGLGAFAARKIKDAFTGFVVLELTVALCGSLAILITAAVIGLGQQLPMLIASTLGLPPDQLPEGGMVGSLQKLSEYLPYIWGVSLGLMIGMEIPLIARVRQSLSDEHLLHNAGTIYGADYIGAGIGAAIWVGFMLAIDIQLAAALTASFNLLAGFVFIWRFWPKIQRAKLLLAGHFVVTGVLLLLAIQGPSWELQFNNLLYKDKVVYAKATRFQQLTFTERLRGNGLSPIYSLYINGRLQFSSIDEHIYHAFLVHPTLAASARHNKVLIIGGGDGLGLKQVLRWEPEQVTLLDLDAALVQLFKTPDTDMPKRLSQALLALNGNAFNDPRVKVIHDDAFNGVDKLIAAGDKYDAIIVDLPDPSHPDLNKLYSDYFYRKLKELMSSDGALTVQSTSPYHAQKAFISVAKTLALAGFDVKQYHHNVPSFGEWGWSIATLSGKDAQHRLGELTTLPIADDWLTLGLVKGAFEFPANFYQDAANIKPNELGSLQLYHYHQQAWSETQGLDLF

SEQ ID NO: 3739 - protein, 304 aa, Helicodiceros muscivorus
MGGHDSGRSDISFGGRFASSAFAACFAELCTIPLDTAKVRLQLQKKSVAGDGVSLPKYRGMLGTVATIAREEGLSALWKGIVPGLHRQCLFGGLRIGLYEPVKSFYVGEGFVGDVPLSKKILAGLTTGALAITVANPTDLVKVRLQAEGKLSPGIPRRYSGALNAYSTIVKQEGLGALWTGLGPNIARNAIINAAELASYDQVKQTILKIPGFSDNIFTHILAGLGAGFVAVCIGSPVDVVKSRMMGDSTYKSTLDCFIKTFKNDGPLAFYKGFIPNFGRLGSWNVIMFLTLEQVKKVFIKEAP

SEQ ID NO: 3740 - protein, 171 aa, Robiginitalea biformata HTCC2501
MDSSQPDIFIVMGVSACGKTTLGKALAAELECPFFDGDDFHPPENIVKMKAEEPLGDSDREGWLKALNALARKHTGSGGAVIACSALKEKYRDWLREGLAPGKICWVVLTGTFDAILERIQARADHYMPPALLRSQFADLEVPDYGIHLPAYGMPTEEMVRRVSAHIKTNR

SEQ ID NO: 3741 - protein, 467 aa, Yersinia pseudotuberculosis IP 32953
MKNDSSTLKRGLSARHIRFMALGSAIGTGLFYGSAEAIRLAGPAVLLAYLIGGAAVFMVMRALGEMAVHDPVAGSFGHYASRYLGPLAGFLTGWTYTFEMVVVALADVTAFGIYMGLWFPDAPQWVWVLSIIFFIGALNLCSVKVFGEMEFWLSLLKVAAIIAMIAAGLGIMMFGFGAGHDSTGVSNLWAHQGFMPNGITGVIASFAVVMFAFGGIEIIGVTASEAKDPGKVLPRAINTVPIRILLFYVLTLFVLMAIYPWKSIGQNGSPFVEIFSSLGINSAANILNLVVITAAISAINSDIYGAGRMMYGLAQEGLAPKSFSRLTRNGVPYMTILVMAITLLCGVVLNYLIPKNVFLVIASIATFATVWVWLMILVSQVAMRRSMSKAQVARLAFPVPFWPLAPILTILFMAFIIAVLGYFPATRIAMYVGLAWVALMTLAWWIWLRKAPSCVIQERVKSSEIPS

SEQ ID NO: 3742 - protein, 189 aa, Pyrococcus horikoshii
  misc_feature (112)..(112): Xaa can be any naturally occurring amino acid
  misc_feature (148)..(148): Xaa can be any naturally occurring amino acid
MMIVIMDNGGQYVHRIWRTLRYLGVETKIIPNTTPLEEIKAMNPKGIIFSGGPSLENTGNCEKVLEHYDEFNVPILGICLGHQLIAKFFGGKVGRGEKAEYSLVEIEIIDEXEIFKGLPKRLKVWESHMDEVKELPPKFKILARSETXPIEAMKHEELPIYGVQFHPEVAHTEKGEEILRNFAKLCGEL

SEQ ID NO: 3743 - protein, 196 aa, Triticum aestivum
ASGVETVVVFPKNAGKIVPAGEETELLVGLQNDGESTLNVVAVHSTLHLPFDHRMYGQNLTVQNFFNASVPVSVQATFPYKFVVSKFLQPGAYDLVGYIVYEIDQHPYQNVFYNGTVEVVEAGGLLSVESVFLITLGIALLGLFGLWAYGQVQQFSKKTKKAPKVELGTGTTDANIDEWLEGTSFVQRSKSKKKQT

SEQ ID NO: 3744 - protein, 534 aa, Zea mays
  misc_feature (138)..(138): Xaa can be any naturally occurring amino acid
  misc_feature (144)..(144): Xaa can be any naturally occurring amino acid
  misc_feature (263)..(263): Xaa can be any naturally occurring amino acid
TNFLAESTVLAMDVALSTIVFVIAIFIPALLTLVQRSRSRHAGHNPPPPPEPRAIPLVGHLHHLLRKKPLHRCLAHLAERHGDVLGLRFGSSRVAVVSSASVAQQCLVALDTSFGNRPRLPSARILSYEWSTMGHSNXGPYWRXLGGTTSTEFSSVERVQHFADVHEQEARAMARRLCRVAHASGGRALVDVKSRLLEMLMNGLLDMLFRRTTSRSRSSDEKDEAVEVSEEARCFMAMAEETMELTLTVWDFLPPLARWLDVXRWARRLQRLQANRTEFLQRLIEEHKEMEKSGQVTRRTLVGVMLELQDKDPEAYTDQLIRSLCVSALEAGTLSTGYTIEWVMSLLLNNPHIMKKARDEIDACVGEPKRLLDATDLPKLPYLRCIILETLRLYPVVPLLVPRESSTNCTVNGFNIAKGTMLLVNTFAIHRDPRTWDDPETFLPERFEDGSNQSGKTTMDLSFGMGRRRCPAENLGMQLAGIALGTMIQCFNWERVGTELVDMAEGSGLTMAKKVPLEAFCQPRASMVDLLANI

SEQ ID NO: 3745 - protein, 472 aa, Synechococcus sp. WH 5701
MPPERFFLELDPPEALMRDWPHVVIVGGGFAGLKACHALAGKPVRVTLIDKRNFNLFQPLLYQVASGLVSEADVASPLRQMVGQAPNIQVLLGEVVDIDPQAKQVAFNDHSYGYDHLILASGSGSTYFGHEEWRPLAPPMKILEHADEIRRRLLMALEEAEQTRDPERRGFLQTVVVVGAGPAGCELAGSLIELMHRAIRCDFKQLQHDRCKVVLVDAVERVLPTMHPNLSTAAATHLQGAGVTLMMRSMVKGIAPGRVSLEGTDGPQELQAATICWTAGVRASRLGALLAERTGCPVDRGGRLLVEPDFSVPGHPDIHAIGDLCAYLHTSDGKSLPGMAGPAVQMGGWVAAHILARRGGSSVAPFRFTDLGSMAVIGPWYAVADLRGLHVTGLAGWVLWALAHLAFIPDTENRITLFTKWMWQIATRQRTALLITGRPDQHLGVDVGLFRAQLHPEADATASQQESEPLAA

SEQ ID NO: 3746 - protein, 431 aa, Synechococcus sp. WH 5701
MFDSLDLVIDSIVAREVLDSRGTPTVEAEVRLEGGAQGHAIVPSGASTGAHEAHELRDGGSRYAGKGVLQAVANIEEKIAPVLCGLTAIEQVAVDTTMIELDGSDNKSALGANAILAVSLAVARAAADGVGLPLYRYLGGPMATLLPVPLMNVINGGAHAANNLDFQEFMLVPHGAPSFREALRMGTEVFHVLKGLLSDQGLSTAVGDEGGFAPNLESNDAAGALLVAAIEKAGYKPGEEISLALDVASTEFYADGRYAFGGGSYSSAEMVDQLDALVSRYPIVSIEDGLAEDDWEGWALMTERMGSRLQLVGDDLFVTNTSRLQRGIDAGTANSILIKVNQIGSLTETLQAIDLAGRAGYTSVISHRSGETEDTTIADLAVATRAGQIKTGSLSRSERVAKYNRLLRIEDELGSQALYAGAEGRGPQGKL

SEQ ID NO: 3747 - protein, 252 aa, Triticum aestivum
  misc_feature (142)..(142): Xaa can be any naturally occurring amino acid
MVKKQPLSSLFYPVNSANKDTPPSSPPTPTATPQAWMWPSCKNPTAHSFRSPSASAAAAVAAKNTASLFVDSAESSSFTNSSARMHHDCAASDSLSTESEASGAAAEDMADAIVRGLRSDRLRFEPRAPSSSILEKKPPSSXARGHEAAGATSFGGGVAVAFESVDPYRDFRSSMEEMMTAHGAGDWDWLEKMLGWYLRANGKGTHAAIVSAFVDLVVTTTASSSSGHSSFTLAGSDLESSSAGRNGSFRLR

SEQ ID NO: 3748 - protein, 1146 aa, Populus tremula
MASQSQRQSNQPAHNQAQSSGTSNMRQHHHPTESVSKAIAQYTVDAQLHAVFEQSGGTGKSFDYSKSVRTPNQSVPEEQITAYLSKIQRGGHIQPFGCMIAADEQSFRVIAYSENAKDMLGLTPQSVPSLEKQEILFVGADVRILFRPSSAVLLEKAFGAREITLLNPIWIHSKNSGKPFYAILHRIDVGIVIDLEPARTEDPALSIAGAVQSQKLAVRAISQLQSLPGGDIKLLCDTVVDSVRELTGYDRVMVYKFHEDEHGEVVAENKRVDLEPYIGLHYPSTDIPQASRFLFKQNRVRMIVDCHAIPVSVIQDEGLMQPLCLVGSTLRAPHGCHAHYMENMGSIASLAMAVIIYGNDEEAIGGRNSMRLWGLVVCHHTSARCIPFPLRYACEFLMQAFGLQLNMELQLASQLLEKHVLRTQTLLCDMLLRDSPTGIVTQSPSIMDLVKCDGAALYYQGQYYPLGVTPTEAQIKDIVEWLLTLHGDPTGLSTDSLADAGYPGAAFLGDAVCGMAVAYIAERDFLFWFRSHTAKEVKWGGAKHHPEDKDDGQRMHPRSSFKAFLEVVKSRSLPWENAEMDAIHSLQLILRDSFRDAEATNSKAVVHTQLKDMELQGMDELSSVAREMVRLIETATAPIFAVDVEGRINGWNAKVAELTGLSVEEAMGKSLVHDLVYKEYEEIVDKLIHRAVKGEEDKNVEIKLRTFCSEHQKKAVFVVVNACSSKDYMDNIVGVCFVGQDVTGQKVVMDKYVLIQGDYKAIVHSPNPSIPPIFASDENTCCLEWNTALEKLTGWSRGEVVGKMLVGEVFGSCCRLKGPDALTKFMIALHNAIGGIDTDKLPFSFFDRNEKNVQTLLTANKRVNMKGDIIGAFCFLQIASPELQPSLKVQKQQEKKSFARMKELAYICQEIKNPLSGIHFTNSLLENTDLTEDQQQFLETSAACEKQILKIIRDIDLESIENGSLELEKAEFLLGSVINAVVSQAMLLLRERNLQLLRDIPEEIKTLAVYGDQARIQQVLADFLLNMVRYAPSSAGWVEIHVCPTLKQISDGHTLVHTEFRYLERVLQTRMLGLQHPLRSFLNCKLTLVMLHREGMVPKIQFQGLSVCQGRLIWLSFPENTTVALYPLTIWFLLLHRHQSRSITHT

SEQ ID NO: 3749 - protein, 378 aa, Glycine max
MLPLRLSAVVSSLILCFLFPPLLCLGIRSFPTTADDGAFFHYSEAPEYRNGAGCPVSSTRVSLPSWDPSLVHIAMTLDSGYLRGSIAAVNSVLRHSSCPENVFFHFIAAEFDPASPRVLTRLVGSIFPSLNFKVYIFREDTVINLISSSIRQALENPLNYARNYLGDMLDACVSRVIYLDSDVVVVDDVGKLWRAPITRERVIAAPEYCHANFTKYFTDEFWNDPLLSRVFSTRKPCYFNTGVMVMDLAKWREGNYRRKIENWMELQRKKRIYELGSLPPFLLVFGGNVEAIDHRWNQHGLGGDNLNGVCRSLHPGPVSLLHWSGKGKPWVRLDEKKPCPLDSLWEPYDLYKQVKDRVRDQNWGFSSSILVGYAHDLL

SEQ ID NO: 3750 - protein, 1146 aa, Populus tremula
MASQSQRQSNQPAHNQAQSSGTSNMRQHHHPTESVSKAIAQYTVDAQLHAVFEQSGGTGKSFDYSKSVRTPNQSVPEEQITAYLSKIQRGGHIQPFGCMIAADEQSFRVIAYSENAKDMLGLTPQSVPSLEKQEILFVGADVRILFRPSSAVLLEKAFGAREITLLNPIWIHSKNSGKPFYAILHRIDVGIVIDLEPARTEDPALSIAGAVQSQKLAVRAISQLQSLPGGDIKLLCDTVVDSVRELTGYDRVMVYKFHEDEHGEVVAENKRVDLEPYIGLHYPSTDIPQASRFLFKQNRVRMIVDCHAIPVSVIQDEGLMQPLCLVGSTLRAPHGCHAQYMENMGSIASLAMAVIIYGNDEEAIGGRNSMRLWGLVVCHHTSARCIPFPLRYACEFLMQAFGLQLNMELQLASQLLEKHVLRTQTLLCDMLLRDSPTGIVTQSPSIMDLVKCDGAALYYQGQYYPLGVTPTEAQIKDIVEWLLTLHGDPTGLSTDSLADAGYPGAAFLGDAVCGMAVAYIAERDFLFWFRSHTAKEVKWGGAKHHPEDKDDGQRMHPRSSFKAFLEVVKSRSLPWENAEMDAIHSLQLILRDSFRDAEATNSKAVVHTQLKDMELQGMDELSSVAREMVRLIETATAPIFAVDVDGCINGWNAKVAELTGLSVEEAMGKSLVHDLVYKEYEEIVDKLIHRAVKGEEDKNVEIKLRTFCSEHQKKAVFVVVNACSSKDYMDNIVGVCFVGQDVTGQKVVMDKYVLIQGDYKAIVHSPNPSIPPIFASDENTCCLEWNTALEKLTGWSRGEVVGKMLVGEVFGSCCRLKGPDALTKFMIALHNAIGGIDTDKLPFSFFDRNEKNVQTLLTANKRVNIKGDIIGAFCFLQIASPELQPSLKVQKQQEKKSFARMKELAYICQEIKNPLSGIHFTNSLLENTDLTEDQQQFLETSAACEKQILKIIRDIDLESIENGSLELEKAEFLLGSVINAVVSQAMLLLRERNLQLLRDIPEEIKTLAVYGDQARIQQVLADFLLNMVRYAPSSAGWVEIHVCPTLKQISDGHTLVHTEFRYLERVLQTRMLGLQHPLRSFLNCKLTLVMLHREGMVPKIQFQGLSVCQGRLIWLSYPENTTVALYPLTIWFLLLHRHQSRSITHT

SEQ ID NO: 3751 - protein, 325 aa, Kineococcus radiotolerans SRS30216
MSGNPRNISLEPAAQAFVDATSEPPFLYQLAPEGGRKAVDSVQDEPIDKPEVDEQWITVDGGPTGSVPVRIVKPLGTTGTGTGAALPVIVYTHGAGWVFGNAHTHDRLVRDLAVGTGAAVVFPEYDRSPEARYPVANEQSWTALQWVVREGAAHGLDASRIAVAGDSVGGNMAIALTLMAKERGGVDLRAQVLFYPVTDAAFDTPSYHEFANGYFLTREGMQWFWDQYTTSDADRAQITASPLRASTGQLTGLPPALVITAQADVLRDEGEAYAVKLREAGVPVTQVRYQGIVHDFVMVNALHQTEAAKAAVAQAVATLRTALHG

SEQ ID NO: 3752 - protein, 1146 aa, Populus tremula
MASQSQRQSNQPAHNQAQSSGTSNMRQHHHPTESVSKAIAQYTVDAQLHAVFEQSGGTGKSFDYSKSVRTPNQSVPEEQITAYLSKIQRGGHIQPFGCMIAADEQSFRVIAYSENAKDMLGLTPQSVPSLEKQEILFVGADVRILFRPSSAVLLEKAFGAREITLLNPIWIHSKNSGKPFYAILHRIDVGIVIDLEPARTEDPALSIAGAVQSQKLAVRAISQLQSLPGGDIKLLCDTVVDSVRELTGYDRVMVYKFHEDEHGEVVAENKRVDLEPYIGLHYPSTDIPQASRFLFKQNRVRMIVDCHAIPVSVIQDEGLMQPLCLVGSTLRAPHGCHAQYMENMGSIASLAMAVIIYGNDEEAIGGRNSMRLWGLVVCHHTSTRCIPFPLRYACEFLMQAFGLQLNMELQLASQLLEKHVLRTQTLLCDMLLRDSPTGIVTQSPSIMDLVKCDGAALYYQGQYYPLGVTPTEAQIKDIVEWLLTLHGDPTGLSTDSLADAGYPGAAFLGDAVCGMAVAYIAERDFLFWFRSHTAKEVKWGGAKHHPEDKDDGQRMHPRSSFKAFLEVVKSRSLPWENAEMDAIHSLQLILRDSFRDAEATNSKAVVHTQLKDMELQGMDELSSVAREMVRLIETATAPIFAVDVDGCINGWNAKVAELTGLSVEEAMGKSLVHDLVYKEYEEIVDKLIHRAVKGEEDKNVEIKLRTFCSEHQKKAVFVVVNACSSKDYMDNIVGVCFVGQDVTGQKVVMDKYVLIQGDYKAIVHSPNPSIPPIFASDENTCCLEWNTAMEKLTGWSRGEVVGKMLVGEVFGNCCRLKGPDALTKFMIALHNAIGGIDTDKLPFSFFDRNEKNVQTLLTANKRVNMKGDIIGAFCFFRIASPELQPSLKVQKQQEKKSFARMKELAYICQEIKNPLSGIHFTNSLLENTDLTEDQQQFLETSAACEKQILKIIRDIDLESIENGSLELEKAEFLLGSVINAVVSQAMLLLRERNLQLLRDIPEEIKTLAVYGDQARIQQVLADFLLNMVRYAPSSAGWVEIHVCPTLKQISDGHTLVHTEFKYLERVLQTRMLGLQHPLRSFLNCKLTLVMLHREGMVPKIQFQGLSVCQGRLIWLSYPENTTVALYPLTIWFLLLHRHQSRSITHT

SEQ ID NO: 3753 - protein, 1146 aa, Populus tremula
MASQSQRQSNQPAHNQAQSSGTSNMRQHHHPTESVSKAIAQYTVDAQLHAVFEQSGGTGKSFDYSKSVRTPNQSVPEEQITAYLSKIQRGGHIQPFGCMIAADEQSFRVIAYSENAKDMLGLTPQSVPSLEKQEILFVGADVRILFRPSSAVLLEKAFGAREITLLNPIWIHSKNSGKPFYAILHRIDVGIVIDLEPARTEDPALSIAGAVQSQKLAVRAISQLQSLPGGDIKLLCDTVVDSVRELTGYDRVMVYKFHEDEHGEVVAENKRVDLEPYIGLHYPSTDIPQASRFLFKQNRVRMIVDCHAIPVSVIQDEGLMQPLCLVGSTLRAPHGCHAQYMENMGSIASLAMAVIIYGNDEEAIGGRNSMRLWGLVVCHHTSARCIPFPLRYACEFLMQAFGLQLNMELQLASQLLEKHVLRTQTLLCDMLLRDSPTGIVTQSPSIMDLVKCDGAALYYQGQYYPLGVTPTEAQIKDIVEWLLTLHGDPTGLSTDSLADAGYPGAAFLGDAVCGMAVAYIAERDFLFWFRSHTAKEVKWGGAKHHPEDKDDGQRMHPRSSFKAFLEVVKSRSLPWENAEMDAIHSLQLILRDSFRDAEATNSKAVVHTQLKDMELQGMDELSSVAREMVRLIETATAPIFAVDVEGRINGWNAKVAELTGLSVEEAMGKSLVHDLVYKEYEEIVDKLIHRAVKGEEDKNVEIKLRTFCSEHQKKAVFVVVNACSSKDYMDNIVGVCFVGQDVTGQKVVMDKYVLIQGDYKAIVHSPNPSIPPIFASDENTCCLEWNTALEKLTGWSRGEVVGKMLVGEVFGSCCRLKGPDALTKFMIALHNAIGGIDTDKLPFSFFDRNEKNVQTLLTANKRVNMKGDIIGAFCFLQIASPELQPSLKVQKQQEKKSFARMKELAYICQEIKNPLSGIHFTNSLLENTDLTEDQQQFLETSAACEKQILKIIRDIDLESIENGSLELEKAEFLLGSVINAVVSQAMLLLRERNLQLLRDIPEEIKTLAVYGDQARIQQVLADFLLNMVRYAPSSAGWVEIHVCPTLKQISDGHTLVHTEFRYLERVLQTRMLGLQHPLRSFLNCKLTLVKLHREGMVPKIQFQGLSVCQGRLIWLSFPENTTVALYPLTIWFLLLHRHQSRSITHT

SEQ ID NO: 3754 - protein, 1146 aa, Populus tremula
MASQSQRQSNQPAHNQAQSSGTSNMRQHHHPTESVSKAIAQYTVDAQLHAVFEQSGGTGKSFDYSKSVRTPNQSVPEEQITAYLSKIQRGGHIQPFGCMIAADEQSFRVIAYSENAKDMLGLTPQSVPSLEKQEILFVGADVRILFRPSSAVLLEKAFGAREITLLNPIWIHSKNSGKPFYAILHRIDVGIVIDLEPARTEDPALSIAGAVQSQKLAVRAISQLQSLPGGDIKLLCDTVVDSVRELTGYDRVMVYKFHEDEHGEVVAENKRVDLEPYIGLHYPSTDIPQASRFLFKQNRVRMIVDCHAIPVSVIQDEGLMQPLCLVGSTLRAPHGCHAQYMENMGSIASLAMAVIIYGNDEEAIGGRNSMRLWGLVVCHHTSARCIPFPLRYACEFLMQAFGLQLNMELQLASQLLEKHVLRTQTLLCDMLLRDSPTGIVTQSPSIMDLVKCDGAALYYQGQYYPLGVTPTEAQIKDIVEWLLTLHGDPTGLSTDSLADAGYPGAAFLGDAVCGMAVAYIAERDFLFWFRSHTAKEVKWGGAKHHPEDKDDGQRMHPRSSFKAFLEVVKSRSLPWENAEMDAIHSLQLILRDSFRDAEATNSKAVVHNQLKDMELQGMDELSSVAREMVRLIETATAPIFAVDVDGRINGWNAKVAELTGLSVEEAMGKSLVHDLVYKEYEEIVDKLIHRAVKGEEDKNVEIKLRTFCSEHQKKAVFVVVNACSSKDYMDNIVGVCFVGQDVTGQKVVMDKYVLIQGDYKAIVHSPNPSIPPIFASDENTCCLEWNTAMEKLTGWSRGEVVGKMLVGEVFGSCCRLKGPDALTKFMIALHNAIGGIDTDKLPFSFFDRNEKNVQTLLTANKRVNMKGDIIGAFCFLQIASPELQPSLKVQKQQEKKSFARMKELAYICQEIKNPLSGIHFTNSLLENTDLTEDQQQFLETSAACEKQILKIIRDIDLESIENGSLELEKAEFLLGSVINAVVSQAMLLLRERNLQLLRDIPEEIKTLAVYGDQARIQQVLADFLLNMVRYAPSSAGWVEIHVCPTLKQISDGHTLVHTEFRYLERVLQTRMLGLQHPLRSFLNCKLTLVMLHREGMVPKIQFQGLSVCQGRLIWLSFPENTTVALYPLTIWFLLLHRHQSRSITHT

SEQ ID NO: 3755 - protein, 1064 aa, Shewanella sp. MR-4
MEAITMFKASEVLAGRYDSANLDELFKAVTDNYIVDEEQYLSELIKLVPSSDEAIERVTRRAHELVNKVRQFDKKGLMVGIDAFLQQYSLETQEGIILMCLAEALLRIPDAATADALIEDKLSGAKWDEHLSKSDSVLVNASTWGLMLTGKIVKLDKKIDGTPSNLLNRLVNRLGEPVIRQAMMAAMKIMGKQFVLGRTMKEALKNSEDKRKLGYTHSYDMLGEAALTRKDAEKYFNDYANAITELGAQSYNESESPRPTISIKLSALHPRYEVANEDRVLTELYDTVIRLIKLARGLNIGISIDAEEVDRLELSLKLFQKLFNSDATKGWGLLGIVVQAYSKRALPVLVWLTRLAKEQGDEIPVRLVKGAYWDSELKWAQQAGEAAYPLYTRKAGTDVSYLACARYLLSDATRGAIYPQFASHNAQTVAAISDMAGDRNHEFQRLHGMGQELYDTILSEAGAKAVRIYAPIGAHKDLLPYLVRRLLENGANTSFVHKLVDPKTPIESLVVHPLKTLTGYKTLANNKIVLPSDIFGSDRKNSKGLNMNIISEAEPFFAALDKFKSTQWQAGPLVNGQTLTGEHKTVVSPFDTTQTVGQVAFADKAAIEQAVASADAAFATWTRTPVEVRASALQKLADLLEENREELIALCTREAGKSIQDGIDEVREAVDFCRYYAVQAKKLMSKPELLPGPTGELNELFLQGRGVFVCISPWNFPLAIFLGQVSAALAAGNTVVAKPAEQTSIIGYRAVQLAHQAGIPTDVLQYLPGTGATVGNALTADERIGGVCFTGSTGTAKLINRTLANREGAIIPLIAETGGQNAMVVDSTSQPEQVVNDVVSSSFTSAGQRCSALRVLFLQEDIADRVIDVLQGAMDELVIGNPSSVKTDVGPVIDATAKANLDAHIDHIKQVGKLIKQMSLPAGTENGHFVSPTAVEIDSIRVLEKEHFGPILHVIRYKASELAHVIDEINSTGFGLTLGIHSRNEGHALEVADKVNVGNVYINRNQIGAVVGVQPFGGQGLSGTGPKAGGPHYLTRFVTEKTRTNNITAIGGNATLLSLGDSDA

SEQ ID NO: 3756 - protein, 120 aa, Oryza sativa
  misc_feature (111)..(111): Xaa can be any naturally occurring amino acid
MAARRGRGRGREWEDDDLGVGGGQPPHLAAPVVCLARSAGDLAAGAFVGSLVGYVINAGVAGCCTGLALSFPGAPQAMFHSCVTFAAFSCIMDGLNKQQAAMAATLASKPXSTIKHQEGD

SEQ ID NO: 3757 - protein, 297 aa, Robiginitalea biformata HTCC2501
MRSELKGTGVALVTPFREDLSPDIPALRKLVRHVIEGGVDYLVALGTTAESATLAPGEKAAVLRVIAEENDGRLPLVAGIGGNNTLSVAAEMESANLDGYDAILSVSPYYSRPTQEGIYQHFKYLAHRAPLPIVMYNVPARTGSNMLPETVARLARDCQGIVGIKEACGDIAQIHTLIDAVPRDFLVISGDDLTAVPTVLAGGVGVISVLGQALPVEFSTMIRQGLAGESGPATDLSESLRPLIGLIFREGNPAGVKMLLSQLGICRPEVRLPLMAASAELSRDLDTFMTAFLREKV

SEQ ID NO: 3758 - protein, 403 aa, Polaromonas sp. JS666
MSASSSGKRRFARIDRLPPYVFNITAELKLAARRRGEDIIDMSMGNPDGATPAHIVAKLTEVAQRPDTHGYSASKGIPRLRRAIAHWYQSRYQVAIDPDTEAIVTIGSKEGLAHLMLATLDRGDTVLVPDPSYPIHIYGAVIAGADIRSVPLTPDTDFFAELEKAIRGSYPKPKMMVLGFPSNPTAQCVELEFFEKVIALARKHDIFVVHDLAYADIVFDGWKAPSIMQVPGAKDIAVEFFTLSKSYNMAGWRVGFMVGNPDLVAALARIKSYHDYGTFTPLQVAAIAALEGDQSCVKEIAAQYQSRRDVLYKGLIEAGWQVDCPKASMYIWARIPEAYRKLGSLEFAKQLLEKARVCVSPGIGFGDHGDDHVRFALIENEARIRQAVRGIKAMFKADGLVRP

SEQ ID NO: 3759 - protein, 392 aa, Sulfolobus tokodaii str. 7
MEVDIVPVEGELNVGPQHPGSGHMRIYVKLNGDIIVDADLDVGYVHRAVEKLSEVRNYMHLIPLVERPAILDSIHMNLGYIMAVEKILGVDVPERAQYLRTLAAEVNRIASHLYGIGILAIFLGHSTGFMWGFGDREVWVEILQALTGARVTNSYIIPGGVRRDLIPTIKEMIEKAIVYQRKKVQDWYKIFVKNPNIRDRLENVGVMTRENAIKWGAVGPNLRASGVYYDVRKIEPYAAYDKVDFEIPVYKEGDAYARLLVRFEEIEQSMRILEQVIKNIPEGNILSDRFFKQIPPTRLKKWWEGQRRVVFPGYYASFRPPRGEAISRVEAARGELVYYVVSDGSPHPYRLRMITPSYRLIYVFKELAKGARYADLVAIYGSLDYFPPEADR

SEQ ID NO: 3760 - protein, 393 aa, Methanosarcina barkeri str. Fusaro
MRPSCDPSKFVADVVKEIPPSGIRRFFDLVSGLEDVISLGVGEPDFITPWHIREMCIHSLEKGQTSYTSNYGLPELRDELTRTYYRRYGLDYDPSSEILITTGVSEALDIAVRTVVNPGDEVIIVQPSYVAYLPSVVLAGGKPVIVSTHRDDEFSLTAEALKPAITDKTKAIILNFPNNPTGAIMSKEGLEDIADLVVENDLFVISDEVYECLTYEGKHVPLSSLDGMKERTVMLNGFSKAYAMTGLRLGFAMGSPEIIHSMMMIHQYSMLCAPITAQIGAIEALRHGKDEMERMVREYDRRRHFIVRGFNRIGLECCNPKGAFYAFPYVGNTGLSSSEFAERLLDEKKVVAIPGDAFGEAGEGFLRCAYAASINDIRKALDRMEDFVDRLKQ

SEQ ID NO: 3761 - protein, 357 aa, Thiomicrospira crunogena XCL-2
MTQEVLILPGDGIGPEITAEAVKVLEALQQKDNLDISMTHDLVGGAAYDQHGVPLAEETLEKAKQSDAILLGAVGGYQWESLDISVRPEKGLLALRSNLELFANLRPAYLFPQLADASTLKPEVVAGLDILIVRELTGGIYFGQPRGIRTLDNGERQGYNTYVYSESEIKRIAHVAFDAAMKRNKKLCSVDKANVLEVTEMWREIVDEVAKEYPEVEVQHMYVDNAAMQLVLNPKQFDVMVTGNMFGDILSDEASMLTGSIGMLASASLDANNKGMYEPSHGSAPDIAGQNIANPLATILSAAMMLRYSLNREDLALKIETAVSKVLDQGLRTGDIWSEGLTKVSTSEMGDAVVAAL

SEQ ID NO: 3762 - protein, 511 aa, Saccharomyces cerevisiae
MSKRSIEVNEEQDRVVSAKTESHSVPAIPASEEQDAPKNDLEEQLSDEFDSDGEIIEIDGDDEINDEDDLRKKQEEAETLVQKDQSEGNKEKIQELYLPHMSRPLGPDEVLEADPTVYEMLHNVNMPWPCLTLDVIPDTLGSERRNYPQSILLTTATQSSRKKENELMVLALSNLAKTLLKDDNEGEDDEEDDEDDVDPVIENENIPLRDTTNRLKVSPFAISNQEVLTATMSENGDVYIYNLAPQSKAFSTPGYQIPKSAKRPIHTVKNHGNVEGYGLDWSPLIKTGALLSGDCSGQIYFTQRHTSRWVTDKQPFTVSNNKSIEDIQWSRTESTVFATAGCDGYIRIWDTRSKKHKPAISVKASNTDVNVISWSDKIGYLLASGDDNGTWGVWDLRQFTPSNADAVQPVAQYDFHKGAITSIAFNPLDESIVAVGSEDNTVTLWDLSVEADDEEIKQQAAETKELQEIPPQLLFVHWQKEVKDVKWHKQIPGCLVSTGTDGLNVWKTISV

SEQ ID NO: 3763 - protein, 169 aa, Sulfolobus tokodaii str. 7
MVMDKVKEYKKEKNPFRLFVDHLNAVGTGIKYMIQPQRITLKYPEESLTLPTGYRGMIRLYKDICIGCTLCALICPADAMKMVTEGGKKFPSINYGRCVFCGFCVDVCPVDALKETRVHDAVFTNRRDLVFRPDRFDQDFDQPIPSQGIVKKVRAVVDEKKGIKYVPDE

SEQ ID NO: 3764 - protein, 1146 aa, Populus tremula
MASQSQRQSNQPAHNQAQSSGTSNMRQHHHPTESVSKAIAQYTVDAQLHAVFEQSGGTGKSFDYSKSVRTPNQSVPEEQITAYLSKIQRGGHIQPFGCMIAADEQSFRVIAYSENAKDMLGLTPQSVPSLEKQEILFVGADVRILFRPSSAVLLEKAFGAREITLLNPIWIHSKNSGKPFYAILHRIDVGIVIDLEPARTEDPALSIAGAVQSQKLAVRAISQLQSLPGGDIKLLCDTVVDSVRELTGYDRVMVYKFHEDEHGEVVAENKRVDLEPYIGLHYPSTDIPQASRFLFKQNRVRMIVDCHAIPVSVIQDEGLMQPLCLVGSTLRAPHGCHAQYMENMGSIASLAMAVIIYGNDEEAIGGRNSMRLWGLVVCHHTSARCIPFPLRYACEFLMQAFGLQLNMELQLASQLLEKHVLRTQTLLCDMLLRDSHTGIVTQSPSIMDLVKCDGAALYYQGQYYPLGVTPTEAQIKDIVEWLLTLHGDPTGLSTDSLADAGYPGAAFLGDAVCGMAVAYIAERDFLFWFRSHTAKEVKWGGAKHHPEDKDDGQRMHPRSSFKAFLEVVKSRSLPWENAEMDAIHSLQLILRDSFRDAEATNSKAVVHNQLKDMELQGMDELSSVAREMVRLIETATAPIFAVDVEGRINGWNAKVAELTGLSVEEAMGKSLVHDLVYKEYEEIVDKLIHRAVKGEEDKNVEIKLRTFCSEHQKKAVFVVVNACSSKDYMDNIVGVCFVGQDVTGQKVVMDKYVLIQGDYKAIVHSPNPSIPPIFASDENTCCLEWNTALEKLTGWSRGEVVGKMLVGEVFGSCCRLKGPDALTKFMIALHNAIGGIDTDKLPFSFFDRNEKNVQTLLTANKRVNMKGDIIGAFCFLQIASPELQPSLKVQKQQEKKSFARMKELAYICQEIKNPLSGIHFTNSLLENTDLTEDQQQFLETSAACEKQILKIIRDIDLESIENGSLELEKAEFLLGSVINAVVSQAMLLLRERNLQLLRDIPEEIKTLAVYGDQARIQQVLADFLLNMVRYAPSSAGWVEIHVCPTLKQISDGHTLVHTEFRYLERVLQTRMLGLQHPPRSFLNCKLTLVKLHREGMVPKIQFQGLSVCQGRLIWLRFPENTTVALYPLTIWFLLLHRHQSRSITHT

SEQ ID NO: 3765 - protein, 467 aa, Pseudomonas aeruginosa PAO1
MMESYDVIVIGAGPGGYNAAIRAGQLGLKVACVEGRETLGGTCLNVGCMPSKALLHASELYAAASGGEFARLGIRVSPELDLAQMMKQKDESVAALTRGVEFLFRKHKVQWIKGWARLQGEGRVGVALADGGHAQLEARDIVIATGSEPAPLPGVPVDNQRILDSTGALELVEVPRHLVVIGAGVIGLELGSVWRRLGAQVTVLEYLERICPGLDGETARTLQRALTRQGMRFRLGTRVVAARSGEQGVELDLQPAAGGATESLQADYVLVAIGRRPYTEGLGLETVGLASDRRGMLENQGQRSAAPGVWVIGDVTSGPMLAHKAEEEAIVCIERIAGHAAEMNAEVIPSVIYTQPEVASVGLGEEQLQAARREYKVGRFPFSANSRAKINHESEGFIKILSDARSDQVLGVHMIGPGVSEMIGEACVAMEFSASAEDLALTCHPHPTRSEALRQAAMDVHGRAMQN

SEQ ID NO: 3766 - protein, 1146 aa, Populus tremula
MASQSQRQSNQPAHNQAQSSGTSNMRQHHHPTESVSKAIAQYTVDAQLHAVFEQSGGTGKSFDYSKSVRTPNQSVPEEQITAYLSKIQRGGHIQPFGCMIAADEQSFRVIAYSENAKDMLGLTPQSVPSLEKQEILFVGADVRILFRPSSAVLLEKAFGAREITLLNPIWIHSKNSGKPFYAILHRIDVGIVIDLEPARTEDPALSIAGAVQSQKLAVRAISQLQSLPGGDIKLLCDTVVDSVRELTGYDRVMVYKFHEDEHGEVVAENKRVDLEPYIGLHYPSTDIPQASRFLFKQNRVRMIVDCHAIPVSVIQDEGLMQPLCLVGSTLRAPHGCHAQYMENMGSIASLAMAVIIYGNDEEAIGGRNSMRLWGLVVCHHTSARCIPFPLRYACEFLMQAFGLQLNMELQLASQLLEKHVLRTQTLLCDMLLRDSPTGIVTQSPSIMDLVKCDGAALYYQGQYYPLGVTPTEAQIKDIVEWLLTLHGDPTGLSTDSLADAGYPGAAFLGDAVCGMAVAYIAERDFLFWFRSHTAKEVKWGGAKHHPEDKDDGQRMHPRSSFKAFLEVVKSRSLPWENAEMDAIHSLQLILRDSFRDAEATNSKAVVHNQLKDMELQGMDELSSVAREMVRLIETATAPIFAVDVEGRINGWNAKVAELTGLSVEEAMGKSLVHDLVYKEYEEIVDKLIHRAVKGEEDKNVEIKLRTFCSEHQKKAVFVVVNACSSKDYMDNIVGVCFVGQDVTGQKVVMDKYVLIQGDYKAIVHSPNPSIPPIFASDENTCCLEWNTALEKLTGWSRGEVVGKMLVGEVFGSCCRLKGPDALTKFMIALHNAIGGIDTDKLTFSFFDRNEKNVQTLLTANKRVNIKGDIIGAFCFLQIASPELQPSLKVQKQQEKKSFARMKELAYICQEIKNPLSGIHFTNSLLENTDLTEDQQQFLETSAACEKQILKIIRDIDLESIENGSLELEKAEFLLGSVINAVVSQAMLLLRERNLQLLRDIPEEIKTLAVYGDQARIQQVLADFLLNMVRYAPSSAGWVEIHVCPTLKQISDGHTLVHTEFRYLERVLQTRMLGLQHPPRSFLNCKLTLVMLHREGMVPKIQFQGLSVCQGRLIWLSFPENTTVALYPLTIWFLLLHRHQSRSITHT

SEQ ID NO: 3767 - protein, 707 aa, Zea mays
  misc_feature (696)..(696): Xaa can be any naturally occurring amino acid
MPESFTLHDSEKHYSDVFVVGGYKWRVLIFPKGNNVDHFSMYLDVADSGNLPYGWSRYAQFSLAVVNQIHPKYTIRKDTQHQFNARESDWGFTSFMPLSDLYDPSRGYLVNDTVIVEAEVAVRRMVDYWTYDSKKETGFVGLKNQGATCYMNSLLQTLYHTPYFRKAVYHMPTTENDMPSGSIPLALQSLFYKLQYSDNSVATKELTKSFGWDTYDSFMQHDVQELNRVLCEKLEDKMKGTVVEGTIEQLFVGHHINYIECINVDYKSNRKESFYDLQLDVKGCRDVYASFDKYVEVESLEGDNKYHAERYGLQDARKGVLFLDFPPVLQLQLKRFEYDYMRDTMVKINDRYEFPLQLDLDRDNGKYLSPDADRSIRNLYTLHSVLVHSGGVHGGHYYAFIRPTLSDQWYKFDDERVTKEDTKKALEEQYGGEEELPQINPGFNNTPFKFTKYSNAYMLVYIRENDKDKIMCNVDEKDIAEHLRIRLKKEQEEKEHKKKEKSEAHLYTIIKIARDEDLKEQIGKNIYFDLVDHEKVHSFRIQKQLPFTSFKEEVAKEFGIPVQFQRFWLWAKRQNHTYRPNRPLTPHEEAQSVGQLREVSNKAHNAELKLFLEVELGPELCPIRPPEKSKEDILLFFKLYNAEKEELHFVGRLFVKALGKPSEILTKLNAMAGFSPNEEIELYEEIKFEPNVMCEXHIDKKLTFPAS

SEQ ID NO: 3768 - protein, 1146 aa, Populus tremula
MASQSQRQSNQPAHNQAQSSGTSNMRQHHHPTESVSKAIAQYTVDAQLHAVFEQSGGTGKSFDYSKSVRTPNQSVPEEQITAYLSKIQRGGHIQPFGCMIAADEHSFRVIAYSENAKDMLGLTPQSVPSLEKQEILFVGADVRILFRPSSAVLLEKAFGAREITLLNPIWIHSKNSGKPFYAILHRIDVGIVIDLEPARTEDPALSIAGAVQSQKLAVRAISQLQSLPGGDIKLLCDTVVDSVRELTGYDRVMVYKFHEDEHGEVVAENKRVDLEPYIGLHYPSTDIPQASRFLFKQNRVRMIVDCHAIPVSVIQDEGLMQPLCLVGSTLRAPHGCHAHYMENMGSIASLAMAVIIYGNDEEAIGGRNSMRLWGLVVCHHTSTRCIPFPLRYACEFLMQAFGLQLNMELQLASQLLEKHVLRTQTLLCDMLLRDSPTGIVTQSPSIMDLVKCDGAALYYQGQYYPLGVTPTEAQIKDIVEWLLTLHGDPTGLSTDSLADAGYPGAAFLGDAVCGMAVAYIAERDFLFWFRSHTAKEVKWGGAKHHPEDKDDGQRMHPRSSFKAFLEVVKSRSLPWENAEMDAIHSLQLILRDSFRDAEATNSKAVVHNQLKDMELQGMDELSSVAREMVRLIETATAPIFAVDVEGRINGWNAKVAELTGLSVEEAMGKSLVHDLVYKEYEEIVDKLIHRAVKGEEDKNVEIKLRTFCSEHQKKAVFVVVNACSSKDYMDNIVGVCFVGQDVTGQKVVMDKYVLIQGDYKAIVHSPNPSIPPIFASDENTCCLEWNTALEKLTGWSRGEVVGKMLVGEVFGSCCRLKGPDALTKFMIALHNAIGGIDTDKLPFSFFERNEKNVQTLLTANKRVNIKGDIIGPFCFFQIASPEFQPSLKVQKQQEKKSFARMKELAYICQEIKNPLSGIHFTNSLLENTDLTEDQQQFLETSAACEKQILKIIRDIDLESIENGSLELEKAEFLLGSVINAVVSQAMLLLRERNLQLLRDIPEEIKTLAVYGDQARIQQVLADFLLNMVRYAPSSAGWVEIHVCPTLKQISDGHTLVHTEFRYLERVLQTRMLGLQHPPRSFLNCKLTLVMLHREGMVPKIQFQGLSVCQGRLIWLSFPENTTVALYPLTIWFLLLHRHQSRSITHT

SEQ ID NO: 3769 - protein, 265 aa, Pseudomonas aeruginosa PAO1
MNEQIGNGVALVTGASSGIGATYAEHLARRGHDLLLVARDRQRLEALADRLRQAHGVRVEILRADLSERDDRLRVERRLRDDASIALLVNNAGVAMNGPLADADMDRAERMIALNVVALTRLAAGAAEGFRRRGGGAIVNLGSVVALAPELFNAVYSATKAYVLSLSQSLQHELAGSGVYVQAVLPGVTRTEIWERSGTGIAGIPAEMVMEVEDLVEAALVGFDRREAVTIPSLPDAADWQALMTARARLAPNLSRQRPAERYLG

SEQ ID NO: 3770 - protein, 1146 aa, Populus tremula
MASQSQRQSNQPAHNQAQSSGTSNMRQHHHPTESVSKAIAQYTVDAQLHAVFEQSGGTGKSFDYSKSVRTPNQSVPEEQITAYLSKIQRGGHIQPFGCMIAADEQSFRVIAYSENAKDMLGLTPQSVPSLEKQEILFVGADVRILFRPSSAVLLEKAFGAREITLLNPIWIHSKNSGKPFYAILHRIDVGIVIDLEPARTEDPALSITGAVQSQKLAVRAISQLQSLPGGDIKLLCDTVVDSVRGLTGYDRVMVYKFHEDEHGEVVAENKRVDLEPYIGLHYPSTDIPQASRFLFKQNRVRMIVDCHAIPVSVIQDEGLMQPLCLVGSTLRAPHGCHAQYMENMGSIASLAMAVIIYGNDEEAIGGRNSMRLWGLVVCHHTSARCIPFPLRYACEFLMQAFGLQLNMELQLASQLLEKHVLRTQTLLCDMLLRDSHTGIVTQSPSIMDLVKCDGAALYYQGQYYPLGVTPTEAQIKDIVEWLLTLHGDPTGLSTDSLADAGYPGAAFLGDAVCGMAVAYIAERDFLFWFRSHTAKEVKWGGAKHHPEDKDDGQRMHPRSSFKAFLEVVKSRSLPWENAEMDAIHSLQLILRDSFRDAEATNSKAVVHNQLKDMELQGMDELSSVAREMVRLIETATAPIFAVDVEGRINGWNAKVAELTGLSVEEAMGKSLVHDLVYKEYEEIVDKLIHRAVKGEEDKNVEIKLRTFCSEHQKKAVFVVVNACSSKDYMDNIVGVCFVGQDVTGQKVVMDKYVLIQGDYKAIVHSPNPSIPPIFASDENTCCLEWNTALEKLTGWSRGEVVGKMLVGEVFGSCCKLKGPDALTKFMIALHNAIGGIDTDKLPFSFFDRNEKNVQTLLTANKRVNIKGDIIGAFCFLQIASPELQPSLKVQKQQEKKSFARMKELAYICQEIKNPLSGIHFTNSLLENTDLTEDQQQFLETSAACEKQILKIIRDIDLESIENGSLELEKAEFLLGSVINAVVSQAMLLLRERNLQLLRDIPEEIKTLAVYGDQARIQQVLADFLLNMVIYTQSSAGWVEIHVCPTLKQISDGHTLVHTEFRYLERVLQTRMLGLQHPPRSFLNCKLTLVKLHREGMVPKIQFQGLSVCQGRLIWLSFPENTTVALYPLTIWFLLLHRHQSRSITHT

SEQ ID NO: 3771 - protein, 292 aa, Clostridium perfringens ATCC 13124
MSNEKLFPTTFPVQNQSIHPGVEDEMNPLPIYDLPQYINDGKRLKNKVAIITGGDSGIGRAVALAYAREGAKVCIIYLSDEEDKDANKTKELIESAGSEALVIKGNISDINFCTSSVKKVIEKWGKLDILVNNAAVQHDSKTLDDIGPEQIENTFKINVFGTFYMTKAAVKYMECGSSIINTTSITAYRGNEILFDYSCTKGALTTMTRTLATMLVKNGIRVNAVAPGPIWTPLIPSSMNKKKVSEFGVNSPMGRAGQPVELAGAYVFLACNEASYISGITIHVNGGEIING

SEQ ID NO: 3772 - protein, 1146 aa, Populus tremula
MASQSQRQSNQPAHNQAQSSGTSNMRQHHHPTESVSKAIAQYTVDAQLHAVFEQSGGTGKSFDYSKSVRTPNQSVPEEQITAYLSKIQRGGHIQPFGCMIAADEQSFRVIAYSENAKDMLGLTPQSVPSLEKQEILFVGADVRILFRPSSAVLLEKAFGAREITLLNPIWIHSKNSGKPFYAILHRIDVGIVIDLEPARTEDPALSIAGAVQSQKLAVRAISQLQSLPGGDIKLLCDTVVDSVRELTGYDRVMVYKFHEDEHGEVVAENKRVDLEPYIGLHYPSTDIPQASRFLFKQNRVRMIVDCHAIPVSVIQDEGLMQPLCLVGSTLRAPHGCHAQYMENMGSIASLAMAVIIYGNDEEAIGGRNSMRLWGLVVCHHTSTTCIPFPLRYACEFLMQAFGLQLNMELQLASQLLEKHVLRTQTLLCDMLLRDSHTGIVTQSPSIMDLVKCDGAALYYQGQYYPLGVTPTEAQIKDIVEWLLTLHGDPTGLSTDSLADAGYPGAAFLGDAVCGMAVAYIAERDFLFWFRSHTAKEVKWGGAKHHPEDKDDGQRMHPRSSFKAFLEVVKSRSLPWENAEMDAIHSLQLILRDSFRDAEATNSKAVVHNQLKDMELQGMDELSSVAREMVRLIETATAPIFAVDVDGRINGWNAKVAELTGLSVEEAMGKSLVHDLVYKEYEEIVDKLIHRAVKGEEDKNVEIKLRTFCSEHQKKAVFVVVNACSSKDYMDNIVGVCFVGQDVTGQKVVMDKYVLIQGDYKAIVHSPNPSIPPIFASDENTCCLEWNTAMEKLTGWSRGEVVGKMLVGEVFGSCCRLKGPDALTKFMIALHNAIGGIDTDKLPFSFFDRNEKNVQTLLTANKRVNIKGDIIGPFCFFQIASPEFQPSLKVQKQQEKKSFARMKELAYICQEIKNPLSGIHFTNSLLENTDLTEDQQQFLETSAACEKQILKIIRDIDLESIENGSLELEKAEFLLGSVINAVVSQAMLLLRERNLQLLRDIPEEIKTLAVYGDQARIQQVLADFLLNMVRYAPSSAGWVEIHVCPTLKQISDGHTLVHTEFRYLERVLQTRMLGLQHPPRSFLNCKLTLVMLHREGMVPKIQFQGLSVSQGRLIWLSFPENTTVALYPLTIWFLLLHRHQSRSITHT

SEQ ID NO: 3773 - protein, 390 aa, Scherffelia dubia
MATTACSIPTVARSVAGQRRAAKSFNGDASVFAARPARASVAARAVVVVTEAKAKVAINGFGRIGRNFLRCWHGRGASSGLDVVAINDSGGVKQASHLLKYDSTLGTFGADVQIVDDSHISVDGKVITVVSARDPLKLPWKEMGIDIVIEGTGVFLDSEGAGKHITAGAKKVVITAPAKGKDVPTYVIGVNDKDYNPKTDHIVSNASCTTNCLAPFVKVVDEKFGIVKGMMTTTHSYTGDQRLLDASHRDLRRARAAALNIVPTTTGAAKAVALVLPGLKGKLNGFALRVPTPNVSVVDLVVQVEKKTFAEEVNQAFRDAAAGPMKGVLAITDIPLVSVDFRCTDVSTTVDAALTMVMGDDMVKIVAWYDNEWGYSQRVVDLAELVAKKM

SEQ ID NO: 3774 - protein, 320 aa, Oceanobacillus iheyensis HTE831
MKRMDVIGIGETMVSLTPDKYGLIRQTSSFEPRVAGTETNTLIGLSRLGHNTGFISRLGEDELGAMVLKELRGENVDTKLIDLDPYHQTGLFLKEIINESDVHVYYYRQHSAASQMTRELLDESYISSASYLFITGITPAISESCKQTIFTAINMAKNNGVKIVFDPNIRKKLWSESEARQTLIEILKLSDIILPGISEGQFLLDSNDPEEIGKKCVDLGAELVVVKLGENGAYYCTSDHGDYVPSFPVKQVRDPVGAGDAFAAGLLSGLIDELSIEKAVERACITGGYATTYVGDYEGFPDKSRLERLTNLSTSEDVSR

SEQ ID NO: 3775 - protein, 909 aa, Bradyrhizobium sp. BTAi1
MTETSFALRIDDQVVDVPAGTTLLEAARQCGIAIPNVCACDRTGYAAEASCRFCLVEIKGERTLAPSCRREAEEGQVVRTSSERVLQTRRLVAELTLSEQGPEALRPGSRLAEALAQVGVGATRFGHRPTIERVTQQHPAITVDLDACIRCGLCRTACQDVQVNGVIGVAGRGAEACIVFDANVPLTDSSCVACGECVQVCPTGALAPVAAPIAETEPTTTAETICPFCSVGCRIELTVADGRVVRADGADGPANRSRLCVKGRFGFDFLHHPDRLTVPLIRRQDAPKHAVAVAGPDAVRDFFRPASWDEALDRAAAGLRAVADRHGADALAVLGSAKASNEDAYILQKLARTVLGTPHVDHCTRLCASVPPLGEAIGYSAVTAPIDEIDRADVVLMVGSNPEVNHPVGATFMKNAVRRGTKLILVDPYRQSFARHATYHLALRPGTDVTLISAMLNVVICEGLYDRTFVRERIDGFDELAARVRGVTPQLAQRLTGVDADLLVSAARMFATAERAMSFWGMGASQHVHGADNIRCVIALALICGHVGKPGSGLHPLRGQNNVQGSCDAGLIPSSFPGYAPVSDPQARARFTALWGTELPAKAGLTQVEILNAAHEGRIRGLYVAGGNPAMANPDLARTREALARLDHLVVQDIFPTETAAFADVILPAAALAERSGSVTNTDRVVQLLTPAVPAPGAARPDWWITAELARRLDAPWRHDALAGLFDEMAAAVPMLAGTSWSMLEGRGALALPLASANGSARSLFAERFPTPAGRARIAALDGRGPAEEPDADYPLILVTGRLLEHWHTGSMTRRAPVLHALAPEPMVRIAADVFDALGLECAARVRVATRRGGVTVAPCRDVGLQAGVIWMPFAYFEAAANDLTNSALDPTTRVPEYKYCAARITSET

SEQ ID NO: 3776 - protein, 337 aa, Ganoderma lucidum
MPVKVGINGFGRIGRIVLRNALLHGDIEVVAVNDPFISLEYMVYMFKYDSVHGRFKGAVEAKDGKLYVEGKPISVFEEKDPANINWSGVGAEYIVESTGVFTTVDKASAHLKGGAKKVVISAPSADAPMFVCGVNLDKYDSKYQVISNASCTTNCLAPLAKVINDNFGIVEGLMTTVHSTTATQRTVDGPSMKDWRGGRAVASNIIPSSTGAAKAVGKVIPSLNGKLTGMAFRVPTIDVSVVDLVVRLEKEATYDEIKAAVKSAATGNLKGIIDYTEDKVVSTDFTGSDASSIFDAEAGIALNKNFVKLIAWYDNEWGYSRRVCDLLVYAAKQDGAL

SEQ ID NO: 3777 - protein, 292 aa, Oryza sativa (japonica cultivar-group)
MVFDMGGNAVSVQRHGNFASVGILTLVSTRAKPLEVEIAKEDERMSSSADNTVYCCIAKGRKIIYCYNSKDGDPHMETTAALCLENAPSYHRHYIHTAGSRSYGYLMADGHTFFAIIDPSVGNVGALQFLERVREVFRTVNRSGFHDSLVPAVQRLVASLEKMPHATFDLEESVEKGEPSDSSSCTSSKVPLLGRSGSRKDKKKAKEKAASAAVCEDEQHGTRGVRIDVPPEEVGGMSLERSASQSRLRRQHSSRSLWVRHVKIIIVVDAIICILLFAAWLAVCKGFQCVSS

SEQ ID NO: 3778 - protein, 352 aa, Nostoc sp. PCC 7120
MKAKLRFQPVSHSWVALHPKPKGVIQFIGGAFFGTFAPMLFYRYLLQYLFDNGYTIILLPFNFTFNHYVEAGFLIREEYEITPQLIRMAKLANYDYQVYLNDRKFSWIGHSIGCKYIALLEAFSALPQQPKELEELIRDIVTKTSNPSDQAKNERKIQSIVENLEVLMNDLQQQRAKATQLIKYYLGYEPDTYWDRMENPNIDKTFFKSIFIKGQTSILLAPVNTGTDSAVPKFLANIIDRLGWGVKPSPQETYALIQATNLFNLLGLIRFKSDNIAKSTGDWFINVFKKPPTDFQNYLVGGHLKPLGIQLGGYVVNFPDSPPMIESPQRRNSELEIYIDKLLQALEKERQL

SEQ ID NO: 3779 - protein, 370 aa, Saccharomyces cerevisiae
MNIQSNNSPNLSNNIVSKQVYYAHPPPTIDPNDPVQISFPTTEVVGHGSFGVVFATVIQETNEKVAIKKVLQDKRFKNRELEIMKMLSHINIIDLKYFFYERDSQDEIYLNLILEYMPQSLYQRLRHFVHQRTPMSRLEIKYYMFQLFKSLNYLHHFANVCHRDIKPQNLLVDPETWSLKLCDFGSAKQLKPTEPNVSYICSRYYRAPELIFGATNYTNQIDIWSSGCVMAELLLGQPMFPGESGIDQLVEIIKILGTPSKQEICSMNPNYMEHKFPQIKPIPLSRVFKKEDDQTVEFLADVLKYDPLERFNALQCLCSPYFDELKLDDGKINQITTDLKLLEFDENVELGHLSPDELSSVKKKLYPKSK

SEQ ID NO: 3780 - protein, 1146 aa, Populus tremula
MASQSQRQSNQPAHNQAQSSGTSNMRQHHHPTESVSKAIAQYTVDAQLHAVFEQSGGTGKSFDYSKSVRTPNQSVPEEQITAYLSKIQRGGHIQPFGCMIAADEQSFRVIAYSENAKDMLGLTPQSVPSLEKQEILFVGADVRILFRPSSAVLLEKAFGAREITLLNPIWIHSKNSGKPFYAILHRIDVGIVIDLEPARTEDPALSIAGAVQSQKLAVRAISQLQSLPGGDIKLLCDTVVDSVRELTGYDRVMVYKFHEDEHGEVVAENKRVDLEPYIGLHYPSTDIPQASRFLFKQNRVRMIVDCHAIPVSVIQDEGLMQPLCLVGSTLRAPHGCHAQYMENMGSIASLAMAVIIYGNDEEAIGGRNSMRLWGLVVCHHTSARCIPFPLRYACEFLMQAFGLQLNMELQLASQLLEKHVLRTQTLLCDMLLRDSPTGIVTQSPSIMDLVKCDGAALYYQGQYYPLGVTPTEAQIKDIVEWLLTLHGDPTGLSTDSLADAGYPGAAFLGDAVCGMAVAYIAERDFLFWFRSHTAKEVKWGGAKHHPEDKDDGQRMHPRSSFKAFLEVVKSRSLPWENAEMDAIHSLQLILRDSFRDAEATNSKAVVHTQLKDMELQGMDELSSVAREMVRLIETATAPIFAVDVEGRINGWNAKVAELTGLSVEEAVGKSLVHDLVYKEYEEIVDKLIHRAVKGEEDKNVEIKLRTFCSEHQKKAVFVVVNACSSKDYMDNIVGVCFVGQDVTGQKVVMDKYVLIQGDYKAIVHSPNPSIPPIFASDENTCCLEWNTALEKLTGWSRGEVVGKMLVGEVFGSCCRLKGPDALTKFMIALHNAIGGIDTDKLTFSFFDRNEKNVQTLLTANKRVNIKGDIIGAFCFLQIASPELQPSLKVQKQQEKKSFARMKELAYICQEIKNPLSGIHFTNSLLENTDLTEDQQQFLETSAACEKQILKIIRDIDLESIENGSLELEKAEFLLGSVINAVVSQAMLLLRERNLQLLRDIPEEIKTLAVYGDQARIQQVLADFLLNMVRYAPSSAGWVEIHVCPTLKQISDGHTLVHTEFRYLERVLQTRMLGLQHPPRSFLNCKLTLVKLHREGMVPKIQFQGLSVSQGRLIWLSFPENTTVALYPLTIWFLLLHRHQSRSITHT

SEQ ID NO: 3781 - protein, 411 aa, Oryza sativa (indica cultivar-group)
MAGQQQGDSWDRIKAIIVVLDFDPSGDMNITKFTYKELSRVTENFSPSNKIGEGGFGSVYKGKLRNGKLVAVKVLSLESRQGAKEFLNELMAISNVSHENLVKLYGYCVEGNQRILVYNYLENNSLAQTLLGYGHSNIQFNWATRVNICVGIARGLTYLHEVVNPHIVHRDIKASNILLDKDLTPKISDFGLAKLLPPDASHVSTRVAGTFFTYSVLHDRGYLAPEYAIRGQVTRKSDVYSFGVLLLEIVSGRSNTNTRLPYEDQILLERFPEITNGVLLLQTWVHYEEGDLEKIIDASLGDDLDVAQACEMDVELAKISKPAIISDFMDLKVRSMRKEVDIVSSSTSTLLSSIMAHSSPLLSQETTEASMTFTAISDPSEVVHECMQMQACNNGWSIRDQHMSELEVITN

SEQ ID NO: 3782 - protein, 1146 aa, Populus tremula
MASQSQRQSNQPAHNQAQSSGTSNMRQHHHPTESVSKAIAQYTVDAQLHAVFEQSGGTGKSFDYSKSVRTPNQSVPEEQITAYLSKIQRGGHIQPFGCMIAADEQSFRVIAYSENAKDMLGLTPQSVPSLEKQEILFVGADVRILFRPSSAVLLEKAFGAREITLLNPIWIHSKNSGKPFYAILHRIDVGIVIDLEPARTEDPALSIAGAVQSQKLAVRAISQLQSLPGGDIKLLCDTVVDSVRELTGYDRVMVYKFHEDEHGEVVAENKRVDLEPYIGLHYPSTDIPQASRFLFKHNRVRMIVDCHAIPVSVIQDEGLMQPLCLVGSTLRAPHGCHAHYMENMGSIASLAMAVIIYGNDEEAIGGRNSMRLWGLVVCHHTSARCIPFPLRYACEFLMQAFGLQLNMELQLASQLLEKHVLRTQTLLCDMLLRDSPTGIVTQSPSIMDLVKCDGAALYYQGQYYPLGVTPTEAQIKDIVEWLLTLHGDPTGLSTDSLADAGYPGAAFLGDAVCGMAVAYIAERDFLFWFRSHTAKEVKWGGAKHHPEDKDDGQRMHPRSSFKAFLEVVKSRSLPWENAEMDAIHSLQLILRDSFRDAEATNSKAVVHNQLKDMELQGMDELSSVAREMVRLIETATAPIFAVDVDGRINGWNAKVAELTGLSVEEAMGKSLVHDLVYKEYEEIVDKLIHRAVKGEEDKNVEIKLRTFCSEHQKKAVFVVVNACSSKDYMDNIVGVCFVGQDVTGQKVVMDKYVLIQGDYKAIVHSPNPSIPPIFASDENTCCLEWNTALEKLTGWSRGEVVGKMLVGEVFGSCCRLKGPDALTKFMIALHNAIGGIDTDKLPFSFFERNEKNVQTLLTANKRVNMKGDIIGAFCFLQIASPELQPSLKVQKQQEKKSFARMKELAYICQEIKNPLSGIHFTNSLLENTDLTEDQQQFLETSAACEKQILKIIRDIDLESIENGSLELEKAEFLLGSVINAVVSQAMLLLRERNLQLLRDIPEEIKTLAVYGDQARIQQVLADFLLNMVRYAPSSAGWVEIHVCPTLKQISDGHTLVHTEFRYLERVLQTRMLGLQHPPRSFLNCKLTLVMLHREGMVPKIQFQGLSVCQGRLIWLSFPENTTVALYPLTIWFLLLHRHQSRSITHT

SEQ ID NO: 3783 - protein, 547 aa, Oceanobacillus iheyensis HTE831
MTELIHKTVGQLLQDRADDMPGQEAVVYSDRGLRYTYKEFNQLCEKVARGIMALSIDKGEHVAVWGTNTPEWLTLQYATGKMGAVLVTVNTSYRANELEYLLKQSDSTTIFLIENYRDHSYIDTLYEICPELHESIPGELNAERLPSLKNVVIMGEKRYPGAFHWNDIIDKAEEISREELIFQSQNLDPNDVINMQYTSGTTGFPKGVMLTHRNLTNNGFNIANCMKLTAEDRLCIPVPFFHCFGCVIGTLAAVSVGATMIPIQEFEPEQVLKTVEQESVTALHGVPTMFIAELNHPNFERYNLSSLRTGVMAGSNCPVEVMKNVMNKMNMSEITICYGQTESSPVITQTRANDPIELRVESVGKALPNVEVKIIDPATNEELPHYTQGELCTRGYHVMKGYYKNPEATQRTIDEDGWLHTGDLAIMDDNGYCKITGRLKDMIIRGGENIYPREIEELLYKHPKILDAQVVGVPDEKFGEEVHAWIILKEGEISSSDEIKQFCNGQISKYKIPKHIFITDAYPMTASGKIQKFKLREKSLNEVERKI

SEQ ID NO: 3784 - protein, 1146 aa, Populus tremula
MASQSQRQSNQPAHNQAQSSGTSNMRQHHHPTESVSKAIAQYTVDAQLHAVFEQSGGTGKSFDYSKSVRTPNQSVPEEQITAYLSKIQRGGHIQPFGCMIAADEQSFRVIAYSENAKDMLGLTPQSVPSLEKQEILFVGADVRILFRPSSAVLLEKAFGAREITLLNPIWIHSKNSGKPFYAILHRIDVGIVIDLEPARTEDPALSIAGAVQSQKLAVRAISQLQSLPGGDIKLLCDTVVDSVRELTGYDRVMVYKFHEDEHGEVVAENKRVDLEPYIGLHYPSTDIPQAPRFLFKQNRVRMIVDCHAIPVSVIQDEGLMQPLCLVGSTLRAPHGCHAQYMENMGSIASLAMAVIIYGNDEEAIGGRNSMRLWGLVVCHHTSARCIPFPLRYACEFLMQAFGLQLNMELQLASQLLEKHVLRTQTLLCDMLLRDSPTGIVTQSPSIMDLVKCDGAALYYQGQYYPLGVTPTEAQIKDIVEWLLTLHGDPTGLSTDSLADAGYPGAAFLGDAVCGMAVAYIAERDFLFWFRSHTAKEVKWGGAKHHPEDKDDGQRMHPRSSFKAFLEVVKSRSLPWENAEMDAIHSLQLILRDSFRDAEATNSKAVVHNQLKDMELQGMDELSSVAREMVRLIETATAPIFAVDVDGRINGWNAKVAELTGLSVEEAMGKSLVHDLVYKEYEEIVDKLIHRAVKGEEDKNVEIKLRTFCSEHQKKAVFVVVNACSSKDYMDNIVGVCFVGQDVTGQKVVMDKYVLIQGDYKAIVHSPNPSIPPIFASDENTCCLEWNTAMEKLTGWSRGEVVGKMLVGEVFGSCCRLKGPDALTKFMIALHNAIGGIDTDKLPFSFFDRNEKNVQTLLTANKRVNIKGDIIGPFCFLQIASPEFQPSLKVQKQQEKKSFARMKELAYICQEIKNPLSGIHFTNSLLENTDLTEDQQQFLETSAACEKQILKIIRDIDLESIENGSLELEKAEFLLGSVINAVVSQAMLLLRERNLQLLRDIPEEIKTLAVYGDQARIQQVLADFLLNMVRYAPSSAGWVEIHVCPTLKQISDGHTLVHTEFRYLERVLQTRMLGLQHPPRSFLNCKLTLVMLHREGMVPKIQFQGLSVCQGRLIWLSFPENTTVALYPLTIWFLLLHRHQSRSITHT

SEQ ID NO: 3785 - protein, 1146 aa, Populus tremula
MASQSQRQSNQPAHNQVQSSGTSNMRQHHHPTESVSKAIAQYTVDAQLHAVFEQSGGTGKSFDYSKSVRTPNQSVPEEQITAYLSKIQRGGHIQPFGCMIAADEQSFRVIAYSENAKDMLGLTPQSVPSLEKQEILFVGADVRILFRPSSAVLLEKAFGAREITLLNPIWIHSKNSGKPFYAILHRIDVGIVIDLEPARTEDPALSIAGAVQSQKLAVRAISQLQSLPGGDIKLLCDTVVDSVRELTGYDRVMVYKFHEDEHGEVVAENKRVDLEPYIGLHYPSTDIPQASRFLFKHNRVRMIVDCHAIPVSVIQDEGLMQPLCLVGSTLRAPHGCHAQYMENMGSIASLAMAVIIYGNDEEAIGGRNSMRLWGLVVCHHTSARCIPFPLRYACEFLMQAFGLQLNMELQLASQLLEKHVLRTQTLLCDMLLRDSPTGIVTQSPSIMDLVKCDGAALYYQGQYYPLGVTPTEAQIKDIVEWLLTLHGDPTGLSTDSLADAGYPGAAFLGDAVCGMAVAYIAERDFLFWFRSHTAKEVKWGGAKHHPEDKDDGQRMHPRSSFKAFLEVVKSRSLPWENAEMDAIHSLQLILRDSFRDAEATNSKAVVHNQLKDMELQGMDELSSVAREMVRLIETATAPIFAVDVDGRINGWNAKVAELTGLSVEEAMGKSLVHDLVYKEYEEIVDKLIHRAVKGEEDKNVEIKLRTFCSEHQKKAVFVVVNACSSKDYMDNIVGVCFVGQDVTGQKVVMDKYVLIQGDYKAIVHSPNPSIPPIFASDENTCCLEWNTALEKLTGWSRGEVVGKMLVGEVFGSCCKLKGPNSLTKFMIALHNAIGGIDTDKLPFSFFDRNEKNVQTLLTANKRVNMKGDIIGAFCFLQIASPELQPSLKVQKQQEKKSFARMKELAYICQEIKNPLSGIHFTNSLLENTDLTEDQQQFLETSAACEKQILKIIRDIDLESIENGSLELEKAEFLLGSVINAVVSQAMLLLRERNLQLLRDIPEEIKTLAVYGDQARIQQVLADFLLNMVIYTQSSAGWVEIHVCPTLKQISDGHTLVHTEFRYLERVLQTRMLGLQHPPRSFLNCKLTLVMLHREGMVPKIQFQGLSVCQGRLIWLSFPENTTVALYPLTIWFLLLHRHQSRSITHT

SEQ ID NO: 3786 - protein, 444 aa, Synechococcus sp. RS9916
MTRSPSARPLPTTGAITGVGEAIAFFRNADFAQQRFERLGDVFETKLIGQRLVFIRGDAAISDLLGQAEAVEGWWPESVRRLLGSRSLANRNGAAHKARRRVVGQLFSSAALQRYSPRIVEQVNALAQDLLNSTHTPIPLAERMRRFAFSVIASTVLGLDDNDRDALFGDFEIWTRALFSVPLAIPGTAFAKALAARERLLIRLKEVLAKADGSRGGLDLMTGGLDEAGLPLSDDDLVEQLLLLLFAGYETTASSLSCLMRELLLQPTVDQWLREETNALAWPPHDAEAAMAYDSQRAPRLNAVVQEVMRMTPPVGGFFRRTTGAVTLAGVEVPAGSVIQVALAASNRHGAGDLDAFRPSRHLEPGNGGPTLMPFGGGERVCLGKALAELEIRLMVVGLLQQVDLELTPDQDVSLQLIPSPTPRDGLRVRATADHERHPSLKTD

SEQ ID NO: 3787 - protein, 1146 aa, Populus tremula
MASQSQRQSNQPAHNQAQSSGTSNMRQHHHPTESVSKAIAQYTVDAQLHAVFEQSGGTGKSFDYSKSVRTPNQSVPEEQITAYLSKIQRGGHIQPFGCMIAADEQSFRVIAYSENAKDMLGLTPQSVPSLEKQEILFVGADVRILFRPSSAVLLEKAFGAREITLLNPIWIHSKNSGKPFYAILHRIDVGIVIDLEPARTEDPALSIAGAVQSQKLAVRAISQLQSLPGGDIKLLCDTVVDSVRELTGYDRVMVYKFHEDEHGEVVAENKRVDLEPYIGLHYPSTDIPQASRFLFKQNRVRMIVDCHAIPVSVIQDEGLMQPLCLVGSTLRAPHGCHAQYMENMGSIASLAMAVIIYGNDEEAIGGRNSMRLWGLVVCHHTSARCIPFPLRYACEFLMQAFGLQLNMELQLASQLLEKHVLRTQTLLCDMLLRDSPTGIVTQSPSIMDLVKCDGAALYYQGQYYPLGVTPTEAQIKDIVEWLLTLHGDPTGLSTDSLADAGYPGAAFLGDAVCGMAVAYIAERDFLFWFRSHTAKEVKWGGAKHHPEDKDDGQRMHPRSSFKAFLEVVKSRSLPWENAEMDAIHSLQLILRDSFRDAEATNSKAVVHTQLKDMELQGMDELSSVAREMVRLIETATAPIFAVDVEGRINGWNAKVAELTGLSVEEAMGKSLVHDLVYKEYEEIVDKLIHRAVKGEEDKNVEIKLRTFCSEHQKKAVFVVVNACSSKDYMDNIVGVCFVGQDVTGQKVVMDKYVLIQGDYKAIVHSPNPSIPPIFASDENTCCLEWNTALEKLTGWSRGEVVGKMLVGEVFGSCCRLKGPDALTKFMIALHNAIGGIDTDKLTFSFFDRNEKNVQTLLTANKRVNMKGDIIGAFCFLQIASPELQPSLKVQKQQEKKSFARMKELAYICQEIKNPLSGIHFTNSLLENTDLTEDQQQFLETSAACEKQILKIIRDIDLESIENGSLELEKAEFLLGSVINAVVSQAMLLLRERNLQLLRDIPEEIKTLAVYGDQARIQQVLADFLLNMVRYAPSSAGWVEIHVCPTLKQISDGHTLVHTEFRYLERVLQTRMLGLQHPPRSFLNCKLTLVKLHREGMVPKIQFQGLSVCQGRLIWLSFPENTTVALYPLTIWFLLLHRHQSRSITHT

SEQ ID NO: 3788 - protein, 254 aa, Fulvimarina pelagi HTCC2506
MREDKPMHFDLSGRTALVTGASSGLGEHFARVLAKAGAEVTLAARRLDALKENVDAIAGEGGKAKAVELDVTDEASVAKIFANGPFDIVVNNAGVTLTHPAIKVEEAEWDKVVDTNLKGAFLVAQAAAKAMKEAERGGSIVNIASILGLRVAGGVMPYSVSKAGLIQMTKAMALEWARYGIRVNALCPGYIETPLNADFFASEAGKALIKRIPQRRLGQNADLDGALLLLSSDAGAYMTGSELVVDGGHLVSSL

SEQ ID NO: 3789 - protein, 947 aa, Saccharum officinarum
MAASVSGATICLQKPGSKGRRARDATSFARRSVAAPRSPHAAKASVIRSDAGAGRGQHCSPMRAVVDAAPIATKKRVFYFGKGKSEGDKSMKELLGGKGANLAEMSSIGLSVPPGFTVSTEACKQNQDAGSILPAGHWREILDGLQFVEEYMGATLGDPQRPLLLSERSGSRGVQAGMMDTVLNLGLNDEVAAGLAAKSGERFDYDTFRRFHDMYGNVVMDIPRSLIEEKLEHMKESKGVKNDTDLTAADLKELVGQYKEVYLTAKGEPFPSDPKKQLELAVRAVFNSWESPRAKKYRSINQITGLVGTAVNVQSMVFGNMGNTSGTGVLFTRNPNTGEKKLYGEFPINAQGEDVVAGIRTPEDLDAMKDVMPQAYEELVENCNILESHYKEMQDMEFTVQENRLWMLQCRTGKQTGTGAVKIAVDMVSEGLAERRQAIKMVEPGHLDQLLHPQFENPAAYKDQVIATGLPASPGAAVGQIVSTAEDAEAWHAQGKAAILVRAETSPEDVGGMHAAAGILTERGGMTSHAAVVARGWGKCCVSGCSAIRVNDAEKTVAIGDHVLSEGEWISLNGSTGEVILGKQPLSPPSLSGDLGTFMSWVDEVRKLKVLANADTPEDALAARNNGAQGIGLCRTEHMFFASDERIKAVRQMIMAPTVELRQQALDRLLPYQRSDFEGIFRAMDGLSVTIRLLDPPLHEFLPEGNVEEIVRELCAETGANEEEALERVEKLAEVNPMLGFRGCRLGISYPELTEMQARAIFEAAIAMSNQGVEVFPEIMVPLVGLPQELGHQVNVIKQVAEKVFTSMGKTIGYKIGTMIEIPRAALVADQIAEQAEFFSFGTNDLTQMTFGYSRDDVGKFIPIYLAQGILQHDPFEVLDQRGVGELVKFATERGRQTRPNLKVGICGEHGGEPSSVAFFAKAGLDYVSCSPFRVPIARLAAAQVLV

SEQ ID NO: 3790 - protein, 536 aa, Fulvimarina pelagi HTCC2506
MRDEEHLRPRPANFNPLTPLDFLDHAVNSLPTKTAVVWRDRSWTWSEFHQIVLRLAKALKDRGIQKGDVVSIMCPNRPEMLAAHYAIPALGAVLNSVNTRIEAKDVAFILKHAESRLILADPTCADDARKAAQETGVPIEVFAEDGESGDGLKLLSGERPPEIDLIAEITDEWQPIALNYTSGTTGNPKGVVLHHRGAWLNAVGNITALQFNDKTAYLWTLPMFHCNGWCHTWSITAAGGTHVCLDKVVPEAVFEAMDRIGVTHLSCAPVVLYMLINSDAKEKRDASRRITVATGGAAPTASLIKQMDALGFDFIHLYGLTECYGPTSIRELNEHEAGLDVEERANLLARQGVRHLSANRIRVVNDEGAEVPADGTTVGEIVLTGNTLLAGYYRNPDETEKAFAGGGFHTGDLAVRHPDGHIEIKDRAKDVIITGGENVSSLEVEDVLSKHPDVAIAAVVAKPDEKWGEIPMAFIEAKSGTSPQPETLETFCREHLPGFKIPRAWAFCELPKTATGKIQKYVLREQAAEKAAGANG

SEQ ID NO: 3791 - protein, 135 aa, Geobacillus kaustophilus HTA426
MKGLAYTLKELTREKVTYDYPHEPLPLPDRFRGIQKFYPEKCIVCNQCVNICPTECIQLTGKKHPDPTKKGKVIETYNINFEICILCDLCTEVCPTEAIVMTNNFELAEYSRDALYKDLAWLDENDTNIRRENKP

SEQ ID NO: 3792 - protein, 367 aa, Geobacillus kaustophilus HTA426
MMLRTEEMILNVGPQHPSTHGVFRLILKIDGEIIQEATPVIGYLHRGTEKIAEGLQYTQIIPYTDRMDYLSAMTNNYVLCHAVETMMGIEVPERAEYLRVLAMELGRIASHLVWWGTYLLDLGATSPFLYAFREREMIINLLNELSGARLTFNYMRIGGVKWDAPDGWIDKVKQFVPYMREKLHGYHELVTGNEIFRQRVTGVGRYTKEEAISYSLSGVNLRSTGVKWDLRKDEPYSIYDRFDFDVPVREGGDCLARYECRMAEIEQSLRIIEQACEQFPPEGPIMGKVPRIIKAPPGETFVRIEAPRGEIGCYIASDGKKEPYRLKFRRPSFYNLQILPKLLKGENLANVIAILGSIDIVLGEVDG

SEQ ID NO: 3793 - protein, 542 aa, marine gamma proteobacterium HTCC2143
MSNIFESELPKNLANHTALTPVHFLSHAAKTYPDNLAVVHGDLRYNYATLQQRCRRLASALSQHGIGPGDTVSVIAPNIPAHLEAHFAVPMTGAVLNSINIRLDADTFAYIFDHGECDVLLIDAQFAEVAKQALSKSSRRPLIIDLDDSLGPRSVRIGSTTYEQFLLTGNPDIVPALPADEWQSLALNYTSGTTGNPKGVVYHHRGAHQNAMGNILAWNMGHAPTYLWTLPMFHCNGWCFPWTITLLAGVHVCLRDVAADAIIESIVANDVSHMCGAPIVLSMIANAPEVLRNQIPKGIKIMTAGAAPPAAVIVAIEDLGAEITHTYGLTEVYGPCVYCAWHTEWDELSREHRAAMKARQGVAYPVLNNLDVLDPETMRPVPDDGETIGEVMFRGNVVMKGYLKNPDATREALADGWFHSGDLAVKHPDNYIEIKDRSKDIIISGGENISSIEVESALYQHSAVLSAAVVAKADDKWGETPCAFVELKDGTTLDAQTLIAFSRNHLASFKIPKHVIFGELPKTSTGKIQKFILREKAKTIVD

SEQ ID NO: 3794 - protein, 497 aa, Geobacillus kaustophilus HTA426
MDEEKDLAQRKKEAAERAKQLARERLAARQADEQAKSAAETGSLKTPPNSNGSQLETTKGEATEPASADDLALAKKRAAEEARARAAELRRQREAAASGAATEGDLEAAKRKAAEEARARAAELRRQREAAATGGATEGDLEAAKRKAAEEARARAAELRRQREAAASGAATEGDLEAAKRKAAEEARARAAELRRQREAAASGAATEGDLEAAKRKAAEEARARAAELRRQREAAESGAEDDLELAKKKAAAAAKARAAALAKQKAAEASGDDDELAKQKAAAAAKAKAAAAAKARAAALAKQQGSAGDEGAKQKAAAAARTKAEETDGGTGRYAAPSPNDPLLEKYVRIIHEHLGSDVLEDAYINRLAKDVPTLVVKKEAYYKVAELLKGHEQLRFDYLSELHGTDFQTHMEVYVHLYSYPNRQPVALKVKIERDNPEVDSLVPLWPGANWPECEAYDLLGIRFRGHPNLIRIFLGEQWVGHPLRKDYEPYDAEV

SEQ ID NO: 3795 - protein, 167 aa, Oryza sativa (japonica cultivar-group)
MMASRVSSLLRAAAAAVSVPGRSRSLSAAAATAAKKPAGDYVPVYVAMGMIAVSVSLGLATARQQLAHAPNVRLDKKKRETVPEVAAPDMALDEAERFVGGSLFRKVAHVQDDASLRAGVAADPVAEYPARKAVTLKDAGVEPPGIEQGREGILEVLGKKTKPAAAA

SEQ ID NO: 3796 - protein, 498 aa, Aspergillus oryzae
MGHTVPPLKDQSLFIEKAYVNGEWVGAQSGETFEVHDPASGKLIGTCPEFNAADTEKAIQAATEAFPKFRTTLARERARMLRRWYQLMIDNAEDLATLITWENGKPLADAKGEVNYAAAFFEWFSEEAPRIYGDTIPSSVAGNRVMTLKQPVGVCSLITPWNFPAAMITRKAGPALAAGCTVVVKTPGETPFTANALAELAHRAGIPKGVFNIVTSLKNTPEVGEALTTHPEVRKVSFTGSTNVGKLLMKQSSSTVKKVSWELGGNAPFIVFDDVEDLDAAVAGAVASKFRSSGQTCVCANRIYVQRGIYDEFVKRFVEKVKGFKVGAGFEEGVTHGPVIHGRAIEKIDEHVRDAESKGAKVAVGGRKLSDLGPNFYDMTVLTDMNKDMLVASEETFGPVAGLFPFETEKEVVDLANRAEVGLAGYFFSGNVKRIFRVAEALEVGMVGVNTGLISDVASPFGGVKQSGFGREGSKYGIDEFLTIKSVTFGGMGEPLQS

SEQ ID NO: 3797 - protein, 322 aa, Rauvolfia serpentina
SLALSSPILKEILIEAPSYAPNSFTFDSTNKGFYTSVQDGRVIKYEGPNSGFVDFAYASPYWNKAFCENSTDAEKRPLCGRTYDISYNLQNNQLYIVDCYYHLSVVGSEGGHATQLATSVDGVPFKWLYAVTVDQRTGIVYFTDVSTLYDDRGVQQIMDTSDKTGRLIKYDPSTKETTLLLKELHVPGGAEVSADSSFVLVAEFLSHQIVKYWLEGPKKGTAEVLVKIPNPGNIKRNADGHFWVSSSEELDGNMHGRVDPKGIKFDEFGNILEVIPLPPPFAGEHFEQIQEHDGLLYIGTLFHGSVGILVYDKKGNSFVSSH

SEQ ID NO: 3798 - protein, 117 aa, Polaromonas sp. JS666
MGLSTHVLDTMHGTPAGGMRVALFTTRSGQATLVKSFDLDDDGRYPGGLLYDSTTLQAGTYRLVFDVAAYFRAKGAVLPEPPFLDQVTLDFGVADPSQHYHVPLLVSPWSYSTYRGS

SEQ ID NO: 3799 - protein, 455 aa, Nostoc sp. PCC 7120
MKLPDSPKIPKFMQLVQWIYQPLQLMEASAKAHGDSFTLWLTNKRPIVFLSNPQAIQELFTTPLEQLDARGTAQVLQPLLGENSLLLLSGETHQRQRKLLTPPFHGDRMRAYGDIITNITKEVISNWQLGKPFSVRDSMQEITLRVILQAVFGLREGERYTQLQKRLCDILDLSGSALRSTLSFLPALQIDLGRWSPWGHFLRQREAIDQLLYAEIQDRRDHPDPSRTDILSLMMAARDENGEAMTDVELRDELMTLLVAGHETTASALTWALYWIHKLPQVREKLLAELDNFGDNGDVNEITRLPYLTAVCQETLRIYPIAMVTIPRITKTNLEIGGHQFAPGTMLVGCIYLMHRRPDLYPQPQEFKPERFLEKQYSLYEYLPFGGSNRRCVGMAFALYEMKLILATVLANVDLALVDNYPVKPTRRGVTLAPSGGKWLIATAQHQKIKNPVEV

SEQ ID NO: 3800 - protein, 116 aa, Robiginitalea biformata HTCC2501
MESLVSFVENEFVARKEFPKFSAGDTITVYYEIKEGEKTRTQFFRGVVIQRRGSGATETFTIRKMSGTVGVERIFPINMPALQKIEINKRGKVRRARIFYFRGLTGKKARIKEVRS

SEQ ID NO: 3801 - protein, 560 aa, Saccharomyces cerevisiae
MIRQSLMKTVWANSSRFSLQSKSGLVKYAKNRSFHAARNLLEDKKVILQKVAPTTGVVAKQSFFKRTGKFTLKALLYSALAGTAYVSYSLYREANPSTQVPQSDTFPNGSKRKTLVILGSGWGSVSLLKNLDTTLYNVVVVSPRNYFLFTPLLPSTPVGTIELKSIVEPVRTIARRSHGEVHYYEAEAYDVDPENKTIKVKSSAKNNDYDLDLKYDYLVVGVGAQPNTFGTPGVYEYSSFLKEISDAQEIRLKIMSSIEKAASLSPKDPERARLLSFVVVGGGPTGVEFAAELRDYVDQDLRKWMPELSKEIKVTLVEALPNILNMFDKYLVDYAQDLFKEEKIDLRLKTMVKKVDATTITAKTGDGDIENIPYGVLVWATGNAPREVSKNLMTKLEEQDSRRGLLIDNKLQLLGAKGSIFAIGDCTFHPGLFPTAQVAHQEGEYLAQYFKKAYKIDQLNWKMTHAKDDSEVARLKNQIVKTQSQIEDFKYNHKGALAYIGSDKAIADLAVGEAKYRLAGSFTFLFWKSAYLAMCLSFRNRVLVAMDWAKVYFLGRDSSI

SEQ ID NO: 3802 - protein, 557 aa, Arabidopsis thaliana
MATSSAWKLDDHPKLPKGKTIAVIVLDGWGESAPDQYNCIHNAPTPAMDSLKHGAPDTWTLIKAHGTAVGLPSEDDMGNSEVGHNALGAGRIFAQGAKLCDQALASGKIFEGEGFKYVSESFETNTLHLVGLLSDGGVHSRLDQLQLLIKGSAERGAKRIRVHILTDGGDVLDGSSVGFVETLEADLVALRENGVDAQIASGGGRMYVTLDRYENDWEVVKRGWDAQVLGEAPHKFKNAVEAVKTLRKEPGANDQYLPPFVIVDESGKAVGPIVDGDAVVTFNFRADRMVMHAKALEYEDFDKFDRVRYPKIRYAGMLQYDGELKLPSRYLVSPPEIDRTSGEYLTHNGVSTFACSETVKFGHVTFFWNGNRSGYFNEKLEEYVEIPSDSGISFNVQPKMKALEIGEKARDAILSGKFDQVRVNIPNGDMVGHTGDIEATVVACEAADLAVKMIFDAIEQVKGIYVVTADHGNAEDMVKRDKSGKPALDKEGKLQILTSHTLKPVPIAIGGPGLAQGVRFRKDLETPGLANVAATVMNLHGFVAPSDYEPTLIEVVE

SEQ ID NO: 3803 - protein, 362 aa, Polaromonas sp. JS666
MKTYKIACIPGDGIGKEVVPAGQTVLEALAATQNKFKFEFTSFDWGGDYFRQHGVMMPEDGLDALRDKDAILFGSAGDPHIPDHITLWGLRLKICQGFDQYANVRPTRILPGIDGPLKRCKPEDLNWVIVRENSEGEYSGVGGRAHQGHPIEVATDVSMMTRAGVERIMRFAFKLAQLRPRKLLTVITKSNAQRHAMVMWDEIALQISKEFPDVKWDKELVDASTARMINRPASLDTIVATNLHADILSDLAAALAGSLGIAPTGNIDPERRYPSMFEPIHGSAFDIMGKGLANPVGTFWSCVMMLEHLGEPEAARVLMDAVEAITADPALHTGDLGGKATMAQVTEAVCALFAAAPVRQAA

SEQ ID NO: 3804 - protein, 253 aa, Thiomicrospira crunogena XCL-2
MRQLFVAGNWKMHGDKASIKTLVTGLNAKADSVGDVLVAVCPPAIYLDYTKNCLMAGEIALGGQNMAIEPVQGAYTGETSASMLKDVGCQYVILGHSERRAIYGETDQDIAAKVKTALDSGLTPILCVGETLEERESGQLESVISQQLDAVISEVGIDQFADVVIAYEPVWAIGTGKTASAQQAQDVHAFIRGQLAKLNPSVAEKVIIQYGGSVKPNNASELFSQPDIDGGLIGGASLNADDFIAICQAAGEQ

SEQ ID NO: 3805 - protein, 299 aa, Chlorobium tepidum TLS
MSERLDENFSRAIDLMLACTGKIIISGMGKSGIIGQKIAATLSSTGTTAIFLHPAEAAHGDLGVVSEGDTVICLSKSGMTEELNFILPALRERKATIIAFTGNPRSYLAMNADVVLDTGVEQEACPYDLAPTSSTTAMLAMGDALAICLMKKKNFTDQEFALTHPKGSLGKQLTMRVGDVMATGDALPVVSEDAMLSDLILEMTSKRYGVSGVVDAEGKLTGIFTDGDLRRLVQTGESFLDKKAVEVMTPNPKTVAPDMKAKACLELLETHRITQLMVCDEKRCPVGIVHIHDLVTLGL

SEQ ID NO: 3806 - protein, 1146 aa, Populus tremula
MASQSQRQSNQPAHNQAQSSGTSNMRQHHHPTESVSKAIAQYTVDAQLHAVFEQSGGTGKSFDYSKSVRTPNQSVPEEQITAYLSKIQRGGHIQPFGCMIAANEQSFRVIAYSENAKDMLGLTPQSVPSLEKQEILFVGADVRILFRPSSAVLLEKAFGAREITLLNPIWIHSKNSGKPFYAILHRIDVGIVIDLEPARTEDPALSIAGAVQSQKLAVRAISQLQSLPGGDIKLLCDTVVDSVRELTGYDRVMVYKFHEDEHGEVVAENKRVDLEPYIGLHYPSTDIPQAPRFLFKQNRVRMIVDCHAIPVSVIQDEGLMQPLCLVGSTLRAPHGCHAHYMENMGSIASLAMAVIIYGNDEEAIGGRNSMRLWGLVVCHHTSARCIPFPLRYACEFLMQAFGLQLNMELQLASQLLEKHVLRTQTLLCDMLLRDSPTGIVTQSPSIMDLVKCDGAALYYQGQYYPLGVTPTEAQIKDIVEWLLTLHGDPTGLSTDSLADAGYPGAAFLGDAVCGMAVAYIAERDFLFWFRSHTAKEVKWGGAKHHPEDKDDGQRMHPRSSFKAFLEVVKSRSLPWENAEMDAIHSLQLILRDSFRDAEATNSKAVVHNQLKDMELQGMDELSSVAREMVRLIETATAPIFAVDVDGRINGWNAKVAELTGLSVEEAMGKSLVHDLVYKEYEEIVDKLIHRAVKGEEDKNVEIKLRTFCSEHQKKAVFVVVNACSSKDYMDNIVGVCFVGQDVTGQKVVMDKYVLIQGDYKAIVHSPNPSIPPIFASDENTCCLEWNTALEKLTGWSRGEVVGKMLVGEVFGSCCKLKGPNSLTKFMIALHNAIGGIDTDKLPFSFFDRNEKNVQTLLTANKRVNMKGDIIGAFCFLQIASPELQPSLKVQKQQEKKSFARMKELAYICQEIKNPLSGIHFTNSLLENTDLTEDQQQFLETSAACEKQILKIIRDIDLESIENGSLELEKAEFLLGSVINAVVSQAMLLLRERNLQLLRDIPEEIKTLAVYGDQARIQQVLADFLLNMVRYAPSSAGWVEIHVCPTLKQISDGHTLVHTEFRYLERVLQTRMLGLQHPPRSFLNCKLTLVMLHREGMVPKIQFQGLSVCQGRLIWLSFPENTTVALYPLTIWFLLLHRHQSRSITHT

SEQ ID NO: 3807 - protein, 417 aa, Thiomicrospira crunogena XCL-2
MSEIRNYTLNFGPQHPSAHGVLRLVLELDGETIVRSDPHIGLLHRGTEKLAEYKPFNQSIGYMDRLDYVSMMANEHAYVMGIEKMLGIEVPERAQYIRVMFDEITRILNHLMWLGAHALDIGAMTVFLYAFREREDLMDCYEAVSGARMHATYYRPGGVYRDLPDTMAKYEESKWHSGKKLDQLNETREGSLLDFIEAFTERFPGYVDEYETLLTDNRIWKQRTVDIGIVSPERALQLGFTGPMLRGSGIAWDLRKKQPYEVYDKLDFDIPVGATGDCYDRYLVRVAEMRESNKIIKQCVKWLKENPGPVISDDHKVTPPSREDAKSNMEALIHHFKLFTEGYSVPEGESYTAVEHPKGEFGIYMVSDGANKPYRLKVRAPGFAHLASLDEMAKGHMIADVVAIIGTQDIVFGEVDR

SEQ ID NO: 3808 - protein, 1144 aa, Populus tremula
MASQSQRQSNQPAHNQAQSSGTSNMRQHHHPTESVSKAIAQYTVDAQLHAVFEQSGGTGKSFDYSKSVRTPNQSVPEEQITAYLSKIQRGGHIQPFGCMIAADEQSFRVIAYSENAKDMLGLTPQSVPSLEKQEILFVGADVRILFRPSSAVLLEKAFGAREITLLNPIWIHSKNSGKPFYAILHRIDVGIVIDLEPARTEDPALSIAGAVQSQKLAVRAISQLQSLPGGDIKLLCDTVVDSVRELTGYDRVMVYKFHEDEHGEVVAENKRVDLEPYIGLHYPSTDIPQASRFLFKHNRVRMIVDCHAIPVSVIQDEGLMQPLCLVGSTLRAPHGCHAQYMENMGSIASLAMAVIIYGNDEEAIGGRNSMRLWGLVVCHHTSARCIPFPLRYACEFLMQAFGLQLNMELQLASQLLEKHVLRTQTLLCDMLLRDSPTGIVTQSPSIMDLVKCDGAALYYQGQYYPLGVTPTEAQIKDIVEWLLTLHGDPTGLSTDSLADAGYPGAAFLGDAVCGMAVAYIAERDFLFWFRSHTAKEVKWGGAKHHPEDKDDGQRMHPRSSFKAFLEVVKSRSLPWENAEMDAIHSLQLILRDSFRDAEATNSKAVVHNQLKDMELQGMDELSSVAREMVRLIETATAPIFAVDVDGRINGWNAKVAELTGLSVEEAMGKSLVHDLVYKEYEEIVDKLIHRAVKGEEDKNVEIKLRTFCSEHQKKAVFVVVNACSSKDYMDNIVGVCFVGQDVTGQKVVMDKYVLIQGDYKAIVHSPNPSIPPIFASDENTCCLEWNTALEKLTGWSRGEVVGKMLVGEVFGSCCKLKGPDALTKFMIALHNAIGGIDTDKLPFSFFDRNEKNVQTLLTANKRVNMNIIGAFCFLQIASPELQPSLKVQKQQEKKSFARMKELAYICQEIKNPLSGIHFTNSLLENTDLTEDQQQFLETSAACEKQILKIIRDIDLESIENGSLELEKAEFLLGSVINAVVSQAMLLLRERNLQLLRDIPEEIKTLAVYGDQARIQQVLADFLLNMVRYAPSSAGWVEIHVCPTLKQISDGHTLVHTEFRYLERVLQTRMLGLQHPPRSFLNCKLTLVMLHREGMVPKIQFQGLSVCQGRLIWLSFPENTTVALYPLTIWFLLLHRHQSRSITHT

SEQ ID NO: 3809 - protein, 265 aa, Oryza sativa (indica cultivar-group)
MASPAESPGGGGTARPSRYESQKRRDWQTFGQYLRNHRPPLELSRCSGAHVLEFLRYLDQFGKTKVHAHGCPFFGHPSPPAPCPCPLRQAWGSLDALVGRLRAAFEEHGGRPESNPFGARAVRLYLRDIRDTQSKARGIAYEKKRRKRAAASHTKQKQQQQQLVEQAVAPPAAAAAAAALPDMETTTTTTTVPHFLFPAHFLHGHYFLAPAGEQPGGGDVAASTGGAAGAPSGGGGEDLVLAMAAAAAAAEAHAAGCMMPLSVFN

SEQ ID NO: 3810 - protein, 138 aa, Glycine max
MATILPPSNAQFVSFNARHRSSSPTLPRWGWRKEQDASIVANRTRGQAFQVLVASGKEGSKDDVVMVDPVEAKRLAAKQMEKIKAKEKLKRRRQIEAINGAWAMIGLTAGLVIEGQTGKSILTQLQDYLGTIVSFFVR

SEQ ID NO: 3811 - protein, 375 aa, Coccidioides immitis RS
MEEEVAALVIDNGSGMCKAGFAGDDAPRAVFPSIVGRPRHHGIMIGMGQKDSYVGDEAQSKRGILTLRYPIEHGVVTNWDDMEKIWHHTFYNELRVAPEEHPVLLTEAPINPKSNREKMTQIVFETFNAPAFYVSIQAVLSLYASGRTTGIVLDSGDGVTHVVPIYEGFALPHAISRIDMAGRDLTDYLMKILAERGYSFSTTAEREIVRDIKEKLCYVALDFQQEIQTASQSSSLERSYELPDGQVITIGNERFRAPEALFQPSVLGLESGGIHATTYNAIMKCDVDVRRDLYGNIVMSGGTTMYPGIADRMQKEITALAPSSMKVKIIAPPERKYSVWIGGSILASLSTFQQMWISKQEYDESGPSIVHRKCF

SEQ ID NO: 3812 - protein, 1146 aa, Populus tremula
MASQSQRQSNQPAHNQAQSSGTSNMRQHHHPTESVSKAIAQYTVDAQLHAVFEQSGGTGKSFDYSKSVKTPNQSVPEEQITAYLSKIQRGGHIQPFGCMIAANEQSFRGIAYSENAKNMLGLTPQSVPSLEKQEILFVGGDVRIFFRPSSAVLLEKTFGAREITLLNPIWIHSKNSGKPFYAILHRIDVGIVIDLEPARTEDPALSIAGAVQSQKLAVRAISQLQSLPGGDIKLLCDTVVDSVRELTGYDRVMVYKFHEDEHGEVVAENKRVDLEPYIGLHYPSTDIPQASRFLFKQNRVRMIVDCHAIPVSVIQDEGLMQPLCLVGSTLRAPHGCHAQYMENMGSIASLAMAVIIYGNDEEAIGGRNSMRLWGLVVCHHTSARCIPFPLRYACEFLMQAFGLQLNMELQLASQLLEKHVLRTQTLLCDMLLRDSPTGIVTQSPSIMDLVKCDGAALYYQGQYYPLGVTPTEAQIKDIVEWLLTLHGDPTGLSTDSLADAGYPGAAFLGDAVCGMAVAYIAERDFLFWFRSHTAKEVKWGGAKHHPEDKDDGQRMHPRSSFKAFLEVVKSRSLPWENAEMDAIHSLQLILRDSFRDAEATNSKAVVHNQLKDMELQGMDELSSVAREMVRLIETATAPIFAVDVDGRINGWNAKVAELTGLSVEEAMGKSLVHDLVYKEYEEIVDKLIHRAVKGEEDKNVEIKLRTFCSEHQKKAVFVVVNACSSKDYMDNIVGVCFVGQDVTGQKVVMDKYVLIQGDYKAIVHSPNPSIPPIFASDENTCCLEWNTALEKLTGWSRGEVVGKMLVGEVFGSCCRLKGPDALTKFMIALHNAIGGIDTDKLPFSFFDRNEKNVQTLLTANKRVNIKGDIIGAFCFLQIASPELQQSLKVQKQQEKKSFARMKELAYICQEIKNPLSGIHFTNSLLENTDLTEDQQQFLETSAACEKQILKIIRDIDLESIENGSLELEKAEFLLGSVINAVVSQAMLLLRERNLQLLRDIPEEIKTLAVYGDQARIQQVLADFLLNMVIYTQSSAGWVEIHVCPTLKQISDGHTLVHTEFRYLERVLQTRMLGLQHPPRSFLNCKLTLIKLHREGMVPKIQFQGLSVCQGRLIWLSFPENTTVALYPLTIWFLLLHRHQSRSITHT

SEQ ID NO: 3813 - protein, 435 aa, Nitrosomonas europaea ATCC 19718
MTITNQQLFERSRQYIPGGVNSPVRAFKSVGGTPVFFQRGQGAYFWDVEGKSYIDYVGSWGPLILGHAHPDVVRAVQIAAGHGTSFGAPTAAELEIAELLCRLLPSLEMVRLVSSGTEAGMSAIRLARGYTGRNRIIKFEGCYHGHDDALLVKAGSGALTFGHPSSAGVPAETAGHTLVLNYNDVAGVEETFSKMGTEIAAVIVEPVAGNMNLIKATSQFLETLRTLCTKHGSLLILDEVMTGFRVGLECAQGLYGIKPDLTILGKVIGGGLPMAAFGGRRDVMECLAPLGSVYQAGTLSGNPVAVAAGLETLHQIQVPGFFDKLSTMTRKLTEGLTAVAAKHSVAFCAQAVGGMFGLYFRKSPPESFAEVMESDREAFNHFFHAMLKEGVYFAPSAFEAGFVSAAHSNEEIDKTLAVADRIFGQGMRRTEKATL

SEQ ID NO: 3814 - protein, 1146 aa, Populus tremula
MASQSQRQSNQPAHNQVQSSGTSNMRQHHHPTESVSKAIAQYTVDAQLHAVFEQSGGTGKSFDYSKSVRTPNQSVPEEQITAYLSKIQRGGHIQPFGCMIAADEQSFRVIAYSENAKDMLGLTPQSVPSLEKQEILFVGADVRILFRPSSAVLLEKAFGAREITLLNPIWIHSKNSGKPFYAILHRIDVGIVIDLEPARTEDPALSIAGAVQSQKLAVRAISQLQSLPGGDIKLLCDTVVDSVRELTGYDRVMVYKFHEDEHGEVVAENKRVDLEPYIGLHYPSTDIPQAPRFLFKQNRVRMIVDCHAIPVSVIQDEGLMQPLCLVGSTLRAPHGCHAQYMENMGSIASLAMAVIIYGNDEEAIGGRNSMRLWGLVVCHHTSARCIPFPLRYACEFLMQAFGLQLNMELQLASQLLEKHVLRTQTLLCDMLLRDSPTGIVTQSPSIMDLVKCDGAALYYQGQYYPLGVTPTEAQIKDIVEWLLTLHGDPTGLSTDSLADAGYPGAAFLGDAVCGMAVAYIAERDFLFWFRSHTAKEVKWGGAKHHPEDKDDGQRMHPRSSFKAFLEVVKSRSLPWENAEMDAIHSLQLILRDSFRDAEATNSKAVVHTQLKDMELQGMDELSSVAREMVRLIETATAPIFAVDVDGRINGWNAKVAELTGLSVEEAMGKSLVHDLVYKEYEEIVDKLIHRAVKGEEDKNVEIKLRTFCSEHQKKAVFVVVNACSSKDYMDNIVGVCFVGQDVTGQKVVMDKYVLIQGDYKAIVHSPNPSIPPIFASDENTCCLEWNTALEKLTGWSRGEVVGKMLVGEVFGSCCRLKGPDALTKFMIALHNAIGGIDTDKLPFSFFDRNEKNVQTLLTANKRVNIKGDIIGPFCFLQIASPELQQSLKVQKQQEKKSFARMKELAYICQEIKNPLSGIHFTNSLLENTDLTEDQQQFLETSAACEKQILKIIRDIDLESIENGSLELEKAEFLLGSVINAVVSQAMLLLRERNLQLLRDIPEEIKTLAVYGDQARIQQVLADFLLNMVRYAPSSAGWVEIHVCPTLKQISDGHTLVHTEFRYLERVLQTRMLGLQHPPRSFLNCKLTLVMLHREGMVPKIQFQGLSVCQGRLIWLSFPENTTVALYPLTIWFLLLHRHQSRSITHT

SEQ ID NO: 3815 - protein, 1144 aa, Populus tremula
MASQSQRQSNQPAHNQAQSSGTSNMRQHHHPTESVSKAIAQYTVDAQLHAVFEQSGGTGKSFDYSKSVRTPNQSVPEEQITAYLSKIQRGGHIQPFGCMIAADEQSFRGIAYNENAKNMRGLTPQSVPSLEKQEILFVGGDVRILFRPSSAVLLEKTFGAREITLLNPIWIHSKNSGKPFYAILHRIDVGIVIDLEPARTEDPALSIAGAVQSQKLAVRAISQLQSLPGGDIKLLCDTVVDSVRELTGYDRVMVYKFHEDEHGEVVAENKRVDLEPYIGLHYPSTDIPQASRFLFKQNRVRMIVDCHAIPVSVIQDEGLMQPLCLVGSTLRAPHGCHAQYMENMGSIASLAMAVIIYGNDEEAIGGRNSMRLWGLVVCHHTSARCIPFPLRYACEFLMQAFGLQLNMELQLASQLLEKHVLRTQTLLCDMLLRDSPTGIVTQSPSIMDLVKCDGAALYYQGQYYPLGVTPTEAQIKDIVEWLLTLHGDPTGLSTDSLADAGYPGAAFLGDAVCGMAVAYIAERDFLFWFRSHTAKEVKWGGAKHHPEDKDDGQRMHPRSSFKAFLEVVKSRSLPWENAEMDAIHSLQLILRDSFRDAEATNSKAVVHNQLKDMELQGMDELSSVAREMVRLIETATAPIFAVDVDGCINGWNAKVAELTGLSVEEAMGKSLVHDLVYKEYEEIVDKLIHRAVKGEEDKNVEIKLRTFCSEHQKKAVFVVVNACSSKDYMDNIVGVCFVGQDVTGQKVVMDKYVLIQGDYKAIVHSPNPSIPPIFASDENTCCLEWNTALEKLTGWSRGEVVGKMLVGEVFGSCCRLKGPDALTKFMIALHNAIGGIDTDKLPFSFFDRNEKNVQTLLTANKRVNINIIGAFCFLQIASPELQPSLKVQKQQEKKSFARMKELAYICQEIKNPLSGIHFTNSLLENTDLTEDQQQFLETSAACEKQILKIIRDIDLESIENGSLELEKAEFLLGSVINAVVSQAMLLLRERNLQLLRDIPEEIKTLAVYGDQARIQQVLADFLLNMVRYAPSSAGWVEIHVCPTLKQISDGHTLVHTEFRYLERVLQTRMLGLQHPLRSFLNCKLTLVMLHREGMVPKIQFQGLSVCQGRLIWLSFPENTTVALYPLTIWFLLLHRHQSRSITHT

SEQ ID NO: 3816 - protein, 191 aa, Clostridium perfringens ATCC 13124
MKKVLVFLAEGFETIEALSVVDVCNRAKVTCHACSLTENRTVNSAHGTMVLCDKLISDNDLETYDAIVLPGGMPGSTNLRDNEKVQSLIKKYNKENKIVAAICAAPIALAKAGVIEGKKVTSYPGFKEELGNVNYVEEDTVVVDGNIITSRGPATALVFGLEILKKLGYEKEAEEIREGMLINFFLEKEGK

SEQ ID NO: 3817 - protein, 591 aa, Fulvimarina pelagi HTCC2506
MCGICGEIRFDGENASPERVQRMGDCLARRGPDGSGQVMRGRVGLAHRRLKIIDLSEKAEQPMVDPVLGLTIAFNGCIYNYPELKKELEAKGYTFFSTGDTEVIVKAYHAWGRDCVKRFHGMFAFAIHERETGRVMLARDRFGIKPLYLSQNDKRLFIGSSLQSILKSGDVDTGIDKVALHHYMTFHAVVPPPHTILKGVRKLPPATTRMIEADGTYDDEVFWWPEFAPKSGDEKLTSDDWRDMVMEAMKLAVDRRMVADVPVGVLLSGGVDSSLIVGLLAEKGQKDLNTFSIGFEDANGEVGNEFEYSDLIANHYGTEHHKLFVPGDELIQELPKAIEVMSEPMVSYDNIGFFLLSREVAKHIKVVQSGQGADEVFAGYHWYPKVAGANDPLAAYQRAFFDRDHETLGTHLNPEWMPETDVSKEFVANHFAMEGATEAVDKALRIDAHVMLVDDPVKRVDNMTMAWGLEARVPFLDHELVELAARVPADEKLKQDGKGVLKEVARQVIPSEVIDRKKGYFPVPQLKYLSGPTLDFVKDALHSDAAKSRGLFRKEYTDALFANPSEHITPLRGSELWQVALLEMWLQAQGV

SEQ ID NO: 3818 - protein, 394 aa, Triticum aestivum
MTTRNGQIKNFTSNSGPQHPAAHGVSRSVLEMNGEVVERAEPHIGSLHRGTEKLIEYKTYLQALPYFDRLDYVSTMAQEHAHSSAVERLLNCEVPLRAQYIRVLFCEITRISNHSLASTTHAMDVGASTPFLWAFEEREKLLEFYERVPGARMHASFIRPGGVAQDLPLGLCRDIDSSTQQFASRIDELEEMSTGNRIWKQRLVDIGTVTAQQAKDWGFSGVMLRGPGVCWDSRRAAPYDVHDQSDLDVPVGTRGDRYDRYCIRIEEMRQSVRIIVQCPNQMPSGMIKADDRKLCPPSRSRMKLSMESSIHHFELYTEGFSVPAPSTYTAVEAPKGEFGVFLVSNGSNRPYRCKIRAPGFAHSQGLDSMSKHHMPADVVTIIGTQDIVFGEVDR

SEQ ID NO: 3819 - protein, 474 aa, marine gamma proteobacterium HTCC2143
MKTIDQFYIDGQWTAPHGKHVLSILNPATSVPCVAMACANETDVNAAAEAAFRAFPAWSATPSDQRALLMMGIADEMENRADDLVQAHVETMGIPRHQAMEVQIAGPIDAMRYFASLAATMGEPEDRGGYLISHEPVGVCALINPWNYPLLQMIGKVAPALAAGCTMLAKPAEQTPTSDIIMAEIFDKVGLPAGVFNLITGLGAEVGPLMASHPRVDMVSFTGSNRSGISVAIEAAPTVKRVCQEMGGKSALIITEDADLHTAVRYGVENVMLNTGQTCDALTRMLVPASRYQEAIDQAVIVADEQVVGDPDDPLTTMGPLASEQQCQRVRDYIKQGIAEGARMVAGGAELPTSLEGGAYVLPTLFADVRNDMVIAREEIFGPVLCIMSYETIDEAVDIANDSEFGLSSGVFAANDSDAIAIARRMRAGQCFIQGGFFRLEAPFGGYKQSGNGREWGEAGLAEYQEIKAIIRPD

SEQ ID NO: 3820 - protein, 322 aa, Rauvolfia serpentina
  misc_feature (43)..(43): Xaa can be any naturally occurring amino acid
  misc_feature (94)..(94): Xaa can be any naturally occurring amino acid
  misc_feature (158)..(158): Xaa can be any naturally occurring amino acid
  misc_feature (168)..(168): Xaa can be any naturally occurring amino acid
  misc_feature (181)..(181): Xaa can be any naturally occurring amino acid
  misc_feature (254)..(254): Xaa can be any naturally occurring amino acid
SLALSSPILKEILIEAPSYAPNSFTFDSTNKGFYTSVQDGRVXKYEGPNSGFVDFAYASPYWNKAFCENSTDAEKRPLCGRTYDISYNLQNNQXYIVDCYYHLSVVGSEGGHATQLATSVDGVPFKWLYAVTVDQRTGIVYFTDVSTLYDDRGVQQIXDTSDKTGRLXKYDPSTKETTLLXKELHVPGGAEVSADSSFVLVAEFLSHQIVKYWLEGPKKGTAEVLVKIPNPGNIKRNADGHFWVSSSEELDGNXHGRVDPKGIKFDEFGNILEVIPLPPPFAGEHFEQIQEHDGLLYIGTLFHGSVGILVYDKKGNSFVSSH

SEQ ID NO: 3821 - protein, 325 aa, Gibberella zeae PH-1
MVLHNPNNWHWVNKDVSGWARSYLDEAVAKVQVEDGEVKAKIDKIQSMDGDVDVSQRKGKVITIFDVKLVLQYSGSAPGEDDVSGTITVPELAHDTEEDEYVFDVDIFAESKEKQPVKDLVRSKIVPQLRQEFQKLAGALIAEHGKDIQHAPGSNPSSGFSTPKVHPQSSTPKPAATTSTQSKTGSVVNTTTVTDNEEFRTTAEELYQTFVDPQRIAAFTRSPPKVFDGAKVGGKFELFGGNVSGEYLELEQPKKITQSWRLNQWPAGHFSKLHMEFDQNDVDHVTVMRVKWEGVPIGQEDVTKRNWLEYYVKSIKQTFGFGTIL

SEQ ID NO: 3822 - protein, 405 aa, Zea mays
MRSMPFQLKTGHHHHGAAMEGKPPPPPTTQQPAPTPRVSRLRRLLGRVSSSEKFAADGKDRDKDEKLPPPPPPLPPATDDADAAGSLGLDRMVLSFMEEASAVERPPRGRCNCFNGSNHEESDEEFDFLPSAHASATAAAGAGDALEALKGLVQSASVAERNLLADASRLADKCGKGCKGKAECRRAVADGLRSLGYDASVCTSRWEKAPSHPAGEHEYIDAVVGKGKEQEEEEVRLIVEVDFRSQFELARSTKAYRAALQALPPLFVGTPDRLGQIVAVVAEAARQSLKKKGLHFPPWRKPEYMRAKWLSPHVRCGGVGGDMVAVPAAAAAAATPVQAASFSGEFELVFDRKRSSAGAGAAAEGGAVGGEKITVVVSPWRPTEEASKKQLPPKAKVVTGLAAVL

SEQ ID NO: 3823 - protein, 913 aa, Oryza sativa (japonica cultivar-group)
MGNSLPVESKFTFEEENDRIKYVVSSMQGWGEKMEDAHAAILNLDDTTSTSFFGVYDGHGGAEVALYCAKQFHIELCNHEDYHNDLINALDNVFLSMDENLQQSDAWRELVIPHDNGCMYFLKAGVCAKPFPQATYTGPAYEGSTACVVVIRGNQMIVGHVGDSRCVLSRQGGLAIDLSFDHKPCTRTESERERVQNAGGRSPGLRCEQVMGNYVVKEQWVLGDFGGGDFAFKKNKDLDREKQMLVCDPDILADDITDDMEFLVIASQGLWSCVDSADVVSYIHDRLSVEGAELRVICEEVVEFGLASGENTTVILVQFKPGAFQYQLLMMMSKRELDESCRGEVSVGTTSHRMGPLLERWISREGRSDGGDSSGPAQPLFRISLSLASQEQRQSKASSAMGNSLPVESKFTFEEENDRIKYVVSSMQGWGEKMEDAHAAILNLDDATSTSFFGVYDGHGGAEVALYCAKQFHIELCNHEDYHNDLINALDNVFLSMDENLQQSDAWRELVIPHDNGCMYFLKAGVCAKPFPQATYTGPAYEGSTACVVVIRGNQMIVGHVGDSRCVLSRQGGLAIDLSFDHKPCTRTESERERVQNAGGRSLGLRCEQVMGNYVVKEQWVLGDFGGGDFAFKKNKDLDREKQMLVCDPDILADDITDDMEFLVIASQGLWSCVDSADVVSYIHDRLSVEGAELRVICEEVVEFGLASGENTTVILVQFKPGAFQYQLVDPAGFGTAVSNIASTSAAPAGASDTSDEGVMADSSATADTSGSARAESGELVPTPSANNTVTDEVDPTGTVAADDKVDPNSSANADADDGAPKPSLGAVIESDEVALDATATGHQVAVRQQEEFDPKKCWICGKGYKKILLEPSSARARNPLLAHAKTCESEDKKAKKKITKYMMKANVTNQYH

SEQ ID NO: 3824 - protein, 407 aa, Rheum australe
MDGVAQISDTDMAEAAPPPSDPSQPQPAAPDPSQHQPLPQQPQQINIPATLSHGGRFIQYNIFGNIFEVTAKYKPPIMPIGKGAYGIVCSALNSETSEHVAIKKIANAFDNKVDAKRTLREIKLLRHMDHENVVAIRDIIPPPLRDSFNDVYIAYELMDTDLHQIIRSNQGLSEEHCQYFLYQILRGLKYIHSANVLHRDLKPSNLLLNANCDLKICDFGLARVTSETDFMTEYVVTRWYRAPELLLNSSDYTTAIDVWSVGCIFMELMDRKPLFPGRDHVHQLRLLMELIGTPSEAELGFLNENAKRYIRQLPQYTRQSIPGKFPHVHPLAIDLVEKMLTFDPRQRITVEDALAHPYLNSLHDISDEPVCMTPFSFDFEQHALSEEQMRELIYREALAFNPEYQQG

SEQ ID NO: 3825 - protein, 1148 aa, Anabaena variabilis ATCC 29413
MIGAMVGAWVGELVTVEVSKALLSGVTSKLNPSDLDKAIKTATIEACKQETRLFYSCPPDFIPKFLCNFFKEQGLSELQKPLENEGKPDVDYLAVVFQKAALADSKMKEIKIDYVYSWMEVFVTTYFQNTDNCIRFQIAKENYLQQLVNWFDDVKFAGIAVPGQEVEKSEKLVNIFVLPEVQEDNHKDINNLNSSIETELLSSNLSQSQQQLLWEQRQRALRKSSGRKFLASQILSQTNCQKFVLLGAPGSGKTTLLSYFVVMLAQKQIEQLNITAADYLPIIIPIRDFARQANISVIEYVKQFVEKNLCVKTLPVGFFEYWLEDGHTFIFFDGLDEIAQENKRYDVVRKIENFLGQFPTNCAVITSRPAGYKRDFFNTQEFAHYELLSFDDEKIEKFINCWYNSRIQDKSEAERRKTTLREALNKNERLKLLARNPLLLTIIALIHRYQAVLPKGRHKLYEKAVETLLTSWDANKEINVNHFLQDIDIEDLLFLMRKLAFWIHGQGSTADKEGGTLIACEDLLDKLKREIKSLKEIELYKAEEKAKRFLSLIQERTGLLNEQGQDCYAFVHKTFQEYLCAREINYQADDQDDFDIVLQYIDQHLHDPHWREVLLLLITQQAPNKAATAIRKVLSKNSEYEQWLHRDLLFAGNCLAEDIKNLKTAKDSPAIEILQNLVNLEVSDSLQVSSQIKSQVFQILCSLNETAFQTQALQLLKEKEQQIEQVRFQKYRAALGEKKAAVDRLLELLKDSESNVRSSAANALGRIGTETAIPGLLELLKDSESNVRSSAANALGNIGTETAIPGLLELLKDSESNVRSSAAFALVRIGTEAAIPGLLELLKDSESNVRSSAAFALGIIGTEAAIPGLLELLKDSESNVRSSAAFALGRIGTEAAIPGLLELLKDSESNVRSSAADALGNIGTEVAIPGLLELLKDSESNVRSSAVNALVRIGTEAAIPGLLELLKDSESNVRSSAAFALGNIGTEAAIPGLLELLKDSESNVRSSAAFALGNIGTEAAIPSLLELLKDSESNVRSSAANALGNIGTEAAIPSLLELLKGSELNVRSSAAFALGNIGKEAAIPGLLELLKDSEFNVRLIGAFVLKKIDEKTHSVVINLSRWINENQDSEYIGDGIDLLWELICGETT

SEQ ID NO: 3826 - protein, 112 aa, Pseudomonas fluorescens Pf-5
MDIIETIKEQIANNTILLYMKGSPNAPQCGFSAKAAQAVMGCGEKFAYVDILQNPEIRANLPKYANWPTFPQLWVAGELVGGSDIMAEMFANGELQSLIKAAAEKAAAKTEA

SEQ ID NO: 3827 - protein, 449 aa, Aspergillus oryzae
MVMAPTACIPAEICMTKHSQDKSDFNYNHNLSQISNNGGDDLSQSRLAAKDLVMDVLKKRAGEVNTDRCAPGDEDAFYVADMGEVYRQHLRWKMNLSRVRPFYAVKCNPDPEILRLMAKLGNGFDCASKAEIDMALDTGIDPSRIIYAQPCKTKSYLRYAAQMGVKQMTFDNADELYKIKACFPDAELYLRILTDDSTSLCRLSMKFGASLDIARQLLELAHELELKVVGVSFHVGSGAEDPTAFVKAVQDARMVFDQAAEIGHELHTLDVGGGFSGDTFEKFAGVLSEALDTYFPPHIRVIAEPGRYYVATAFTLAANVIARRDVRDPEDPANDAYMIYLNDGVYGNFSNIIFDHQHPVAQILTCANASNAATSAGIAYSIWGPTCDGIDVISQRITLPGLLDVGDWLFFEEMGAYTKCSATRFNGFSDNHEVIYISSEAGASALLEY

SEQ ID NO: 3828 - protein, 422 aa, Sulfolobus tokodaii str. 7
MNSAVQETLTSNLYDQQVKKLYHVGGILGLTEDVLQVLSTPERVIQVKIEIKGADGKVKTFVGWRSQHNSALGPYKGGVRYHPDVTQDEVIALSMMMTWKNSLLQLPYGGGKGGIRVDPSKLTKEELEALSRRYVDALYKYIGSDIDIPAPDVNTNPQIMAWYLDEYIKITGKADFAVFTGKPIELGGLPARIYSTGLGVATIAKASAKKFLGGIEGATVIIQGFGNVGTYTAKFLQEMGAKIIGVSDSKGGVIDPNGIDVQKIIEIKESTGSVINYPSGKKVTNDELLISECDILIPAALENVINKFNAPKVKAKLIVEGANGPLTADADAIMKERGIPVVPDILANAGGVVGSYVEWANNKMGEIMSEEEARKLIIQRMENAFEGVYQKYNKLGDQDLRTAAMAISIERVVNAMKARGML

SEQ ID NO: 3829 - protein, 163 aa, Thiomicrospira crunogena XCL-2
MIAFIKHQVKTFGLIELFKGLAVTGKYLFKKKITVRYPEEKTPLSPRFRGHHALRRYENGEERCIACKLCEAVCPANAITIESEERDDGTRRTTQYDIDMFKCIYCGFCEEACPVDAVVETRVFEYEFHERGTHIMTKEQLLAFGDKHESQIAADRAADAKYR

SEQ ID NO: 3830 - protein, 460 aa, Chlorobium tepidum TLS
MQVKFGTDGWRAIIAKEYTYDNLKLAALASGKYFLSHPDKSNGVCVGYDTRFMSKEFARYTAEVLSSMGLKVFLSSSFVSTPAVSLYTREHKLAGGVMITASHNPPIYNGFKVKASYGGPAHPEVIDEIEKNLSGIDPSTLVKPAENLITMTDIKSEYIAYLESKLDLKLIRESGLKIAHNAMYGAGQDIVTRLLDESMVNCYHCSVNPGFDGINPEPIPPYITDFVEFFKEVETDVAIINDGDADRIGMLDEKGEFVDSHKLFAIVLKYLVEQKGQRGEVAKTFALTDIIDRICQKHDLKMHLLPVGFKYVSRLMTTNDILIGGEESGGIGITSFLPERDGVYTGLLMLEIMARRQKTLTGLVEELYDEYGFFSYNRLDLRVAESKKAAIIEAASGGKLKSIAGYPVTSFNDLDGFKYHFEGGWLLIRASGTEPVLRIYCEADSTEKVEKVLAFASRLA

SEQ ID NO: 3831 - protein, 418 aa, Brassica napus
MERATLSPSLNQSYLLSPSRASTTRLHSFSFTRNLSPSTSSIKLQPSSSSVSSSFINGGVSLTRCNAVLSNSSSSTDASEVADIDWDNIGFGLKPTDYMYVMKCNLGGEFSNGELQRFGNIEVSPSAGVLNYGQGLFEGMKAYRKQDGKNILLFRPEENATRMRCGAERMCMPAPTIDQLVEAVKATVLANKRWVPPPGKGSLYIRPLLMGTGAVLGLAPAPEYTFLVYVSPVGNYFKEGVSPINLIVESEFHRATPGGTGGVKTIGNYAAVLKAQSVAKAKGYSDVLYLDCIYKRYLEEVSSCNIFIVKDNVVSTPEIRGTILPGITRKSIVDVARSQGLKVEERNVTVDELLEADEVFCTGTAVVVSPVGSITYKGKRVSYGEGSFGSVSEKLYTVLTSLQMGLTEDNMKWTVNLS

SEQ ID NO: 3832 - protein, 1144 aa, Populus tremula
MASQSQRQSNQPAHNQAQSSGTSNMRQHHHPTESVSKAIAQYTVDAQLHAVFEQSGGTGKSFDYSKSVRTPNQSVPEEQITAYLSKIQRGGHIQPFGCMIAADEQSFRGIAYNENAKNMRGLTPQSVPSLEKQEILFVGGDVRILFRPSSAVLLEKTFGAREITLLNPIWIHSKNSGKPFYAILHRIDVGIVIDLEPARTEDPALSIAGAVQSQKLAVRAISQLQSLPGGDIKLLCDTVVDSVRELTGYDRVMVYKFHEDEHGEVVAENKRVDLEPYIGLHYPSTDIPQASRFLFKQNRVRMIVDCHAIPVSVIQDEGLMQPLCLVGSTLRAPHGCHAQYMENMGSIASLAMAVIIYGNDEEAIGGRNSMRLWGLVVCHHTSARCIPFPLRYACEFLMQAFGLQLNMELQLASQLLEKHVLRTQTLLCDMLLRDSPTGIVTQSPSIMDLVKCDGAALYYQGQYYPLGVTPTEAQIKDIVEWLLTLHGDPTGLSTDSLADAGYPGAAFLGDAVCGMAVAYIAERDFLFWFRSHTAKEVKWGGAKHHPEDKDDGQRMHPRSSFKAFLEVVKSRSLPWENAEMDAIHSLQLILRDSFRDAEATNSKAVVHNQLKDMELQGMDELSSVAREMVRLIETATAPIFAVDVDGCINGWNAKVAELTGLSVEEAMGKSLVHDLVYKEYEEIVDKLIHRAVKGEEDKNVEIKLRTFCSEHQKKAVFVVVNACSSKDYMDNIVGVCFVGQDVTGQKVVMDKYVLIQGDYKAIVHSPNPSIPPIFASDENTCCLEWNTAMEKLTGWSRGEVVGKMLVGEVFGSCCKLKGPDALTKFMIALHNAIGGIDTDKLPFSFFDRNEKNVQTLLTANKRVNINIIGAFCFLQIASPELQPSLKVQKQQEKKSFARMKELAYICQEIKNPLSGIHFTNSLLENTDLTEDQQQFLETSAACEKQILKIIRDIDLESIENGSLELEKAEFLLGSVINAVVSQAMLLLRERNLQLLRDIPEEIKTLAVYGDQARIQQVLADFLLNMVRYAPSSAGWVEIHVCPTLKQISDGHTLVHTEFRYLERVLQTRMLGLQHPLRSFLNCKLTLVMLHREGMVPKIQFQGLSVCQGRLIWLSFPENTTVALYPLTIWFLLLHRHQSRSITHT

SEQ ID NO: 3833 - protein, 359 aa, Oryza sativa (japonica cultivar-group)
MRTFQGHNPNTMKVHSRKSQPSKKKPREFYDTVEVHIIDDDSDGDANIHKDYSMEDTSKHLVMYNPEITYDKQGEVEVTEPIDNYTSLNQRYMKPRHGYNTVLPSIGAYTVQCAHCFKWRIIPTKEKYEEIRENICQDVFVCERAREWNRVISCVDPEDISQDGSRVWAIDKASISQTPPGWDREVRIRGEGCSKFADVYYTSPTGKKLRSLVEVGRYLAENPHYIRQGVNLTQFSFATPKPLQEDYVRKHTYAATPELPELLETAQVDPLCWAAPPTRSELLGELGASTSRSVDVSQSEVSYPVDLHQPEESAPLPPRTKKKTMKRGRVSATGSQSTPPGSSKDQSGGCVSDVEFVSL

SEQ ID NO: 3834 - protein, 125 aa, Zea mays
TPRAPRPPWPQDEPRATSAPRRDQINHPTDPEADEILAKKGVVVLPDIYANSGGVVVSYFEWVQNIQGFMWDEEKVNDELEKYMSSAFQHMKAMCKSLDCDLRMGAFTLGVNRVARATLLRGWEA

SEQ ID NO: 3835 - protein, 516 aa, Oryza sativa (indica cultivar-group)
MGLPGRRNPLLSARRAAASLRRSRRLPVYVAAVFFVASVLLMFRDEILYLTTARSPSSSLPTTGGSAGGAGLARREELVSVNKPVLLGHGGKPEKHHSVTERHRPKVSAKRRPNKKAAKAARKKFMASPAVAAGAEVNVPETCNLSKGKWVFDNATYPLYREQECEYLTAQVTCTRNGRRDDGYQKWRWQPRDCDLPLAFDARLFMERLRGKRLMFVGDSLNRNQWESMVCLVRPALSPGKSYVTWWDGQRVVLHAWEYNATVEFYWAPFLVESNSDDPKAHSIRDRVIKPEAIAAHAGDWVGVDYLVFNTYIWWMNTVNMKVVLPTRHDQFTVIRRPTGKTWEEYDEVGRIEAYRRVLDTWATWVNDNVDPARTSVFFMSVSPLHISSEAWGNPGGVRCAKEDAPVQNWHGPLWLGTDWDMFRAARNASRAAGRVPVTFVDVTAMSELRKDGHTSVHTIRQGRVLTPEQQADPATYADCIHWCLPGVPDVWNLMLYARILSRPPAAAAAAAGYVA

SEQ ID NO: 3836 - protein, 456 aa, Oryza sativa (japonica cultivar-group)
MSRAHGSPRSFFPVGNPFRVMFPGGAHLSRKLQELLASYEDALALSLRKLKPEAASDVLTLSWMRLAVDCLSELHTNIANLITDLELPVSDWDDKWVDIYLNSSVKLLDICIALSSELSRLDQGQLLLQYALHVLGSESGVPSQEQLKRAEPSLREWMELVGVRCARLVSCSATLQELAGNLSLMKVKNSAKGKVLMRALYGIESVTVFVCSIFVAVLSGSPKPLVELHVPEKFGWSQAFNDLHTAVSEELTRQLSGGSVAAVKELEEVEACARRLHVLASTSQLEEEAANLANAVSHTEEEVMSDSIAQEGDHHCGLKLADDTTREGGIVISESIAEGGTQEAEMKKDISYEKEVAMVERISYKEHQDSNVKQANGSSDESALVVPERTSVQESKEELLNCISSMSKSAEGLRHGLDSLSKRVGDFFQIVLTGRDALLCNLRISDAASKVAEVSS

SEQ ID NO: 3837 - protein, 129 aa, Oryza sativa (indica cultivar-group)
MEVAKPRWYERTLVLAVQRVFFNAYFLGYLLSPKLAHRVVGYLEEEAPRCPFPGDGSQGYACPARLSLMKSCGGLCPTQLCSCYQETRVAVDLLYPSSASPPGGRVTGAASRRQGCARGFARRALIYSA

SEQ ID NO: 3838 - protein, 304 aa, Triticum aestivum
MDKYEKLEKVGEGTYGKVYKARVAATGQLVALKKTRLEMDEEGIPPTALREISLLRLLSASLYVVRLLSVEQVTKPCGKTVLYLVFEFLDTDLKKFVDGFRKGPSPRPLPTQVVKSFLYQLCKGTAHCHGHGVLHRDLKPQNLLIDKEKGVLKIADLGLSRAFTVPMKSYTHEIVTLWYRAPEVLLGATHYSTGVDIWSIGCIFAEMVRRQALFPGDSELQQLLHIFRLLGTPNEEKWPGVCALRDWHDYPQWKPQHLSRAVPTLEPEGLDLLAKMLQFDPANRISAKAAMDHPYFDSLDKSQF

SEQ ID NO: 3839 - protein, 232 aa, Brassica rapa
EKFSYGKELAHEKECGFALCYCPAPDCNYAGVYKDLYSHYDANHKDTSTRFVCGTLHRTYLGTVSTTSVLQEYRDGPLVVVQGFVVAHGLSVTVNCIAPSARGVGKFSFNLTYTLGRHTVTFGSTEMNRIQKVSFETPQGDFMSIPSYLVSPIIVKNLRICIRRLEEEAGEDEEEEEEEEEEAGEEEEEEEEEEEEEEEEEKEEAVEVDVVNNVRRSTREKKGNSKYQNKVK

SEQ ID NO: 3840 - protein, 145 aa, Zea mays
  misc_feature (18)..(18): Xaa can be any naturally occurring amino acid
  misc_feature (35)..(35): Xaa can be any naturally occurring amino acid
  misc_feature (131)..(131): Xaa can be any naturally occurring amino acid
MTENASAKLRQRSTLNVXGVHSTLHLPFDHNMYGXQNLTGQNFFNASDTVSVQATFPYKCDESKILQTVAYDLVGYIVYEIDQHPYHNVFYNGTIDDVEAGGLLSAESGLLITLEIALVGLLWIWTYGADXQQLSKKTKKAPKVE

SEQ ID NO: 3841 - protein, 497 aa, Oryza sativa (indica cultivar-group)
MGTRRRRNPVIFLFLWFVMAFELCASLNHEGVALMRFKEMIDADPFDALLDWDEGNASPCSWFGVECSDDGRVVALNLPNLGLKGMLPQEIGTLAHMRSIILHNNSFYGIIPTEMKYLHELKVLDLGYNTFSGPFPSELRNILSLKFLFLEGNKLSGSLPIEYELASMDQTSLNKISTERKTSTVVPFSPTASGQLHTATLGGITKFKRSELETACEGFSNIIDTLPRFTLYKGTLPCGAEIAAVSTLVTYASGWTTVAEAQFKDKVEVLSKVSHKNLMNLVGYCEDEEPFTRMMVFEYVSNGTLFEHLHVKEADQLDWQSRLRIAMGVMYCLNYMQQLNPPVLLRDLSTSCIYLTEDNAAKVSDISFWGDKKEDEKSEASDEHSTVYKFALLLLETISGRRPYSDDYGLLILWAHRYLIGDKPLMDMVDPTLKSVPEEQVRELTKLVKLCLSEDPMERPTVAEVTAWMQEITGISEEEAIPKNSPLWWAELEIITS

SEQ ID NO: 3842 - protein, 241 aa, Coccidioides immitis RS
MAALPRRTTSLTRLTNETKVQVSLSLDGGVLLPFEPCEHFPQNSPEEATQILPLAGSAHSTQFTSTQQITINTGIGFLDHLLHALAKHAGWSLAVRCKGDLIIDDHHTTEDTFLALGTAFTRALGPRVSLVRFARGDAPLDEALSWAVIDISSRPYSVINLGLQREKIGALSTEMIPHALESFAQTAGVTLHVGCMYGSNDHHRAESAIKAVAVAIRGATTRRGAGEVGGGGEVVSTKGVL

SEQ ID NO: 3843 - protein, 446 aa, Legionella pneumophila str. Lens
MEIKRVLKDRLTARVCVIGAGPSGIAAIKNLQEHGITNVTVFEKNNQIGGNWVYDEQNEHSSVYETTHIISSKRWSEFEDFPMPVDYPDYPSHSQLLKYFQSYVEHFHLDRYIRFNTVVQKVHRLDDDTWHVIYEDAQGIHEACYDYLLVANGHHWDPFMPVYPGVFDGEILHSHQYKKASIFKGKRVLVVGGGNSACDVAVEISRVAPGTCISMRRGYHIFPKFIFGKPTDVAVAKIQWMPSWLRQKFISLVIRGLQGRYAKYKLMKPDCGPLEIHPTINSELLYFIRHGKIHPRPGISRFEGNTVHFTDGTQGEFDTIIFATGYQISFPFFDKSCIDFSNSTTIPLYRKMMHPEFENLYFIGLCQPQGCIWPLADYQSKIVARIIAGTLKRPEQLHRKIAKEINKPHHRFKSHMRHALEVDYHIFRKELLEMLGQKHKRLKFYP

SEQ ID NO: 3844 - protein, 804 aa, Oryza sativa (japonica cultivar-group)
MGPLLERWISREGRSDGGDASGPVLFWCVLIIFAVPDAIRSSSLRLGQVAPRLVLFSNFKAFRSPKFAKILPGSDLFSPRVLGFRTRVVLLLDVFEVGFALFCKASSTMGNSLPVESKVTVEEENDRIKYIVSSMQGLGHKMEDAHAAILSLDDTTSTSFFGVYDGHGGAEVASYCAKRFHIELCNHEDYHNDLTNALDNVFFSMDENLQQSDAWRELVIPRDNGWMYFLKAGVCANFWPFPQAYTGPAYEGSTACVVVIRGDQMIVGHAGDSRCVLSRQGGLAIDLSSDHKPRTSESERERVQNAGGISLGVDCEKVMENYVIKEQWILGYFGESVTISRSIGDFAFKQNKDLNREEQMLICDPDIHTHDITGDMEFLVIASQGLWSCMESADVVAYIHVRLLEGLKLRVICEELVQSGLASGENTTVILVQFKPGAFQFQYELVDPAAFDTAASNVASTSAGPAGGSDSDTSATSDEGVDDTATAGTTTTGYEAGSSTGPGSGGGSANAAFDSGGDLAANLDIATNFGSDDLAANLDIATDIDTEDVFTFINSDDTFGINSDEVELDPNFRPKPQVRRAHDGPSPTPSEIEADLNASPTRYNMRDIFEAFDKVEAELGGFPLQGHDVSSTSTNPNTATDTGSGSRTGDDDVDGAIARAMAVASSVMTGAGYEVDSTTTNPSAAADTGSYTGDEIKVDDSTSGSARGDSGELVNNDTTVADNNASGVADSTTVGDEVDPTATVAADDSNTGDKVDPPAITKATADSNTSGEVDVDATATATASASAAVADDEGTAPDDSEGSP

SEQ ID NO: 3845 - protein, 589 aa, Oryza sativa (japonica cultivar-group)
MRTMLPLLVILVVGLRLAGASPPPQPVACTKGTTDCTVTNVYGSFPDRTICRAADASFPRTEAELVAAVAAAAAAGRKAKAATRHSHSFPKLACPGGRDGTIISTRFLNRTVAVDAAARRITVESGVVLRDLIRAAAAAGLALPHSPYWYGLTVGGLLATGAHGSSLWGKGSAVHEYVVGLRIVTPAPASQGFAVVRELVAGDPDLDAAKVSLGVLGVISQVTFELQPQFKRSVRFVTRDDSDFAEKVAVWGGAHEFGDMAWLPRQGKVIYREDDRVDVATPGNGLNDYLGFRAQPTLGLITARAAEERLERNGTDIARCLAARLPPSLFELQAYGFTNDGVFFTGWPVVGFQHRIQASGTCISSPEDGLLSSCTWDPRIRGPFWYNSGFSIALPRAAAFVADMMRLRDLNPRAFCDIDAKLGILMRYVKASSAYLGKPEDCVDFDVTYYRSYDDGEPRPHSDVFDELEQMALRKYGAVPHWGKNRNFAFDGAAAKYPNSGEFIKVKERYDPDGIFSSEWSDQVLGISGSPNIVDKRCAIEGLCVCSDDSHCAPELGYFCRPGKLFKEARVCSKDKSAAAGDDDLLDEL

SEQ ID NO: 3846 - protein, 117 aa, Glycine max
MGSLMSGWDSPTKDPNSVRRCKSLTREEIDAFWKTKKKTEEKHVQAVSNLVAQEVAESQGIEDRYENQSKTTGWWKRSNWAFLNEPREEEGRPNNYVPQFQVAHIAKIASNSAGVTG

SEQ ID NO: 3847 - protein, 136 aa, Rheum australe
MARTKQTARKSTGGKAPRKQLATKAARKSAPATGGVKKSHRFRPGTVALREIRKYQKSTELLIRKLPFQRLVREIAQDFKTDLRFQSSAVAALQEAAESYLVGLFEDTNLCAIHAKRVTIMPKDMQLARRIRGERA

SEQ ID NO: 3848 - protein, 617 aa, Oryza sativa (japonica cultivar-group)
MDAGGEEEKQERHRVDGASPSMVALRSDVLHAVLGGKSHNQDTSELVTLSEWSKNKFPLYAYAAAFMFLVMQEYDKRSHGIDFLNRDFVVRELFDNILKHMSEGREEEEEGACSMVTTSHRTGHSRSVGLAARDDPTAEMRLVQGEGSVGTTSHRMGALLERWISREGRTDGGDTSVQGERSVGTTSHRMGALLDVGSAVDDPAKQRSAMGNSLPVESKFTDEKENDRIKYVVSSMQGWGEKMEDAHAAILNLDDTMTSFFGVYDGHGGAEVASYCAKRFHIELCNHEDYDSNLSNAMRSAFYSMDEDLQLSDAWRELVIPRNNGWMYFLKAAACTSICKATYTEPAYEGSTACVVVIRGNQLIVGHAGDSRCVLSRNGQASALSVDHKPDRDFACKKNERLPPEDQMLTCNPDILTMDITDDMEFLVIATEGLWCNMTNQNVVDHTHDRLLEGAEARVICEELVQFGLPSGDNTTVILVLFKPGAYPAVPPVDTDTDTDSHTGDDVDNNDPANEVDPTANAGSDDSNTSDEVKVDATATAVGSSSTTAVAADEATVVSLSTATITIVDNYFFINTSEEVDPTANAGSDDSNTGDEVKVDATASSGLSDWELIYSEF

SEQ ID NO: 3849 - protein, 429 aa, Anabaena variabilis ATCC 29413
MSNIVDTAIEAIVAREILDSRGRPTIEAEVHLLSGAVGLAQVPSGASTGTFEAHELRDKDKSRYGGKGVLKAVHNVNEVLAPKLIDLDAINQELIDRTMIALDGSGNKSNLGANAILAVSLAAARAGAASLGIPLYRYLGGPLANLLPVPLMNVINGGAHAANNVDFQEFMIVPVGATSFREALRWGAEVFATLSEVLHDKGLLTGVGDEGGFAPNLESNQVALELLVAAIEKAGYKPGEQVALALDVAASEFYKEGQYVYDGRPHAPTEFIDYLGQLVDQYPIVSIEDGLHEEDWQNWQLLTQKVGSRVQLVGDDLFVTNATRLQKGIQEKAGNAILIKLNQIGSLTETLETIDLGTRNGFRSVISHRSGETEDTTIADLAVATRAGQIKTGSLCRSERVAKYNRLLRIEDELGDRAVYAGAVGLGPK

SEQ ID NO: 3850 - protein, 1083 aa, Oryza sativa (japonica cultivar-group)
MEEAVNASAALDPKLAPLLLFGHGDATFLYSVPKRALLPMPTPTRVGDGGVDDMMRGHRWWTTAQGWLLMARRGSPCTFLWDPFTGRRAGLPPDHDGTVLAAEGSHRRRCLLSCCGPMDPTSCTVLVIDLAYPELWYCRPGDNQWVKLHQHPYQYRNPAHRDAIIWGLRQLTAIDGKFYTEELSGIVGVLEFSPEVAFTKIAVHDVDRRPAVYKKRTTSFVESNGELHSVVFSHPIGCDRIVARVGVYRLSINPTTTQEQRSAAWVKVDSLGGRAFFVKIGSFGASLDTEGTGLRGNCVYYSGFNGKVLCVYDMERGTTVVIDPGTNLPYHQSPQVLMPTIFWDIMAGTTRSVENIYQVGPTIMENAYEVKDTKVSKVKRVVRFFEDGCTCLPIPIQNTRVTKQKDKLINQKKSKRSTAGRPPYRGEGASSPETKNSYHGCGFPLEPLKRLLEWGRIADAEENLGGIEVREAHLAESLYFISVRQKANMTSLQLYSEIFRNHEHWNRWITIHTKARPAAAAAGLCLGERRRARAPWGPPDTGGALLERWISRERRSDSRDASGSAKQRSAMGNSLPVESKFTDEKENDRIKYVVSSMQGWGEKMEDAHAAILNLDDTMTSFFGVYDGHGGAEVASYCAKRFHIELCNHEDYDSNLSNAMRSAFYSMDEDLQLSDAWRELVIPRNNGWMYFIKAGVCANLSPFPQATYTAPSYEGSTACVVVIRGDQLIVGHAGDSRCVLSRNGQASALSVDHKPDRDFACKKNERLPPEDQMLTCNPDILTMDITDDMEFLVIATEGLWCNMTNQNVVDHTHDRLLEGAEARVICEELVQFGLPSGDNTTVILVLFKPGAFPAVPPVDTDTDTDSHIDDDVDPTGSNNATASDNNDPANEVDPTANAGSDDSNTGDEVKVDATATAVGSSSTTAVAADEGTGNPPHGALVDTDDEDGLTYSQDMDLPPASTSPPTFPDEDDLPRSNPDKSPPHVAPPNLQQGGKFNDMDAGGEEAKQERHLVLAHKLFLLSHPDLDDLAKVALRSDALDAVKSDGMAPLFESLAAAGVLEPDDALLAEMRARIDEEVRKLDEK

SEQ ID NO: 3851 - protein, 295 aa, Hibiscus cannabinus
PFSSGTTGLPKGVMLTHKSLVTSVAQHVGGDNPNIYFHERDVILCLLPLFHIYSLNCILLCSLRAGAAILIMQKFEILPLMELVEKYSVTIAPFVPPIILAIAKTPDIQKYDLSSIRMVISGAAPMGKKLEDAVRDRLPNAKLGQGYGMTETVLALNLAFAKEPWETKSGACGTVVRNAEMKIVDPETGTSLPRNQSGEICIRGSQIMKGYLNDPEATKRTIDKEGWLHTGDIGYIDEDNELFIVDRLKELIKYKGFQVAPAELEAMLISHPNISDAAVVPMKDEAAGEVPVAFV

SEQ ID NO: 3852 - protein, 216 aa, Triticum aestivum
  misc_feature (172)..(172): Xaa can be any naturally occurring amino acid
  misc_feature (183)..(183): Xaa can be any naturally occurring amino acid
  misc_feature (203)..(203): Xaa can be any naturally occurring amino acid
MGAANSREDLDLTSSSGEEEDADEEYDPGSGSASGPRKDDPLRATTPASIEFLDAKLRALDLKYKQPDNAARLYLHVGGASADARWVPAERRATYAFVDKAAAAAAEADDDYYDDDRDRRGRRHTSSSSSASRGPRWVLEVGPGRRVSAPVGQELQLKALPGQRRADFAAAXSVWALRFPTTXLRRFREQYDRCLFENTYGVXEATDEGPREVFGA

SEQ ID NO: 3853 - protein, 205 aa, Mycobacterium smegmatis str. MC2 155
MTTALKAARIGIGGPVGSGKTALVEALLAGFARRGRSVSVITNDLVTTEDAERVRRSGLIDPRRVRAVEAGGCPHTVIREDPSLNMAAADALEAEFPDTEMILLESGGDNLASTFSRDLVDYWLFVIDVAGGDDIPRKRGPGVLRCDLLVINKVDLAPHVGVDLDLMRREADEVRSGRTVVAISARNGHGIDELMDVLEREVLFV

SEQ ID NO: 3854 - protein, 1100 aa, Prochlorococcus marinus str. MIT 9515
MPQRGDLKRILILGSGPIVIGQACEFDYSGTQACKALRKAGYEIILINSNPASIMTDPDIANKTYIEPLTPEIVSQIILKEKPDAILPTMGGQTALNLAVKLSESNFLKNNNVELIGADLKAINKAEDRKLFKESMEKINVNVCPSGIASDLVEAMKVSKQINSYPLIIRPAFTLGGVGGGIAYNLEEFNDLCKSGLDESPSNQILIEKSLIGWKEFELEVMRDTSDNVVIICSIENLDPMGVHTGDSITVAPAQTLTDKEYQRLRDLSLKIIREVGVETGGSNIQFAVNPNNGDVIVIEMNPRVSRSSALASKATGFPIAKIAALLSVGYTLDEIINDITKKTPACFEPSIDYVVTKVPRFAFEKFKGSSNILNTAMKSVGETMAIGRSFEESFQKALRSLEIGIFGWECDSIEDFNNENDLKNNLRNPTAERILIVKKAMEAGKSDSYINEITNIDLWFLEKLRNIFNFQNQFLKEKNLNEIDRDLMLRAKQIGFSDQQIAKLTDSDFFEVRNYRKKLNILPLYKTVDTCSAEFSSETPYHYSTYEESFSESNLHFSDNESYSNKANPAKKIMILGGGPNRIGQGIEFDYCCCHASYQSSSNGYQTIMVNSNPETVSTDYDTSDILYFEPVTFEDILNIIEAENPYGLIVQFGGQTPLKLSLPLSNWLKSKEGLKCNSKILGTSPLSIDIAEDREEFTKILKDLNIRQPLNGIARTQEEALSVSQNIGFPLVVRPSYVLGGRAMEIVKDKIELSRYISEAVKVSPDHPILLDQYLSNAIEIDVDALCDENGSVVIAGLMEHVEPAGIHSGDSACCLPSISLSQLTLETVKEWTKLIANRLNVVGLINLQFAVTNINHQENELYILEANPRASRTIPFVSKAIGKPVAKLATQLMQGSSLKDINYTEEIIPKYQAVKEAVLPFKRFPGSDTLLGPEMRSTGEVMGLAEDFGLAYAKSELASGNGVPSEGVAFLSTNDLDKDKLEEIARELIVLGFKLIATKGTASYLLNLGIEVDEVLKVHEGRPNIEDLIRSGLIQLVINTPIGSQAFHDDAYLRRAALEYNIPTFTTIPGAKAALQAIKSLRINKIDTLSLQEIHKD

SEQ ID NO: 3855 - protein, 241 aa, Prochlorococcus marinus str. MIT 9515
MRKSVIAGNWKMHMTCAETKNYLEEFIPLIKDLPNDRKIVIAPPFTAISTFSSYSNFDYLDIASQNIHWEDQGAFTAEISPKMLIEHNVKYAIVGHSEPRKYFSESDEQINKRAVFAQSSGLTPIVCVGETLEQRERGEANRVITRQVEQGLENTDPSNLIIAYEPIWAIGTGKTCEASDANKICALIRELIGFDDVIIQYGGSVKPNNIDEIMSMSDINGVLVGGSSLDPISFSRIANYE

SEQ ID NO: 3856 - protein, 384 aa, Triticum aestivum
  misc_feature (166)..(166): Xaa can be any naturally occurring amino acid
  misc_feature (215)..(215): Xaa can be any naturally occurring amino acid
  misc_feature (268)..(268): Xaa can be any naturally occurring amino acid
  misc_feature (294)..(294): Xaa can be any naturally occurring amino acid
  misc_feature (326)..(326): Xaa can be any naturally occurring amino acid
METAGKVIKCKAAVAWEAGKPLSIEEVEVAPPQAMEVRVKILYTALCHTDVYFWEAKGQTPVFPRILGHEAGGIVESVGEGVTELAPGDHVLPVFTGECKDCAHCKSEESNLCDLLRINVDRGVMIGDGQSRFTIGGKPIFHFVGTSTFSEYTVIHVGCLAKINPXEAPLDKVCVLSCGISTGLGATLNVAKPKKGSTVAIFGLGAVGLAAMEGXAKMAGASRIIGVDLNPAKYEQAKKFGCTDFVNPKDHTKPVQEVLVEMTNGGVXDRAVECTGHVDAMVSAFECVHDGWGXVAVLVGVPHKEAVFKTHPMNFLNERTLKGTFXFGNYKPRTDLPEVVEMYMRKELDVEKFITHSVPFSQINTAFDLMLKGEGLRCVMRMDE

SEQ ID NO: 3857 - protein, 214 aa, Mesorhizobium sp. BNC1
MVHLPERLLAGYRNFMAGRYSAESARYRSLAREGQSPETMVIACCDSRAAPETIFDSGPGELFVVRNVANLVPPYAPDEYHHGTSAALEFAVQSLKVKNIVVMGHGRCGGIGAALNPSAEPLSPGDFIGRWMSLVAPAAEAVAGNKLLTPAERQTALERISIRFQVENLRSFPCVRILEQKGKLTLHGAWFDISSGELWVMDPNTGDFARPDLG

SEQ ID NO: 3858 - protein, 590 aa, Aspergillus oryzae
MALPRARFRALSWANQFLAYKRPTWQCTTCRTLRPTPIIAPRRFATAPSGEHKKPYYVTTPIFYVNAAPHVGHLYTMIIADILKRWRTLCGETDAQLLTGTDEHGMKGYSQSKNFHGIDCTVQIQQAALAAEMDTQAFCDMNYKTFEDLAKAANMDYNYFIRTTEAAHKKSVQYFWEMLDHRGYIYTSKHEGWYSVSDETFYPPSQVHNSLDPTTGRKRMVSAETGKEVEWSSETNYHFRLSAFQERLLDLYKTGFITPSNYTTEIVKSVSSGLQDLSISRPVERLTWGIPVPGDDTQTIYVWLDALVNYLTKAGYPFPPGQEGGLGWPADVHVVGKDIVRFHCVYWPAFLMALDLPLPRNVLVHGHWTINHEKMSKSTGNVVNPFFSLDRFGVDTMRFFLAYQGGLAGDADYDNSYIIRDYKKLLQSGIGNLVLRTIGSSKGKLHSYIVSGTSGELPAANEQDLQFEQLLRETPVKVGEQMESLNPRAALQNIMVLIEQGNKYIHLSEPWKDAIKAQRVLFNVAESLRIAGILLQPFMPTKSKELLDVLRVDGTRPSKRAFSAAVFGSDAEYGEGIKKTVLFPPLIVEQ

SEQ ID NO: 3859 - protein, 177 aa, Chlorobium tepidum TLS
MPIKSRIRTVPDYPKKGIMFRDITTLIKDPVGFRLVIDNMTQHYLSNGVDFDAIVGIESRGFILGGALAYTLGKGFVPVRKPGKLPADVVQLEYELEYGTDKIEMHTDALVQGQRVLLVDDLLATGGTALAAAGLVEKLGGVVASMAFIVNLPDIGGEKKIREKGYNIYFLTEFEGD

SEQ ID NO: 3860 - protein, 190 aa, Zea mays
MSSDAGMESKILAIRDFLEDPDQSEDDIVSLLQNLADMDITYKALQDTDIGRHVNGLRKHPSSEVRQLVKLLVRKWKEIVDDWVRLHNSGGDGSGSIISDGDSPDKVQSKYHQNTHASDFKYPPSPQRHNVFSSERSSNHNLVESTTEKRRSSPAPAYNNTKQNNSNNYSSISSSAPARAIREQKTLFWI

SEQ ID NO: 3861 - protein, 202 aa, Glycine max
  misc_feature (121)..(121): Xaa can be any naturally occurring amino acid
MKKLYRKGTVHPSPSPSPPTISDHLSFLPAAILTLTLSLSSEDREVLAYLISCSSSSSSTTNFSGNHRRKPKVVADGDHPPLFNCSCFRCYMSYWVRWNSSPNHQLIHEIIDAFEDSLAHXQNLRRKDKRNKRGSKTKPSELTRSEFPSSPPESVPESSSSSAGAGEVEAGQGGDGGGDEEKGSVRRFVSFIGERIWGAWGQ

SEQ ID NO: 3862 - protein, 678 aa, Oryza sativa (japonica cultivar-group)
MASTTTKNALLLLLLLLLLFPLLHSSLADVAAAAPSSASAAEVDALMELKAALDPSGRLLPSWGARRRPGKGLAGAISPAVAMLPGLTGLYLHYNELAGAIPRQLGDLPMLAELYLGVNNLSGTIPVELGRLPALQVLQLGYNQLSGSIPTQLGQLKKLTVLALQSNQLTGAIPASLGDLPELARLDLSSNRLFGSIPSKLAAIPKLATLDLRNNTLSGSVPSGLKKLNEGFHFDNNSELCGAHFDSLKPCANGDEDDNEEGSKMARKPESTNVKPLQAPQTMNVNRDCDNGGCSRSSSSSTTLSSGAILAGTIIIIGGAAACGISVISWRRRQKQKVGGGGTVESLEGRASSSNASSSLINVEYSSGWDTSSEGSQQGLRLSPEWSPSVRYNMEEVECATQYFAGANLLGRSGFAATYRGAMRDGAAVAVKSIGKSSCKAEEADFLRGLRAITSLRHDNLVALRGFCRSRARGECFLVYEFMANGSLSRYLDVKDGDVVLDWATRVSIIKGIAKGIEYLHSSKANKAALVHQNICADKILMDHLFVPHLSGAGEHKLLADDVVFSTLKDSAAMGYLAPEYTTTGRFTDRSDVYAFGVVVFQVLTGRKAVSSELRLLGGGGGAEYSGKLDDLVDPRLGGRFSRPEAAKLAGIALLCTSESPAQRPAMAAVLQQLGATQ

SEQ ID NO: 3863 - protein, 413 aa, Arthrobacter globiformis
MQTLAIVGASLAGLSAARAARAQGFTGRLVIIGDEEHRPYDRPPLSKDFLLGSITAEDLSLETETDDLDAEWLLGTRAVSLDADSKTVSLANGQVVQADGIVIATGARARQLPALAGLSNVFSLRTLADAQSLAPELVPGSKMAVIGAGFVGAEVASSAASRGMDVTLVDTKPVPFAAQLGMEMGSVVGGLHTAKGVRLISSAVIEDFYAGEGNVTGLRLADGTFVAADVVVVGIGAEPNVEWLAGSGVQVDGGVLCDAMGRTNVPGIVAVGDCAAWFDAAVDRHRRVEHWTGALERAALAVQGLLDDDAPAQPLKPPYFWSDQHGVKIQFAGHSAGYDRLDVEAGDAAEHSLLAVYYRDDVPVAVLGMNQPRLFTKWRRSLVPSAPKPAAAVVPSVLTPAGGPALAGAAAGL

SEQ ID NO: 3864 - protein, 293 aa, Triticum aestivum
  misc_feature (111)..(111): Xaa can be any naturally occurring amino acid
  misc_feature (150)..(150): Xaa can be any naturally occurring amino acid
KPRGGGRALKWEAELASPNDDGFDRKWRWEAKSKPGGKAKTKWGTEIKGKGSLQPWSHAYTWEEDFAASDDDDDDVLEIEERKPEKKKKEDKPKKIKENDDKKKKKPARTXSQIEEIPEDNSAGCDAIRKAFAMGNGKGKAKELSPQDAXALLIQMNYRAHLAHRSQVLRCLRDLAVAKAKLKELRSLFYNLSYRRRLSHDHEERQRFSEKIIVLLLTVDALEGPDFMVRTAKKSMLEELESMLEIVDPQPPGKQRSFSRRKFDLPEGGAIPNEKTAGVNNAVRVINTGKSKQ

SEQ ID NO: 3865 - protein, 474 aa, Mycobacterium smegmatis str. MC2 155
MNAHPAGPRHAEELHHADVPDKPQSPDEIMLLAPNVWPRNLVRGADGVVTIAGVPVTDLAAKFGTPLFVIDEDDFRTRCRDIAAAFGGGQYVHYAAKAFLCSEIARWVDEEGLSLDVATGGELAVALHAGFPASRITVHGNNKSVAELTAAVQAGVGHVVLDSEIEIERLDQIAGAAGVVQDVLVRVTVGVEAHTHEFISTAHEDQKFGLSLATGAAMNAIRRVFATDNLRLVGLHSHIGSQIFDVAGFEIAAHRVIGLLRDVVAEFGVEKTSQMSIVDLGGGLGISYLPHDDPPPMKELADKLLEIVRTESAAVGLPTPKLVVEPGRAIAGPGTITLYEVGTVKDVAVSQTAHRRYVSVDGGMSDNIRTSLYAAQYDARLVSRVSDAPPALARIVGKHCESGDIVVRDTWVSDDIAPGDLIGVAATGAYCYSMSSRYNLLCRPAVVAVADGQARLVLRRETVEDLLSLEVKGQ

SEQ ID NO: 3866 - protein, 213 aa, Glycine max
SFSFQLSELKVDKQSVGGCGGIIGRKKGAVAIRINYKGIRMVFISCHLSAHARNVEERNSQCRHISHSLFSKFWNPYSRPSHITIWLGDLNYRLQGIDTYPARSLIEQNLHRRLHGKDQLLQEAGRGQIFNGFCEGTLNFKPTYKYNKGSSNYDTSHKIRVPAWTDRILFRIEDENKMEATLHSYESMDEIYGSDHKPVKAHLCLRLRQIPTN

SEQ ID NO: 3867 - protein, 124 aa, Glycine max
MAMATAVVCPQNITGAIVSSPSKTKKRVVHVRGINSFGGLKASNGVVSLGIPMSTEKCFAKVVSSVKAATSNGKGKGGALSSTCNAAGEIFTIAAIINGLVLVGVAVGFVLLRVEAWVEESEAE

SEQ ID NO: 3868 - protein, 338 aa, Xylella fastidiosa Temecula1
MSVALSIDLSKKKTILCFGEALIDMLAQPLVKKGMPRAFLQCAGGAPANVAVAVARLGGAVQFVGMLGSDMFGDFLFDSFAEAGVVTDGIVRTSTAKTALAFVALDAHGERSFSFYRPPAADLLFRVEHFQDASFSDALIFHACSNSMTDADIAEVTFEGMRRAQAAGAIVSFDLNFRPMLWPNGENPASRLWKGLSLADVVKLSSEELDYLANTLAADANAVIQQLWQGRAQLLLVTDAAGPVHWYTRTAGGEVPTFRVQVQDSNAAGDAFVGGMLYTFAQQFDDAAALIDFCHDPESIVSTLRFAAAVGALAVTRQGAFTAMPMLSEVLSLIQEQS

SEQ ID NO: 3869 - protein, 557 aa, Arabidopsis thaliana
MTTTSEISLQEEYVTDAVDHRGLDARRSNTGRWRAALFIIGVEVAERFAYYGIGSNLISYLTGPLGESTAVAAANVNAWSGIATLLPVLGAFVADAFLGRYRTIIISSLIYVLGLAFLTLSAFLIPNTTEVTSSTSSFLNVLFFFSLYLVAIGQSGHKPCVQAFGADQFDEKDSQEKSDRSSFFNWWYLSLSAGICFAILVVVYIQEEFSWAFGFGIPCVFMVISLVLFVSGRRIYRYSKRRHEEEINPFTRIGRVFFVALKNQRLSSSDLCKVELEANTSPEKQSFFNKALLVPNDSSQGENASKSSDVEDATALIRLIPVWFTTLAYAIPYAQYMTFFTKQGVTMDRTILPGVKIPPASLQVFIGISIVLFVPIYDRVFVPIARLITKEPCGITTLKRIGTGIVLSTITMVIAALVEFKRLETAKEHGLIDQPEATLPMSIWWLIPQYLLLGLADVYTLVGMQEFFYSQVPTELRSIGLALYLSALGVGSLLSSLLISLIDLATGGDAGNSWFNSNLNRAHLDYFYWLLAIVSAVGFFTFLFISKSYIYRRVDRV

SEQ ID NO: 3870 - protein, 1367 aa, Ustilago maydis 521
MAPVRRLARASSSASVSSSPANLPTPTLSGPQLQSTSNAEPRISVHQTPTAAPRVLQHPSTSPSKPHGSNSFDAPIILSDTETDNGTAGIVQHTGSSDDDMTAPHRTAGVDNGKAQRLSLLFPAITDNHQDESRSSTTLDRSYATSLNSEVNLISDGSLSSLSSIDSDSDVTDDSDNKSIAAAISSLRSTPRQTHNKTPALLSKRGTEATPEATASSSSSSSTPSRRSARIVSSGSSIQKALQRRDDLDAKLLASPLRRKPDSPEAPPPPRRAVGRPRKSVQPVPAQSSAARLSTSPAVLPSSVQNLASPSSTRRSARLSLPFPMAPNSEYPASKDASQSPRREAELGPRPELRPGKHSRKFAEASDKSKPVITLQPFSDSVTFSASVGSAISNGPVGNSPAVTSDAQSIPTLPVERSRGRPRKSQPGLPTFPQTPAALTAEREQPALVTRLRKRNLSTAGMTAKSESLAVDEQQEDSDFPPRKRGRPARSSTSATDRTAGEPLSTASGQTLHGRTPLRIDVIDLLDDDLSELSDASDMSLNSSQPHQSASQSIQSGESHRQRPPQASTLPSKKLKRASKQNKDGKIYHYTGLYAGEADAVASTSSLYPDASQSTLLPYPIHFGAKLLTEERDFCLPYPIHQTMDQLRDRVNAKRKPPRYQQINKNKYVTRAKLQGEVPLCNCKPGSGCGHDCINRMLMFICDPKTCPSASNCTNISLGRRPHVKTAVAYYGRRGFGLKTLEAIKRDDFIDEYRGEVINLSEAAKRVTEEYKATGNYYLLDYDSAAGELLDGGRKGNITRFANHSCDPNCRIEKFIICGTDEALSAEFQIGLFANRDIAAGEELTYNYGWAAFQPRDITGAPTAQVPTEQCLCGAANCSGILGGKKAPVSKSAADAVAANTRKKTGKGRGKRKSKGKVSKSTQSSRIHLTSMAPLLSASRLSAAAIPSSALSSVEAARNLRKREDAQTRRNAISKITIKRRERSGRSAGDASSSTSASVTDSSVEPVTETWTKQISVPGGKNGQQIPRSRAAKAVHATKSRQAPRDPISSFSQVIDLTGEHATPSPIEAISPKEASSTSTSVQFTGPTDADQAALGGDVLSSSASRVFPQLPLPKRINIKKPGGGFGAMAARGTKDRRWLTAEAPSSDNDDSSSIRCDSAEYPSDILKEDDEAQLQDSSGKVPGKKRRGRHKLQLSAEEMARRAVERRARNAFLARKRRASKRGIVVMDPSHHPLKKISIQCTAAPENTYIPDLPSSLVTLGMTIADARRARNAFLARVRRAIKRGFPKDAAIKMAAKPLPGDPERDTPVMKAQRAYMEQLEREAADEVTDSSQNGHGSSGSVSASNSSVAAEDDDWEDEPRWAAAL

SEQ ID NO: 3871 - protein, 656 aa, Pisum sativum
VEGIITKCSLVRPKVVKSVHFCPTTGSFTSRDYRDITSNLGLPTGSVYPTRDENGNLLVTEYGLCKYKDHQTLSMQEVPENSAPGQLPRTVDVIAEDDLVDSGKPGDRVAIVGIYKALPGKSKGSVNGVFRTVLIANNVALLNKEANAPIYSTEDLKNIKKIAERDDTFDLLGNSLAPSIHGHSWIKKAVILLMLSGVEKNLKNGTHLRGDINMMMVGDPSVAKSQLLRAIMNIAPLAISTTGRGSSGVGLTAAVTSDQETGERRLEAGAMVLADRGVVCIDEFDKMNDQDRVAIHEVMEQQTVTIAKAGIHASLNARCSVVAAANPIYGTYDRSLTPTKNIGLPDSLLSRFDLLFIVLDQMDPDIDRQISEHVLRMHRFRSAIDGGEAAHDGSARYGKKEEADTESSVFVKYNRMLHGKKTDRGRKRDTLTIKFLKKYIHYAKHRIQPDLTDEASDQIATAYAELRNANSNAKTGGTLPITARTLETIIRLSTAHAKLKLSRKVTKSDVDAALKILNFAIYHKELTEMDEREEEREKEREREQERKRKADAENNGPDRGSKSKRDSTSEAMELDDTSAAPPAVGLTPERIEAFNSLFGQHMRANPLDQISIADIEDVINRGADSTYSSADILLLLEKLQEDNRLMIVAGMVHMIS

SEQ ID NO: 3872 - protein, 192 aa, Nostoc sp. PCC 7120
MNFAEPASVIRLTSLSVIAALGLLAPVNAQNPQPIDPNSPNNLRPTAQNNSVLSIEGGERLMKEAEQAVAAQNYTLAAKKLQEARQVYNQLSNFYQDLNSSFSGIDNRVSDSQRQRALLTAQKRDEATYQLALVHRAQNQAELAVPLLVQIIRSQNPTRDLGKKAYQQLFELGFVDAPFPRQGGNPASSSQK

SEQ ID NO: 3873 - protein, 379 aa, Nicotiana tabacum
MAIDCMITNVKSPILRILEDEKKPLIFDASQMKREYNIPTQFVWPDDEKPRAVARELPVPLIDLGGFLSGDPVAAQQASRLVGEACRNHGFFLVVNHGVNANLISNAHRYMDMFFDLPLSEKQKAQRKLEEHCGYASSFTGRFSSKLPWKETLSFRYSAEEDSSHIVEEYFQNTMGESFSHLGNVYQEYCNSMSTLSLGIMELLGMSLGVGREHFKEFFEENESIMRLNYYPPCQKPDLTLGTGPHCDPTSLTILHQDSVGGLQVFVDNEWRSISPNFNAFVVNIGDTFMALSNGRYKSCLHRAVVNNKTPRKSLAFFLCPKKDKVVSPPTELVDTNNPRIYPDFTWPTLLEFTQKHYRADMNTLQTFSNWLQQKTAQV

SEQ ID NO: 3874 - protein, 446 aa, Polaromonas sp. JS666
MNKPSTSSMHSATGTALDSALAETTARYRARNPGSERLLRKAADVLPAGNTRSVLFYTPFPLYMARGEGCHLWDADGHRYLDALGEFTAGIYGHSNPVIRQAIVAALQDGLSLSSHTAREAALAHEIQRRFPGMALLRFTNSGTEANLMALAAATAHTGRRKVLVFNGAYHGGVLSFGGGGSPVNVPHDFVVAPYNDLDAVRGLVQTHGPQLAAILVEPMLGAGGCIPAEPAFLHGLRALADACGALLILDEVMTSRLSGGGRQALLGLKPDLTTLGKYFGGGLSFGAFGGRVDVMSRFDPRRADALGHAGTFNNNTLTMAAGLAGLTQVLTPAALDALNQRGERLRERLNGVFKRHAVGLQFTGLGSVMQLHATDRPLRNAADLAGADDRVKALLFFDLLERGIFLARRGLVALSLPFGDAEADEFVAALDAVVTARHALLPVAG

SEQ ID NO: 3875 - protein, 1073 aa, Escherichia coli B
MPKRTDIKSILILGAGPIVIGQACEFDYSGAQACKALREEGYRVILVNSNPATIMTDPEMADATYIEPIHWEVVRKIIEKERPDAVLPTMGGQTALNCALELERQGVLEEFGVTMIGATADAIDKAEDRRRFDVAMKKIGLETARSGIAHTMEEALAVAADVGFPCIIRPSFTMGGSGGGIAYNREEFEEICARGLDLSPTKELLIDESLIGWKEYEMEVVRDKNDNCIIVCSIENFDAMGIHTGDSITVAPAQTLTDKEYQIMRNASMAVLREIGVETGGSNVQFAVNPKNGRLIVIEMNPRVSRSSALASKATGFPIAKVAAKLAVGYTLDELMNDITGGRTPASFEPSIDYVVTKIPRFNFEKFAGANDRLTTQMKSVGEVMAIGRTQQESLQKALRGLEVGATGFDPKVSLDDPEALTKIRRELKDAGADRIWYIADAFRAGLSVDGVFNLTNIDRWFLVQIEELVRLEEKVAEVGITGLNAEFLRQLKRKGFADARLAKLAGVREAEIRKLRDQYDLHPVYKRVDTCAAEFATDTAYMYSTYEEECEANPSTDREKIMVLGGGPNRIGQGIEFDYCCVHASLALREDGYETIMVNCNPETVSTDYDTSDRLYFEPVTLEDVLEIVRIEKPKGVIVQYGGQTPLKLARALEAAGVPVIGTSPDAIDRAEDRERFQHAVDRLKLKQPANATVTAIEMAVEKAKEIGYPLVVRPSYVLGGRAMEIVYDEADLRRYFQTAVSVSNDAPVLLDHFLDDAVEVDVDAICDGEMVLIGGIMEHIEQAGVHSGDSACSLPAYTLSQEIQDVMRQQVQKLAFELQVRGLMNVQFAVKNNEVYLIEVNPRAARTVPFVSKATGVPLAKVAARVMAGKSLAEQGVTKEVIPPYYSVKEVVLPFNKFPGVDPLLGPEMRSTGEVMGVGRTFAEAFAKAQLGSNSTMKKHGRALLSVREGDKERVVDLAAKLLKQGFELDATHGTAIVLGEAGINPRLVNKVHEGRPHIQDRIKNGEYTYIINTTSGRRAIEDSRVIRRSALQYKVHYDTTLNGGFATAMALNADATEKVISVQEMHAQIK

SEQ ID NO: 3876 - protein, 307 aa, marine gamma proteobacterium HTCC2143
MPLNPTLAAVLAQMAEAGAPELHQMSPADGRAMYLAMNADNTREPVTQVRDEMANGVPVRIYHPSPEETLPCLVYFHGGGWVIGDLETHDSICRKLANSASCVVVAVDYRLAPEHIYPAPMDDCYTALNWVVTQAAELGVNAHKIAVGGDSAGGNLSTVMALRARDENGPQICHQLLVYPVTDATFDTVSYSENGEGYMLSKATMEWFWHHYIGNDNDVLSPYISPLRAENLTNLPPATIITAEFDPLRDEGEAYAARLVAAGNTVTVKRFDGVVHGFFSMSDVLEEAQEAINLAAIELTAAFTAVN

SEQ ID NO: 3877 - protein, 592 aa, Medicago sativa
MNHLPRIFGYRNKSTTEMNSKKKKQPKLQRRNAVKNFNYDAQPSSSSPESSESASSSASILCTRSMDFHDRKSFRVEGVDGEFDIICRSLGLNGPEDFSIPAAAWEAMKFRSSSDVLPRLNVSEFDETKTSGEIDQVGVVDCDDRVLVRDSPAESSGGEVNVSIRDSPAKSSGCCTGGEIRVPVRGFDETSNCSTGSGGIKGIRPPMLKPPPGVRVSVVDDTCSTWDILRDFAPEGEGKEREEQEEEEEKVDEVEEKEEVGELELKVEEEENGDIIGEFSRSCSFTTSQEDDSSSTTTDTRSNSISPNVRLKPVITPGSWQKGELLGRGSFGTVYEGISEDGFFFAVKQVSLLDQGSQGKQSVVQLEHEIALLSQFEHENIVRYIGTEMDESNLYIFIEFVTKGSLLSLYRRYKLRDSQVSAYTRQILHGLKYLHDRNIVHRDIKCANILVDANGSVKVADFGLAKAIKLNDVKSCQGTAFWMAPEVVRGKVKGYGLPADIWSLGCTVLEMLTGKIPYSPMECISAMFRIGKGELPPVPDTLSRDARDFILQCLKVNPDDRPTAAQLLDHKFVQRSFSQSSGSASPHIPRRG

SEQ ID NO: 3878 - protein, 185 aa, Gluconobacter oxydans 621H
MEDLSMKRSWQSRDWSHFIKLFRGLTFYERFEQAIILTLIALIMLVTAIATIHLIGAVWHLVVDVGIDPINQTIFQAIFGAIFTVIISLEFKHSLLVVLAQHENVIRVRTIVLIALLAIARKFILLDLHDVTAMELFALSAAVLALGAVYWLVREQDARVARDAREQAHLEDNPAARCEPERSSS

SEQ ID NO: 3879 - protein, 410 aa, Pseudomonas putida
MATHVAIIGNGVGGFTTAQALRAEGFEGRISLIGDEPHLPYDRPSLSKAVLDGSLERPPILAEADWYGEARIDMLTGPEVTALDVQTRTISLDDGTTLSADAIVIATGSRARTMALPGSQLPGVVTLRTYGDVQVLRDSWTSATRLLIVGGGLIGCEVATTARKLGLSVTILEAGDELLVRVLGRRIGAWLRGLLTELGVQVELGTGVVGFSGEGQLEQVMASDGRSFVADSALICVGAEPADQLARQAGLACDRGVIVDHCGATLAKGVFAVGDVASWPLRAGGRRSLETYMNAQRQAAAVAAAILGKNVSAPQLPVSWTEIAGHRMQMAGDIEGPGDFVSRGMPGSGAALLFRLQERRIQAVVAVDAPRDFALATRLVEARAAIEPARLADLSNSMRDLVRANEGDLT

SEQ ID NO: 3880 - protein, 560 aa, Oryza sativa (japonica cultivar-group)
MSLHCCPAAGDPPAPAGTAEELLERARSLVPAALDAARAATGFGGRWKVIAARLERVPPCLSDLSSHPCFSKNSLCRELLQSVAATLAEAAELGARCREPPRAGKLQMQSDLDALAGKLDLNLRDCALLIKTGVLSDATVPPVAPAAEAAAQTDVRELLARLQIGHAEAKHRAVDGLLDALREDEKSVLSALGRGNVAALVQLLTATAPKIREKAATVLCLLAESGSCECLLVSEGALPPLIRLVESGSLVGREKAVITLQRLSMSPDIARAIVGHSGVRPLIDICQTGDSISQSAAAGALKNLSAVPEVRQALAEEGIVRVMVNLLDCGVVLGCKEYAAECLQSLTSSNDGLRRAVVSEGGLRSLLAYLDGPLPQESAVGALRNLVSSAISPDSLVSLGVLPRLVHVLREGSVGAQQAAAAAICRVSSSSEMKRLVGEHGCMPLLVRLLEAKSNGAREVAAQAVASLMSCLANARDIKKDEKSVPNLVQLLEPSPQNTAKKYAISCLLTLSASKRCKKLMISHGAIGYLKKLSEMDVAGAKKLLEKLERGKLRNLFSRK

SEQ ID NO: 3881 - protein, 334 aa, Glycine max
MATAPLSGFFLTSLSPSQPSLQKQTLRSSPTVACLPSSSSSSSSSSSSRSVPTLIRNEPVFAAPAPIITPYWSEEMGSEAYEEAIEALKKLIIEKEELKTVAAAKVEQATAALQTGTSSDKKAFDPVENIKQGFITFKKEKYETNPALYGELAKGQSPKYMVFACSDSRVCPSHVLNFQPGEAFVVRNIANMVPPFDKVKYGGVGAAIEYAVLHLKVENIVVIGHSACGGIKGLMSFPLDGNNSTDFIEDWVKICLPAKSKVISELGDSAFEDQCGRCEREAVNVSLANLLTYPFVREGLVKGTLALKGGYYDFIKGAFELWGLEFGLSETSSV

SEQ ID NO: 3882 - protein, 102 aa, Arabidopsis thaliana
MAKRISAQLFVSRLSAYTTDQSLRQLFSPFGQIKEARLIRDSETQRPKGFGFITFDSEDDARKALKSLDGKIVDGRLIFVEVAKNAEEVRAGINSNKAEDRG

SEQ ID NO: 3883 - protein, 174 aa, Oryza sativa (indica cultivar-group)
MARFVDPLVVGRVIGEVVDLFVPSISMTAAYGDRDISNGCLVRPSAADYPPLVRISGRRNDLYTLIMTDPDAPSPSDPSMREFLHWIVVNIPGGTDASKGEEMVEYMGPRPTVGIHRYVLVLFEQKARFVDGALMPPADRPNFNTRAFAAYHQLGLPTAVVYFNSQREPANRRR

SEQ ID NO: 3884 - protein, 308 aa, Photorhabdus luminescens subsp. laumondii TTO1
MTKQSDYIWFNGEMVPWADAKVHVMSHALHYGTSVFEGIRCYDSHKGPVVFRHREHMQRLHDSAKIYRMPLNQSVDELMEACRATLRKNNLVSAYIRPLVFIGDVGMGVNPPAGYKTDVIIAAFPWGAYLGEGALDQGIDAMVSSWNRAAPNTMPTAAKAGGNYLSSLLVGSEARRRGYQEGIALDVSGYISEGAGENLFEVKDGILFTPPFTSAALPGITRDAIIKLAKDLGLEVREQVLSRESLYLADEVFMSGTAAEITPVRSVDDIQVGIGRCGPITKKIQQAFFGLFDGTTDDKWGWLDPVNP

SEQ ID NO: 3885 - protein, 287 aa, Zea mays
  misc_feature (61)..(61): Xaa can be any naturally occurring amino acid
ATGPQGCPGLAAHFRAGGCPLAAGRVASCTDLIVQRVEFVLDSDKRSYLMDLIHAPNAKIXLHAQKANGTHGKHALTLVFVETKRGADALEDWLFRNGFPATSIHGDRTQQEREHALRSFKSGATPILVATDVAARGLDIPHVAHVINFDLPNDIDDYVHRIGRTGRAGKSGLATAFFNESNTTLARPLSDLMKEANQEVPKWLEGYAARSAYGGGGGRNRRQGSSARFGGRDFRRDRGSGGGYGGGSYGGGGGGGYGGSSGYGGAYGGGGSGGGGYGGGQSTSSWD

SEQ ID NO: 3886 - protein, 204 aa, Pseudomonas aeruginosa PAO1
MTSQPLRVGIGGPVGSGKTALTLALCRELRERYNLAVVTNDIYTQEDAEFLVRNEALAPERIIGVETGGCPHTAIREDASINLEAVDQLNRRFPGLELILVESGGDNLSATFSPELSDLTLYVIDVSAGDKIPRKGGPGICKSDLLVINKIDLAPLVGASLDVMDRDARRMRGDKPFVFSNQKTGQGLDEIIAFIERQGLLTAA

SEQ ID NO: 3887 - protein, 529 aa, Mycobacterium sp. MCS
MTTTSATTMASDAASPAAQVLPTADELRGRVRTAFESIGATAYLGAPGGGGLPASTPITGEVLFTVEESSPAQTEAAIEAAADAFGQWRTTPPPVRGALVARLGELLVEHKAALASLVTVEAGKITSEALGEVQEMIDICQFAVGLSRQLYGRTIASERPGHRLMETWHPLGVVGVITAFNFPVAVWSWNTAVALVCGDTVVWKPSELTPLTAIACQALLQRAAADVGAPSAVGQLVLGGRDVGETLVDDPRVALLSATGSVRMGQQVGPRVAQRFGRALLELGGNNAAIVTPSADLDLAVRAIVFSAAGTAGQRCTTLRRLIVHRSVADDLVERIVAAYRQLPVGDPAADGTLIGPLIHETAYRDMVAALETARADGGEVTGGERRIFEGDSGDMSFYVTPAVVRMPSQTAVVHAETFAPILYVLTYDDLDEAIALNNAVPQGLSSAIFTLDVREAERFMAADGSDCGIANVNIGTSGAEIGGAFGGEKQTGGGRESGSDAWKAYMRRATNTVNYSAELPLAQGVHFG

SEQ ID NO: 3888 - protein, 272 aa, Photorhabdus luminescens subsp. laumondii TTO1
MDQFAVFGNPVAHSKSPRIHQLFARQTGIEHRYGKILVPISKFQEALDTFLKQGGIGVNITVPFKEQAFIRANELTERARLSGAVNTLKLLNNNQLLGDNTDGIGLLTDLMRLEFITQGQHILIIGAGGAARGVLFPLLEFGCKITITNRTFSRAIQVANNFSAIGSIRPAEMKVLNSPEFDLIINATASGINGEIPTISPFIFNENCVCYDMFYQANLTPFISFARKHGVSRYADGLGMLVGQAAHSFKLWHGVLPEISPVLLTLEQELRS

SEQ ID NO: 3889 - protein, 285 aa, Mycobacterium sp. MCS
MVDSAPTPDGVIPYPGETSEMSERPRDEMSDYVGRDLLAGKRALITGGDSGIGRAVAVAFAKEGADVSIAYLDEHADAEHTAALVEQCGRRSLLLPGDLAEAEQCRTVVERTVVEFGGLDIVVNNVAYQNPTESFTDISDEQWRRTFAVNIDSFFRVTKAALEHLPDGGAIINTSSINGLRGNKTLIDYSATKGAVLALTYSLAQSLADRKIRVNCVAPGPVWTPLIPATMDAEKTESFGEQTPMGRAAQPDEIAPSYVFFAAGRMSSYYSGEVLAPIGGETLPG

SEQ ID NO: 3890 - protein, 167 aa, Arabidopsis thaliana
  misc_feature (115)..(115): Xaa can be any naturally occurring amino acid
  misc_feature (134)..(134): Xaa can be any naturally occurring amino acid
  misc_feature (141)..(141): Xaa can be any naturally occurring amino acid
  misc_feature (151)..(151): Xaa can be any naturally occurring amino acid
  misc_feature (160)..(160): Xaa can be any naturally occurring amino acid
MASSMLSSATMVASPAQATMVAPFNGLKSSAAFPATRKANNDITSITSNGGRVNCMQVWPPIGKKKFETLSYLPDLTDSELAKEVDYLIRNKWIPCVEFELEHGICVPVSTGNSXPGYYDGRYWTMWKLPLFGXRIRLSVXREVEESRRGXPNAFIRSSXLQNRQGQ

SEQ ID NO: 3891 - protein, 299 aa, Oryza sativa (japonica cultivar-group)
MDAVAGASVSSSSARLRPCPRPRRIGNVAPATVRRRSRRRAVTCAAAADADVVGLFDAAKLTVDRFVESGMVVGLGSGPASGLAIQYLGTRLRRGSLTGILGIPSSTISASEAVKAGIQVSSYEEGTQIDFAFTDADIIEEDTMTAVIGRRKTESGEPSFMVEKGIVKSADKLAFIIGHEKYVKGIEGSIPVLVKSANWIDTAEEIDDLFLGDAEVWRRPSIGTAGPLGGDFPLVTKEGHHVLDVIFTTPIPDLGKVAESLEKIAGVVDHGIVSSIPSYVVVALNGEVQVLDEKSSVIP

SEQ ID NO: 3892 - protein, 370 aa, Mesorhizobium sp. BNC1
MLHAREPSILKKPVGDDSLSISDITSEAARLPSFDGHENIWCGRDEDRGLTAIVAIHNTKLGPALGGTRLWPHESFEAALTDALRLSRGMTYKSAVAGLPLGGGKAVIIADPKTGKTPALLTAYAEMLVRLEGQFITAEDVGMTLEDADFLREHAPNVVGTSAGGSGNPSPFTAEGVFLGIKAALKHRNGTERLSGIRVAVQGLGSVGWSLCEKLYREGAALIVTDLDPGQVEKAKRAFEAETVAPGEIVTVSADVFAPCALGGAITARNVPHIKFGIIAGSANNQLAKHEDARLLMERGILYAPDYVINAGGLINVAAELSPEGYDPEAVMAKLAKIPLTLTEIFQRAEQQKRPTNDIAAEMAMERIRR

SEQ ID NO: 3893 - protein, 262 aa, Arabidopsis thaliana
MDKRWSLQGMNALVTGGTKGIGEAVVEELSILGARVHTCARDETQLQERLREWQEKGFQVTTSICDVSLREQREKLMETVSSLFQGKLNILVNNVGTLMLKPTTEYTAEEFSFLMATNLDSAFHISQLAHPLLKASGSGSIVLMSSIAGVVHVGVGSIYGATKGAMNQLARNLACEWASDNIRTNAICPWLITTPLISDLLSVEEMKKEAEERTPMGRVGEANEVSPLVAFLCLPAASYITGQVICVDGGLTVNGFSYQPHA

SEQ ID NO: 3894 - protein, 359 aa, Ustilago maydis 521
MSCKTYKIAVIPGDGIGQEVMPCGLQALRAASARFKFDLSITAFDFASCDYYDKHGKMMPDNWIELLTPFDAIYFGAVGDPARHPDHVTLWGSLLQMRRHFDQYVNLRPCRLVKGVPSPLASPGEIDFWIVRENTEGEYSEVGGKIFEGTERETVIQETIMTRVGVDRILEYAFKLAKTTKRKRLTSATKSNGIKITMPYWDDRFKLMSTAYPEVATEQFHIDILTAHFVAKPSHFDVVVGSNLHGDILSDLGPAVTGTIGIAPSGNINPEGKFPSLFEPVHGSAPDIMGRGIANPVGMIWAGQMMLLHLGEKEAAETMIKAIDFVLGQSDQSMLTPDMKGRGTTKKLGDAIAEAIASV

SEQ ID NO: 3895 - protein, 342 aa, marine gamma proteobacterium HTCC2143
MTIRVAINGYGRIGRNILRALYESDYRQSIRLVAINDLGDTAFNAHLTQYDSVHGRFPGSVAVQDDKLIINGDEIITVSERDPSQLPWAELAIDVVYECTGFFTSRDKAYGHIEAGAKKVIISAPAADVDATVVYGVNENILTPDCQIISNASCTTNCLAPVAKVLNDGVGIELGSMTTIHAFTNDQSLHDVYHSDIYRARAAGQSMIPTKTGAAQAVGLVLPELAGKLDGMAVRVPTANVSLVDFTFLASRDTTVEEINQLIDTAAATMMPGVLEYNEQPLVSIDFNHQPASSTFDATQTRVNGRMVKVMAWYDNEWGFSNRMLDNTLALMSAQHNTSKAA

SEQ ID NO: 3896 - protein, 321 aa, marine gamma proteobacterium HTCC2143
MNKPVHIVADIGGTNARFAYVQADSNELLGIEIFPCAEFPFLRDAIRAYMERGHVDLIDEICLAVAGPVESDWIDLPNNHWAFSRAELQQSLDASVSIINDFSAQVLSIDTLSGADLKWIGTPRPADIQQHVVAVLGPGTGLGVSAMLSTGEILPSEAGHVAFAPTDEHECDLLKVLWQRYQRVSVERILSGMGLANLYWANCRLAGFERELTAADISAGAHAGDKYCLRAVNDFCAILGSVAGEVALMMGATDGVYVSGGIIPRLIDLLDEDLFRRRFDEKGRFREICAEIPLAIMLAKHPGLQGCVKAINVNKYRNMRS

SEQ ID NO: 3897 - protein, 340 aa, Gluconobacter oxydans 621H
MTKTIPATLIAGDGIGPEIMQSVTTVMDALGAPFLWDHQSAGVGAFDQHGTALPEATLDSIRRTGLVLKGPLTTPVGKGFRSINVTLRQAFDLYANVRPTQTIVPGGRYENVDLVVIRENIEGLYAAMEYYMAVDGDPEAVAYGAGFNTRTECNRIVRFAFEYAVKNNRKKVTLVHKANILKILSGLFLHEGRKVAAEYEGRVALEERIVDACAMELVIRPENYDVIVTTNLFGDILSDLTAGLVGGLGMAPGANIGEKMGIFEAVHGSAPDIAGQGIANPLALMMAGSMMLAHVGRQDLSQRLDGAMKQILQVEGLRTRDLGGKATTQDVTQALLRAIQ

SEQ ID NO: 3898 - protein, 417 aa, Oryza sativa (japonica cultivar-group)
MQRNGVVECSVCRSRLVVPSPRSVSRAYDKHRSKISSKFRALNVLLVVGDCILVGLQPILVFMSKVDGKFQFSPISVNFLTEVTKVVFAIVMLIIQSRKQKVGEKPLLARSTFIQAARNNALLAVPALLYAINNYLKFIMQLYFNPSTVKMLSNLKVLVIAVLLKFIMKRRFSVIQNCHVLSFNVDDHNLQSGLLVTHYVTEWEALALLLIGISINQLRTVPAGNTAFGLPVTAIAYIYTLIFVTVPSLASVYNEYALKSQYDTSIYLQNLFLYGYGAIFNFLGILGTALFQGPESFNILRGHSRATMFLICNNAAQGILSSFFFKYADTILKKYSSTVATIFTGLASAAFLGHTLTINFLLGISVVFISMHQFFSPLAKAKDDKPAELLELEDTQNHRSSESSFVNMTAGAAEDVV

SEQ ID NO: 3899 - protein, 487 aa, Aspergillus oryzae
MSEGSNSTSAAASTQRQVRVQLTSKQEDIALPENTGPILVPTGLRRYALSTLVNNLLGNDKPIPFEFLINGSFLRTSIDEYLTANGISAETTLEIEYVRALIPPLHIASFEHDDWVSSVDVLSTTSPAASLASATIAAGQERILSGSYDGLLRVWNMSSQIVATSPSAADGGHTASIKAAKFISPNSIVSAGLDRTVRVWKYSEDGDGFSGKIAPQLELYGHKGPINSLSVHAPSNRILSASSDHSIGFWSTKKSDAPAAPEDLLPSAALRSSKRRKLNSSVTIPQRGPLALLSSHSAPVSAAIFDSNDSTVGYSASWDHSLRTWDLVTATLVDTRTTSHSLLSLEHLPEHHLLAAGTSARHITLIDPRVSATTIAAMTLRGHTNAVVSLARDPKSSYGLISGSHDGTCRIWDIRATKTDKDGVVGESVYSISRKSLEEQGKSEAKRIGGEGVKVFGVAWDGTVGIVSAGEDKRIQINRGEGVLSSA

SEQ ID NO: 3900 - protein, 839 aa, Ustilago maydis 521
MSSAGPSTDHGDKAFSNVITSTCTPGPSPVSTPGAMSALPVPMSGGPHHHTPAMPSNSMSIAGTSQEQNTPGSFGPSSMNASSDMGSVMTEDEEDLEDYGKGGYHPVHVGDTFSEGRYLIVRKLGWGHFSTVWLAKDNKMKRHVALKVVKSAPHYTETALDEIKLLQRLVSANPNHPGRRHCVSLLDHFRHKGPNGSHVCMVFEVLGENLLGLIKRYQHRGVPPHIVKQIAKQVLLGLDYMHQECGIIHTDLKPENVLICIEDVEAVVEAELRSNPAAVPTKLVGVPPSQGRGGTQTPRRDGIFITGSQPLPSPSSSLGSSPMFDKWAFGMSKIDKPSVSDSENGFRSGPGSEAAGSKGGSLATSKEREKSTEAIGHGISQLSTQGSSSLPADSFGSRMSKGAPQQKGPSLLSLGAPRVPQQASESTATAPKAEPSDSPSPMSMDSPSPPNHQEPTPMDQEMHQPAVSAGDPNTLPPPPPYDPSSLERITVKIADLGNACWVDHHFTNDIQTRQYRCPEVILGAKWGPSADMWSASCMFFELLTGDYLFDPAAGTKYNKDDDHVAQIIELLGDFPKSLAFAGKYSADIFNRRGELRHIHKLRFWPLISVLQEKYLMPYNDANELSSFLLPMLRLHPEKRAGARELLDHTWIDGIVVQGEIEQAMRQAGIDVEALTASSPSGRTLPPGLTPSEADALKPVGSVSSSPATMSLNMQGLEDAKRRAAQHQAELAAATAGGVNGTAASNQSSAASSALPTPSHSGSRDPVHALQAESLERSVSSDGAGESHMTVKGAGDDSGIRQVSTPKLSAQQQTPQGNSANRPGSPSPQGLPRPVATTVQ

SEQ ID NO: 3901 - protein, 555 aa, Oryza sativa (indica cultivar-group)
MAMAMAMRRAAALGARHILAASSTSSSGVLLRRHMSVDAGAAMEKVRAAGLLRTQGLIGGKWVDAYDGKTIEVVNMQFALGNPCEQFVELIYFLQDALYLVQNPATGETLANVSCMGSKETSDAIASAHSTFYSWSKLTANERSKALRKWHDLIISHKEELALLMTLEQGKPMKEALVEVTYGASFIEYFAEEAKRIYGDIIPPTLSDRRLLVLKQPVGVVGAVTPWNFPLAMITRKVGPALACGCTVVVKPSEFTPLTALAAADLALQAGIPAGAINVVMGNAPEIGDALLQSTQVRKITFTGSTAVGKKLMAGSANTVKKVSLELGGNAPCIVFDDADIDVAIKGSLAAKFRNSGQTCVCANRILVQEGIYEKFASAFIKAVQSLKVGNGLEESTSQGPLINEAAVQKVEKFINDATSKGANIMLGGKRHSLGMSFYEPTVVGNVSNDMLLFREEVFGPVAPLVPFKTEEDAIRMANDTNAGLAAYIFTKSIPRSWRVSEALEYGLVGVNEGIVSTEVAPFGGVKQSGLGREGSKYGMDEYLELKYICMGNLN

SEQ ID NO: 3902 - protein, 478 aa, Mycobacterium smegmatis str. MC2 155
MAEKTSDDIFKLIKDENVEYVDIRFCDLPGVVQHFSIPASAFDESVFEDGLAFDGSSVRGFQSIHESDMMLLPDPNTARIDPFRAAKTLNMNFFVHDPFTREAYSRDPRNVARKAENYLASTGIADTAFFGAEAEFYIFDSVSFDSKINGTFYEVDSESGWWNTGEPFESDGSANRGYKVRPKGGYFPVAPYDHYVDLRDQMATNLQNAGFTLERGHHEVGTAGQAEINYKFNTLLAAADDVLLFKYIIKNTAWQAGKTVTFMPKPLFGDNGSGMHAHQSLWKDGQPLFHDESGYAGLSDIARHYIGGILHHAPSLLAFTNPTVNSYKRLVPGYEAPINLVYSQRNRSACVRIPITGNNPKAKRLEFRCPDSSGNPYLAFAAMLMAGIDGIKKKIEPLQPVDKDLYELPPDEAAAIPQAPTSLSAVIDKLEEDHEYLTEGGVFTEDLIETWISYKRENEIMPIQIRPHPYEFSLYYDV

SEQ ID NO: 3903 - protein, 270 aa, Brassica napus
MITPSVVVREVWADNLESEFELISGIVEDYPFISMDTEFPGVIYKADLRRLNPGYLYKLLKSNVDALSLIQVGLTLSDADGNLPDLGGGGGGSRFIWELNFRDFDVDRDPHAPDSIELLRRHGIDFERNRREGVESGRFAELMVSSGLICNESVSWVTFHSAYDFGYLVKILTRRELPGSLGEFLRLLRAFFGERVYDVKHMMRFCERRLFGGLDRVARSLEVNREVGKCHQAGSDSLLTWQAFRRMRDLYFVEDGPEKHAGVLYGLEVF

SEQ ID NO: 3904 - protein, 477 aa, Yersinia pestis KIM
MTNPGDISMSAEHVLTMLNEHEVKFVDLRFTDTKGKEQHITIPAHQVNADFFEEGKMFDGSSIGGWKGINESDMVLMPDASTAVMDPFFADSTLIIRCDILEPGTMQGYDRDPRSISKRAEDFLKSSGIADTVLFGPEPEFFLFDDIRFGSSINGSHVSIDDVEGAWNSSTKYEGGNKGHRPAVKGGYFPVPPVDSAQDLRSAMCLTMEEMGLVVEAHHHEVATAGQNEVATRFNTMTKKADEIQIYKYVVHNVAHAFGKTATFMPKPMFGDNGSGMHCHMSLSKNGNNLFAGDKYGGLSEIALFYIGGIIKHAKAINALANPTTNSYKRLVPGYEAPVMLAYSARNRSASIRIPVVASPKARRIEARFPDPAANPYLCFAALLMAGLDGIINKIHPGDAMDKNLYDLPPEEEAEIPKVAGSLDEAMAALNEDREFLTRGGVFTDDAIDAYIELRREEMDRVRMTPHPVEFELYYSV

SEQ ID NO: 3905 - protein, 610 aa, Arabidopsis thaliana
EFHSRFSNGLYHLDDKISSSNGVRSASIDLITRMDDSSPKPILRFGVQNFSSTGPISQTVLAMPALSPTMSHGNVVKWMKKEGDKVEVGDVLCEIETDKATVEFESQEEGFLAKILVTEGSKDIPVNEPIAIMVEEEDDIKNVPATIEGGRDGKEETSAHQVMKPDESTQQKSSIQPDASDLPPHVVLEMPALSPTMNQGNIAKWWKKEGDKIEVGDVIGEIETDKATLEFESLEEGYLAKILIPEGSKDVAVGKPIALIVEDAESIEAIKSSSAGSSEVDTVKEVPDSVVDKPTERKAGFTKISPAAKLLILEHGLEASSIEASGPYGTLLKSDVVAAIASGKASKSSASTKKKQPSKETPSKSSSTSKPSVTQSDNNYEDFPNSQIRKIIAKRLLESKQKIPHLYLQSDVVLDPLLAFRKELQENHGVKVSVNDIVIKAVAVALRNVRQANAFWDAEKGDIVMCDSVDISIAVATEKGLMTPIIKNADQKSISAISLEVKELAQKARSGKLAPHEFQGGTFSISNLGMYPVDNFCAIINPPQAGILAVGRGNKEVEPVIGLDGIEKPCVVTKMNVTLSADHRIFDGQVGASFMSELRSNFEDVRRLLL

SEQ ID NO: 3906 - protein, 271 aa, Arabidopsis thaliana
MAKTGESLRDKPRWSLVGMTALVTGGSKGIGEAVVEELATLGARIHTCARDETQLQESLRKWQAKGFQVTTSVCDVSSRDKREKLMETVSTIFEGKLNILVNNVGTCIVKPTLQHTAEDFSFTMATNLESAFHLSQLAHPLLKASGSGSIVLISSVSGVVHVNGASIYGVSKGAMNQLGRNLACEWASDNIRTNSVCPWFIETPLVTESLSNEEFRKEVESRPPMGRVGEVNEVSSLVAFLCLPAASYITGQTICVDGGFTVNGFSFKPLP

SEQ ID NO: 3907 - protein, 107 aa, Zea mays
  misc_feature (12)..(12): Xaa can be any naturally occurring amino acid
  misc_feature (47)..(47): Xaa can be any naturally occurring amino acid
SITGAERGGGNXFAQGNLPDANKGSISLAASRAKLCQLCEQYSYEAXLLYLTQTETETEMVSILEDECVSLVRLKQQGITLIDYYVPIFFSEECMGTPEKVCESMHM

SEQ ID NO: 3908 - protein, 483 aa, Ustilago maydis 521
MAPVAVTESTPIAPTAAKLNGAATHNGDMNGTITNTTGPSLFGSNTSAVLHGAKDLRIEERPYAAPIGDEVQIRVRATGLCGSDLHYYLHGRNGDFALQHSMCLGHESAGEIVAVGPNVPASLGLAVGDRVAIEAGRFCGSCLKCRDGRYNLCKQMRFASSAKTHPHLDGTLQKYMNWPSWLVHKLPANVSLTSAALCEPLSVVLQGIRRSQLQPGQSVLVYGAGAVGLLACAAAKASGASFVAAVDIDQGRLAFAAANGWADATYLLPRAAPAAVDGEQTNVGARRAAEDKAAISSASASAASLLKALSSSDPSSSQQTSYAIQPAPLDLSSEGFDVVFECTGVPTCVQTGIFATKAGGKVVLIGMGNPIQTLPVGSASLREVDIVGVFRYANTYPVALGLLAGGTLRAQGGGLHAQAVGLPTNLDTNEGHGPGRKMGGIENLVSHTFPLKHAIKAFETLANGKDPEHGRGVVKVFITDDDA

SEQ ID NO: 3909 - protein, 981 aa, Aspergillus oryzae
MSKAVVKTTFEASRTLRPIYTGGSTALDASGRLLVACVGEDALIIDLETGDQLASLEGDGEIITSLAITPSASHVVVCSRSMSMRIYSLTPFEDSSRTLDAKLVRSLKPHTAPVVTTAIDQTSTLLATGASDGSIKVWDIRGGYVTHTFHGHAGVISALCFFQVSFQDSESKSSSKKGKSKRKSDDSDEDEDMEDVAPVASIGGFRLASGSEEGKVRVWDLNKRKSIASLDSHVSVVRSLSYSPAENALLSAGRDKTVIVWDVRTFKTRRIIPVLESVEAATFVADSGLALVGGENGVLRVWDCNRGGEVTQEQEAAAEFEAIVAIQYTPGMPFAMTVHADQTLRLHSLDSLSDFKPGSSLDPLPIIRRISGNDDDIIDLAYVGPDRSMLALATNTESVRLISVGRSVDRPSNKEEDYFGADIAHLEGHDDIVICIDVDWSGHWLATGAKDNTARLWRLDPKTSSYTCFAAMTGHAESLGAISFPRVPPPANTPARNDPLNHPPQFLLTGSQDRTIKRWDTGKLAPLSSSKPHNPKAAFTRKAHDKDINALDVNPTSTLFASASQDRTVKIWSVEEGSVVGILRGHKRGVWSARFSPNGTPTISSSAQGSTNRGLIVTGSGDKTVKLWSLSDYSCLLTFEGHTNSVLKVLWLPPSDLSTKKDDDEVDDDEATPAQKNATQARPLVASAAADGLVKIWSPYTGELETTLDNHTDRVWALASPTPSGSRADVLSSNTHNISSPYAIASGSADSTVTFWTDTTSATYTATVSANAARIEQDQKLENYIRAGAYREAITLALQLNHPGRLLSLFTAAVDAAVDPSSTDAERSERANSLTGNPSIDEVLQTLDSNNLRTLLLRLRDWNTNARNSRVAQRILFALFRSYPASTFIELATASMANRRSDSRTAAGMKDILQALSAYTERHYRRIEELTDESYLVEWVLGEMDGGVGLGGLGISGTRDVIDSATDDVPEHEKDTIMLGA

SEQ ID NO: 3910 - protein, 1073 aa, Neorickettsia sennetsu str. Miyayama
MQEKKSTILVIGAGPIVIGQACEFDYSGTQACRILRKCGYKVVLINPNPATIMTDPDTADVVYIEPINIGIIERIIAIERPDKLLPTVGGQTALNIAIELFDRGILSRYGVELIGASKRVIENAEKRSVFNRLMGEIGLQVPKNTMVTHVNEIEKAFEFIGVPAIIRPSFTLGGLGGGVATTKFDFFTIINNGLKFSPVSEVQVDESVLGWQEFELEVVRDSVGNSIIVCSIENTDPMGVHTGDSVTVSPILTLRDEEYQEMRDAAFKVLDCIGVTTGGANVQFALNPENGELRVIEMNPRVSRSSALASKATGYPIAKVAAQLAAGLTLPEIYNDAVPTIPASFEPAMDYVVVKIPRFNFEKFFHAEERLSSSMKSVGTTMAIGRCFQEALQKAFSSLEQGLDGLNTVLDLNVSRKVIERKLRSLIPNKILVIADAIRAGFQIKEIVYLSKYNEWFLLQIDELVNLENEIKSGNFSPNRLLIWKKKGFSDSRIASLKGCDEAFVRSTRKKMAIRPVFKRVDTCAAEFESDIKYLYSTYEGDTVTQPECEAYPSDRKKVIVLGSGPNRIGQGIEFDYTCVHAISAIKELGYEAIMVNCNPETVSTDYDISDKLYFSPMNVESVLDIVEKESERGELLGVVLQCGGQTPLKLARAMHENNVRIIGTGFASINTAEDRKSFNSLVAELEMLQPENAIVLAREEIAKNVKKIGFPLIVRPSYVLGGESMQIIYDDAMLEDYLERHTQLFSGSSLLLDKFLVNALELDVDAISDGEDVYIAGIMEHIEEAGVHSGDSAFVFPPQKLSEEILERIKSCTKKVAIALNVVGFLNIQFAIDGRDVYVLEVNPRSSRTIPFVAKALGIPVARIATKVMLGMKLRDFQLKGYEDYVKHVFVKQPVFSFEKFPESDVLLGPEMKSTGEVMGVGDDFDTAFAKVCMASMRKLPTSGKVFFSIRDEDKLKSVEVAKILSELQFTILATKGSAAFLEKHNIDAVTVNKVKEGSPHVVDMIMNSEISLVINTSSHVLESVRDSMSIRSSSIINQIPCCTNIHSALALVRGIKKIVKCKLPVYQLSYV

SEQ ID NO: 3911 - protein, 726 aa, Xanthomonas oryzae pv. oryzae KACC10331
MEVDGQGISSYPHPWLMPEFWQTPTVSMGLGPLAAIYQAQFMRYLENRGLIEKSDRKVWCFIGDGESDEPETLGAIALAGREGLDNLIFVVNCNLQRLDGPVRGNGKIIQELEGVFRGGGWNVIKLLWGGYWDALLAKDSNGVLRKLMMETVDGQYQNCKAFGGAYTRENFFGRYPETAAMVAGLSDDDIWRLNRGGHDPHKVYAAYHQAVNTTGMPTVILAKTVKGYGMGSAGEALNPTHQTKKLDDAAVKHFRDRFNIPVTDAQLEDGKVPFYHPGDDSPEVQYLKERRNVLGGFLPSRRPKASKSFAAPTLDKFERLLKDSGERSYSTTMSFVQSLNIALRDKELGPRIVPIVADEARTFGMEGMFRQIGIYAPFGQKYKPVDADQLMYYREDQTGQVLQQGISEPGAIASWMAAGTSYSVSDVPMLPFYIYYSMFGFQRVGDIAWQAADMRTRGFLLGGTAGRTTLNGEGLQHEDGFSQLVAGGIPNVRSYDPTFGFEVTVIMQHGMKAMMEDQIDEYYYITLMNENYAHPGMPDGAAEGIIKGMYLLKDAGKPKKGELRVQLLGSGTILREAIAAAELLDKDFGVTADIWSCPSLNEVRRDGYAVERWNRLHPEAEQRKPYVTQLLEGRQGPAIAATDYVRAFADQIRAFVPMTYTVLGTDGFGRSDTRANLRRFFEVDRYYIAHAAIAALAKDGKMTGKDVARAIKQYKIDPEKANPVGV

SEQ ID NO: 3912 - protein, 218 aa, Oryza sativa (indica cultivar-group)
MSFLEQATERKAPPPARLGSITKLTAASSSFANLFSTFLGPVSSPEPRPRRSFDGGATGVGLGIVAAMSHACLTTEAEPIAIGAAARRRTREEAELSESYTCVITHVAGVDGASGSVRKRVYFGFGDGGGGWLVEADEEPAPAADFLSRCFLCDKRLDGLDIYMYRGEKAFCSSECRCHQMLMDDHADNCGSEALKANDYSASPHSAPLPFSLSVAAA

SEQ ID NO: 3913 - protein, 285 aa, Solibacter usitatus Ellin6076
MPANFKAELVACFGQPVAENPTGAMQEAAFRAMGLNWRYLTVEVSPENLADAIRGARAFGMRGLNLTIPHKVAVIPLLDEIAPDAAVIGAVNTVRFDGRRLIGENTDGKGFLRGVRVDAGLDPRGKRAIVLGAGGAARAIVTELALAGVDDLLVVNRSAERAWRMTEEIAIRTKHHIRCQPWRGTYRVPADTDILVNATSIGLYPDVDAMPPVDLREAQPGLLVCDAVFNPPETRLLAAARELGLPTLDGLSMLVYQGVIGCRLWTGQDPPEDVMKHALRQALGL

SEQ ID NO: 3914 - protein, 549 aa, Escherichia coli O157:H7 EDL933
MKNINPTQTAAWQALQKHFDEMKDVTIADLFAKDGDRFSKFSATFDDQMLVDYSKNRITEETLAKLQDLAKECDLAGAIKSMFSGEKINRTENRAVLHVALRNRSNTPILVDGKDVMPEVNAVLEKMKTFSEAIISGEWKGYTGKAITDVVNIGIGGSDLGPYMVTEALRPYKNHLNMHFVSNVDGTHIAEVLKKVNPETTLFLVASKTFTTQETMTNAHSARDWFLKAAGDEKHVAKHFAALSTNAKAVGEFGIDTANMFEFWDWVGGRYSLWSAIGLSIVLSIGFDNFVELLSGAHAMDKHFSTTPAEKNLPVLLALIGIWYNNFFGAETEAILPYDQYMHRFAAYFQQGNMESNGKYVDRNGNVVDYQTGPIIWGEPGTNGQHAFYQLIHQGTKMVPCDFIAPAITHNPLSDHHQKLLSNFFAQTEALAFGKSREVVEQEYRDQGKDPATLDYVVPFKVFEGNRPTNSILLREITPFSLGALIALYEHKIFTQGVILNIFTFDQWGVELGKQLANRILPELKDDKEISSHDSSTNGLINRYKAWRG

SEQ ID NO: 3915 - protein, 322 aa, Mycoplasma hyopneumoniae 232
MKILGIETSHDDASVALFSENKVEILLTISQFELHEQFGGTVPELASREHSRNLAIILEKLLGKNIDFSTIDAIAYTKNPGLIGPLKIGFLFASALSLFFNKPLIPIDHLLGHFWSAAIENDLEFPVLSLLISGGHTQLIFAENKNNLEIIGSTVDDALGEIYDKIGRSLGCGYPGGPKIDLIWQQNNVRNMELIDFSLPKVLENPLDFSFSGLKTQVINYTNNLKENYLFSQKKVVEIAVSFQKTVIKYLKRQLDLALKTKKNVKTITLVGGVAANSEIRKLIKTYENKYKVVIPKKEFCTDNGAMIAKAAQIFLKFNEEK

SEQ ID NO: 3916 - protein, 214 aa, Zea mays
  misc_feature (173)..(173): Xaa can be any naturally occurring amino acid
  misc_feature (184)..(184): Xaa can be any naturally occurring amino acid
  misc_feature (196)..(196): Xaa can be any naturally occurring amino acid
MAEQEPTAEQLAQIAAENEEDEHSVNYKPPAQKSIQEIQELDKDDESLRKYKEALLGRVAVSADPNVPNVIVTRLTLVCSTAPGPLELDLTGDLESFKKQSFVLKEGVEYRIKISFRVNREIVSGMKYIQHTYRKGVKIDKTDYMVGSYGPRAEEYEFLTPMEEAPKGMLARXSYNIKSRFTDXRQTDHLSWEWNXTIKREWRTELSWETAGRR

SEQ ID NO: 3917 - protein, 521 aa, Solibacter usitatus Ellin6076
MATTTQSTVRPFTNEPMSDYRKPENAAAMKAAIEKVRKELGREYDLVIGGKRIRTTEKIVSINPAKPSEVVGIHQKAGKEHVEPAMQAALAAFEKWQYATVEERTGVLFRTAEILRQRKFEFNAWLVLEVGKNYDEAEADTCEAIDFLELYTRQALVLDAAEPVVQLPGERDFLRYIALGVGAVISPWNFPNAIALGMAGASLVCGNTVILKPSSDSPTIAAKFFEALEEAGMPPGVVNFCPGSGASFGNGLVEHPKMRYIAFTGSRDVGLEIHTRAAQTQKGQVWIKRTVLEMGGKDTIVVDADANLDAAVEGVTAAAFGFQGQKCSACSRAVVHEAVYDRFLEKLKGSVEKLQIGLPEDNAKMGPVINEGAMKSILNYIEVGKQEGRVITGGARAAGEGYCIQPTVIADIAPMARLSQEEIFGPVLAVIKAKDYDDALAIANNTEYGLTGAVYTTSDAKIERAKREFHVGNLYINRKCTGAVVGANPFGGFNMSGTDSKAGGTDYLYLFSQAKSIGQKI

SEQ ID NO: 3918 - protein, 271 aa, Glycine max
  misc_feature (196)..(196): Xaa can be any naturally occurring amino acid
KQILQYVELYQRENRLKPMPIILCGDWNGSKRGHVYKFLRSQGFVSSYDIANRYSDSYADAHKWVSHRNHRGNICGVDFIWLCNPNQARKPLKTSWAEAVFSILKFQLRKASVSEDDAFTFLKGDNYADSVTYFSFSEALRQVKLVGVPYGLCFQQLQDLWNQADVDGNGVIDFEEFKQKIWNSTCPEHGVGKCEXGCMEDGNTEQEQEAIGFKVKNAMLYPREVEKAPGPEDYSLSDHARLTAVFSTARMRCSWRTKLNVLHATNSFRLH

SEQ ID NO: 3919 - protein, 196 aa, Glycine max
MFFPKLAIIITALALVPLIFINESDSAEVTPFASQKVNLSVYYASLSQPCATFIVKNLEEIFHSDLINILNLQLVPWANAYVDKTNHSIICQNGPDECELNSLEACALNVLDDVNKHYALIYCFEFLAIEGRHKNWQDCFSQLDLPLEPILSCYNRGNGTELGQKYINETTLFYTPHEFLPWVVVNNQSIGKEYEN

SEQ ID NO: 3920 - protein, 347 aa, Chlamydomonas reinhardtii
MTSLPALVPFAALPALVPFAALASTGRLLGSMSGLVCGAQRRLPAHTAFARSHGTATGHAGIVGGAGLSHVKDAAQAFGANQSSSSPSFATSGVAPHPGMKAPSPPTDDEVEACWRPVYDTAYLEKVKPFHITPERLYQRIGFRAIMAARWTFDKLTGYGPNMTEAKWLQRMIFLETIAGVPGMVAGVLRHLKSLRSMKRDHGWIHTLLQEAENERMHLLTFFELRKPGPLFRASIIVAQGVFWNLYFIGYLVSPRTCHAAVGFLEEEAVKTYTHALQEIDAGRLWKGKVAPPIACEYWGLKPGASMRDLILAVRADEACHAHVNHTLSGLPATAPNPFAYGASQLP

SEQ ID NO: 3921 - protein, 652 aa, Arabidopsis thaliana
MLSLSLSNHVPPLTLLSHERRILKLQSRSSILFHQLFHTKFLLLSNSSSLSSSHGVVAISASPSSVAVPELEDEDHFDDELRRLLALVPEEIRQTLKEHPEISELIEIVLDLGRKPLARFPSGDFVISDDAVRVKDLEFAVSQVGEFTNDNRAGISRTLHRISAIRNRKGEIIGLTCRVGRSVRGSANLLRDLVQDGNSLLLIGPPGVGKTTMIREVARMLGNDYEKRVMIVDTSNEIGGDGDIPHPGIGNARRMQVPNSDIQHKVLIEAVENHMPQVIVIDEIGTKLEAIAASTIAERGIQLVATAHGATIENLIKNPSLDLLVGGVQSVTLGDEEATRRGGQKTVLERKGPSTFNCGAEIVSKTEVRVHRSLEATVDAILAGRLPNVEIRKIKSHGVEVIMEKEPFIDEKTVDKKHEEETLDVSKLTKEETVSEVLQTKEITEAESSEKDTLMYLYVYGMETAVELTDDISEAEALLALQAKIRKNPRIKSFATSHGIPVYVTKTNSGIQVAKAIRALLTDYEDGLGEFGSEDRLKLSEKMDALEEARLAIERIVIPKKETTDLLPRPPRIVSLQGKLVRKYNLRSERKWRGDEMYLRILPYSTEEDRDDREDEGEFGEANGEELDELGFATGESNDSPSGIDRLPLLPD

SEQ ID NO: 3922 - protein, 382 aa, Ustilago maydis 521
MAPVANTKSSVELSALKDNLILMATHKKELELIKSTPAAPGPGMALVHVRATGVCGSDVHFWKHAGLGPWKIESQCALGHESGGIVIAVGEGVDNVVPGDRVAIEPGVPCFKATCDFCRTGKYNLCPTVDFYSVPPKDGTLKRYHEHPAGWLHKVPDNMSYEEIALLEPLSVTLQATLQAEISLGTPVLITGAGPIGIVQLLCASAAGATPIVITDVVKDRLDFAQKIVPGTFTYQIDPKKSPLESATEICKVFSKASGKHIAQGERDVQPAITMECTGIESSIQTASYATAASGLVFVIGVGANLQQIPFMHLSTNEITLKFLFRYRDTWPRAIRLVSSGKIDVKQIVTSRFPLEKAKEAVEHAADRSKFSVKTIIYDDQE

SEQ ID NO: 3923 - protein, 474 aa, Acinetobacter sp. ADP1
MNTMKDSELSLDNGATRDVDYFAKRQLKKGAVGWLLLVGLGVSYVISGDFAGWNFGLAQGGWGGLFIATVIVALMYLCMSLSMSEMSTMLPTAGGGYSFARVAFGPLGGYLTGTAILIEYAIAPAAIAVFIGSYCESLFGIGGWSVYLLCYLVFMGIHLKGAGEALKIMFIITAIACVALLVFIVAMIPHFESGKLFDIAVSNNVGASAFLPLGYLGIWAAVPYAIWFFLAVEGVPLAAEEAKDPVRSLPRGLIGSMLILAAFALLILFLSAGAAGSDALKASGAPLVDALIAVYGQHTWLASFVNFVGLAGLVASFFSIIYAYSRQIFALSRAGYLPKSLSLTNKNKAPFLAIIIPGIIGFLMSLTHEGDLLILMAVFGATISYVLMMLSHIKLRISHPNLARPYKTPGGVVTSSIALVLAAIAVVAGLMVNPKVWLLTAMIYVAFILYFILYSRFHLVKGTPEEEFARVNED

SEQ ID NO: 3924 - protein, 133 aa, Triticum aestivum
MEYQGQHGHATDKVEEYGQPVAGHGGFTGRPTGTHGAQLQATRDDHKTDGVLRRSGSSSSSSSEDDGVGGRRKKGMKEKIKEKLPGGAHKDATAGQQHTAVAGEYAGTHGTEATGEKKGVMDKIKEKLPGGQH

SEQ ID NO: 3925 - protein, 344 aa, Bacillus clausii KSM-K16
MKAVFVDDAEKINIKEIDIPVVKDNDVLIKVAVAGICGSDIHTYKGLHPFRKPPVVIGHEVAGEVVSVGQAVKRVQVGDRVTVEPQIGTGESEGVMTGQANLSDKRLAPGMGDWLGTMAEYFVSPEAQVIKLPDAVSYEKGVLVEPLAVGVHAARKGGIQPGDRVAILGAGPIGLLTLMAVKAKGASHVVVTDVLDYSLDVAKQMGATAAINIKGKPDWIEEAKSKVGRSFDKVLITAGVPGIINDSLNLLKKGGRAVTVAMFHGQQDFDVEQLQQNEKEIVGCMTYNRPDTEEALDIIAKGALPVEKVISHQLSYEQADKGFEMVDKKQDNSVKVIVSFEQEG

SEQ ID NO: 3926 - protein, 254 aa, Mycobacterium smegmatis str. MC2 155
MTPPTGGSVKAVAISIAAAVGGFLFGFDSSVINGAVGAITAHFALTPLMAGLTVASALLGCAVGAWFAGGIADRIGRVRVMGVAAVLFAVSSVGSGLAFSAFDLMAWRITAGVAIGIASVIAPAYIAEIAPARIRGALTALQQLALVIGIFVSLLSDAALASVAGGAANTSWFGVEAWRWMLLVGLVPAVVYAIIARRIPESPRYLARRGEYESAAAVLSRVLDVSIDDARRKVDQIWLFAVEGVEVVGASVPG

SEQ ID NO: 3927 - protein, 491 aa, Escherichia coli O157:H7 EDL933
MNTQYNSSYIFSITLVATLGGLLFGYDTAVISGTVESLNTVFVAPQNLSESAANSLLGFCVASALIGCIIGGALGGYCSNRFGRRDSLKIAAVLFFISGVGSAWPELGFTSINPDNTVPVYLAGYVPEFVIYRIIGGIGVGLASMLSPMYIAELAPAHIRGKLVSFNQFAIIFGQLLVYCVNYFIARSGDASWLNTDGWRYMFASECIPALLFLMLLYTVPESPRWLMSRGKQEQAEGILRKIMGNTLATQAVQEIKHSLDHGRKTGGRLLMFGVGVIVIGVMLSIFQQFVGINVVLYYAPEVFKTLGASTDIALLQTIIVGVINLTFTVLAIMTVDKFGRKPLQIIGALGMAIGMFSLGTAFYTQAPGIVALLSMLFYVAAFAMSWGPVCWVLLSEIFPNAIRGKALAIAVAAQWLANYFVSWTFPMMDKNSWLVAHFHNGFSYWIYGCMGVLAALFMWKFVPETKGKTLEELEALWEPETKKTQQTATL

SEQ ID NO: 3928 - protein, 413 aa, Methanosarcina barkeri str. Fusaro
MSQKITGKDYLTMSDVVLDNKRVLVRVDFNSPMDDNGNILDDKKIKSHLPTLQSLEHSKVVLMSHQGRPGDEDYTTLEAHAKLATELLGREVTYEDDIFSSCARNAIKSLAQGEILLLENTRFNAEEITNRPPEKQAKSQMVKKLYPLFDLFINDAFSVSHRSQCSVVGFTEVLPSVAGILMDKEITGLDKALKCREHPAIFILGGAKANDSIKAISNILKRAGADKILTTGVVATIFMMAMGVDVSEVNRKFIEDKKYMDQISIASKLLKDYSGKIIVPQDVALNSGGERQEVEVDKIKKGNLPIADIGRETIENYSKYLKEAKLCVFHGPTGIFELDNFRLGTDELLKAAAQASYSVAGGGHTLDAIDQLGLGSKFSHISMGGGASITYISGEPLPGITALKKNAFRYHQG

SEQ ID NO: 3929 - protein, 511 aa, Prochlorococcus marinus str. MIT 9515
MSFVITTPLYYVNDKPHLGSIYTTLICDSIARFKRLSGDNVIFITGVDEHGLKIQRTASNKGVDPQSHCDEISDIFKQNWKSWDITNNKFVRTSSQNHESIVNEFYNRVKASGDIYMGVQKGWYCVGCEEFKENPENLSSYKCPIHQKNLEWKNEENLFFRLSKYQSQIEELINEPSFIYPKERRNEIINFVSKGLKDFSVSRTNVSWGISVPDTKDHTFYVWFDALLGYVSAICPNMSDPSLESSINNGWPADIHFIGKDILRFHAVYWPAMLLSAGMDVPKRVFGHGFLTREGQKMGKSLGNVLDPNLLLSKYGKEAVRWYLLKDISLGSDGDFQNKRFVDIINNDLANTIGNLLNRTSSMSRKWFDNKVPDTYELIIDNTLQLCCNEAVEKFINHFNLYELDLAANVILNLAINTNLYLNEKQPWKLIKDENNISIVCNIIYDVLESTRIIGLLLLPILPDLSSKINMQLGSLYNKNESWNDQLNWGLLKSKSNLPAPYPIIEKLEYE

SEQ ID NO: 3930 - protein, 275 aa, delta proteobacterium MLMS-1
LFGFGGARGGSRRASGGPIPGNDLRYDLVISFMEAAHGVEKEVEISKGETCWTCEGSGARPGHPPESCSTCNGIGQVLHAQGPFRVQSACPHCRGQGRVVTEPCQDCQGQGLVKRSKKVSLKIPAGVDSGARMRLKGEGEGGRRGGPAGDLYVIIHVQPHDFFQREGYDIVCSLPLSFTQAALGCSLEVPTIYGSHKLKIPAGTQQGQHFTINEMGVAKLRGGGYGDMICEVRVVVPKRLTKKQKKLLKEFADSEEDPSDDAAKGDGFLKKFFHL

SEQ ID NO: 3931 - protein, 170 aa, Brassica napus
MPKERKHRSVSHERLRGSSLYCESSRALKPSEKQVKEWEEARCPVCMEHPHNGILLVCSSYDNGCRPYMCDTSHRHSNCFDQYRKASKQTPTETEGVVAEAASVVTVVNPREGEGIVEAEAEQEKGKPKLTCPLCRGNIKEWVVDEPARCFIGRKNVEACSSETCEFSGT

SEQ ID NO: 3932 - protein, 453 aa, Yersinia pestis KIM
MHLQNTLRPEMWFFLKSRDNVPLVTDQTQIDSSYKYWRIQLMWTMYIGYAAFYFTRKSFNFIMPAMLTDLGLSMSDVGILGTLFYITYGCSKFVSGMISDRSNPRYFMGIGLVMTGIINILFGMSSSLLVLGALWILNAFFQGWGWPPCSKILTSWYSRSERGGWWAIWNTSHNFGGALIPLLVGVITLHFSWRYGMIIPGIIGVVIGLLMCWRLRDKPSTMGLPSVGKWRNDAMELIQESEGQGLSNKEIVKRYVLTNKYIWLLAVSYVLVYIVRTAINDWGNLYLTQEKGYSLLTANSAISLFEVGGFIGSLVAGWGSDKWFRGNRGPMNLIFAIGIFLSVASLWTLPSISFVLQAGCFFAIGFFIFGPQMLIGMAAAECSHKDAAGAATGFVGLFAYLGAALSGYPIARVMEIWHWNGFFVVISVAACLSAFFLLPFLRAQSPQLKQATT

SEQ ID NO: 3933 - protein, 151 aa, Prochlorococcus marinus
MSVERTFLAIKPDGVQRGLVGEILGRFERKGFKLVGLKQLIPSKELAEKHYGVHKERPFFTGLVGFITSGPVVAMVWEGDGVILSARKLIGATKPLEAEPGTIRGDLGINIGRNVIHGSDGPETASFEIDLWFNSSELNNWNPSDQKWRVE

SEQ ID NO: 3934 - protein, 339 aa, Achlya bisexualis
MAPVAIGINGFGRIGRLVCRAAFANPNATVVAINDPFMDLDYMVYLFKYDSTHGGYKGTVVAEDGNLVIDGHVVRVFSERNPNEIPWGEAGADYVCESTGVFTTTEKAGLHLQGGCKKVVISAPPKDSTPMYVMGVNHDKYDGSAHVVSNASCTTNCLAPLAKVIHDNFGIVEGLMTTVHAVTANQLTVDGPSRGGKDWRAGRGAGANVIPASTGAAKAVGKVLPELNGKLTGMAFRVPVPDVSVVDLTVRLEKGASLDTIKAAVKEASEGSMAGILGYTEDEVVSQDFVSDKRSSIFDANACIALNDNFVKLVSWYDNEWGYSNRLVDLVVHMATIDN

SEQ ID NO: 3935 - protein, 596 aa, Achlya bisexualis
MQVRRFSSVARKFFVGGNWKCNGSLSQAQSLVDTLNTATIPKNVEVVVAPASIHALSVKSSLRKDIGVSGQDTWSRGNGAFTGEVSAEMLKDAGINYTIIGHSERRQKGETNEEVASKAGYALSKGVSVIACIGETKIEREAQKTMQVVTEQLAAYAKNITDWSNVVIAYEPVWAIGTGLTATPEQAQEVHAGIRSWLKQNVSSAVADATRIIYGGSVTAGNAAELSKKADIDGFLVGGASLKPDFLSIINCQNDKAHQGGPVNIAINGFGRIGRLVLRAAQTNPLLNVVAVNDPFIPTEYMEYMLKHDTVHGHFDGTVRHEGDHIIVNDRKIRVFGEKDPKAIKWGESDVEYVVESTGAFTTKEKASAHLLNGPRKVVISAPSADAPMFVVGVNHDKYDPSMNIVSNASCTTNCLAPLAKVVNDKFGIIEGLMTTVHAVTATQLTVDGPSKKDWRGGRAACFNIIPSSTGAAKAVGKVIPELNGKLTGMSFRVPTANVSVVDLTVRLRNKASYEDIKAAIKYASENELRGILGYTDTAVVSSDFISDPRSSIFDADAGIVLTDDFVKLVSWYDNEWGYSNRVLDLITHMVHTERQ

SEQ ID NO: 3936 - protein, 646 aa, Vibrio sp. Ex25
MSSRKQARLEAKQFIETLSVQPYPNSTKVYVEGSRPDVRVPMREIALADSLIGGTKEAPIFEPNEPVRVYDTSGVYTDPEHTIDLYNGLPKLRESWIEERGDTELLDEVSSVYTKERLEDETLDDLRYGNLPRIRRAKDGQCVTQLHYARKGIITPEMEFIALRENMGRAKYRDDVLNQQHPGQSFGANLPKDITAEFVRKEVAEGRAIIPSNINHPESEPMIIGRNFLVKVNANIGNSSVTSSIEEEVEKLVWATRWGGDTVMDLSTGRNIHETREWILRNSPVPIGTVPMYQALEKVNGVAENLNWEVMRDTLIEQAEQGVDYFTIHAGLLLRYVPMTAKRVTGIVSRGGSIIAKWCLAHHQESFLYTHFREICEICAKYDVALSLGDGLRPGSVADANDEAQFAELRTLGELTKVAWEYDVQVIIEGPGHVPMHMIKENMEEQLEHCHEAPFYTLGPLTTDVAPGYDHITSGIGAAMIGWYGCAMLCYVTPKEHLGLPNKEDVKVGMITYKLAAHAADLAKGHPGAQVRDNALSKARFEFRWEDQFNLSLDPETARAFHDETLPQESGKVAHFCSMCGPKFCSMKISQEVREYAKDTEQVAADQAISIKMLDDPLEGMRQKSQEFRESGSELYHPAAHAEVSD

SEQ ID NO: 3937 - protein, 297 aa, Glycine max
MLPYASIPEAVAALGRNLTFAETLWFNYSAAKSDYFLYCHNILFLFLVFSLVPLPLVFLEFKRFSFVSSHKIQPKVRLSLAETFKCYKDVMRMFFLVVGPLQLISYPSIQMIGIRTGLPLPSWREILSQLLVYFLVEDYTNYWIHRFLHNDWGYEKIHRVHHEYHAPIGFAAPYAHWAEILILGIPSFLGPAMVPGHIITFWLWIALRQIEAIDTHSGYDFPRSITKYIPFYGGAEYHDYHHYVGRQSQSNFASVFTYCDYIYGTDKGYRYQKKILQKLKEELANGVEQNGGLYKTD

SEQ ID NO: 3938 - protein, 379 aa, Neorickettsia sennetsu str. Miyayama
MPGKKKDYYEILGVSRSASTEEIRKAYKKLALQYHPDRNKGDKEAAEKFKEIGEAYSVLSNPEKKASYDQYGHSAFNGGGFGGAGGFSADFSGMDFSDIFNDLFGGGRTRRTKADFNEVIKEDGSDLRYDVSITLREAFEGKEVKISYTKLAECEQCGNTGCEGKIKPVQCSTCNGAGSIRSQQGFFTVERSCSTCNGSGMIIENPCKKCGGTGRIRKGVTTCAKIPRGISDGAKVLLRGQGEAGSRGGKPGDLYMIVHIKQDEFFTRKNNDLYCEVPIRMSLAALGGEIEVPSLEGKKFKIKLPEGSQTGDKLKLKGKGMYLLNSEYRGDMYVRLTIETPVKLTKKQREILEEFEKESLGCSPKSEKFFSKIRSMFGL

SEQ ID NO: 3939 - protein, 666 aa, Arabidopsis thaliana
MLSLSLSNHVPPLTLLSHERRILKLQSRSSILFHQLFHTKFLLLSNSSSLSSSHGVVAISASPSSVAVPELEDEDHFDDELRRLLALVPEEIRQTLKEHPEISELIEIVLDLGRKPLARFPSGDFVISDDAVRVKDLEFAVSQVGEFTNDNRAGISRTLHRISAIRNRKGEIIGLTCRVGRSVRGSANLLRDLVQDGNSLLLIGPPGVGKTTMIREVARMLGNDYEKRVMIVDTSNEIGGDGDIPHPGIGNARRMQVPNSDTQHKVLIEAVENHMPQVIVIDEIGTKLEAIAASTIAERGIQLVATAHGATIENLIKNPSLDLLVGGVQSVTLGDEEATRRGGQKTVLERKGPSTFNCGAEIVSKTEVRVHRSLEATVDAILAGRLPNVEIRKIKSHGVEVIMEKEPFIDEKTVDKKHEEETLDVSKLTKEETVSEVLQTKEITEAESSEKDTLMYLYVYGIAESTVLQAIKQLEMETAVELTDDISEAEALLALQAKIRKNPRIKSFATSHGIPVYVTKTNSGIQVAKAIRALLTDYEDGLGEFGSEDRLKLSEKMDALEEARLAIERIVIPKKETTDLLPRPPRIVSLQGKLVRKYNLRSERKWRGDEMYLRILPYSTEEDRDDREDEGEFGEANGEELDELGFATGESNDSPSGIDRLPLLPD

SEQ ID NO: 3940 - protein, 1166 aa, Ustilago maydis
MPPLPYRRSSSLLPVTHSGTSTVARATTSLATRTPIHLTLEDLKRRTIKFISEEDNTTRIVNVSDCRDAYDVMARVLKKFGKPPSGNSYTPTADQGPTGDELGATETWGIFATSADGQNTKALSDNELLAICHAPQPHDPLRERGLTLRRIPNHLPGEDARKVPVRSGRNKLEAFFGERMPVAQMQPAGPGSGVNADEEDAGSVTISGKKMKRASTVSIMSGLGVGPFSSSSHNTGAGHTHGSTRAEGKLLSKKESKHMSPPPVTSKPSKIRNFFGQRPPSELINTNLADFFPSTDSKALQRTARRSIYGRASASTRSKRNSTWSFVADPDAPPLPNKGSMDGHPTPLERSSISIRERGTTPVIQIGYDSRSEDDHQSNARRTSSGTHSHLHSSLTGPPTLPPVVSRDSLDEWSRDLKAVGSPVTEENAMFQSSRHGHASGSQQHHAAMKHYPSHASGYADRPSISRRASGESARSRRSLASQVRHGLSAARERNADTASLLTVDEITQEVENRRESISLAGAGGGWVVDEDGVPIPIPGSSSPFSSSAAASTRPSSGISSSYVHNGHLEHDDSEGHSDEEANQSSDLEEATRTRKARGVPSKAASIRTVASKRASSVLQAPGDESDRHLGDPMAVARSTTSRASSVSELRRSVHDHGDPSDGESGSDFTDSDLDSDGSETDEDEQANDVYLPSAKPAPIKWHKGALIGAGSFGNVFLGMNAKTGLLMAVKQVELPSGDSHLDQRKKGMLEALEREIKLLKSLEHENIVQYLDSFADDSHLNIFLEYVPGGSIVALLRNYGAFEEPLVRNFVRQILNGLSFLHNRGIMHRDIKGANILVDNKGGIKISDFGISKKVESDLVLATNKSGAGGGGAGGAAHRPSLQGSVFWMAPEVVKQTSYTIKADIWSLGCLVVEMISGTHPWAELNQMQALFQIGMGRKPSLPDEISNECRDFLEKTFELDYNNRPSADELLNHAFMGTEMTFPPSSGADGSGGGDDDAGGSGDAGDGDASTMGMTNDAETGTTRETRETKDGKRPTRSKSTRRLEREKRHKEAAAAAAAATALDTGTPNTPTSHTAAAAAAAAAAAASASASASASPAVASTSPAPGDAETGSPTNGKSAVPPAGSTGGTPESILTVSIATARGNSTSTALSAADAAFSEEADS

SEQ ID NO: 3941 - protein, 263 aa, Brassica napus
DTIMSVGHSRVPVYFRNPSHIIGLILVKNLLAVNARKEVPLRKMIMRKIPRVSETMPLYDILNEFQKGHSHIAVVYKDLDEHKGSPETSENDIERRKNKKTKDELFKDSCKKPKAQVEVSEKEVFKIETGDAKSGKSENGEEQQGKTTLTAAPAKKRHRGCSFCILDIENSPIPDFPPNEEVVGVITMEDVIEELLQEEILDETDEYVNIHNRIRVNTHASQENLPSVITSITQSSSGSTSPNRTSHMATPDSSPATKPLENL

SEQ ID NO: 3942 - protein, 261 aa, Streptomyces sp. PGA64
MSQQDKRVALVTGGTSGIGLAVARLLATQNHQVFIGARNAENVAETVKQLQGEGLDVDGSTLDVRSTDDARAFVQAAVDRFGTVDVLVNNAGRSGGGVTADITDELWSDVIDTNLNSVFRLTREVLTTGGLRHKGRGRIINIASTAGKQGVVLGAPYSASKHGVVGFTKALGNELAPTGITVNAVCPGYVETPMAQRVRQGYAAAYDATEEAILEKFQAKIPLGRYSTPEEVAGLVGYLASDTAASITSQALNVCGGLGNF

SEQ ID NO: 3943 - protein, 304 aa, Prochlorococcus marinus str. MIT 9515
MQEFLPYAWFEGKCIPFKDAKVSIATHSLHYGTAAFGGMRAIPNPEDNNEFLLFRTDKHIKRLSQSAKLLLAEISEDYIFNAIETILKINKPSKPIYIRPFVYTSDLGIAPRLHNIETDFFIYCIELGDYLSPDGVSCRMSSWTRQEDRSLPLRGKISGAYITSSLAKTEASLSGFDEALLLNSSGKVSEASGMNLFIVRNGELITPGVDQDILEGITRASVLELAKSFGINVIERPVDKTELLIADEVFLTGTAAKITPVKQIESTRIDKKRPIMNKLKNKLIEITEGRSQDYDSWITRIKIN

SEQ ID NO: 3944 - protein, 136 aa, Corynebacterium efficiens
MTERTLILIKPDGVTNGHVGEIIARIERKGLKLAALDLRVADRETAEKHYEEHADKPFFGELVEFITSAPLIAGIVEGERAIDAWRQLAGGTDPVSKATPGTIRGDFALTVGENVVHGSDSPESAEREISIWFPNL

SEQ ID NO: 3945 - protein, 1398 aa, Gibberella zeae PH-1
MAGSASTANSVKDDITNQTKPKTNINKEISDLARQLSRVSTTAGTELNAFSPQPGTKLDPNSTNFDPRAWVKAFVKLVESEDGSAPSRSLGVAFKNLNVYGWGTGAEHQKTVADYPLDAVSYVLGLLGRGKKRRVDILRNFEGVIEQGELLLVLGPPGSGCSTFLKTIAGETAGLEVGSDSYMNFRGIDENHMRSSFRGDVLYNAEIDCHLAHLTVGETLSFASSAHSLRHVPGGVTRSQADTMMRDVMMSIFGISHTVDTRVGDDFVRGVSGGERKRVSIAEAALTGAKLQCWDNTTRGLDSGNAINFCRNLRLQADLIGVAAAVAIYQAPQSAYELFDRVTVLYEGHQIFFGRIHEARAYFESLGFECPHRQTTPDFLTSMTSPQERRVKQGFERTAPRTPAEFAERWQASSHRKQLMRELEIYEQTHPREERLAEYKESRRAEQFKNQRSKSPYTISYLAQVKLTLWRGWRRLLADPGFTIASLVFNLVMALVLGSGLIFFALLFNAFASQLEVLTVYAERPVVEKHNRYAFYHQSAQAIASYIIDLPYKTANMIVFNLLIYFMSNLRREAGSFFFFCLTSYLTTLVMSCIYRTLACVTRTTHQAMIPVSILSLGLMIYTGFTMPTDYMLGWSRWMNYINPLAYAFEALMANEFHNRQYGCATLVPQGPGYENLPANSTICSVVGAIPGSSLVDGDRYINLSYKYYNSHKWRNIGILLGFLAAFLVFYIFAAEHAKPPRSKGEILVFRKGRMPPSFDKKDGTDVEAQATDRPVVAEKGTVNTNSGLTAGASVFHWEDLCYDIQIKVSGNTHIDGKSTDASFQHRVGYVQQQDLHLNTMTVREALEFSALLRQSAEISRQDRLDYVEQVIDMLDMQEFSDAVIGVPGEGLNVEQRKRLTIGVELAARPQLLVFLDEPTSGLDSQTSWAICDLIEKLTASGQAVLCTIHQPSAILFQRFDRLLLLAPGGKTVYFGDLGEQSQTLLQYFERNGAPPCPVDANPAEYMLNIIQPSNDEEVDNIDWHQIWRSSPEFQSVKQELQRLNALPSTKPDGTSAFDNADASQHQEFVASFWTQFREVLIRTWKNFWRSPTYIWSKTVLIILSSLYIGFTFEAKNTIQGLQNQLYAIFMYMVLFQSITNQIMPIFVPQRALYEVRERPSKIYRWNTYILSNILVEAAWNTLMAVIIYFCWYYPVGFVQNTTSDDQHIRGFLVFLFLLMFMLFTSTFSHFSIICISSAEEAGVLATLLWMLCIAFCGVGVTYNDIPTFWTFMYHVSPATYIVGGIMSVAVYGSDVVCADNEVLQMQVPSGMNLTCGDFMGPFVNAAGGYLVDRSSTDVCQYCSLASTEEFLATFNIDYADRWWHFGLLWVYVLANILGALGLYWLFRVPRGSGVKRA

SEQ ID NO: 3946 - protein, 631 aa, Escherichia coli B
MSATKLTRREQRARAQHFIDTLEGTAFPNSKRIYITGTHPGVRVPMREIQLSPTLIGGSKEQPQYEENEAIPVYDTSGPYGDPQIAINVQQGLAKLRQPWIDARGDTEELTVRSSDYTKARLADDGLDELRFSGVLTPKRAKAGRRVTQLHYARQGIITPEMEFIAIRENMGRERIRSEVLRHQHPGMSFGARLPENITAEFVRDEVAAGRAIIPANINHPESEPMIIGRNFLVKVNANIGNSAVTSSIEEEVEKLVWSTRWGADTVMDLSTGRYIHETREWILRNSPVPIGTVPIYQALEKVNGIAEDLTWEAFRDTLLEQAEQGVDYFTIHAGVLLRYVPMTAKRLTGIVSRGGSIMAKWCLSHHQENFLYQHFREICEICAAYDVSLSLGDGLRPGSIQDANDEAQFAELHTLGELTKIAWEYDVQVMIEGPGHVPMQMIRRNMTEELEHCHEAPFYTLGPLTTDIAPGYDHFTSGIGAAMIGWFGCAMLCYVTPKEHLGLPNKEDVKQGLITYKIAAHAADLAKGHPGAQIRDNAMSKARFEFRWEDQFNLALDPFTARAYHDETLPQESGKVAHFCSMCGPKFCSMKISQEVRDYAATQTIEMGMADMSENFRARGGEIYLRKEEA

SEQ ID NO: 3947 - protein, 269 aa, Picea mariana
SGVPPFWAETQQGIFDAVLRGYIDFDSEPWPSISESAKDLIRKMLTSNPAERLTAHGVLCHPWICKDGVAPDQALDPAVLSRLKQFSAMNKLKKMALMVIAESLSEEEIAGLREMFEAMDTDNSGSITFDELTAGLKRYGSNMKESEIRALMDAADVDNSGTIDYAEFIAATFHLNKLEREEHLFAAFSYFDKDASGYITVDELQQACLEHNLTDVRIDEIIREVDQNNDGRIDYNEFVAMMRKGNGAIGRRTMRNSLNFSRKDNLPIG

SEQ ID NO: 3948 - protein, 356 aa, Neisseria gonorrhoeae FA 1090
MTKHIAILRGDGIGPEIVAETVRVLDKFIAQGLDADYEYAPLGGEAYDEYGHPYPEFTQNLCRKADAVLLGAVGSPQYDNLDRPLRPERGLLAIRKDLNLFANLRPAVLYPELANASTLKPEIVAGLDILIVRELTGDIYFGEPRGIRVLENGEHEGYNTMKYSESEIRRIAHVAFQSAQKRSKKVCSVGKANVLETTELWREIFEEIGKQYPDVELSHMYVDNAAMQLVRAPKQFDVIATGNIFGDILSDEASMLTGSIGMLPSASLDENGKGLYEPSHGSAPDIAGQNKANPLATILSLAMLLRYSLNDEARAQQVENSVQKVLQQGLRTGDIYEEGTKLVSCSEMGDAVLAAL

SEQ ID NO: 3949 - protein, 325 aa, Acinetobacter sp. ADP1
MTHAIDFKKIALETISVEQHAIDVLVNQIDERFDQACEIILQCQGRVVVTGMGKSGHIGRKMAATFASTGTPSFFMHPGEAGHGDLGMLVRGDVLIAISNSGKSDEIMMLMPLIKHLEVPLITISRDDKGPMPQNADIALTLGDSNEACPLGLAPTSSTTATLVLGDALAVALLEARGFTADDFARSHPAGALGKRLLLHVKHLMHTQQELPKVSPDTPMNQVLYEISNKRLGLTTIVDENDHLLGIFTDGDLRRLIDKQQGFDVNLPVRQVMVEHPATISQEARAVEALQKLNEKKINQFVVVDDQNKVIGVISMHDLIQAGVS

SEQ ID NO: 3950 - protein, 280 aa, Brassica napus
MSLFLKDDSIQIREVWHDNLESEMALIRDIVDDFPFVAMDTEFPGIVCRPVGTFKTNTEYHYETLRTNVNLLKMIQLGLTFSDERGNLPTCGPDDKKYCIWQFNFREFDLSSDIFAHDSIELLRQSGIDFDKNKRNGVDSRRFAELLMSSGIVLNENVHWVTFHSGYDFGYLLKLLTCQDLPDTQVGFFEMFRVYFPRVYDIKYLMTFCNGLFGGLNRLAELMGVERVGICHQAGSDSLLTLGSFRKLKERYFPGSTDKYTGVLYGLGVEDSATSTAIAN

SEQ ID NO: 3951 - protein, 333 aa, Chlorobium tepidum TLS
MNKLTTIESHFLQLQKRYPEINSEVTDLLNDVAFAAKLVRREVVRAGLADILGLAGSTNVQGEEVKKLDLFANERLINAIGQHGRFAIMGSEENEEIIKPPKFESGEYVLLFDPLDGSSNIDVNVSVGTIFSIYRLKSGEPSQASLEDCLQKGADQIAAGYVIYGSSVMMVYTTGHGVHGFTYDQTVGEFLLSHENITTPEHGKYYSVNEGSWQEFNDGTKRFLDYLKEEDKATGRPYSTRYIGSFVADFHRNLLTGGVFVYPATKKHKNGKLRLMYEANPMAFICEQAGGRATDGYRRILDIEPKELHQRTPLYIGSKNDVLIAEEFEQGKR

SEQ ID NO: 3952 - protein, 138 aa, Triticum aestivum
  misc_feature (53)..(53): Xaa can be any naturally occurring amino acid
  misc_feature (81)..(81): Xaa can be any naturally occurring amino acid
  misc_feature (96)..(96): Xaa can be any naturally occurring amino acid
  misc_feature (117)..(117): Xaa can be any naturally occurring amino acid
CRGWTGSDRRGPALMTKDVREQGNCSGSVIIGGSESEEHMAVRHKASSKSSHXTNPVHQEVCKRVAQLVAGVVAITGALLXGSIRTQAYGGQICGXMMESGGIDRILLAVRTSRDYXQSKKGISKPEIIIAESGHYAV

SEQ ID NO: 3953 - protein, 467 aa, Arabidopsis thaliana
MLPVRESLQKQVKILIGLGNLGFGGYRGLYTRFTNPNGFLEPASSDLLLINERRNLSVIGAVSRTFSVPSVSGPAFQVCGYHIDLLLSDPCKSMASLGSKSLFVDRHSASLVSKRFTGGMVSGDGPNRGRISMRLRGKDHNEKSTICAYFAYRGAKRWIYLNQQRRGMGFRGLHSSLSNRLSAGNAPDVSLDNSVTDEQVRDSSDSVAAKLCTKPLKLVSGSCYLPHPDKEATGGEDAHFICAEEQALGVADGVGGWAELGIDAGYYSRELMSNSVNAIQDEPKGSIDPARVLEKAHTCTKSQGSSTACIIALTNQGLHAINLGDSGFMVVREGHTVFRSPVQQHDFNFTYQLESGRNGDLPSSGQVFTVAVAPGDVIIAGTDGLFDNLYNNEITAIVVHAVRANIDPQVTAQKIAALARQRAQDKNRQTPFSTAAQDAGFRYYGGKLDDITVVVSYVAASKEEGKH

SEQ ID NO: 3954 - protein, 386 aa, Mesorhizobium loti MAFF303099
MRIAVLGGLGLQGRAAIADLVASGVDEVICVDTAPDGAARLADLTDLSRVRFVVPEGAIGPALADVLADADSVIDLLPQPLMREAVQAAIATRTPLVTTNYGKAIADLAPEAERAGVSVMTECGLDPGIDLVLYARAAKQFDAITSIDSYCGGIPEPKAMAKPLCYKVSWNFDMVLVSQNRDSVMIEDGKRVEVPAARQHDSPFIHEIEVAGLGRLEAFPNGDALHYVEMLPAAKGLRRSGRYTLRWPGWSAFWAPLKELGFLSEDKVPGTSSSPREFLGRLLGPQLQYGPGEKDLCVMRNVFSGLEGGRAKTVTSDLIIERDLASGLFGMSLGVGYPASIVAQMLARREIITPGLLNPLLDVPDEPFFDELAKRGIKIAETVAWD

SEQ ID NO: 3955 - protein, 266 aa, Oryza sativa (japonica cultivar-group)
PCRRREPTREESVYKAKLAEQAERYEEMVEYMERVARAAGGASGGEELTVEERNLLSVAYKNVIGARRASWRIISSIEQKEEGRGNDAHAATIRSYRGKIEAELARICDGILALLDSHLVPSAGAAESKVFYLKMKGDYHRYLAEFKSGDERKQAAESTMNAYKAAQDIALADLAPTHPIRLGLALNFSVFYYEILNSPDRACNLAKQAFDEAISELDSLGEESYKDSTLIMQLLRDNLTLWTSDANDDGGDEIKEAAAPKEPGDQ

SEQ ID NO: 3956 - protein, 1073 aa, Pseudomonas putida KT2440
MPKRTDIKSILILGAGPIVIGQACEFDYSGAQACKALREEGFRVILVNSNPATIMTDPAMADATYIEPIKWQSVAKIIEKERPDAVLPTMGGQTALNCALDLERHGVLEKFGVEMIGANADTIDKAEDRSRFDKAMKDIGLECPRSGIAHSMEEANAVLEKLGFPCIIRPSFTMGGTGGGIAYNREEFEEICTRGLDLSPTKELLIDESLIGWKEYEMEVVRDKKDNCIIVCSIENFDPMGVHTGDSITVAPAQTLTDKEYQIMRNASLAVLREIGVETGGSNVQFGICPNTGRMVVIEMNPRVSRSSALASKATGFPIAKIAAKLAIGYTLDELQNDITGGRTPASFEPSIDYVVTKLPRFAFEKFPKADARLTTQMKSVGEVMAIGRTFQESLQKALRGLEVGACGLDPKVDLASPEAASILKRELTVPGAERIWYVADAMRSGMTCEEIFNLTGIDMWFLVQMEDLIKEEEKVKTLALSAIDKDYMLRLKRKGFSDQRLAVLLGITDKNLRRHRHKLEVFPVYKRVDTCAAEFATDTAYLYSTYEEECEANPSTRDKIMILGGGPNRIGQGIEFDYCCVHAALALREDGYETIMVNCNPETVSTDYDTSDRLYFEPLTLEDVLEVCRVEKPKGVIVHYGGQTPLKLARALEEAGVPIIGTSPDAIDRAEDRERFQQMVQRLSLLQPPNATVRSEEEAIRAAGSIGYPLVVRPSYVLGGRAMEIVYELDELKRYLREAVQVSNDSPVLLDHFLNCAIEMDVDAVCDGTDVVIGAIMQHIEQAGVHSGDSACSLPPYSLSKEVQDEVRVQVKKMALELGVVGLMNVQLALQGDKIYVIEVNPRASRTVPFVSKCIGTSLAMIAARVMAGKTLKELGFTQEIIPNFYSVKEAVFPFAKFPGVDPILGPEMKSTGEVMGVGDSFGEAFAKAQMGASEVLPTGGTAFISVRDDDKPQVAGVARDLIALGFEVVATAGTAKVIEAAGLKVRRVNKVTEGRPHVVDMIKNDEVSLIINTTEGRQSIADSYSIRRNALQHKIYCTTTIAAGEAICEALKFGPEKTVRRLQDLHAGLKA

SEQ ID NO: 3957 - protein, 136 aa, Medicago truncatula
MARTKQTARKSTGGKAPRKPLATKAARKSAPTTGGVKKPHRYRPGTVALREIRKYQKSTELLIRKLPFQRLVREIAQDFKTDLRFQSHAVLALQEAAEAYLVGLFEDTNLCAIHAKRVTIMPKDIQLARRIRGERA

SEQ ID NO: 3958 - protein, 385 aa, Capsicum annuum
MIRGAACFRKLFQSSALSSKFTTRYYTAQAAVQPAIYSSDEESGSIDWDNLGFKLMQTDYMYVTKTSDDGIFRQGQLDRYGNIQLSPSAGVLNYGQGLFEGTKAFRREDGRLFLFRPEQNAIRMQIGAERMCMPAPSTDQFVDALKQTALSNKRWIPPPGKGSLYIRPLLIGTGPILGLAPAPEYTFLVYACPVGNYFKEGTAPLNLYVEEDVHRASRGGAGGVKSITNYAPVLKAMKKAKANGYSDVLYVDAVNKKYIEEVSSCNIFVVKGNVVSTPIAKGTILEGVTRKSIMDIALDLGYTVEERLIEADELISADEVFCTGTAVGVAPVGSITYKGQRIEYKISSDLSCKKFYSRLVGIQKGVIKDERNWIVEIESSYLVQD

SEQ ID NO: 3959 - protein, 437 aa, Mycobacterium smegmatis str. MC2 155
MQTAMMLRHWSRFVSACRRRYGDVFTLRIASMGTWVYLADPADIKTVFAGDPTVFHAGEANSMLSGLLGETSVLVIDEDVHRDRRRLMLAPFARDAVARQTGVMAEVAATNIASWPVGTPFPVAPKMAEIALEVILRTVIGATEPARLAALRHVMPQLLGIGPWQSLAIASPGLQRRRPWRTLQRNLAEADRLLYAEIAACRAGPDLASRPDALAMLVRAANDEGRTMTDRELRDQLMTLLVAGHETTATGLSWTLERLIRHPAVLDKAVAAARTTDGSGEAYLDAVVRESLRIRPVVFEAGRVLTEPVELGGYLLPAGTLVAPSIGLVHASADVYPDPDRFEPDRMLASTQAPSTWLPFGGGNRRCLGATFALVEMRVVLREILHRVDLFATTARGEKQRLKHVTMIPHRGGRICVRALRDVAPAPMTCPAEARRA

SEQ ID NO: 3960 - protein, 186 aa, Medicago truncatula
MTNILLRTASRGGSLRATLIRRFSTDALVESKPGEIGLVSGIPQEHLRRRILCNGLSLTGNADIVRLDTFTRVPSRDFAVVCVLIYSPARTAGQQGSGNVGRWRINFLSTQKWENPLMGWTSTGDPYSHVGDSALDFDTEEAAKEFAERHGWEYVVKKHHTPLLKVKLYADNFKWKGPPKAAEAEQ

SEQ ID NO: 3961 - protein, 359 aa, Mycobacterium sp. MCS
MVNPAEVDAVVLVGGQGTRLRPLTLSAPKPMLPTAGLAFLTHLLSRIAAAGIEHVILGTSYKAEVFEAEFGDGSKLGLQIEYVYESEPMGTGGAIANVAEKLRHDTAMVFNGDVLSGCDLRALLDSHVSKDADVTLHLVRVGDPRAFGCVPTDADGVVTAFLEKTQDPPTDQINAGCYVFKRSVIDRIPRDRAVSVEREVFPGLLSDGLRVCGYVDATYWRDMGTPEDFVRGSADLVRGIAPSPALEGHRGENLVHDGAAVGPGALLIGGTVVGRGAEVGAGARLDGAVIFDGVRVGAGAVIERSIIGFGARIGPRALIRDAVIGDGADIGARCELLRGARVWPGVKIPDGGIRYSTDV

SEQ ID NO: 3962 - protein, 882 aa, Desulfitobacterium hafniense Y51
MSKKFVYLFREGQASMRDLLGGKGANLAEMTNIGLPVPPGFTITTEACNDYYALGRNLPEGLWEQIGPALGDIEKATGKKFGDKDNPLLVSVRSGAKFSMPGMMDTILNLGLNDETVEGLAASTQNARFAYDSYRRFIQMFGDVVLEVEHHEFERILEEAKEKQNVNYDSELTAESLKGVVEGYKRLIQRRTGSPFPLDPMKQLEQAILAVFRSWNNDRAIVYRRINSIPDNIGTAVNVQSMVFGNMGNDSGTGVAFTRNPSTGERVLYGEYLMNAQGEDVVAGIRTPQPIKSLEDENKAIYAQFVETSNSLEAHYRDMQDIEFTIERGRLYILQTRNGKRTAPAAIRVAVELCREGVISKEEAIARIEPGQLDQLLHRRMDSEAKLEVIAKGLPASPGAASGKIVFDADEAERLGHTGERVLLVRTETTPDDIHGILAAQGILTSRGGMTSHAAVVARHMGKPAVCGCEALRIDYAHNTVTIDGVTYPEGTLFSIDGTTGRVIKGAVPMIDPELSEEFKELLGWADEIRTLKVLANADNPRDAQKARDFGAQGIGLCRTEHMFMDPARIPIVQEMILAQTLPEREVALAKLLPMQEEDFYGILKVMAGFPVTIRLLDPPLHEFLPNVEELVVDITKLKLQGDREEELNEKEVLLRKVRALSEMNPMLGHRGCRLGITFPEIYAMQARAIFQASARLVKEGCEIHPEVMIPLVIHVKELAKLRKVTEEAAQTVMAEQGVTFSYTIGTMIEVPRAALTADEVATAADFFSFGTNDLTQTTLGFSRDDAEGKFLPAYLEQNILEHNPFAVLDRIGVGKLMKMGVQLGREANPGLKVGICGEHGGDPSSIEFCHQIGLNYVSCSPFRVPIACLAAAQAAVSSKGQ

SEQ ID NO: 3963 - protein, 254 aa, Arabidopsis thaliana
MARKFFVGGNWKCNGTAEEVKKIVNTLNEAQVPSQDVVEVVVSPPYVFLPLVKSTLRSDFFVAAQNCWVKKGGAFTGEVSAEMLVNLDIPWVILGHSERRAILNESSEFVGDKVAYALAQGLKVIACVGETLEEREAGSTMDVVAAQTKAIADRVTNWSNVVIAYEPVWAIGTGKVASPAQAQEVHDELRKWLAKNVSADVAATTRIIYGGSVNGGNCKELGGQADVDGFLVGGASLKPEFIDIIKAAEVKKSA

SEQ ID NO: 3964 - protein, 181 aa, Brassica napus
MASSMLSSATVVSSPAQAAMVAPFTGLKSSAAFPVTRKTNTDITSIASNGGRVNCMKVWPPVGKKKFETLSYLPDLTDVELAKEVDYLLRNKWIPCVEFELEHGFVYREHGNTPGYNDGRYWTMWKLPLFGCTDSAQVLKEVQECKTEYPNAFIRIIGFDNNRQVQCISFIAYKPPSFTGA

SEQ ID NO: 3965 - protein, 234 aa, Malus xiaojinensis
VVTGKHLAEHCRDEYPKVTNFILWILAELAVVACDIPEVIGTAFALNMLFKIPIWCGVLITGLSTLMLLFLQQYGVRKLEFLIAFLVFLIATCFLVELGYSKPNSSEVVRGLFVPEIKGDGATGLAISLLGAMVMPHNLFLHSALVLSRKVPRSVHGIKEACRFYMIESAFALTVAFLINISIISVSGAVCSADNLNPEDRMNCNDLDLNKASFLLKNVLGNWSSKVFAIALWA

SEQ ID NO: 3966 - protein, 516 aa, Pisum sativum
MAVVAAPKKNNSFNKKDNPNLLLGRFELGKLLGHGTFAKVHLAKNIKTGEAVAIKIISKDKILKSGLVSHIKREISILRRVRHPNIVQLFEVMATKTKIYFVMEYVRGGELFNKVAKGRLKEEVARKYFQQLICAVEFCHARGVFHRDIKPENLLLDENGNLKVSDFGLSAVSDEIKQDGLFHTFCGTPAYVAPEVLSRKGYDGGKVDIWSCGVVLFVLMAGYLPFHDPNNVMVMYKKIYKGDFRCPRWFSPELVNLLTRLLDTKPQTRISIPEIMENRWFKIGFKRIKFYVEDDVVCNLDSLGLDGNNGNDGNDDKKVLNIDEHRDEALESVSESEWDSEVVNRRKNRQLGSLPRPASLNAFDIISFSQGFDLSGLFEEKGDEARFVSGASVSKIMTKLEEVAQLVSFKVRKKDCRVSFEGSREGVKGPLSIAAEVFELTPSLVVVEVKKKGGDKVEYDRFLNTELKSALHSLTMEESAGSSCQNTPDETLQQRAFSDSAIDKHSDSIESLNLDT

SEQ ID NO: 3967 - protein, 108 aa, Brassica napus
MSRPMEEDTNGKTEEEEFNTGPLSVLMMSVKNNTQVLINCRNNRKLLGRVRAFDRHCNMVLENVREMWTEVPKTGKGKKKALPVNRDRFISKMFLRGDSVIIVLRNPK

SEQ ID NO: 3968 - protein, 188 aa, Clostridium acetobutylicum ATCC 824
MKIVLFLAEGFEEVEALTVVDILRRADIICDMCSLEAKEVVGAHKIKVCADKTIEDIDIAEYDGLVLPGGMPGAENLRNSEFVINAVKKFNKEKKIVAAICAAPIVLGKAEVLEGRDATSYPGYGDEMGNCNYLEKITVKDGNILTSRGPATAIYFGLRLVEILKGKEVANGLKDGMMLKFVEGELSK

SEQ ID NO: 3969 - protein, 348 aa, Pseudomonas putida
MLAIRKTKAGPGGLSVDDVAAPKEAHSTDVLVKVEAAGICGTDLLIYKWGEFAKRMKLPTILGHEVSGVIEQVGSDVKGLRPGMRVSLESHLPCGTCYTCRRGWAHVCPKTRYPGVDFDGGFASFVVVPESVCWPVPCGIPPLQATMMEPFGLAVHASLEGSGVSGLNVLVSGCGPIGLMNIAAAKALGASKVIATDIHPLRLTAAAKMGADECINATEESVYKTVRSLLGERGVDVAIDYSGQAAALKELIQSITHGGELRLMGVPSHDILLNLEEWLFKGLIVRGLHGRRLYETWERSTSLLVTGRVDLSSLVSHRLPLSAAEDAFEMALNGQSLKILFEPNGSCI

SEQ ID NO: 3970 - protein, 249 aa, Picea mariana
GMKGGAKVVIEPHRHEGVFIAKAKEDALVTKNMAAGESVYGEKRISVQNEDSTKTEYRVWNPFRSKLAAAILGGVDNIWIKPGTHVLYLGAASGTTVSHVSDIVGPTGIVYAVEMSHRSGRDLVNMAKKRTNVIPIIEDARYPVRYRMLVGMVDVIFADVAQPDQARIVALNAHYFLKNGGHFVLSIKANCIDSTVPAEAVFAQEVKKLQKEQFKPFEQVTLEPFERDHACVVGGYRMPKKQKAADAAA

SEQ ID NO: 3971 - protein, 444 aa, Chromobacterium violaceum ATCC 12472
MESIFRETIMIAVIGAGVSGLSCAWWLQRHGMPVRVFEAAERVGGKVSTLAGEALCEQGPNTLLLDEELGQWLAELGLSPLWPEQGSDLRHVLQRGRYRPLPAGPWQLMAGGLLSWRAKWQLLRGLLRPGDPAEAESSLAAFCRRRFGQEVLDKLLDPLACGVFAGDPEELALDETLPRLARAAARPLPLWKGLWRERAGRARMCTLPGGLQQLPQRLARDLDIKLGAPVTALRRDGDGWRLRTREGWEWADRVVLAVPAAAAAELLHPLAPEMADVCRRIPYAPLAVVSTLLDGEAMEKPLPGYGALHPSGEGALTLGHLTVSNIYPHVCPDGTRLVTSFIGGRKHPEWLEQDDDALLAGLNQELERLFGMRGRPLAQHLTRWPQALPQGTPLQRRLRGAAEQWGGRGLHLCVNWLDGASLPDCLRKGRRLARRLAEREGGFA

SEQ ID NO: 3972 - protein, 593 aa, Yarrowia lipolytica CLIB122
MSERKSFTENVESDNSVGEIHEVKAEGPPDTSHLSYWGRFKHGFGPADVAHLDLEGLTPMEITALKTANAPLQRNLKGRHLQMIAIGGSIGTGLFVGSGSTLANGGPAALLIAYGVIGIMLLLTMHALGELAVCFPVSGGFCTYFTRFLDPGWGFAMSWNYIMGWFVILPLELVAASMTVNFWNEMNGTHINAAAWVSIFWIIICAINLFGVKGYGEAEFVFSIIKVAAIVGFILFGIVMAAGGGPKGGAFHEYQGGKLWQHPGAFAHGFKGVCSVFVTAAFAFAGTELCGLAAAETENPRVMLPKATKQVFWRICLFYLVSLTIVGLLVPWNNDQLLNGSSSADAAASPFVIAIRVAGVKGLPSVMNVVIMISVLSVGNAAVYGFSRTIAAMGESGQAPKIFAYIDREGRPIFGILVVLAFGLFSFIAAAGAETRNEVFNWLLALSGLSSVFIWGSICAAHIRFRMALKYRGRGTDELSFVAGFGVWGSVIGVVLNCLVLMAQFWIALYPLGVKTPNASDFFQAYLAAPVILGFWIFWKIWKRDGLFLLLKDLDIDTGRREPDLERVKAEMAEERYALSQKNFMYRLYNFWC

SEQ ID NO: 3973 - protein, 468 aa, Triticum aestivum
  misc_feature (267)..(267): Xaa can be any naturally occurring amino acid
  misc_feature (297)..(297): Xaa can be any naturally occurring amino acid
MGGGHSRSESREGSGNGRYAHSASFQQPAAPHWGPPGAGGYPYGAGQDAQGGYYGAPPQQGGYAAPYPAYQPAPAAAQPPPARAGGANKPRLDRRYSRIADDFRSVEQVTDALAQAGLESSNLIVGIDFTKSNEWTGKFSFHGRSLHHISNVPNPYEQGISILGQTLSKFDEDNLIPCFGFGDASTHDQDVFCFYPDERPCNGFSEALERYRELVPHLRLAGPTSFAPIIEMAMTIVEQSGGQYHVLLIIADGQVTRSVDTASGPAXGSQEQKTVDAIVRASELPLSIVLVGVGDGXPWDMMKEFDDNIPARAFDNFQFVNFSEIMSKNMPQSRKEAAFALSALMEIPQQYKATVELGILGRRSMKAPERVPLPPPGGSHDAYSYGSKSFSKPQPSTSSSAYPPYETAHTAAPAAPSSAYDNQVCPICLVNPKDMAFGCGHQTCCECGQTLESCPICRSPITTRIKLY

SEQ ID NO: 3974 - protein, 927 aa, Debaryomyces hansenii CBS767
MKSDFKFSNLLGTVYRQGNLVYTEDGTKLLSPVGNRVSCFDLINNKSFTFNYEHRRNISRIALNKQGTLLLSVDETGRAILVNFVSRTVLHHFNFKDKVLDLQFSPDGHYFAIACNRFIQVWKTPDFTEDRQFAPFVRHRVYAGHYSDVTSVTWSNDSRFFISTSKDMTSRIFSLLSKEKEVAMTLAGHRDYVIKAFFNETQEIIYTISKDGALFQWEYTERPSDESDEEEEESDSDSEMNDDVVKNKKPMSWRITAKNFFHSNANVKCATFHAKSNLLIVGFTNGEFRLYDLPEFNMIQQLSMGQNAVNTVNINKTGEWLAFGSSKLGQLLVYEWQSESYILKQQGHFDSMNALCYSPDGSRIVTASDDGKIKIWDVASGFCLMTFQEHTSSVTAVQFAKKGQVLFSSSLDGTIRAWDLIRFRNFRTFTATERVQFNSLAVDPSGEVVVAGSQDTFEIYVWSVQTAQLLDSLTGHEGPISCLAFGTENSVLASASWDKTIRVWNIFSRSQQVEPIEIQSDVLSIALRPDSKEVAVTTLDGHITIWDVEDAKQVHLIDGKKDIIGGRYLEDRFSAKNLARSKYFTTLNYSFDGLSLVAAGNNNSICLYDISNEVLLKRFTVSQNMQLNGTLGMLNSSRMTEAGSLDLIDRDGENSDLEDRIDTSLPGSHKGDPSARNIRPEIRVTSISFSPTLSAFSAASTEGLLVYSVDNTLIFDPFDLDIDITPEATIETLNEKDYLTALVMAFRLNENYLIHKVYESIPIKDIKLVTNDLPIVYLDRMLQFVGKLSLNSPHLEFNLLWIQNLLTSHGKYINNNKSDFTSSLRLLQRFLARIAKDVVSISKKNGYAYSFLTTKPDIQDAEVEAEDESEEFETAQNIQIDGSDDENGIIEDEDDEGWFGIEEKNTKSDVFNSNESDSDSDSDESME

SEQ ID NO: 3975 - protein, 149 aa, Glycine max
MAEQTFIMIKPDGVQRGLIGEIISRFERKGFYLKGLKLVTVDRPFAEKHYADLSAKPFFSGLVDYIVSGPVVAMIWEGKNVVTTGRKIIGATNPAQSEPGTIRGDFAIDIGRNVIHGSDSVESANKEIALWFPEGPANWQSSQHSWIYE

SEQ ID NO: 3976 - protein, 494 aa, Glycine max
MTRGIKHRQKAKSKKKGSKKEGGSSSSLAPEIPAKVWQPGVDKLEEGEELQCDPSAYNSLHAFHIGWPCLSFDILRDSLGLVRTEFPHTVYFMAGTQAEKPSWNSIGIFKVSNITGKRREPVPKLGTDDTEMDGEDSDSDDDSEEEDEGGAQGPSLQETSSSFEFLLFDLLTASNLILRKVAHQGCVNRIRSMPQNPHICAAWADTGHVQVWDLNSHLNVLAETETEGVQGVAAVFNQDGWEKTTHRDEGYAIDWSPLVPGRLASGDCNNCIYLWEPTSAGTWNVDNAPFTGHTASVEDLQWSPTEPDVFASCSVDGNIAIWDTRLGKSPAASFKAHNADVNVMSWNRLASCMLASGSDDGTISIRDLRLLKEGDSVVAHFEYHKHPITSIEWSPHEASSLAVSSSDNQLTIWDLSLEKDEEEEAEFKAKTKEQVNAPEDLPPQLLFIHQGQKDLKELHWHAQIPGMIVSTAADGFNILMPSNIQSTLPSDGAV

SEQ ID NO: 3977 - protein, 477 aa, Mesorhizobium loti MAFF303099
MSHNLQFYVDGAWVDPVVPNTLDVIDPSNEDAFAQISLGSKADVDKAVAAAKRAFNSFGFTSVEERLDILNRVIEVYKKRSKDLALAVSREMGAPRQMALDSQVGVGLAHLEKMAEVLRTFQFRHVKGSALIVKEPIGVVGLITPWNWPLNQITCKVGPALAAGCTMVLKPSEIAPLDAIIFAEIIDEAGVPKGVFNLVNGDGPGVGQALSSHPDVDMMSFTGSTRAGILVAKAAADTVKRVHQELGGKSANILFPDVDLARAVTKGVAGCFGNSGQSCNAPTRMFVPRDRHDEAAGYAKAAAEKFVVGPADGANTKLGPVVSQMQFDKIQDLIQAGIDEGATLVAGGPGRPAELNRGYYVRPTVFADVTHDMRIAREEIFGPVLAILPYDTVEKAVEQANDTVYGLASYIQAKDIQKARDVAARMRSGNVYINYPAWDAGLPFGGYKQSGNGREYAEYGLEDFLEIKGIAGYEAAE

SEQ ID NO: 3978 - protein, 400 aa, Bacillus cereus
AGDAMARYKRMQGYNVHYLTGTDEHGQKIQKKAEELNVTPQAYVDNIVAGIKELWEKMDISYDDFIRTTEDRHKDVVEKIFKQLVDQGDIYLDEYEGWYSVQDETFYTEHQLVDPIMEGDKVVGGKSPDSGHDVELVREESYFFRMGKYVDRLLKFYEENPHFIQPESRKNEMINNFIKPGLEDLAVSRTSFDWGVRVPGNPKHVIYVWVDALSNYITALGYGTENEEMYKKFWPADVHLVGKEIVRFHTIYWPIILMALDLPLPKKVFAHGWILMKDGKMSKSKGNVVDPVTLIDRYGLDALRYYLLREVPFGSDGVFTPEGFVERINFDLANDLGNLLNRTVAMIDKYFNGEIPAFKENVTEFDETLVTFAKDTLKKVEEAMENMEFSVALSSIWQLV

SEQ ID NO: 3979 - protein, 416 aa, Bacillus cereus
HIGHAYTTVAGDAMARYKRMQGYNVHYLTGTDEHGQKIQKKAEELNVTPQAYVDNIVAGIKELWEKMDISYDDFIRTTEDRHKDVVEKIFKQLVDQGDIYLDEYEGWYSVQDETFYTEHQLVDPIMEGDKVVGGKSPDSGHDVELVREESYFFRMGKYVDRLLKFYEENPHFIQPESRKNEMINNFIKPGLEDLAVSRTSFDWGVRVPGNPKHVIYVWVDALSNYITALGYGTENEEMYKKFWPADVHLVGKEIVRFHTIYWPIILMALDLPLPKKVFAHGWILMKDGKMSKSKGNVVDPVTLIDRYGLDALRYYLLREVPFGSDGVFTPEGFVERINFDLANDLGNLLNRTVAMIDKYFNGEIPAFKENVTEFDETLVTFAKDTLKKVEEAMENMEFSVALSSIWQLVSRTNKYI

SEQ ID NO: 3980 - protein, 365 aa, Triticum aestivum
LIFLAHKYWKTRITIDAVEKFLQMQQMIGPTRYAYTDIVAVTSHFRDKLGQGGYGSVFKGVLLPGNVNIAVKMLEGSSNCNGEDFISEVSTIGRIHHVNVVRLVGFCSEEMRRALVYEYMPGGSLDKYIFSADKSISWDKLNEIALGIARGINYLHQGCEMQILHFDIKPHNILLDSNFVPKVADFGLAKLYPRDNSFVPSNALRGTVGYIAPEMISRSFGTISSKSDVYSFGMLLLEMAGGRRNADPNAANSSQSYYPSWVYDKLTAQEADAISLVADMHELERKLCIVGLWCIQMKSHDRPTMSEVIEMLEGGFDGLQMPSRPFFCDDEHTAVPDSYPLLSELTEISAEDEISDFYVPGPRAL

SEQ ID NO: 3981 - protein, 96 aa, Neorickettsia sennetsu str. Miyayama
MSIENKKAIIYRPSKAATQSGYGDQKWVLRFCSEEPKYVEPLMGWVGSRDTITQLVLKFDSREVAEAYAKKNGIDYTVVMPQQAKVKPKSYADNFQ

SEQ ID NO: 3982 - protein, 198 aa, Picea mariana
MSTCKFIKCVTVGDGAVGKTCMLISYTSNTFPTDYVPTVFDNFSANVVVDGNTVNLGLWDTAGQEDYNRLRPLSYRGADVFILAFSLISKASYENIMKKWLLELRHFAPGVPIVLVGTKLDLRDDKQFFTDHPSAVPITTAQGEELKKQIGAAAYIECSSKTQQNIKAVFDSAIRVVLQPPKVKRKKKRKSHKTCSIL

SEQ ID NO: 3983 - protein, 457 aa, Neorickettsia sennetsu str. Miyayama
MYDVIVVGGGPAGYPAAIRASRSGLKVALVEKNKLGGVCLNCGCIPTKALLHIAEKYHFVKTGAAELGINVSNVFLTFSSAIAYAQEKIKKLAAGVSYLMKKNKVELFYSSGRILPGKQVKLEDLGKTISAKNIILATGSTPKEITGLEYDHELIWNYNDAMTATKMPKSLLVVGAGAIGVEFACIYNVFGSKVTVIEMQNQILPAEDTEISNLAEAAFKESGITIRKGTTIQSLKKDKDKVLVTLSDGTNLEVERILVAGGVEASSQNLGLEQIPTIRMNKGFVSVDKYCETGEPGVYAIGDLRGFPCVAHKAIYDAYVCTAKIAGKEPVPLEMDSIPSCIYSFPSIASVGLTEEAAIRMGHKVKIGRAKAEGNGKSVVLGKDKGLVKTVFDAKTGELLGAHIIGYEATEILNGYIIAKASEATVESLKAVVFPHPTISEMMYEAVLAADNEEVHS

SEQ ID NO: 3984 - protein, 136 aa, Salmonella enterica
MPKPMFGDTGSGMHCHMSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLVGINNKIHPGEA

SEQ ID NO: 3985 - protein, 325 aa, Ustilago maydis 521
MSAENPTILPATNGNSAAAAPARTNGSVPKSDANLGTFGVKSGLAQMLKGGVIMDVVNAEQARIAEDAGACAVMALEKIPADIRVEGGVARMSDPAMIKEIQETTTVPCMAKVRIGHIVEAQILQAIGVDYIDESEVLTPADDQHHINKHNFKVPFVCGAKNLGEALRRISEGAAMIRTKGEAGTGNVVEAVRHQRTIQGEIKRVSSMSDEELYAYAKDIQAPFHLLKETARLKRLPVVNFAAGGIATPADAALMMQLGSDGVFVGSGIFKGNNPAQRARAIVEAVTHYNDPAKLAAVSENLGEAMVGLNITKDIKGGRLADRGW

SEQ ID NO: 3986 - protein, 126 aa, Salmonella enterica
MPKPMFGDNGSGMHCHMSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDG

SEQ ID NO: 3987 - protein, 399 aa, Bacillus cereus G9241
MTYTLATRMKAFQSSIFSELGAYKKEKIAAGHKMIDLSIGNPDMPPADFVREEMVHTANQKESYGYTLSGIQEFHEAVTEYYNNTHNVILNADKEVLLLMGSQDGLVHLPMVYANPGDIILVPDPGYTAYETGIQMAGATSYYMPLKKDNDFLPNLELIPEEIADQAKMMILNFPGNPVPAMAHEDFFKEVIAFAKKHNIIVVHDFAYAEFYFDGNKPISFLSVPGAKEVGVEINSLSKSYSLAGSRIGYMIGNEEIVGALTQFKSNTDYGVFLPIQKAASAALRNGAAFCEKNRAIYQERRDTLVDGFRTFGWNVDKPAGSMFVWAEIPKGWTSIDFAYALMDRANIVVTPGHAFGPHGEGFVRIALVQDKEVLQQVVENIRNSGIFALEKVDELVKN

SEQ ID NO: 3988 - protein, 250 aa, Prochlorococcus marinus str. NATL1A
MSIFVGNLPFRAEQEDVMELFSPFGEVSNCSLPLERDTGRKRGFAFVEMADEAVEASAIESLQGAELMGRPLRINKAEPRGSAPRRGGYGGGGGGGYGGGGYGGGGQGGYGGGGQGGYGGGGQGGYGGGGQGGYGGGGQGGYGGGGQGGYGGGGQGGYGGGGQGGYGGGGQGGYGGGGQGGYGGGGYGGGGQADQSAQDRPSGAKGWEDRSHGNASQDVNDFDQGRSRRRRGASPEGGADSTADYGGAES

SEQ ID NO: 3989 - protein, 664 aa, Arabidopsis thaliana
MAGPLLRSLWSNTTRRSFSSHSSPSKFGYSLSSLRSFSAATASTAAAGAPNSSLDPNRLRNVAVIAHVDHGKTTLMDRLLRQCGADIPHERAMDSINLERERGITISSKVTSIFWKDNELNMVDTPGHADFGGEVERVVGMVEGAILVVDAGEGPLAQTKFVLAKALKYGLRPILLLNKVDRPSERCDEVESLVFDLFANCGATEEQLDFPVLYASAKEGWASSTYTKDPPVDAKNMADLLDAVVRHVQPPKANLDEPFLMLVSMMEKDFYLGRILTGRVTSGVVRVGDRVNGLRKTDSGSEKIEEAKVVKLMKKKGTTIVSIDAAGAGDIICMAGLTAPSIGHTVASAEVTTALPTVELDPPTISMTFGVNDSPLAGQDGTHLTGGRIGDRLMAEAETNLAINVIPGLSESYEVQGRGELQLGILIENMRREGFELSVSPPKVMYKTEKGQKLEPIEEVTIEINDEHVGLVMEALSHRRAEVIDMGPVPGNEGRTRLSLTCPSRGLVGYRCVFSSDTRGTGFMHRAFLTYEKYRGPLGNVRKGVLVSMARGTITAHSLMSLEARGILFVSPGLDSYDGMIIGEHSRETDLDLNPVKAKELTNIRSAGKDENVKLSPPRLMTLEEAIGYVASDELIEVTPKTIRLRKRCLDVNKRKSQSKRAKD

SEQ ID NO: 3990 - protein, 320 aa, Photobacterium sp. SKA34
MIKKIGVLTSGGDAPGMNAAVRGVVRAALTEGLEVYGIYDGYQGLYNNCIEKLDRQSVSDVINKGGTFLGSARFPEFREVEVREKAIENLKLYGIDALVVIGGDGSYMGAKKLTEMGYPCIGLPGTIDNDVAGTDYTIGYMTAMNTVIDAIDRLRDTSSSHQRISIVEVMGRHCGDLTLMSAIAGGCEYIITPETGLDKEKLLQHIREGIAKGKKHAIIAITELMTDVNELAKFIEAETGRETRATVLGHIQRGGQPTAFDRVLASRMGAYAVDLLQKGEGGRCVGIQCEQLVHHDIIDAIENMRRPVRNDLYELAEKLF

SEQ ID NO: 3991 - protein, 256 aa, Photobacterium sp. SKA34
MRHPVVMGNWKLNGSKEMVSGLIKGLDAALNGVEGVDVAIAPPVMYLDLAEQLLNKADSKIILGSQNVDLHNNGAFTGDISPAMLKEFGASHIIIGHSERREYHHESDEFVAQKFAFLKENGLTPVLCIGESEAQNEAGETVAVCARQLDAVINTQGVDALNGAIIAYEPIWAIGTGKAATADDAQRIHAAIRAHIAEKSEEVAKNVVIQYGGSVKPENAASYFAQPDIDGALVGGAALDAESFAAIAKAAAEAKN

SEQ ID NO: 3992 - protein, 164 aa, Triticum aestivum
  misc_feature (116)..(116): Xaa can be any naturally occurring amino acid
MAPAVMASSATTVAPFQGLKSTAGLPVSRRSGSAGLSSVSNGGRIRCMQVWPIEGIKKFETLSYLPPLSTEALLKQVDYLIRSKWVPCLEFSKVGFVFREHNSSPGYYDGRYWTIXGKLPMFGCTERKRKCSTSGGKKIPDPIRSLDTSVMLAQCGTSCIGRQN

SEQ ID NO: 3993 - protein, 376 aa, Prochlorococcus marinus str. NATL1A
MADFYDLLGVSRDADADTLKRAYRQQARKYHPDVNKEAGAEDKFKEIGKAYEVLSDSQKRARYDQFGEAGIGGAAGMPDMGDMGGFADLFDTFFNGFGGASSAGGSRPQRRGPQQGDDLRYDLTIDFDKAIFGQEKEITVPHLETCDVCRGTGAKKGTGPVTCSTCSGAGQVRRATRTPFGSFTQVAECPTCGGTGQVIKDPCNACGGKGVKQVRKKLKINIPAGVDSGTRLRVSGEGNAGLKGGPSGDLYVFLKVKNHPNLKRDGLTILSEVNISYLQAILGDTIEIETVDGPTKLQIPAGTQPNSILNLENKGVPKLGNPVARGNHQVSVKIKLPTKLSDSERNLLEELAGHYSALGPQHHYHKSGLFSKLFGK

SEQ ID NO: 3994 - protein, 1016 aa, Desulfitobacterium hafniense Y51
  misc_feature (191)..(191): Xaa can be any naturally occurring amino acid
MEVTRRGFLKLSGASLFALASGLGFDPQIAQAQGFSLRIEGTTKIPSICHFCSGGCGLLLHIKDEKLVYLDGDPDNPVNSGALCPKGASLGHVANAKDRVTKPRYRAPGSSDWQDISWDEAINKIASKIKEVRDTTWMATEEIGGTAYNVNRADGIAVLGSAEVDNEESYLIKKLSELIGTPYNEHQARIXHAPTVASLSPSFGRGAMTNSWTDMQNTKCFLIAGSNCAENHPIAMRWINKAKENGAKVIVVDPRFTRTASQADIFAQVRPGADIAYLNAIINYILENKLYDQDYVLNHTNGLYKISKDFKFADGLFSGFDPETKKYNFDSWAYQLDAENKPVKAESLDDPDCVFGKLKEHFSRYTLEVGADISGIPAEKIKEIADTFCNTRPGSILYALGMTQHTTGVQGIRSYAIIQLLLGNVGKAGSGIQALRGEPNVQGSTDMANLFNNLPGYLPAPVHTDKDLRSYLVRSGSAFERHIVSQLKAWFGENATKENDYCFNYLPKYNSGKNYSMVKLWEAANNGQFKMLLNFGSNSMVSIPNRQIVREGLAKLDMLVIADVYEVETAQFWREKDPTTGELLVDPAKINTEVILLPAAFVYEKGGTLSNSGRWIQWKDAALKPPGEAKPDLDILDHIYHKLKELYAGSTDPKDEPILKARWDYGHEPDPLKVLQEISGYDETTGKVLPTLADYLKAPIGSASSGCWIYAGVTGNGNLAARRDNSDPSGLGLYRNWSFSWPGNIRILYNRGSCDMNGQPLDENRKLIWWDAAKNSWEGNDGADVPDKTKGPDTPEGKQVFRMNPEGVGRLFTAKYFSGIPATPAADGLPHIGVRPAGQCNDGPLPEFYEPVESPTVNSLHPDVSSNPTVPIPNFLPGVTNHGSKEDFPYVLTTYALVEHFCAGGITRNIPMLNELMPQPFAEISKNLAQKIGVKEGDMVEVSSARGKVQVVALVTDRIQTLKINGQDSETIGMPWSWGFASLSPGPTTNNLTISAIDPTAGTPEYKCCLVNIRRA

SEQ ID NO: 3995 - protein, 386 aa, Dechloromonas aromatica RCB
MYRPARRLADIEPFHVVELLTRARQLEAEGRDIIHMEVGEPDFPTPEPIANSAINAIKSGKTLYTQALGLPELREAISQFYGQRYGASVPASRIAVTNGASGALNLAFACLADPGSEWLLTDPGYPCNRHILRAYEGCPQNIPVGPDTNFQPTPELLRRHWKSTTAGLLVASPANPTGTLLTLPEIAGLSEVCREKNGHFLVDEIYHGLTYEIDAPTACAAGEDIWVINSFSKYFQMTGWRLGWMVIPEAYVRDVEKLAQNLTLCPSTPAQHAALAAFEPETIAILESRRSEFRRRRDFLAPALEAIGFRITARPEGAFYLYCDCSALADDSFALAKDLLEKTGVAATPGLDFGSNQPEKHIRFAYTTGVERLAEAVERLSRYFGR

SEQ ID NO: 3996 - protein, 666 aa, Chlamydia muridarum Nigg
MAGNSELDIDILEKIAGTIKQLSIESIQKASSGHPGMPLGCAEIAAYLYGCVLRYNSKDSQWMNRDRFVLSAGHGSALLYSCLHLAGFNVRLEDLQQFRQLHSQTPGHPEFRETDGVEATTGPLGQGIGNAVGMALSLKMLGSRFNQSSTSIFDAKVYCLAGDGCFMEGVSHEACSFAGSLGLDNLILIYDYNEIILDGTLQDVSVEDTKQRFLAYGWDVFEANGHDFEDLHRVFSQIKKGQQKPTLIIAHTIIGHGSPKEGTNKAHGSPLGEDGVAQTKSFWHLPEEKFFVPSSVKMFFAAKQQEGQKLQEEWQERFRVWSKRFPEQHQEYLKLTQEISIQDLEVLLNLIDMPESIAGRAASNKVIQVLAENIPSLIGGSADLSSSDGTWIAKETAVNASHFQGRNIRYGVREFGMGTIMNGLAYSQVFRPFGGTFLVFSDYLRAAIRLAALSKLPVIYQFTHDSIFVGEDGPTHQPIEQIMSLRAIPGLRVVRPADAHEVKGAWLSALENSGPTALILSRQNLPTLKETKRSFRDGVGRGAYILVKEEGGSPDYTLCASGSEVHLAMEVAQSLMALDKRVRVISFPCWELFERQDPEYRESVIGGDLGLRVSIEAGSALGWYKYIGSNGLSIAMDVFGMSGAPHEVAETCGFTVDSIVQRILSV

SEQ ID NO: 3997 - protein, 149 aa, Brassica napus
MASGGGGGYGDPSQKIDYVFKVVLIGDSAVGKSQILARYARDEFSLDSKATIGVEFQTRTLVIDHKSVKAQIWDTAGQERYRAVTSAYYRGAVGAMLVYDITRRQTFDHIPRWLEELRAHADKNIVIILIGNKSDLEDQRAIPTEDAKE

SEQ ID NO: 3998 - protein, 1306 aa, Mycobacterium bovis AF2122/97
MSFVIATPEMLTTAATDLAKIGSTITAANTAAAAVAKVLPASADEVSVAVAALFGTHAQEYQTVSAQVATFHDRFVQTLSAAASSYVAAEAVNVEQSLLAAVNAPTQALFGRPLIGNGADGSPGTGQAGGPGGILYGNGGNGGSGAPGQRGGAGGAAGLIGNGGNGGAGGVGTTGGAGGHGGAGGWLYGNGGAGGFGGAGAVGGNGGAGGTAGLFGVGGAGGAGGNGIAGVTGTSASTPGGSGTAGGAGGIGGNGGAGGAGGVLMGNGGNGGAGGEGGPGGAGGAGASGAHATNLGADGQAGGNGGNGGAGGTGGVGGPGGGHGLLGLGGSHGAGGAGGSGGDGGAPGDGGNGATGTWGHNLGAGGTGGNGGNPGAGGAGGAGGASVGGSAHGANGAPGTTSTSGGNGGDGGKGADAISSGQTGANGGRGGDGGQVGNGGAGGAGGRGGAGGLGFGSEAPGRPGGAGGTGGAGGNGGTQAGDGGTGGAGGAGGDGGSGGAGSIGFNASAPGAAGSPGGNGGNGGPGGAGGEGGAGGLALAASGQNGSQGAGGDGGAGGNGGTPGNGGHGAAGALGVNGGVGGAGGHGGDPGVGGAGGQGGSGSTPGANGAPGNTPTSGGNGGNGGRGADATGFGQTGASGGRGGDGGLVGNGGAGGAGGNGSKGLPGLGRLGNPGLDGGTGGNGGAGGSGGAWAGNGGTGGAGGTGGVGGTGGSGSDGVNGSSAGADGHPGGTGGVGGTGGKGGDGGDGGAAPNGVAGSQGPGGAGGDGGTGGVGGNGGRGIDGADGATAGARGQDGGAGGAGGKGGRGGTGGPGGAGPAGTTGSQGAGGNGGSGGTGGDPGDGGNGANGSVFTNNGIGGNGGNGGNAGPSGAGGSGGAGSTFGATGSSSSIHVNGGNGGNGGNGDHALSGNGAAGGNGGNGGNGSLRGSGGAGGHGGNGGNASRGMGGDGGTGGAGGNAGQIGNGGAGGNGGDGGTGSDGNPGAITGSGGRGGDGGVGGQGGSVAGDGADGGRGGAGGTGGTGLRGTTGATGATGTFDAGADGHGGNGGTGGVGGTGGAGGGGGNGGAGGKALSPTGNNGSQGAGGDGGAGGTGGTGGTGGDGGRGAHGTLFSSLAGTGGTGGNGGTGGTGGTGGAGGAGGTGSTLGATGATGAAGRAGNGGVGGSGGLGSAFGPGGTGGMGGAGGTSTVSAGGDGGRGGFGGDGLDASSGGNGGDGGHGGDGFRTAGAGGRGGDGGKGADPGGLFPIPGAGGKGGTGGTGGTAHLGPLAIIGQSGQPGQFGSPGADGRGGAGGAGGGGGAGGSF

SEQ ID NO: 3999 - protein, 759 aa, Dechloromonas aromatica RCB
MDSRQLREAALYYHREPKPGKIAVTPIKQLTNQYDLSMAYSPGVAFACEEIVADPREASTLTSRANLVGVITNGTAVLGLGAIGPLAAKPVMEGKGVLFKKFANIDVFDIEIEERDPDKLIDTIASLEPTFGGINLEDIKAPECFYIEKKLRERMKIPVFHDDQHGTAIVVGAAILNGLHLIGKDLAKVKIVTSGAGAAALACLDLLVMLGAPPSNIWVTDIKGLVYEGRVEEMDEIKARYAKVTDARTLGEVIADADVFLGLSAGGVLKPEMVAKMASNPLIMALANPTPEITPELVKSVRNDAIICTGRSDYPNQVNNVLCFPFIFRGALDVGATTITEEMKMAAVKAIAELARAEQSEVAARAYGEKVASFGPEYLIPNPFDPRLIVKIAPAVAKAGMDSGVATRPIKDWDAYIQGLNEFVYHSGMIMKPVFSQAKMAPKRIVFAEGEDERVLRAVQVVRDEGIAWPILIGRHAEINRRIEVAGLRIREGEDFEVVHSDNSAFFDEHYEEFWQTYHGLMERKGVSPDYARREVRRRNTLYGALMVRLGYADGLICGTFGRHETHREYVQSVIGTRADHDRYYAMNLLMLPERTVFIGDTYVNYDPTAEQLADMTLLAAEEIRNFGIVPKVALLSHSTFGTEDTPTSVKMRDVLAQLKQRAPDLEVEGEMHGDAALDEQIRKAAFPNSRLKGQANLLVMPTLDAANISFNLLKVAAGDNLTIGPILLGAAKPVNILTPTATVRRIVNMTALTVVDAV

SEQ ID NO: 4000 - protein, 227 aa, Picea mariana
AILIDWLIEVHLKFELMPETLYLTVNIIDRYLSIEIVTRKNLQLVGITAMLLACKYEEIWAPEINDFVCISAKEYASEQLVAMEHTILNQLKFNLTVPTPYVFLVRFLKAAGSDKEMENLAFFLVDLSLLHYIMIKYSPSMLAAAAVYTAQCTLKKSSPWSKTLILHTGYSEADLKECAHFMVNFHLNAGGSKLRVVHKKYSDPFFGCVAFLSPANLPVDDSCSSSN

SEQ ID NO: 4001 - protein, 284 aa, Picea mariana
KKAAGSSYQSESFGGRAIKSLARSINGNVCVKTGGLMQSDICRLRAVAEDGGLGVGEEEEGNDFPPDSQQPRILSVLSYALRRLVTRNDQFTPKNFVTVFHGVRTPGISIAKYLERVYKYTSCSPSCFVVAYIYIDRLVHRQPNFPVISLNIHRLLLTSLMIAAKMLDDAHYNNAFYARVGGVSIAELNRLEVDFLFRLDFRLKVTASVFESYCLHLEKEMLCGASGQRIDRTLPGFHRSTDVVSSDLDIVIREESKVQVSVRCPRCSPATTMVVGDHPDPPGR

SEQ ID NO: 4002 - protein, 404 aa, Cryptococcus neoformans var. neoformans B-3501A
MVKITFKTVQNKLFTVDAQDSDTVADLKKKIQETQTFPVENQKLIYSGKILNDASSVESLKIKEKDFLVVMVSRATPAATPAAPATPAPSTPAPAPAASEQASVANPAVPAPSAPAAESAPASAPAPAAESAQPSAVESGLGGSFVTGPALQAAIDGMVEMGFERDQVIRALRASFNNPDRAVEYLMSGNIPSVEGTAPAAPAPAAPSTPSAAAAPAQPAAPSEPAAQPVASAPPASAGGSADNLFAAAEAAMNRDRGVPAAAGAPGLPGAPGLPGAGAGMPGGMGGGDQLSAIRQMVQQNPAMIQPLLQQIATEHPELAQLIAQNPEALYELLGGGGGEGDDDDEFGEGPVMRVNLTQEEAAAVERLEALGFDRQTVLQAYMLCDKNEELAANFLFENMEEDQ

SEQ ID NO: 4003 - protein, 138 aa, Salmonella enterica
LGDNGSGMHCHMSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGIKNKIHPGEAMDKNLYD

SEQ ID NO: 4004 - protein, 469 aa, Arabidopsis thaliana
MSSRSDLKIKRVSLIIFLLSVLVEFCYGGFTSEYVRGSDLPDDMPLDSDVFEVPPGPNSPQQVHVTQGNHEGNGVIISWVTPVKPGSKTVQYWCENEKSRKQAEATVNTYRFFNYTSGYIHHCLIDDLEFDTKYYYEIGSGKWSRRFWFFIPPKSGPDVPYTFGLIGDLGQTYDSNSTLSHYEMNPGKGQAVLFVGDLSYADRYPNHDNNRWDTWGRFVERSVAYQPWIWTAGNHEIDFVPDIGEIEPFKPFMNRYHTPHKASGSISPLWYSIKRASAYIIVMSCYSSYGIYTPQYKWLEKELQGVNRTETPWLIVLVHSPFYSSYVHHYMEGETLRVMYEQWFVKYKVDVVFAGHVHAYERSERVSNIAYNIVNGLCEPISDESAPIYITIGDGGNSEGLLTDMMQPQPKYSAFREASFGHGLLEIKNRTHAYFSWNRNQDGNAVAADSVWLLNRFWRAQKKTWLDAF

SEQ ID NO: 4005 - protein, 122 aa, Salmonella enterica
GMHCHMSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGIKNKIHP

SEQ ID NO: 4006 - protein, 662 aa, Clostridium tetani E88
MNKLDTTAINTIRILSAEAIQKSNSGHPGLPLGSAPMAYTLWAKNMKHNPKNPNWTNRDRFVLSAGHGSMLIYSLLHLFNYGLTMEDLKDFRQWGSKTPGHPEYGHTIGVETTTGPLGQGIANAVGMAMAEAYLAEKFNKPGCELIDHYTYSLVGDGCLMEGISSEAASLAGTLGLDKLIVLYDSNNITIEGNTDIAFTEDVKGRFEAYNWQVINVEDGNDVEAIDKAIKEAKSDKKRPSIIIIKTQIGYGCPAKQGKSSAHGEPLGEENLKITREFLKWGHEEEFFVPEEVREYMKEKVEELSKEEEEWNKLKEEYDNKYPELAKEWELWFSGKIEKDLLNDEDFWKFEKKTATRAASGDVINRLAAVVPNLIGGSADLAPSNKTYMKDKGDFSKEDRKGANLHFGVREHAMAAIANGMYLHGGLKVFVSTFFVFSDYMKPSMRLSALMNLPITYVLTHDSIGVGEDGPTHEPIEQLASLRSIPNMTVFRPADAKETAAAWYYAITKEDGPVSLVLSRQNLPLYNETGKDALKGAYILKDTEDKKPDIILMATGSEVELIYEGAKILEEKGIKVRVVSMPSLEVFEKQSKEYKEEVLPSNVTKRLAVEAASSFGWHKYLGFDGDILSIDHFGASAPGDVLFKEFGFTIENLVKKAEEVLNK

SEQ ID NO: 4007 - protein, 338 aa, Neisseria gonorrhoeae FA 1090
MKAMVYHGANDIRFEEKPRPQIIDPTDAVVKIVKTTICGTDLGIWKGKNPEVADGRILGHEGIGIVEEVGEAVKNIKVGDKVIISCVSKCCTCDNCKIQLYSHCRNGGWILGYMIDGTQAEYVRTPYADNSLVPPHDNVNEEIALLLSDALPTAHEIGVQYGDVKPGDTVFIAGAGPVGMSALLTAQLYSPAAIIVCDMDENRLKPAKELGATHTISPASGDVSKQVFAIVGEDGVDCAIEAVGIPATWNMCQDIVKPGGHIAVVGVHGQSVDFKLEKLWIKNLAITTGLVNANTTEILMKAIFSSSVDYTKMLTHRFKFSQLEKPTTCSNTPPKTKR

SEQ ID NO: 4008 - protein, 125 aa, Salmonella enterica
MSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGIKNKIHPGEAMDKNL

SEQ ID NO: 4009 - protein, 118 aa, Salmonella enterica
GSGMHCHMSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGI

SEQ ID NO: 4010 - protein, 328 aa, Neisseria gonorrhoeae FA 1090
MSSTPNKHADYPRLVADIGGTNARFALETAPCVIEKVAVLPCKEYDTVTDAVRAYLNQSGATGVRHAAFAIANPILGDWVQMTNHHWAFSIETTRQALGLDTLILLNDFTAQALAVTQTSSKDLMQVGGQKPVEFAPKAVIGPGTGLGVSGLVHSPAGWVALAGEGGHTSFPPFDDMEVLIWQYAKNKYRHVSAERFLSGAGLSLIYETLAVKQKAEPAKLMPSEITEKALNCESPLCRQALDIFCAMLGTVASNLALTLGARGGVYLCGGIIPRMLDYFKTSPFRSRFENKGRFEAYLAAIPVYVVLSEFPGIAGAAAALGNHLKNV

SEQ ID NO: 4011 - protein, 482 aa, Clostridium perfringens str. 13
MNTKENIFYNFMGGNFYENKSDKLIDIKSPLDGSLVGRIQSLSKEDVDKIIDNAEKAQKSWNEVPLNERAHVLYKTADLLEEHKEELANIMIREVAKDKKSALSEVSRTADYIRFTADAAKSMDGESIPSDNFPGFNRSKISVVTREPLGVVLAISPFNYPVNLSASKIAPAIVAGNSVVLKPATQGSLSALFLAKMFHDAGLPGGVLNTVTGRGSEIGDYCVTHDKIDFINFTGSTEVGRRISEITVMKPLLMELGGKDAAIVLEDADLDLTVNNIIAGGYSYSGQRCTAVKRILVMNSVADKLVEKLKEKISKLKMGNPLEVEDVTIVPLIDNKAADFVMELIDDAKEKGATLVCGGHREGNLIEATLFDNVTTDMRLAWEEPFGPVLPIIRINDKDEAIKIANASKYGLQSSVFTRDINEAFYIANKLEVGTVHVNNKTERGPDHFPFLGVKSSGMGTQGIRYSIEAMSRPKATVITIR

SEQ ID NO: 4012 - protein, 715 aa, Escherichia coli O157:H7 EDL933
  misc_feature (140)..(140): Xaa can be any naturally occurring amino acid
MKKVVTVCPYCASGCKINLVVDNGKIVRAEAAQGKTNQGTLCLKGYYGWDFINDTQILTPRLKTPMIRRQRGGKLEPVSWDEALNYVAERLSAIKEKYGPDAIQTTGSSRGTGNETNYVMQKFARAVIGTNNVDCCARVXHGPSVAGLHQSVGNGAMSNAINEIDNTDLVFVFGYNPADSHPIVANHVINAKRNGAKIIVCDPRKIETARIADMHIALKNGSNIALLNAMGHVIIEENLYDKAFVASRTEGFEEYRKIVEGYTPESVEDITGVSASEIRQAARMYAQAKSAAILWGMGVTQFYQGVETVRSLTSLAMLTGNLGKPHAGVNPVRGQNNVQGACDMGALPDTYPGYQYVKDPANREKFAKAWGVESLPAHTGYRISELPHRAAHGEVRAAYIMGEDPLQTDAELSAVRKAFEDLELVIVQDIFMTKTASAADVILPSTSWGEHEGVFTAADRGFQRFFKAVEPKWDLKTDWQIISEIATRMGYPMHYNNTQEIWDELRHLCPDFYGATYEKMGELGFIQWPCRDTSDADQGTSYLFKEKFDTPNGLAQFFTCDWVAPIDKLTDEYPMVLSTVREVGHYSCRSMTGNCAALAALADEPGYAQINTEDAKRLSIEDEALVWVHSRKGKIITRAQVSDRPNKGAIYMTYQWWIGACNELVTENLSPITKTPEYKYCAVRVEPIADQRAAEQYVIDEYNKLKTRLREAALA

SEQ ID NO: 4013 - protein, 340 aa, Prochlorococcus marinus str. NATL1A
MTLRVAINGFGRIGRNFMRCWLSRGANTNIEVVGINVTSDPKTCAHLLKYDSILGAIKDAQISHTDDTFQINGKTIKCYSDRNPLNLPWKEWGIDLVIESTGVFNTDVGASKHLQVGAKKVILTAPGKGDGVGTYVVGVNADSYSHEDFDILSNASCTTNCLAPIVKVLDQKLGINKGLMTTIHSYTGDQRILDNAHRDLRRARAAAMNLVPTSTGAAKAVALVYPQMKGKLTGIAMRVPTPNVSAVDLVFESGRKTSAEEVNSLLKTASQGEMKGIIKYGDLPLVSTDYAGTNESTIVDEALTMCIDDNMVKVLAWYDNEWGYSQRVVDLAEIVAQKWK

SEQ ID NO: 4014 - protein, 548 aa, Neisseria gonorrhoeae FA 1090
MKHLHDLPAWSKLWNHFDDSKTLHMREMFEQDPQRAERYWLQVGGLTLDYSKNRINDETMSLLFELAREAGVPERMRQMFHGEKINTTENRAVLHVALRNRTNSPIMVDGEDVMPKVNRVLQRMGEFAHEVRSGSWLGYTNQVITDVVNIGIGGSDLGPLTMCTALKPFGHPRLNMHFVSNVDGSQLRDVLSKVHPETTLFIIASKTFTTQETLTNALTAREWFLNHAGDEEAVAKHFAAVSTNRKAVAEFGIDIANMFEFWDWVGGRYSLWSAIGLPIMLYLGEENFIEMLNGAHLMDQHFINTPLERNLPVILALIGIWYINYYGGGSHVIAPYDQHLHRLPKFIQQLDMESNGKQVTLDGKAVGHETSPIIWGETGINGQHAFFQLLHQGTHITPIDLIASLEKRSNLPGHHEILLANVFAQAEAFMCGKTPDEVRAELKAQGMDEARIEELVPHKTFSGNRPTNLILMDKVNPRNMGSLIAMYEHKTFVQGIIWGINSFDQWGVELGKQLAKTILGELTGETEPQKHDSSTERLINLYLQTNRK

SEQ ID NO: 4015 - protein, 405 aa, Puccinia triticina
MASAAVALPSSATGGSMNPTAPASTSVNATTINITNAPANKPKQAGSRAVGEPRRVRFNVGSKYHVMDVIGEGAYGVVCSAIHRPTGQKVAIKKIVPFDHSMFCLRTLRELKLLKYFQEHNVSENIVSIVDIIRPPTIEAFKEVYLIQELMETDMHRVIRTQVLSDDHCQYFIYPTLRAMKALHSADVIHRDLKPSNLLLNANCDLKVCEFGLARSIRTAEQETGFMTEYVATRWHRAPEIMLTFKQYTKAIDVWSVGCILGEMLSGRPLFPGRDYHHQLTLILDVLGTPTLDEFYAINSRRSRDYIRALPLRKKRPFATIYPNASPLAIDFLTKTLTFDPKKRLTVEEALQHPYLEAYHDPEDEPTAPPLDEDFFAFDRQKDEISKEELKRLLFEEINSFHFTT

SEQ ID NO: 4016 - protein, 164 aa, Triticum aestivum
  misc_feature (29)..(29): Xaa can be any naturally occurring amino acid
  misc_feature (40)..(40): Xaa can be any naturally occurring amino acid
  misc_feature (53)..(53): Xaa can be any naturally occurring amino acid
  misc_feature (61)..(61): Xaa can be any naturally occurring amino acid
KYHEAFLGETKLKHVCLGIMDPNKWGGAXIELSILSKYYXGREIAPYDIPDNXRCDLYGQXKNSHERQALIYDGLHSNALATSPAEGAPEEFDQTIYVVDQNRSIGPVEGLALNLAKEAHRKRSYTDTANFTLRWGVCQIGVIGQKEAVEHAQATGHVNFQEYK

SEQ ID NO: 4017 - protein, 833 aa, Oryza sativa
  misc_feature (695)..(695): Xaa can be any naturally occurring amino acid
  misc_feature (726)..(726): Xaa can be any naturally occurring amino acid
MPPWWGKSFSKDAKKTTKENLIDTFHRLISPNDQKGSTKSKRSCRRGNDSSVEKSCRSTTVSRPTSPSKEVSRCQSFSADRPHAHPLPIPGVRPPVTRTVSDITESKPILEKRGKPPLLLPLPKPNRPPRRHGNSEVVSEIVVASPSSNCSDSDDHGDSQLQSPVGNDAENATLVTLKNKSSNARKECPGPITAKNMKEIHRPANQVHGSHILSTSPRGVAADSYQSNLQNPRPLVLDSAPNSLMSSPSRSPRRICPDHIPTSAFWAVKPHTDVTFVGSGQCSSPGSGQTSGHNSVGGDMLAQLFWQPSRSSPECSPIPSPRMTSPGPSSRVHSGSVSPLHPRSGGMAPESPTNRHDDGKKKQTHKLPLPPLSISHSSFHPNNSTPTSPISVPRSPGRTENPPSPGSRWKKGKLIGRGTFGHVYVGFNSDSGEMCAMKEVTLFLDDPKSKESAKQLGQEISLLSRLQHPNIVQYYGSETVDDKLYIYLEYVSGGSIHKLLQEYGQLGEQAIRSYTQQILSGLAYLHAKNTVHRDIKGANILVDPSGRVKLADFGMAKHINGQQCPFSFKGSPYWMAPEVIKNSNGCNLAVDIWSLGCTVLEMATSKPPWSQYEGIAAMFKIGNSKELPPIPDHLSEPGKDFIRKCLQRDPSQRPTAMELLQHPFVQKAVSLEKSVLSEPLEHLAVISCRSSAKFXMAAHTRNISSLGLEGQTIYQRRGAKFSSKHXQSTYSNEGFAIPSRSPDDLFASRPTDPDLGQFIRVHQVSQGLQERVVSEADILSPQFGKRLGNVFDLRDKLSPSERFTHHAFVDHVKLNPSLDLTSGSPHLGLKHGN

SEQ ID NO: 4018 - protein, 255 aa, Photorhabdus luminescens subsp. laumondii TTO1
MRHPLVMGNWKLNGSTHMVNELITGLRQELSSVTGCDVAIAPPALYLSQAKQALAGSRIALGAQDVDVNLSGAFTGETSATMLKDIGAEYIIIGHSERRTYHQESDEFIAKKFAILKQQGLIPVLCIGETEQENEAGQTESVCARQIDAVLNTLGVAAFQGAVIAYEPVWAIGTGKSATPAQAQAVHKFIRDHIAQKDAAIAQQIIIQYGGSVNADNAAELFSQPDIDGALVGGASLKANAFAVIVKAAAAAKKA

SEQ ID NO: 4019 - protein, 323 aa, Photorhabdus luminescens subsp. laumondii TTO1
MSNEIKRIGVLTSGGDAPGMNAAIRGVVRAGLTEGLEVFGIYDGYLGLYENRMKKLDRFSVSDMINRGGTFLGSARFPEFRDEKVRTVAIENMRKNGLDALVVIGGDGSYLGAKKLTEAGFPCIGLPGTIDNDVAGTDYTIGYFTALETVVEAIDRLRDTSTSHKRISIVEVMGRYCGDLTLSAAIAGGCEFIVLPEVSFSCDELVAEIKAGIDKGKRHAIVAITEHVCDVYELAKHIEKETHHETRATVLGHVQRGGSPVAYDRILASRMGAYSIQLLLEGYGGRCVGIQNEKLVHHDIIDAVQNMKRVFKQDWLETAKKLY

SEQ ID NO: 4020 - protein, 106 aa, Salmonella enterica
LAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGL

SEQ ID NO: 4021 - protein, 319 aa, Cryptococcus neoformans var. neoformans B-3501A
MPRESENDGSRDYRDNDRESGRKEQDERYRSRSERDDRDRDRERRRVRSSSMDRDKDRDRERDRDSRRRHRDSESRSPSRHRRAKNRDEDRHHKPRSSRRRSRSGSRSDSSDYSSDSESEDERRRRKRKERERKREKEEKEERRRRKEKKRAKRDKKKRETAASTHSWGQYGIISEIDLPKKDSEFRAWLVEERKINPETISKDRTKKEFAVYVEDYNTATLGHEKYYDMDKYMIKLNMIRSGQTLPDESSGYDPMADMKAHSSSLKSTTKEPQESYLSPQEVAELRRIEAERTEISKRRLLGMNVPKNMGVRTEDADY

SEQ ID NO: 4022 - protein, 539 aa, Acidovorax sp. JS42
MRPDRSVSAARLPDRPPQRSALRRATQIAMALTGFLLWVAWHRGLMRCDTHRAAERFAQVLERLGTTFVKLGQHLSLRADVLPPDAQRALASLQAHVAPFSSEQAVQEVEAALGRPWQEVFARFDMQALAAASIAQIHRAALPDGTEVVVKIRRPGAAEQAETDMRILRRLVLTIQWFVPSLRRWGLAAIVDEVAANFRYEMDLSREASSVRRFADAWRDSPDIVLPDVVDGLCTSTVMVQQFSRGAHLHGLPPAMGAAAAGKLVDSYIVQIFRDGFFHGDPHPGNVFVMDDGRICLHDFGIVGRVDRSMRRALVAFALAFVEQDADWVVDAWLDLGLVGEGTDRAVFVPVVRTLVADCAEHPLKDWSLSDALAQLVAAGRTQDVRLPRDLLVLTRTLLLLEGTVRLLAPDFSIIEAISRHTATGIFDERKSAASQRLPYELGNAANALPTLLARRLHSVLRQRELLQLSIKPDVRMLSGIDRLGRRIALALVTLGLYIASSLLMQHAVGPRWGDMPVLALLGYALAIRLTFFIARSRG

SEQ ID NO: 4023 - protein, 114 aa, Salmonella enterica
MSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGIKNK

SEQ ID NO: 4024 - protein, 435 aa, Nostoc punctiforme PCC 73102
MTPPENKPSLPEVHRSIGVPNSSSFWRKMMAYTGPGYLVSVGYIDPGNWATDIAGGSRFGYTLLTVILLSNLMAILLQSLCVRLGVATGRDLAQACRDYFSPKVSFCLWVLCEIAIAACDLAELLGSAIALQLLFGIPLVWGVCITAVDVLLLLFLQHKGFRYTEALVIMLVGTVGICFTAEILFSRPDMGGILLGYLPKKEILQNPEMLYIAIGILGATVMPHNLYLHSSIVQTRSWQPNTEKRWEAIKFGTIDSTFALSLALFINSAILIVSAATFHFSGNQHVAEIQDAYKLLSPLLGVSAASAIFGIALLASGQSSTLTATLAGQIVMEGFLQFRFPSWLRRLITRLIAIIPALITIIIFGENSTSSLIVLSQVILSLQLPFAVIPLVMFTSNRRLMGEFVNPLWLKSLAWLVAIVIVGLNIWLLLQSILG

SEQ ID NO: 4025 - protein, 310 aa, Nostoc punctiforme PCC 73102
MSIIVFGSINIDLVATTPRLPVPGETLLGEEFFKVSGGKGANQAVALAKLGIPTQMVGRVGADDFGVELVNNLQSSGVQIDNIFVDETVSSGVAIIAVNHAGENQIIVIPGANGRVNQEDVERLSQLLPEATALLLQLEIPITTVIAAATAARKSKIRVILDPAPAQSNFPDELYPLVDIITPNEVEAAQLVGFPVDGEEQAAKAAEVLLQRGVKCAIVKLGAKGVFCATAEEKFFVPVFPVHAVDTVAAGDAFNGGLTAALFAGFSLHQAVVWGAAAGALATTKSGAQTSLPDRFTFDAFLREKASVRD

SEQ ID NO: 4026 - protein, 135 aa, Salmonella enterica
PKPMFGDNGSGMHCHMSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGIKNKIHPGEA

SEQ ID NO: 4027 - protein, 219 aa, Debaryomyces hansenii CBS767
MSDPINANPTVIDVSNLPTRFDDSEIQEKEVARNTELVDRILSLSLLNQGSLTHTDTELMPDLVSDVEADTSSMEEELLDETDDQEEEDVIDAQEIFDLISTISDPEHPLTLAQLAVVNLVDIKVTHGANKHTDISEILIKITPTITHCSLATLIGLGIRVRLERCLPPRFRIIILIKEGTHQSENQVNKQLNDKERVAAACENDQLLSVILQMLSTCK

SEQ ID NO: 4028 - protein, 108 aa, Salmonella enterica
MSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGL

SEQ ID NO: 4029 - protein, 290 aa, Solanum tuberosum
MEKHAKSVRQLEPWGELAGKVVMVTGASSGIGRDFCSDLSKAGCRIIAAARRIDRLKSLCDEINGIKLEFLIESTISSQELRAVAIELDVSANGASIEAAVQKAWNAFGRIDVLVNNAGIRGSVHSPLNLSEEEWEKIYNTNLRGAWLVTKYVCIHMRAANQGGTVINISSTAGLNRGKLPGSLAYASSKDALNSITKVMAIELGPYKIRVNSISPGVFKSEITERLIQKDWFKNVALKTIPLRTHGTSNPALTSVVRYLIHDSSEYVSGNIFIVDAGATLPGVPIFSSL

SEQ ID NO: 4030 - protein, 415 aa, Photobacterium sp. SKA34
MTEDFRQQALDYHSLPTPGKIAVALTKSANTVEDLALAYSPGVAEPVREIAQDPDNVYKYTAKGNMVAVITNGTAILGLGNLGPLASKPVMEGKSLLFKRFAGIDSIDIEVKHRTIDEFVDTVANIADTFGGINLEDIKAPDCFEIEQRLIERCNVPVFHDDQHGTAIVTAAGMINALELQGKEISEAMIVCLGAGAAAVACMELLIKCGAQREKIYMLDRKGVIHTRRDDINEYKQLFANNTDKRTLEDVIAGADIFVGVSGPDLLQPDALALMAENPIVFACSNPDPEIKPELAHQVRDDLIMGTGRSDYPNQVNNVLCFPFIFRGALDVRASQINDEMKLAAVHAIRELAKEPVPQSVLEASGAPHLEFGRDYIIPKPMDPRLLPRVAKAVAQAAIDSGVARIEMPMGYMEV

SEQ ID NO: 4031 - protein, 428 aa, Bacillus circulans
MNLDQAEITALTKRFETPFYLYDGDFIEAHYRQLRSRTNPAIQFYLSLKANNNIHLAKLFRQWGLGVEVASAGELALARHAGFSAENIIFSGPGKKRSELEIAVQSGIYCIIAESVEELFYIEELAEKENKTARVAIRINPDKSFGSTAIKMGGVPRQFGMDESMLDAVMDAVRSLQFTKFIGIHVYTGTQNLNTDSIIESMKYTVDLGRNIYERYGIVCECINLGGGFGVPYFSHEKALDIGKITRTVSDYVQEARDTRFPQTTFIIESGRYLLAQAAVYVTEVLYRKASKGEVFVIVDGGMHHHAASTFRGRSMRSNYPMEYIPVREDSGRRELEKVTIAGPLCTPEDCLGKDVHVPALYPGDLVCVLNSGAYGLSFSPVHFLGHPTPIEILKRNGSYELIRRKGTADDIVATQLQTESNLLFVDK

SEQ ID NO: 4032 - protein, 403 aa, Oryza sativa (indica cultivar-group)
MEPAHAPGRDRLSALPDNVLRRIMSFLNARQSVQTCVLSRRWRHLWRSLPRINADYTEFCFACLDEKKEKVQEARFKKFVSTLLLRRDPVPLLDKFWLRYQVSDGNNNEKASAEAGLWISHALQLQTPVVEVLTFQFPLMLDHAVFTSDYLRKLGLSNAYLRMGFFEQLNRGCPQLEDVFLNDCIILDDEISSTTLKTLNIYASRFSEDYRASISTPSLTSLTLYKPDASVPSLKDMKSLVSASIILDDNTDIHELLMSLSGVRNLDLECPQKMVTIAKNTQWCPEFKDLVNLSLGQFCLGSKLYALTEFLKNSPKLEKLTLDPPEVIIDKLEERSFECEHLKIVEVICSEDDSTLLKLVEDIFVTCGMSSLQINRKSSYKQYYSDDFFRFDYDSTTAQEHAE

SEQ ID NO: 4033 - protein, 1084 aa, Oryza sativa (indica cultivar-group)
MGFQSAHDTYSTNGLRGRGSDTMFKRDAPSTDMISGLPEGVLHRIMSFLTLREAVQTCVLSRRWRNLWLSMPLINADYNEFFEMTDTKAGYDEALAVAVPMFKRFVNRLLELRDPVASIDKFCLWYSISDDNEDDTESQDAAAKRWISQALQKKARVVEVYVDLADLYPLVIDHSVFTSSYLTKVVFSNVLLEDGFFKQLESGCPALEDLSLYDCVISGDEISSQTLKILTIKDTKFSMEHKTSISTPSVTSLTLWRPAHGIVVLKDMASVVTASVKPSEFIDEFDARGLRQYLWALSGVKNLEFYYLGENTPRLEKLTLKLKPFRYQQPRIIGELTERSFTCGHLKIVEVMCSENDPLVNNLVDFFVSSEPSDYSINGLNHPDITQLRNPQHLLLQQRISSHSVVLQIEVVQTCVLSRRWRDLWRFMPCINAEFFDFSIRGTESMEVIAEDEVLFKSGSSTDCWSSVTQPYRSKAWSVDLVTPNLPLEIEYAMFTSRYLRRVGLCNVTTLSSPMRTGLLLFLLRQSPFLSLCSPGQEVPSLMDMPSLVTASVDLNDKEAQFDANDMQEFLQSLSRVKQLKFRYNGEELTIGSNSKWCPKFFNLVSLTLGQWCMHSNIYALIVFLQNSPRLEKLTLKLSDDHWKTSETIIGELEERSFTCEHLTSVEVTCSEDDPMAETTLIAEEILHLLLNDYSLLDIVARQSPNHLRYTASRRVGSTLSDLPEGVLHHIMSFLDSRQAVQMCVLSQRWRNLWRSMPGINIDCKEFEVTDKAVFIEFVNRLLELRDPVAPISKFSLWYSMSGSGCGTVKKDTGRWISHALQKQAWAVENYVDMFYGYLKPLVLDHSVFTSTYLQIIWFSNVILDDGFFKQLEAGCPALEDLFLDECFIGDVEISSQTLKVLTIKRADFSTDPKTSISTPSVTSLTLSDPICGIFVLKDMASVATASVKPTFMPHRECIAGLHQYLWTLSGVKNLEFFYPWCPKFNNLVNLTLGEWCLHANFYALIVFIENSPRLEKLALKLYEFGQRTSNRTIVELNDRPFTCGHLKIVEVICFKNDPLANHVVDFLFSSGMTSAQIHIKHCW

SEQ ID NO: 4034 - protein, 528 aa, Prochlorococcus marinus str. NATL1A
MASMISAEKRNPAIVILDFGSQYSELIARRIRETEVYSLVMSYTTSADKLRSLKPKGIILSGGPGSVYEEGAPYCDPEIFNLGIPVLGVCYGMQLMVHELGGSVKPATGKAEYGKAPLEVDDPTALLTNVISGSTMWMSHGDSVQKLPKGFVRLAHTSNTLEAAIALHDKSFYGVQFHPEVVHSTHGMVVIRNFVYDICSCEPDWTTNLFIDEAVSQVQQQVGDKKVLLALSGGVDSSTLAFLLNKAIGPQLTCMFIDQGFMRKGEPEFLMSFFDEKFKINVEYINARERFISQLKGVTDPEQKRKIIGREFIRVFEEESLRLGPFDYLAQGTLYPDVIESSGTNIDPKTGERIAVKIKSHHNVGGLPKDLQFKLVEPLRRLFKDEVRKVGKSLGLPDEIVRRHPFPGPGLAIRILGEVTHEKLNCLRDADLIVREEINNAGLYNKIWQAFAVLLPVYSVGVMGDQRTYAWPIVVRCVSSEDGMTADWSRLPYAVLEKISNRIVNEVEGVNRVVLDITSKPPGTIEWE

SEQ ID NO: 4035 - protein, 304 aa, Oryza sativa (indica cultivar-group)
MAEVGVIPVLPEPGPTTISAPRHTAADARGAPETESYNRAVQRLKDGSGKGSATEADARCGCSRATSRWCRSYANFSADTAESYGNMMKNKVLGTDGSDGDMPAAQMPAFAYLHLNHDYGDDDKMFFCDDDQRLVMRTDTYIVPSLFLVTTFQDELDALFPERGAVFHYLGRYLFPQANHTAVLQRVPRAGVAAAGRRPDCGSQVLFCSSAAAAEDDTLTCAKPWRDGQSRLERILQPERSGRLDLAVHRIQPEPGRQGAEKEDGERHRMRKKGQQVKEMHGDSWWRRGRRRLSFILINLMKRC

SEQ ID NO: 4036 - protein, 374 aa, Francisella tularensis subsp. tularensis SCHU S4
MQQKCYYEILNVSKTASGVEIKRAYRKLAMEYHPDRNPGDKEAEIKFKEISEAYEILSDDSKRSRYDQFGHAGVNQQSGFGGTGGFGGFEDIFDTFFGGGTSRGSNRSRASRGSDLEYTLEITLEEAFFGVEKEITIPRMESCDSCDGTGSKSRSKTTCHACHGQGTIRRQQGFFAFEQTCPVCNGTGYSITDPCDACYGNGKVKKQKTLKVKIPEGVDNGDRIRLQGEGDSGSNGAMNGDLYVQIIIKEHKIFERRDINLYCEMPISFTKACLGGDIKVPTLDGEVVLKVVPETQTGKVFRLREKGMKSLRGHRRGDLLCKVVVETPVNLSAEQKELLEKFADSLGEDYQSKHAPKSKTWFDNVKDYAKKFFE

SEQ ID NO: 4037 - protein, 612 aa, Oryza sativa
  misc_feature (190)..(190): Xaa can be any naturally occurring amino acid
  misc_feature (206)..(206): Xaa can be any naturally occurring amino acid
MVRSGSVRRTAASSSPAAAAVPTAFTASPGDYRLLEEVGYGANAVVYRAVFLPSNRTVAVKCLDLDRVNSNLDDIRKEAQTMSLIDHPNVIRAYCSFVVDHNLWVIMPFMSEGSCLHLMKVAYPDGFEEPVIASILKETLKALEYLHRQGHIHRDVKRNIIQAGNILMDSPGIVKLGDFGVSACMFDRGXAPEVLQPGAGYNFKYXGKNSNYHKNTGNKVLLMTLQNAPPGLDYDRDKRFSKSFKEMVAMCLVKDQTKRPTAEKLLKHSFFKNAKPPELTVKSILTDLPPLWDRVKALQLKDAAQLALKKMPSSEQEALSMIHDDDPPEIKEDVDNDRINEADKEPFSGNHFGQPKILSGKHFRLNHEQTCVTAVSPGGNMHETSRGLVSEPGDADSERKVDGYRKQGEAAVKLASDKQKSCTKRTTNLSGPLALPTRASANSLSAPIRSSGGYVGSLGDKSKRSVVEIKGRFSVTSENVDLAKVQEVPTSGISRKLQEGSSLRKSASVGHWPVDAKPMDLITNLLSSLQQNEKADATQYRLGNMDGDTEVETSISEGERSLLVKIFELQSRMISLTDELITTKLQHVQLQEELKILYCHEEIIDTREVDNA

SEQ ID NO: 4038 - protein, 339 aa, Oryza sativa (indica cultivar-group)
MNQDLAKVQTEEDDFLIEISGEAPLTYSTLEGCVPPTFRSMTVGPIYQVFDMGGNAVSVQRHGNFASVGILTLVSTRAKPLEVEIAKEDERMSSSADNTVYCCIAKGRKIIYCYNSKDGDPHMETTAALCLENAPLYHRHYIHTAGSRSYGYLMADGHTFFAIIDPSVGNVGALQFLERVREVFRTVNRSGFHDSLVPAVQRLVASLEKMPRATFDLEESVEKGEPSDSSSCTSSKVPLLGRSGSRKDKKKAKEKAASAAVCEDEQHGTRGVRIDVPPEQVGGMSLERSASQSRLRRQHSSRSLWVRHVKIIIVVDAIICILLFAAWLAVCKGFQCVSS

SEQ ID NO: 4039 - protein, 150 aa, Triticum aestivum
MAEQTFIMIKPDGVQRGLIGEVISRFEKKGFYLKGLKLQNVEKSFAEQHYSDLSSKPFFAGLVEYIVSGPVVAMVWEGKSVVATGRKIIGATNPLASEPGTIRGDFAVDIGRNVIHGSDSVESARKEIALWFPEGIAEWRSSQHNWIYEA

SEQ ID NO: 4040 - protein, 151 aa, Saccharomyces cerevisiae
MKAQLQAISLRIQAVRSSDQMTRSMSEATGLLAGMNRTMNLPQLQRISMEFEKQSDLMGQRQEFMDEAIDNVMGDEVDEDEEADEIVNKVLDEIGVDLNSQLQSTPQNLVSNAPIAETAMGIPEPIGAGSEFHGNPDDDLQARLNTLKKQT

SEQ ID NO: 4041 - protein, 574 aa, Tagetes erecta
  misc_feature (333)..(333): Xaa can be any naturally occurring amino acid
MDVRRRPLNHRTLKPTLAGGVLEQPKASDALPFPLYLTNALFFSLFFSVMYFLLHRWREKIRNSVPLHVLTLSELLALLSLVASVVYLVGFFGIDFVQSIFRPSPDTWDIDDLLDQDKPIKPCGQALIPRITEPSPKITTTTTTTDQKKDPSQKKMKTSSKWWVEGSLPSYALESKLGDCKRAASIRREALEQITGKSLSGLPLEGFDYDSILGQCCEMPVGYVQIPVGIAGPLLLNGTEFSVPMATTEGCLVASTNRGCKAIYISGGATCILLKDGMTRAPVVRFGTAKRAAELKQFLEDPMNFDTLAVVFNKSSRFGRLQSVQCAIAGKNXYNRFCCATGDAMGMNMVTKGVQNVLDFLQHDFPDMDVMGISGNYCSDKKPAAINWIEGRGKSVVCEAIIKEEVVQKVLKTTVPALVELNMLKNLTGSAMAGALGGFNAHASNIVSAVYLATGQDPAQNVESSHCITMMEAVNDGKDLHVSVTMPSIEVGTVGGGTQLASQSACLNLLGVKGASKEEPGSNARVLATIVAGSVLAGELSLMSAISAGQLVKSHMKYNRSTRDVSNLTSSTSN

SEQ ID NO: 4042 - protein, 392 aa, Burkholderia xenovorans LB400
MKYSNLVERLQGRRTSAWEIHRVAQQAAANGEDVIVLSVGDPDFATPAPIVERAVEALRGGDTHYSAVSGREPVRAAIAEEHARTTGCAVSAANVILTAGAQNGVFASSLCLLEAGDEVIVPEPMYLTYEACVRAAGATLVAVPVDRARAFHVDCEALEAAVTSRTKAIFFATPCNPTGVVMPRADLERIARIACEHDLWVLSDEVYAELTFERGHLSIAALPGMAERTVTLGSLSKSHAMAGWRVGWAIGPAELIEHMGRLALAMLYGLPGFIQQAALTALQNKAQIAAGMREIYRRRRDVVFERLQRVPGLRCVLPEAGMFMMVDVSGTGLDTVDFTWQLFRAQGVSLLDASAFGETANGFVRLGFVVEEARLIDACERIAAFVRALPAR

SEQ ID NO: 4043 - protein, 346 aa, Chlamydia muridarum Nigg
MKYSLQIEDLHIEGFEQVLKISCESVQLVAVIAIHQTKVGPALGGIRAFNYSQFDDGLQDALRLSKAMTYKALLSSTGTGGGKSVIFLPEGLSSPTEGMLRAFGQAVDSLQGKYIAAEDVGISVQDMTIIHEETPYVCGLASISGDPSIYTAHGVFLCIQETVDYLWNEGIKGKRVAVQGLGSVGRKLVHELFFAGADLIVYDTRKHLLDEVVTLYGAQVDENIISVDCDVLCPCALGGVINACSVDQLRCRAIVGAANNQLENTSIGKELAIREILYAPDYLANAGGLLNVASSVGQTYAPKEVLKKVESLPKTLRRLYEKSIQESIDTGTLANTIVEERLAAYS

SEQ ID NO: 4044 - protein, 294 aa, Nostoc punctiforme PCC 73102
MNQINRVAIVGGTHGNEFTGAYLIEKFAQFPDLITRQSFETVTLLANPNAFAAGRRYVEKDLNRCFLKQDLQNPTLNSYEELQAKSIQNTLGSNRNKQADFILDLHSSTANMGLTIILVNSHPLNLQLAAYLSQISPLVRIYRCSFKSITENPFVNSLCELGFAIEVGPIAQGILKATLFQQTEELVYAVLDYLEQFNQGKIASTNETLILYDHLSVVDYPKQQDGKIFAMIHPELQDKDYQALNPGDPMFITFDNKTIVYEGASTVWPIFINEAAYYEKGIAMCLTQKQQINI

SEQ ID NO: 4045 - protein, 146 aa, Salmonella enterica
ATFMPKPMFGDNGSGMHCHMSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGIKNKIHPGEAMDKNLYD

SEQ ID NO: 4046 - protein, 355 aa, Oryza sativa
MTTTFRASALVRKATQPVVPFGDIRGKTGPIFGSKLIEVVYQVGEGWRAPLLRDYGDLEVRPQIAGLHYGLQVFDHCVISADKATKKPRIFRQECFLSRLAESRDYLHFGKYEDAELTALIKEYLAAEQFNIPTGPGQALLVRTCIIGDNNSLSAGPADSFRLFIFSTPFDTFAETKPLNVKADPTVRRSWAGGTGGVSVGGNYANQIYHETLARKEGFDRILWLVDNENIATAGDANFFAVYKNASGAHELVTPELGQTSMAGTVRTTILERFGKQARVSDVTAKEFGAALRSGAAVEAFATSSTCITRPIASMSYNGEAFAIPTPADGFAARIKKEVLGIWDGSIADPSSQLL

SEQ ID NO: 4047 - protein, 137 aa, Salmonella enterica
ATFMPKPMFGDNGSGMHGHMSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGIKNKIHPG

SEQ ID NO: 4048 - protein, 115 aa, Glycine max
  misc_feature (104)..(104): Xaa can be any naturally occurring amino acid
  misc_feature (110)..(110): Xaa can be any naturally occurring amino acid
MDHAAEAQRTDLMTITRHALNEQGRHPESRGDFTILLSHIVLGCKFVASAVNKAGLAKLIGLAGETNVQGEEQKKLDVLSNEVFVKALVSSGRTCVLVSEENEXAIFVDXALRGK

SEQ ID NO: 4049 - protein, 426 aa, Oryza sativa (indica cultivar-group)
MEGRPGRRRRRRVKAPTRAACMDWISGLTDEILHHIMSFLNARQAVQTCVLSRRWSDLWRTVPCINADFNEFDFIDYQGDDEDYNDEVAFKRFVNRMLELRDPATMMDKFWLKYKISDGYNEYKDSNVDANRWISHALQKQARVMEVVVFSFPLELDHSVFTSCYLRKIGFSCVSLHQGFFKQLDAGCPELEELFLHDCTIADEEIFSQSLKVLTIDDTEFSKANKAYISIPSVTSLTLSSPENSTPMLKDMALLTTTSVSVKFYTFSYGFDANDLRQCLWSLSGVTNLELNYEGTELTFENNLQWCPEFINVVNLTLGQWCLDANFYALIVFLQNSARLEKLTLNLAKCIWKKSPRIVSELMERSFTCEHLKIVEVKCLEDDPQVISVQDFFASNGMASVQFHIKHWGQYEEEDELPAFVRYEER

SEQ ID NO: 4050 - protein, 161 aa, Brassica napus
MGEIVFTEKQEALVKESWEILKQDIPKYSLHFFSQILEIAPAAKDMFSFLRDTDEVPHNNPKLKAHAVKVFKMTCETAIQLREKGKVVVADTTLQYLGSVHLKSGVLDPHFEVVKEALVRTLKEGLGEKYNEEVEGAWSKAYDHLALAIKAEMKQEDSQKP

SEQ ID NO: 4051 - protein, 437 aa, Oryza sativa (indica cultivar-group)
MEEPPGKKGPAMDPAQDSGRDWLSGLPEGVLHRIMSFLDSRQAVRTCVLSRRWRDLWRSVPRVHADIYDFTPDGTIDGEGEEDVEEAEVVVVFNRFVNRLLERRDPTASIETFFFRCCIPDEDDDGSADANRWISYGLQKNAWFLEVVVQLNSLELDRSVFNSIYLRRIAFGNVFMDQGFFKQLQIGCPALERLYLDDCIVADDEISSNTLKVLTFDTTEFCYEHRISISIPTVTTLALRNTICGKPVLKDVASLVSASVVLYCVESGNFDAYDLRHYLWSFSHVKDLIFSYQGRKLTIENNLQWCPKFFNLVGLTLGKWCLNANFYALIVFLQNSPRLEKLTLILAEDNCKTSEVFIGELEEKSFTCEHLTSVEMKCWEDDPLVINVVDFFVGSGMSSSQIHIEYEDDDEDQFHIESDDMFGFEFEYEDEDEDEDE

SEQ ID NO: 4052 - protein, 922 aa, Oryza sativa (indica cultivar-group)
MAASTSQHALVSVKSLCTGANFGFEKRTSKVRFVLVGRCCSGTRKLGLVCASNSHSSVMEPAQLPLSPESGNTPKKSSESALILIRHGESLWNEKNLFTGCVDVPLTPKGVDEAIEAGKRICNIPVDVIYTSSLIRAQMTAMLAMMQHRRKKVPIVVHSESEQAHRWSKIYSEETKKQSIPVITAWQLNERMYGELQGLNKQETADRFGKEQVHEWRRSYDIPPPNGESLEMCAERAVAYFKDQIVPQLVAGKHVMIAAHGNSLRSIIMHLDKLTSQEVISLELSTGIPMLYIFKEGKFIRRGSPAGPSEAGVYAYTRALFPPASEEFSSVEHTVYPPICHKEVAKHTIHWMSNHNSPCDIPKPASVDEFVKNGKKKKSFMSSIFRKKGRSGTGSSDKKLLSRRDIVFDRHCATKIESLTLSCLDSPHRQFDTREYRVFVGTWNVAGKPPNSSLNLEDFLQIEGLPDIYVLGFQEIVPLNAGNVLVIEDNEPAAKWLGLIYQALNKPQDQSSGDELSPPETSDSRQGGGSGSRDSIPKSSSGGMLFFQKPSLKMLSKNYRVDSALVKTCTCLTDPSTMQRRAREMREFLYRIEASPPPSLASAAAAADEDGGPDAGGELARSSVNYCLIASKQMVGIFLSVWVRRELVQYIGHLRVDSVGRGIMGRLGNKVLDAVLLCLCSLFGSLDSWRRHGWLSCLQGCIAMSMTLHQTSVCFVCSHLASGEKEGDEVRRNSDVAEIIKSTQFPRICKVPGQRIPDKILDHDRVIWLGDLNYRVALSYDETKTLMGENDWDTLLEKDQLMIERQAGRVFKGWKEGKIYFAPTYKYKQNSDSYAGETAKSKKKRRTPAWCDRILWHGQGIEQLQYIRGESRFSDHRPVCSVFVIEADVDNGSMIRKGYSTLDSRIHFESPIPQRHSFYDDF

SEQ ID NO: 4053 - protein, 836 aa, Oryza sativa (indica cultivar-group)
MKRSGDIASLFGNHEAKTMEIPESSSSSNVFIGDETPVPEEEPRQVPTDAFPRAPPVQRNASSVSATMDRRPGRHKLRRVKAHVRAARMDRISGLPDKILHHIMSFLNARQAVQTCVLSRRWRNLWRTMPCINADFDEFDFIAYQGDDEDYNDEVAFKRFVNQMLELRDPTAMIDTFWLSYIIWDGYNEYKDSNVDANRWISHALQKQARVIEVVVFAFPLELDHSVFTSCYLRKIGFSCVSLHQGFFKQLDTGCPALEELFLHDCIIADEEILSQSLKVLTIDGTEFSMANKASISIPSVTSLTLSIEDSTPMLKDMELLTTASVSVKFNTFIFSYGFDANDLRQCLWSLSGVTNLEFNYEGTELTFENNLQWCPEFIDVVNLTLGQWCLDANFYALIVFLQNSPRLEKLTLNLAKCIADKSPRIVGELMERSFTCEHLKIVEVKCLEDDPQVISVEDFFASNGMASVQFDIKHWGQYEDELPAFIRHHKSYIPEIKRHPVIFHMAIKVPHAHHLFDETPLRAWPPWRGVLAVARRKVKTPAHAAGMDWISDLPDEILHRIMSFLNARQAVQTCVLSRRWRNLWRTVPCINADCKEFDFFGFRRSEVEFKRFVNRLLELRDPIAMMDAFWFRYHKLDTDTTSSADTNRWISHALQKQARVLEAVMYPCHLLDLDHSSFTSRYLRRIGFSGVRLDQGFFKQLEAGCPALEDLFLHHCTIEDDKISSQTLKVLTIDRTYFLIAINATDVQKKSISAPSVTSLTMYSPEGSLPILKDMTSLVTASVSFSEFRVHFDANDFYQYLWSLSGVTNLEFNYQGPKACRHANLYAMQANAATT

SEQ ID NO: 4054 - protein, 326 aa, Zea mays
MTTAAPALPMFLRLCPASPFLLPPSLHVPSSRRPTPSRLSSFRPARPLFPISAVEKTNEAAAAGEGELEGMPPEFYDEEWQARQRERTKEWHAYRQKEEAEEERITNEYREIGMRLKAYPQEEVRKARILVSSFIRAGGDVEEEIEKAAERGELTELVLMVIWNRLDIARRDDERDAIRSLDLLYRRVETEILKSEATPAMRLLNDLLNLHDGGDNEKWLKKCRKRMLEVFPREDPFTVVLPAGFNMENREGRIELPPQDDDLLLRVDFVREVDELLKEVRAVEDKNKQQIGFDPESVAYMLKQQEKMQTMRQVESLLDLASSLKW

SEQ ID NO: 4055 - protein, 114 aa, Desulfitobacterium hafniense Y51
MSECIFCKIINKEIPSQVVFEDEHVLAFKDINPVAPVHLLVIPKKHRESLNDIDVADEALLGHILVVAKKLAQESGIADSGYRVVNNCGDDGGQVVKHLHFHVIGGQPLGVKIC

SEQ ID NO: 4056 - protein, 483 aa, Tagetes erecta
  misc_feature (333)..(333): Xaa can be any naturally occurring amino acid
MDVRRRPLNHRTLKPTLAGGVLEQPKASDALPFPLYLTNALFFSLFFSVMYFLLHRWREKIRNSVPLHVLTLSELLALLSLVASVVYLVGFFGIDFVQSIFRPSPDTWDIDDLLDQDKPIKPCGQALIPRITEPSPKITTTTTTTDQKKDPSQKKMKTSSKWWVEGSLPSYALESKLGDCKRAASIRREALEQITGKSLSGLPLEGFDYDSILGQCCEMPVGYVQIPVGIAGPLLLNGTEFSVPMATTEGCLVASTNRGCKAIYISGGATCILLKDGMTRAPVVRFGTAKRAAELKQFLEDPMNFDTLAVVFNKSSRFGRLQSVQCAIAGKNXYNRFCCATGDAMGMNMVTKGVQNVLDFLQHDFPDMDVMGISGNYCSDKKPAAINWIEGRGKSVVCEAIIKEEVVQKVLKTTVPALVELNMLKNLTGSAMAGALGGFNAHASNIVSAVYLATGQDPAQNVESSHCITMMEAVNDGKDLLYF

SEQ ID NO: 4057 - protein, 377 aa, Desulfitobacterium hafniense Y51
MKRDYYEVLGVSKSADEQEIKKAYRKLARQYHPDVNPGDKDAEEKFKEATEAYDVLSDTEKRARYDQMGHSAFDPNQQGFGGFGGDFGGFGDIFDMFFGGGGGGGQRRQGPTRGNDLRYDLTITFEEAAFGTEKEIQVPRQETCTECHGSGSAPGTHPTTCSQCHGTGQVKATQRTPFGAIQTARTCPACNGSGQFISSPCKECSGKGTTRKVKTIKVTVPPGSEDGLNLRFSGNGEAGLRGGPSGDLYVVLNVKAHKFFEREGNDVYCEIPITFVQAALGSELDVPTLDGKVKMKIPEGTQTATVFRLRGHGIPYRRGNGRGDQHVRVVVATPTKLTDRQKELLREFGEVTSDQQQMGKKSFFEKVKENIRDAIDL

SEQ ID NO: 4058 - protein, 125 aa, Salmonella enterica
MSLAKNGTNLFSGDKYAGLSEQALYYIGGVIKHAKAINALANPTTNSYKRLVPGYEAPVMLAYSARNRCASIRIPVVASPKARRIEVRFPDPAANPYLCFAALLMAGLDGIKNKIHPGEAMDKNL

SEQ ID NO: 4059 - protein, 439 aa, Serratia marcescens
MTATTFSELELDDRLIDALRDKGYDRPTAIQAAAIPPAMDGRDVLGSAPTGTGKTAAFLLPVLQHLLDFPRKKSGPPRVLILTPTRELAMQVADQARELAAHTSLDIATITGGVAYMNHAEVFSENQDVVVATTGRLLQYIKEENFDCRAVETLILDEADRMLDMGFAQDIETISAETRWRNQTLLFSATLEGEAIREFAERILKEPVEVEADPSRRERKKILQWYYRADDVQHKTALLIHLLKQPDVQKSVIFVRKRERVHELATWLREAGINTCYLEGEMVQAKRNEAVKRMMDGRVNVLVATDVAARGLDILDITHVFNFDMPRTADTYLHRIGRTGRAGRKGTAISLVEAHDHLLLGKVGRYLNEPLKARVIDELRPKTKVPNEKSNGKPSKKVLAKRAEDKARNKEKAKVKVRHRDAKNVGKRRQAKAKPAGDA

SEQ ID NO: 4060 - protein, 459 aa, Vibrio vulnificus CMCP6
MLNFFKTRPDAPLSDSSNEGMLKRYKNYQWQVFLGLIFGYAVFYVVRMSLGVVKKPMLDAGIVTIEELGIMGSAFFFTYAFGKFLNGFLSDYANIGRFMSCSLLVSGVLSVVMGMNTVGFFFVLLWGLNGWFQSVGSAPSCVSLYQWFSPKQRGSRYSIWGGSRNIGEGITWILTATLVSYFGWRAGFIGAGIAAVVAALIMLKVLKDRPQTYGLPDPGTAFGEGTEIKKANDPKETRRAQMFILKQPVVWLIALSCAAMYISRYAMSSWAVLFLQETKGYSLIDAGFAMSMYPTAGLAGAILSGILSDKVFKGNRNIPNLLYGLANIAGMCLMFFGPDNRVIDAVALSMIGFSIGGLVVFLAGLIACDLMPKNAVGAVKGLIGLCSYIAASAQELISASLITITEVDGVKHYDFGNAQYFWLAAGVVSVLLALTVWNAKKVVDIDEEQDKKLQTRTAS

SEQ ID NO: 4061 - protein, 555 aa, Oryza sativa (japonica cultivar-group)
MAMATATASSCVDATWWAYALPALLGADTLCAHPALLAGAVLLAFATAAVLAWAASPGGPAWAHGRGRLGATPIEGPRGLPVFGSIFALSRGLPHRALDAMSRDAAAPRARELMAFSVGETPAVVSSCPATAREVLAHPSFADRPLKRSARELLFARAIGFAPSGEYWRLLRRIASTHLFSPRRVAAHEPGRQADATAMLSAMAAEQSATGAVVLRPHLQAAALNNIMGSVFGRRYDVSSSSGAAADEAEQLKSMVREGFELLGAFNWSDHLPWLAHLYDPNHVARRCAALVPRVQAFVRGVIRDHRLRRDSSSTAADNADFVDVLLSLEAHENLAEDDMVAVLWEMIFRGTDTTALVTEWCMAEVVRNPAVQARLRAEVDAAVGGDGCPSDGDVARMPYLQAVVKETLRAHPPGPLLSWARLATADVGLANGMVVPAGTTAMVNMWAITHDGEVWADPEAFAPERFIPSEGGADVDVRGGDLRLAPFGAGRRVCPGKNLGLATVTLWVARLVHAFDWFLPDGSPPVSLDEVLKLSLEMKTPLAAAATPRRRRAA

SEQ ID NO: 4062 - protein, 507 aa, Burkholderia xenovorans LB400
MLLGHPVLFKSLCYVDGRWVHSASAASVAVHNPADQQVLGHVPMLDAAQITEAVGAAQRAFSTWRWLPVSQRSALLLRWHELILRHQHDLAAILSLEQGKPLAEARGEIAYGASFVEWFAHEVRRLNGRTIPTHIDGAHLGTMIEPVGVAALITPWNFPCAMITRKAAAALAAGCTVVVKPAHETPFSALALAQLAEEAGFPAGVFNVVLGEPQMAMERLVGDSRVRSVSFTGSTRVGALVMQAAARAGIKKTALELGGNAPFIVTGDADLDQAVRVAVAAKFQTSGQDCCAANRIFVARPLYEAFVAQYSDAVKALKVGAAFEANVDVGPLMHQAAFDSTAQRVADAKARGARITAGGGAHERGGWFFEPTVVADAAPGMRIYDEENFAPISAVSPFDSLDEVVERANDTEYGLAAYVCARDLNTVFQLIRRLDFAMVSVNGAKFTGAPIPFGGIKSSGLGREGGAEGFEPFVETRYFCLGQLGLPVTESLPAHRLAAATGAAATA

SEQ ID NO: 4063 - protein, 130 aa, Salmonella enterica
MFGDNGSGMHCHMSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGIKNKIHPG

SEQ ID NO: 4064 - protein, 465 aa, Burkholderia xenovorans LB400
MTQLDQLFDADRAHFMHPSTHAHDHASGALPGRIVTGAQGIRIEDHQGKSYIDAFAGLYCVNIGYGRTEVAEAIYEQAKKLAYYHTYVGHSTDTIIELSSRIIEWAPQGMKKVYYGMSGSDANETQIKLVWYYNNVKGRPDKKKIISRQRGYHGSGIVTGSLTGLASFHQYFDLPIGRVKHTVCPHWYRHAPAGMNEAQFVAYCVEELEKLIAQEGADTIAAFIAEPVMGTGGILPPPAGYWPAIQQVLKKHDILLICDEVVCGFGRLGSKMGAQHYGIAPDLITVAKGLTSAYAPLSGVIVSEGVWDVIDKASQEFGAMGHGWTYSGHPICAAAALANLDILERENLTQNAAQTGAYLLEQLHAAFDSHPLVGEVRGAGMLAALEFMADKDGRQPFDAALKVGPRVSAAALQRGLIARAMPHGDILGFAPPLITSRSEVDEIVKLAREAVDEVASAVLSPAASA

SEQ ID NO: 4065 - protein, 293 aa, Clostridium tetani E88
MDNETQFINSFPKSIPGQHQTKHPGIESIMNPRPIFDNPNYVASDKLKDKVALITGGDSGIGRAVALAYAKEGADISIVYYDEHEDAEETKALIENLGRKCILIPGDITDSNFCNNAVNETVNSLNGLHILVNNAAVQYTQNSIEDITEEQLEKTFRTNIFSMFYLVKASIPHLKQGSSIINTASITAYKGDELLIDYSCTKGAVVTFTRSLALSLASMGIRVNAVAPGPIWTPLIPSSFDVAKVEQFGKNTALTRPAQPVELAGAYVYLASCDASYVTGEIIHVNGGKFVSG

SEQ ID NO: 4066 - protein, 124 aa, Salmonella enterica
SGMHCHMSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGIKNKIHPG

SEQ ID NO: 4067 - protein, 404 aa, Vibrio vulnificus CMCP6
MQDILTVILAGGMGSRLSPLTDDRAKPAVPFGGKYRIIDFTLTNCLHSGLRKILVLTQYKSHSLQKHLRDGWSIFNPELGEYITSVPPQMRKGGKWYEGTADAIYHNLWLLERSEAKYVMVLSGDHIYRMDYAPMLEEHIANNAALTVACMDVNCKEAKAFGVMGIDERHRVHSFVEKPQNPPHLPNDPERSLVSMGIYIFSMEVLQQALIEDADDDASSHDFGKDIIPKLIDTGSVFAYKFCGSKGRVDKDCYWRDVGTIDSFYQANMDLLEPIPPMNLYQKDWGIRTYEPQYPPARTVSSGSGNEGIFINSIIANGVINSGGSVQHSIVSSNVRINDSATVVDSIIFDDVEIGEGCQLVNCIIDKHVKVPPYTQIGLNRLEDAQRFKISENGIVVVPESYQF

SEQ ID NO: 4068 - protein, 523 aa, Escherichia coli CFT073
MTLEYEVVAMSVSKKPMVLVILDGYGYREEQQDNAIFSAKTPVMDALWANRPHTLIDASGLEVGLPDRQMGNSEVGHVNLGAGRIVYQDLTRLDVEIKDRAFFANPVLTGAVDKAKNAGKAVHIMGLLSAGGVHSHEDHIMAMVELAAERGAEKIYLHAFLDGRDTPPRSAESSLKKFEEKFAALGKGRVASIIGRYYAMDRDNRWDRVEKAYDLLTLAQGEFQADTTVAGLQAAYARDENDEFVKATVIRAEGQPDAAMEDGDALIFMNFRADRAREITRAFVNADFDGFARKKVVNVDFVMLTEYAADIKTAVAYPPASLVNTFGEWMAKNDKTQLRISETEKYAHVTFFFNGGVEESFKGEDRILINSPKVATYDLQPEMSSAELTEKLVAAIKSGKYDTIICNYPNGDMVGHTGVMEAAVKAVEALDHCVEEVAKAVESVGGQLLITADHGNAEQMRDPATGQAHTAHTNLPVPLIYVGDKNVKAVEGGKLSDIAPTMLSLMGMEIPQEMTGKPLFIVE

SEQ ID NO: 4069 - protein, 104 aa, Glycine max
  misc_feature (22)..(22): Xaa can be any naturally occurring amino acid
MSGRGKGGKGLGKGGAKRHRKXVLRDNIQGITKPAIRRLARRGGVKRISGLIYEETRGVLKIFLENVIRDAVTYTEHARRKTVTAMDVVYALKRQGRTLYGFGG

SEQ ID NO: 4070 - protein, 556 aa, Clostridium perfringens str. 13
MKNDIEIAQSAKMEPIINIAKKIGLGEDDIELYGKYKCKISLDAIKKLENNKDGKLVLVTAINPTPAGEGKSTVTVGLGQALNKIGKNTVIALREPSLGPVFGIKGGAAGGGYAQVVPMEDINLHFTGDMHAITSANNLLCAAIDNHIHQGNLLRIDSRRIVFKRVMDMNDRALRNIVVGMGGKINGFLREDGFMITVASEIMAILCMASDLEDLKERMGNILIAYNLDGEPVYAKELEVQGAMALLMKDAIKPNLVQTLENTPAIIHGGPFANIAHGCNSIIATKTALKMSDITITEAGFGADLGAEKFLDIKCRYGNLNPDCVVLVATIRALKHHGGVKKDELNISNVDALNKGMKNLEKQIENIKAYGVPVVVAINKFITDSDEEVKAIEDFCKNIGVEVSLTEVWEKGGEGGIDLANKVIKTMETEPSNFKMIYDSEESIKDKILKIVQTIYGGKGVNYTPQALKQIAEIEKFNLDKLPICMAKTQYSLSDNPSLLGRPENFDITVKEVRVSNGAGFIVVLTGDVMTMPGLPKVPAANRMDIKDNGEIVGLF

SEQ ID NO: 4071 - protein, 72 aa, Triticum aestivum
WLFCQPNPIAVNTALAQLGVARPVFRLPYVPLPLEKRIEFVRIVEAIGRENFVGEKEAQVLDDDDFVLISRY

SEQ ID NO: 4072 - protein, 249 aa, Oryza sativa (japonica cultivar-group)
MVKLAFGSCGDSFSASSIKAYVAEFIATLLFVFAGVGSAIAYGQLTKGGALDPAGLVAIAIAHAFALFVGVSMAANISGGHLNPVVTFGLAVGGHITILTGIFYWVAQLLGASVACLLCSSPPTDRLAIPTHAIAGISEIEGMVMEIVITFALVYTVYATAADPKKGSLGTVAPMAIGFIVGANILAAGPFSGSSMNPARSFGPAVAAGNFAGNWVYWVGPLIGGGLAGLVYDDVFIASYQPVGQQEYP

SEQ ID NO: 4073 - protein, 387 aa, Oryza sativa (indica cultivar-group)
MEDAAGRDRLSDLPDEILHRIMSFLNARQAVQTCVLSRRWRNLWHTVPCINADFVEFDSIGYQGPEVPFKRFVNRLLEFRDPASVIDTFLLKYAMPDRLDGYKASNEEANRWIGYALQKQARILEVAVFFFPLDLDHSVFTSFYLRRIEFSHVYLRKGFFEQIETGCPLLEDLLLHQCFIWDGEISSQTLKVLTVDATELYTVKEMSISTPNLTSLTLSGLEYPKAVLKDMPLLVTASVSVTFDALNFDGYYDANDLRQYLWGLSAVRNLEFHYEGAELMIANNSQWCPEFVDVVNLTLGEWCLDANFHALIVFLQNSPRLVKLTLKLAKDRWTTPQRIIGELEERSFTCEHLKIVEVICLENDPQVIGVEDFFVRSVTRMNDESQG

SEQ ID NO: 4074 - protein, 245 aa, Bacillus thuringiensis serovar konkukian str. 97-27
MIKLVLIRHGQSLWNLENRFTGWTDVDLSENGLSEAREAGAILKKNGYTFDVAYTSVLKRAIRTLWIVLHEMNLAWVPVHKSWKLNERHYGALQGLNKDETAQKYGEEQVHIWRRSIDVRPPALTEDDPRYEMNDPRYKTLKKGEFPLTECLVDTEKRVLAYWHSEIAPKLKDGNKVIISSHGNTIRSLVKYLDNLSSDGVVSLNIPTSIPLVYELDENLRPIRHYYLSMDGEVPEGEIPKHITF

SEQ ID NO: 4075 - protein, 292 aa, Oryza sativa (indica cultivar-group)
MAASSSSSMASSSQPRMMEQSLFYTQPPARAVHTRKVTAVNLHREMSLIRSLMPTFPFVAVDTQFPGVVHPHPRGAGVTADNRYAAVRANADELCLLQLGITLSAADGRLPVDGALVEFMWEFDFAGFDARYHRHAPESVHFLRAQGFDFEAARLAGVPALAFAAELAASGILGLRGVTWVAFGGMYDVAFLLRLATGGAPLPATRLGFLAQVGAIFGTQVFDAKHMASLLHMHGGLAAVGAMLRLPPQLPRCHMAGQNSVMALQLFMELRRRFSDLGGSLHSCSLKIEGLT

SEQ ID NO: 4076 - protein, 465 aa, Arabidopsis thaliana
MSRLLQTPFLPSVSLPTKTRSSVTGFRVKPRIIPIQAKIREIFMPALSSTMTEGKIVSWVKSEGDKLNKGESVVVVESDKADMDVETFYDGYLAAIMVEEGGVAPVGSAIALLAETEDEIADAKAKASGGGGGGDSKAPPASPPTAAVEAPVSVEKKVAAAPVSIKAVAASAVHPASEGGKRIVASPYAKKLAKELKVELAGLVGSGPMGRIVAKDVEAVAAGGGVQAAVAVKEVVAAPGVELGSVVPFTTMQGAVSRNMVESLGVPTFRVGYTISTDALDALYKKIKSKGVTMTALLAKATALALAKHPVVNSSCRDGNSFVYNSSINVAVAVAIDGGLITPVLQNADKVDIYSLSRKWKELVDKARAKQLQPQEYNTGTFTLSNLGMFGVDRFDAILPPGTGAIMAVGASQPSVVATKDGRIGMKNQMQVNVTADHRVIYGADLAQFLQTLASIIEDPKDLTF

SEQ ID NO: 4077 - protein, 400 aa, Oryza sativa (indica cultivar-group)
MEGSPSKSRGVTAPAHTDDGDWFSDVPDDIILNIMSFLTTRQAVQTCVLSRRWRNLWRSVRCINSDIDEFTRDSDSEGYYDEKTELAFIMFMERVMELRDPAALISTFQFRCKFELDEGFDDISDPEDINAWITHAMQKQPWVLDILVLYDALKLDHSAFTCRYLTRIKFINVLMMPGFFQQLEMGCPVLENLFLDESIVADVEISSRTLKVLTIKSTQFSYKFRTTISTPSVTYLKLWRPVNGIYVFNDMPLLVTSILVLYDVQDSSDFCQNLRSLSAAKRLEFDYFGRKLTMENNLQLYPKFNNLVSLTLGQWCLDANFYGLVVFLQNAPKLEKLTLELEKNTPERIIGKLEDRSFTCEHLTRVEVVCSEGDPLVKDVVNFFVNSGLTSAQVQIIRWC

SEQ ID NO: 4078 - protein, 341 aa, Escherichia coli CFT073
MKALSKLKAEEGIWMTDVPVPELGHNDLLIKIRKTAICGTDVHIYNWDEWSQKTIPVPMVVGHEYVGEVVGIGQEVKGFKIGDRVSGEGHITCGHCRNCRGGRTHLCRNTIGVGVNRPGCFAEYLVIPAFNAFKIPDNISDDLASIFDPFGNAVHTALSFDLVGEDVLVSGAGPIGIMAAAVAKHVGARNVVITDVNEYRLELARKMGITRAVNVAKENLNDVMTELGMTEGFDVGLEMSGAPPAFRTMLDTMNHGGRIAMLGIPPSDMSIDWTKVIFKGLFIKGIYGREMFETWYKMAALIQSGLDLSPIITHRFSIDDFQKGFDAMRSGQSGKVILSWD

SEQ ID NO: 4079 - protein, 554 aa, Mycobacterium tuberculosis H37Rv
MTAQLASHLTRALTLAQQQPYLARRQNWVNQLERHAMMQPDAPALRFVGNTMTWADLRRRVAALAGALSGRGVGFGDRVMILMLNRTEFVESVLAANMIGAIAVPLNFRLTPTEIAVLVEDCVAHVMLTEAALAPVAIGVRNIQPLLSVIVVAGGSSQDSVFGYEDLLNEAGDVHEPVDIPNDSPALIMYTSGTTGRPKGAVLTHANLTGQAMTALYTSGANINSDVGFVGVPLFHIAGIGNMLTGLLLGLPTVIYPLGAFDPGQLLDVLEAEKVTGIFLVPAQWQAVCTEQQARPRDLRLRVLSWGAAPAPDALLRQMSATFPETQILAAFGQTEMSPVTCMLLGEDAIAKRGSVGRVIPTVAARVVDQNMNDVPVGEVGEIVYRAPTLMSCYWNNPEATAEAFAGGWFHSGDLVRMDSDGYVWVVDRKKDMIISGGENIYCAELENVLASHPDIAEVAVIGRADEKWGEVPIAVAAVTNDDLRIEDLGEFLTDRLARYKHPKALEIVDALPRNPAGKVLKTELRLRYGACVNVERRSASAGFTERRENRQKL

SEQ ID NO: 4080 - protein, 335 aa, Oryza sativa (indica cultivar-group)
MAPLGDGAAAAAAEPNLVVSFGEMLIDFVPDVAGVSLAESGGFVKAPGGAPANVACAISKLGGSSAFVGKFGDDEFGHMLVDILKKNGVNAEGCLFDEHARTALAFVTLKSNGEREFMFYRNPSADMLLTEAELNLDLIRRAKIFHYGSISLITEPCRSAHVAAMRAAKSAGILCSYDPNVRLPLWPSEDAARAGILSIWKEADFIKVSDDEVAFLTQGDANDEKNVLSLWFDGLKLLIVTDGEKGCRYFTKDFKGSVPGFSVNTVDTTGAGDAFVGSLLVNVAKDDSIFHNEEKLREALKFSNACGAICTTKKGAIPALPTVAVAQELISKAAN

SEQ ID NO: 4081 - protein, 340 aa, Bacillus licheniformis ATCC 14580
MKVKVAINGFGRIGRMVFRKAMLDEQIDIAAINASYPPETLAHLIKYDTNHGRYELDVKAGEDCLFVNGKKVMLTNQRDPKLLPWAQYGIDIAVEATGKFNSKEKAEAHIEAGAKKVILTAPGKNEDITIVMGVNERDFDAERHTIISNASCTTNCLAPVAKVLDDAFGIENGLVTTVHAFTNDQKNIDNPHKDLRSARACGSSIIPTTTGAAKALSLVMPHLKGRMHGLALRVPVSNVSLVDLVADLKSDVTAEDINEAFRMAAAGSMSGIIDVCDEPLVSSDFNTNPYSAVIDSLSTMVLENRKVKVLAWYDNEWGYSCRVVDLIRYAASRMKHPSAV

SEQ ID NO: 4082 - protein, 469 aa, Geobacter sulfurreducens PCA
MQITFGTDGWRGIIAREFTFDNLSRVAQATMDYLKREGLAARGLVVGYDRRFLSRDFADRVAEIAAGNGIRVWLTDGPAPTPAISWAVHEMKAGAGVMITASHNPPAYNGFKVKESFGGSARPATTRILEEITAANTAAGRGIEERPLAAALADGTVTIFDPREGYCRQLARYVDLDLIRQAAIPLAVDPMHGAGAGVIPELVPGALEIHGDENPGFRGVPPEPTEEHLQELATLVRDGVCRVGLALDGDADRIGAVDENGEFFSSHRIFTVILRHLVERKGLTGGVVKTVSTTRMIDLLAQKYGLPLHETPIGFKHICELMLEHDILMGGEESGGLGVKGHIPERDGVLMGLLLLEAMAMSGKGLRRLLDETMDEIGVFHYQRLDLPIEDAPKAALITRLREERIDAIAGRPVAGTNFRDGFKFMFEDGSWLLIRPSGTEPVLRLYSEAGTPGTVGELLAAGREIAGV

SEQ ID NO: 4083 - protein, 166 aa, Bahiopsis tomentosa
MFPMLTEFMNYGQQTVRAARYIGQGFMITLSHANRLPVTIQYPYEKLITSERFRGRIHFEFDKCIACEVCVRVCPIDLPVVDWKLETDIRKKRLLNYSIDFGICIFCGNCVEYCPTNCLSMTEEYELSTYDRHELNYNQIALGRLPMSIIDDYTIRTILNLPEIKT

SEQ ID NO: 4084 - protein, 230 aa, Schizosaccharomyces pombe 972h-
MDVVLQYADKYVFDTFYGKIAESFDSSSSFANTAVNSTTLGLAEKVNFAITSGLLDRNNVWRQFTSLFLITWIMGTLSYFLSASFAYYVYFDREEARRHPKFLKNQEHLELMVALKNLPGMAILTAPWFLAEIRGYGYVYDKLDEYGYFYLFFSIALFLLFSDFLIYWIHRALHHRWLYAPLHKLHHKWIVPTPYSSHAFHYLDGYSQSLPYHMFPFFFPLNKYVYLLLF

SEQ ID NO: 4085 - protein, 387 aa, Vibrio vulnificus CMCP6
MTKGKTINGFEREEGFDISAASELMAILALSKNLQDMRERIGKVVLAYNLDSEPVSAEQLQVAGAMTVTLKEAIKPTLMQTLEGVPTLIHAGPFANIAHGNSSIIADEIALKLSSYVVTEAGFGSDMGLEKACNIKSSTSHKAPDCVVIVATLRGLKANSGLYDLKPGMPLPDALFQPDRAALESGFSNLKWHIDNAQKYGLPVVVAINQFPQDSAEELGQLKLWIQQLPLNVRVAISEGFAKGGKGMEAVAREVIEACDAPANFRPLYRAEQTLEEKIITVCTKGYGCGEVQFSDTAKQQLALYQTLGFGELAVCMAKTPLSISSDSSLKGAPSGFTIMVREVRLCAGAGFVYALTGNVMTMPGLPDIPAFMALDIDENGDIVGLS

SEQ ID NO: 4086 - protein, 205 aa, Vibrio vulnificus CMCP6
MLSDIDICRTTPLKPIEQIAAKAGLLADEFETHGLYKAKVSARCVKRLAEQQDGKLVLVTAITPTPLGEGKTVTTIGLAQGLQSLNQSVMACIRQPSMGPVFGVKGGAAGGGYSQVAPMDELNLHLTGDIHAVTAAHNLAAAAIDARIYHEQRAGYQAFEARTGLPALRIDPDRVVWKRVMDHNDRALRKVRVGINDEGQDHQRI

SEQ ID NO: 4087 - protein, 166 aa, Venegasia carpesioides
MFPMVTEFMNYGQQTVRAARYIGQGFMITLSHANRLPVTIQYPYEKLITSERFRGRIHFEFDKCIACEVCVRVCPIDLPVVDWKLETDIRKKRLLNYSIDFGICIFCGNCVEYCPTNCLSMTEEYELSTYDRHELNYNQIALGRLPMSIIDDYTIRTIFNLPEIKT

SEQ ID NO: 4088 - protein, 281 aa, Cucumis melo
TLEDGMKVAVKRGNPRSEQGLAEFRTEIEMLSKLRHRHLVSLIGYCDERSEMILVYEYMANGPLRSHLYGTDLPPLSWKQRLDICIGAARGLHYLHTGAAQSIIHRDVKTTNILLDENFVAKVADFGLSKTGPSLDQTHVSTAVKGSFGYLDPEYFRRQQLTEKSDVYSFGVVLMEVLCTRPALNPVLPREQVNIAEWAMTWQKKGMLDHIMDPNLVGKVNPASLKKFGETAEKCLAEYGVDRPSMGDVLWNLEYALQLEETSSALMEPEDNSTNQSLPSN

SEQ ID NO: 4089 - protein, 616 aa, Chromobacterium violaceum ATCC 12472
MCGIAGWVSFERDLSTQRAVAETMTKTMALRGPDDEGLWLDRRAALGHRRLSIIDLEGGRQPMTADEDGRTLACLVYTGEVYNFRELRLELQGLGHAFRTRSDTEVVLRAYLQWGEAMLERLNGMYAFALWDAREQRLLLVRDRMGVKPLYYYPMPDGVLFGSEPKAILAHPEAERRVTAGGLREMLDLVKTPEAAAFAGMHEVRPGQVVTIDRGGLRKRRYWQLEAREHTDDLPTTIRTVRELLDDIVERQIIADVPLCTLLSGGLDSSVVTALAARSMRRQGKGTVRSFSVDFVKHGAAFEADYLRGSPDAPFVRDLAAHAGTEHREILLESRELADPRLRAAVLGAQDLPPAYWGDMLPSLYKLFEAIRAQSTVALSGESADEVFGGYRWFHDAAAVDGDAFPWLAGSSGAFFDGQSLIAPGLLRELDMPGFRRDSYAQALAEVPRLASDSTRERRMREISHMHLTRFVQALLDRKDRMSMAVGLEVRVPFCDHRLVEYVFNAPWSMKNFDGREKSLLRAAGKDVLPESIVRRVKSPYPATQDPAYEQALRQGLARVLDDSRSPALPLLDKAAAWKLLDRPFGKTSTSPERAGLEMALGLDEWLRHHQVSLDL

SEQ ID NO: 4090 - protein, 139 aa, Oryza sativa
  misc_feature (32)..(32): Xaa can be any naturally occurring amino acid
MPMSDPTAAVIPKPGGIGVGGGGGDDEEPVEXREVWADNLEEEFAFRSPADYNYATLKANVDMFHLIQLGLTFSSPRGELPALGPGRRRCVWQFNFREFDDARDIFASDSIELLRRSGIDFRRNSERGVDAGRFAELLM

SEQ ID NO: 4091 - protein, 166 aa, Trigonospermum melampodioides
MFPTVTEFMNYGQQTVRAARYIGQGFMITLSHANRLPVTIQYPYEKLITSERFRGRIHFEFDKCIACEVCVRVCPIDLPVVDWKLETDIRKKRLLNYSIDFGICIFCGNCVEYCPTNCLSMTEEYELSTYDRHELNYNQIALGRLPMSIIDDYTIRTILNLPEIKT

SEQ ID NO: 4092 - protein, 145 aa, Salmonella enterica
ATFMPKPMFGDNGSGMHCHMSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGIKNKIHPGEAMDKNLY

SEQ ID NO: 4093 - protein, 488 aa, Bacillus thuringiensis serovar konkukian str. 97-27
MNSATNQATSKTEATKGKGELRRGLKSRHLTMISLGGTIGTGLFLASGGVIHSAGPGGALIAYAAIGIMVYFLMTSLAELAAYMPVTGSFSTYATKFVDPSLGFALGWNYWYNWAITIAAELAAVTLIMKFWFPDTPSLIWSGLCLAIIFLLNYLSVKGFGESEYWFALIKVATIIIFLIVGFMMIFGIMGGETVGFKNFTVADAPFNGGIMAIIGVFMAAGFSFQGTELLGVAAGETSDPERNIPKAIRSIFWRILLFYILAILVIGLLIPYTTESLAASDVTVSPFTLIFEKAGVAFAASVMNAVILTAVLSAGNSGMYASTRMLWDLARQGKAPKFLGKLDSRGVPVNALIVTSIVGSIAFIASLFGDGVVYIWLLNASGMSGFIAWVGIAISHYRFRKAYIAQGKDLNDLPYRAKWFPFGPIFAFALCVIVILGQNYGAFMGESIDWNGVLVSYIGLPLFLVLWLGYKFTKKTKVIPLDKCELK

SEQ ID NO: 4094 - protein, 295 aa, Medicago sativa
MGNTNSSHNLLITVTVFAVTVTVFFILYFILRRRRFSPSSSSTVRVSPVTPTSSTSSSVVDSLPIFTFSSIKRRSSTVVSGDCAVCLSKFEQNDLLRLLPLCCHAFHTECIDAWLASNQTCPLCRSSVFVSESEIMKIFRSSSTSSGNNSFRLEIGNISHRREATATDNNNNNNNVAGETDRRTYSVGAFDYFVDEEAEIPVGNTNRRIFSGEKDDAAVLSVEVETPVDSQASLIGEGNWLKDYVDGLTRVMSFRGSGSSRRNDVVAGVGDFDVEANGNGFGEEISEMFRWISGV

SEQ ID NO: 4095 - protein, 1123 aa, Oryza sativa
  misc_feature (95)..(95): Xaa can be any naturally occurring amino acid
  misc_feature (127)..(127): Xaa can be any naturally occurring amino acid
  misc_feature (137)..(137): Xaa can be any naturally occurring amino acid
MVVREPVAMEIPAVESSAAGRMPPRIRRRLLEGSRVGGGAPTSAEEIEAKLKEAELRRQQFHEWVSCKARKKPRSPSWSSQEEDQGQRLEAKLQXAAEQKRLSLLAKAQNRLAKLDELRQAAKNIVXEMRIEKEREXLGTRVESRVRQAEANRMRLLHAHMQERAAMKERTARSLVRKQTSERKYTERVKSLILQKRNAAEKKRLALLEAEKRKAQARILHIQRAAKTVCSKRESERRQLQEQLESKLQKAKRQRAEYLKQRVGPRSSAHADYIKHAEFLSTKLARCWKRFLKSNKTTYALVQAYDALGINEMSVKSMPFENLAMLMESPTTLQTTKAVLDRFEKRLLLSQPTGSSSAENIDHLLKRLGSPKRKAPASRSRVAAKKPAKGSETSKLSRYSLRVVLCSYMILAHPGAVLSGQGEKENLLMESAENFVKEFELLVKTVLDRPGGASMQSTDAASQKKFRTQLAAFDKAWCAYLYHFVVWKLKDAKSLEQDLVRAACKLELSMMQTCKLSSDGQSHDLSHDMKAIQKQVTDDQKLLREKIQHLSGDAGIERMNSALSDTRSKFFEAKENGNPLATSVANVSTPLSINSSGQVPNPTSKPTVEGSSFTAQSLPGAASSSSSTSPMKPPTDNEQMVNEMLHEDDVSFARNSDNVSSAEKDFQAKVKATMEKAFWDLVTDSMRGDKPDYSQLINLVKEVRNSLHELASNELKEEILENIDLEILSQVLQSGSQDTRYLGQILQYSLDMVRKLSAPAKEDDMKRSHEKLLNELAASSEVNDNGISSFVIAVIKGLRFTLEEIKQLQTEVSKARIQLMQPIIKGSAGVEYLQKAFTDRYGPPANASVSLPITKQWVSATKSIVEQEWSSHLESLQALPADHAQHVVPVLRAGHGAPAPQASSSAASSSGLPECKGEKIDKLTRVGLLQLISNVEGLNMQSTPETFQINLLRLRAVQDQFQKVIVIATSMLVLHQVLMLKIAPPELQNTISELYDALVKLLDNNADASTKEIVEAMTRSLASVGSLPEEQIQDTTELATKMLLKSLQAGDIVFGKVSRAVYFAFRGVVLGGGAKGKKLAEAPLRRLGAAKLADRVVKAGEVLIKMAVISEKVHGQWYKALAL

SEQ ID NO: 4096 - protein, 135 aa, Salmonella enterica
DNGSGMHCHMSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGIKNKIHPGEAMDKNLY

SEQ ID NO: 4097 - protein, 378 aa, Burkholderia xenovorans LB400
MKALVYEGPRKVTVKEMPDAKIERPTDVLVKITTTNICGSDLHMYEGRTNMETGRILGHENLGVVVEVGAGVERIKVGDRVCLPFNIGCGFCKNCERGLTGFCLTTNPGMAGAAYGFAGMGPYSGGQAEYLRVPFGDFNCLVLPPDAEEKENDYVMLSDIFPTGYHATVLAGVEPGDSVVIYGAGPVGLMAALSASIKGASKIMVVDSHPDRLKLAEKIGAIPVDDTDGSSAERILEMTGGEGADRGCECVGYQCSCKGHEVPNLTMNNLIKAVRPTGGIGVVGVFVAEDPKAGDELAKKGQLALDFGQLWMKGQHIATGQANVKAYNRKLRDLIAAGKARPSQIISHELPLDKAPDGYKHFDERDDGWTKVVLKPAA

SEQ ID NO: 4098 - protein, 151 aa, Prochlorococcus marinus str. NATL1A
MTLERTFVAIKPDGVQRGLIAEILGRFETKGFKLVGLKQLTPSKELAEKHYGVHKDRPFFSGLVDFITSGPVVAMVWEGEGVIASARKLIGATKPLEAEPGTIRGDLAVNIGRNVIHGSDGSDTAVFEINLWFQENELVDWNPSDQAWRVE

SEQ ID NO: 4099 - protein, 418 aa, Vibrio vulnificus CMCP6
MTNTFIELGLDSSLSDHLSQLGFNTPTPIQQQAIPHLLQGRDVLAAAQTGTGKTAAYGLPLIQMLSRQSREETAPKHPRALILAPTRELAQQVFDNLKQYAQHTELAIVTVYGGTSIRVQQEQLAKGVDILIATPGRLLDHLFTKKTSLNQLQMLVLDEADRMLDMGFLPDIQRIMKRMPEERQTLLFSATFETRVKALAYRLMKEPVEVQVAAANSTADTVKQMVYPVDKKRKSELLAYLIGSRNWQQVLVFTKTKQGSDALVSELKLDGIKAASINGDKSQGARQKALDDFKSGKVRALIATDVAARGLDIAQLEQVVNFDMPYKAEDYVHRIGRTGRAGQTGLAVSFMSRDEEYLLQAIENLLDTRLPQEWLAGFEPSEKENYVEDTPSKRTSRSAEKRKLKQKLKIHQGRGKKR

SEQ ID NO: 4100 - protein, 338 aa, Francisella tularensis subsp. tularensis SCHU S4
MYILSGDIGGTNTRLEVSLLENGATQSIAIRKYKGANFNCLSDIIDKFLSEVDLVGQIDSVCLAVAGFVSNGEVEVTNLPWMVSEQYISEGLGIDKTKVKVINDFEAIGYGIESLDREKDIITIQEGKKDDDNLCAVVGAGTGLGMCLVSYDKDDKPRVYKTEGGHVDFSPVDDEQVELFKFMRKTFHRISPERFCSGYGIYNIYKYVVRHPLYDQPECMELRRALFSVSDSDKAAVIVKYAIEHREPSALRTIDIFLSIYGSVAGNLALTSLPFRGLYIAGGIAPRLIKQIKESKFLEKFRDKGRMSNMMKDFPVHIIMNTDVGLIGARTYAAGLVK

SEQ ID NO: 4101 - protein, 345 aa, Zea mays
MGKLLCDPSAAAVAEALPPSPAPAPPPPLLAWSSPAPASSPEASISPTGWDAVWALEDQQRRRLHRIWERGVAWKPSSPGAGEAALPPVVFRLDHGGEVDADGNCLFTAARTAAAAKADARELRHRAVRRFAEVYAAAGEDDKNAVDAAVRHLYAPDLKAGWGVHVVQEIKVLVPKAQRHALDSAIQELVDLGIQREIAAETIYKERCITVDNGDSWTKYMSISGSSEDEHDIITLQYTEEGLLTIDENRDGRAAAFGDDIAIECLATEFKREVYVVQAHGADAMVDEDNCVFFLPHSPRGEVCEPPIFLFMKGTAWCGAGADHYEPLIATVLQHVTPDKAAVIL

SEQ ID NO: 4102 - protein, 552 aa, Francisella tularensis subsp. tularensis SCHU S4
MIKKFLRLIYIFYVINKYCLLNEPIRATKIKTLRALLLLNPFYYSRRVRRLEHGVRIREALEKLGPIFIKFGQALSVRADLLPPDVIKEVSKLQDNVPLFDNKIAAEQIEKAAKKPINEIFKSFESSPLASASVAQVHAAILQNDDKVVVKVLRPGIEKILKLDTSLMLFFATLLSKLKEIRRFKPVEIVKEINQSFFDELDLVREASNASQIRRNFEDSAIHYVPKIYWEYTSSTVMVMERVGGVRVSDIETLDALGVDRRLLAQRGVEIFYSQVFDDCFFHADMHPGNMFIDVSNPADPKYISIDFGIVGTLNRDDQRYLAGNFLAFFKRDYRKVAELHIESGWVPSDTRVDVLESAIRTVCEPIFEKPMKEISLGYTLMQLFAVARRFNMNIQPQLTLLQKTLFHVEGLGQKLCPELNIWETSRPILEKWMKEQMGLRGFYHRSMENMPRVSDKLPELPRMVFDILQQTQINLKNTTTSTQFNNLKEPKKKYRFALGCGLVLTTIGVIYTLNKDTTPLIKLQNFISNYSTSFIIVGVACLIYYSFKKEK

SEQ ID NO: 4103 - protein, 513 aa, Gibberella zeae PH-1
MFATQSPRHLQVLLCRTKKFALASPPICYKVGAASSGSIRKFLSARFSTSARARNLKQSVLDNSGRHGVYLYPTLKPEPLNVVSAKDTTVVFSNGKTIEDTTCGAAVACLGYNNERVKNAMIKQMDSFCYSNSLFYGHEIGEELAAELIGGTNGEMAKVYLMCSGAEAMESAMKMARQYYMELNPRQPQRTNFIAREGSYHGSTLGALSMGGHVGRRKLFEGMLLDNNIHRVSAANEYRGKADGQTTEEYVQQLADELDRKFQEVGPETVAAFVAETLVGATLGTIPAPTGYFKAMKKVCDKYGALLILDEVMCGMGRCGSLHEWEQEGVVPDIQTVAKGLAGGFAPMAAMFINHRLSDALMSGSGTSVFSHGHTYQGHPVGCAAALEVQRIIREDNLVENVRKNGEYLGKLLHDQLDDHPNVGNIRGRGFFWSMEFVADKETKEPFLPSDGIAKKVHLTALNDVGISLYPGMGTKDGVAGDHAWIGPAYNCSKQDIERIVSKVKEAVVLALG

SEQ ID NO: 4104 - protein, 112 aa, Francisella tularensis subsp. tularensis SCHU S4
MSDCIFCKIITGEIPSKKVYEDENIFAFHDINPAADVHILVIPKKHIASLNDLTEQDQELMGKFILSIPKVAKLMGLKGFKTIFNTGKEGGQMVFHLHAHILGGKIRSKLPE

SEQ ID NO: 4105 - protein, 208 aa, Solanum lycopersicum
NSARAQLAINDNANGLARYAIICQQNGLVPIVEPEILVDGAHDIKKCADVTERVLAACYKALNDHHVLLEGTLLKPNMVTPGSESPKVAPEVIAEYTVRALQRTMPPAVPAVVFLSGGQSEEEATVNLNAMNKLQTKKPWSLSFSFGRALQQSTLKAWGGKEENVQKAQAAFLTRCKANSEATLGKYVGASNLSEGASESLHVKDYKY

SEQ ID NO: 4106 - protein, 1361 aa, Aspergillus nidulans FGSC A4
MVEQQTDKDKRLGITWYNLIVKGIATDAAFHDNVGSQFNIPARVKGSRAKPLLRTIIDNSHGCVKPGEMLLVLGRPGAGCTSLLKILANRRLGYAQVTGEVRYGSMTADEAKPYRGQIVMNTEEELFFPTLTVQQTIDFATRMKVPHHLHSNSTKARFQQFNRDFLLRSMGIEHTRDTKVGNEFVRGISGGERKRVSIIETMATRGSVFCWDNSTRGLDASTAMEYIRCMRAMTEVLGLSSIVTLYQAGNGIYDLFDKVLILDEGKQTFYGPLHQAKPFMEELGFLYSDGANIADYLTSVTVPTERRVKPDMESRYPRNAEELRSYYEATQLKRKMALEYNYPISAEAAEATKNFQEAVHSEKSPALSRRSPLTVSFSTQVKSAVIRQYQLLWGDKVTFLIPQGLNFVQALITGSLFYNAPKNSSGLPFKSGSLFFAILLNSLLSMSEVTNSFAARPVLAKHRGFALNHPAAFCFAQIAADVPLILTQVTLFALPVYWMTGLKATGEAFMIYWITTISVTMCMTALFRAIGAAFSSFDAASKVSGFLMSALIMYTGFLLPKPSMHPWFSWIFWINPLAYGYEAILSNEFHGQLIPCVNNNLVPNGPGYTNSEFQACTGIRGVPAGASVITGDQYLQGLSYSHAHVWRNFGIMWAWWVLFVILTVYFTSNWSQVSGNSGYLVIPREKAKKTKHLTMDEEAQPGLDLHDSSHRGGTSPIDDEKGSHTNSSSKVDAQLIRNTSIFTWKGLSYTVKTPSGDRVLLDNVQGWVKPGMLGALMGSSGAGKTTLLDVLAQRKTEGTIRGSILVDGRDLPVSFQRSAGYCEQLDVHEPLSTVREALEFSALLRQSRDTPVVQKLKYVDTIIDLLEMHDIENTLIGTTAAGLSVEQRKRLTIGVELVSKPSILIFLDEPSSGLDGQAAFNIVRFLRKLADVGQAVLVTIHQPSASLFAQFDTLLLLAKGGKTVYFGDIGHNGATVKEYFGRNGAPCPQNTNPAEHMIDVVSGSLSVGKDWNEVWLTSPEYTAMTQELDRIIMEAASKPPGTLDDGHEFATPIWTQLKLVTNRNNASLWRNTDYINNKFMLHVISGLLNGFSFWKLGNSVADLQMRLFTIFNFIFVAPGVMAQLQPLFLERRDIYEAREKKSKMYHWSAFATGLVVSELPYLVLCAVLYYVTWYYTVGFPSGSDKAGAVFFVMLMYEFIYTGIGQAIAVYAPNAVFAILVNPLVIGILVFFCGVYVPYSQIHEVWRYWLYYLNPFNYLMGSMLVFTTFDAPVHCERSELAVFNTPDGQTCGEYLADYMQGLGSRTNLLNPNDTQDCKVCQYRTGSDYLYTINLKDYFYGWRDAAIVALFAVSSYACVYALM

SEQ ID NO: 4107 - protein, 464 aa, Solanum lycopersicum
MATCGIDWKSVLPNCFKGNNVRSEAKVMENSKQMNSDHHRLAFSDISTDSRSVLISLDDLSSNAVIGSNLHVFTYEELKLITSDFSSANFLGKGGFGPVHKGFIDDKIKPGLDAQPVAVKLLDLDGNQGHQEWLTEVVFLGQLRHHHLVKLIGYCWEEEQRLLVYEYMARGNLEDQLFSRYSSCLPWLTRIKIMVGAAKGLAFLHGEEKPVIYRDFKASNILLDSDYRAKLSDFGLAKDGPEGDDTHVSTRVMGTHGYAAPEYIMTGHLTSKSDVYSFGVVLLELITGRRAMDKKRPLKERILVDWARPMLRDPHKLDRIMDPRLEGQYSTQGAKKVAALAYQCLSHHPRSRPTMSNIVKILEPVLDMKDIPMGPFVYVVPSSKPDKGTEIGELKTKVNDENKAGVRENEVDNAGENREDGNAKQRRVGHRYKHRLKTDASVYSDTHLYHKTVKHERTNKLNSY

SEQ ID NO: 4108 - protein, 567 aa, Oryza sativa (indica cultivar-group)
MRTMLPLLVILVVGLRLAGASPPPQPVACTKGTTDCTVTNVYGSFPDRTICRAADASFPRTEAELVAAVAAAAAAERKAKAATRHSHSFPKLACPGGRDGTIISTRFLNRTGRRAAAGLALPHSPYWYGLTVGGLLATGAHGSSLWGKGSAVHEYVVGLRIVTPAPASQGFAVVRELVAGDPDLDAAKVSLGVLGVISQVTFELQPQFKRSVRFVTRDDSDFAEKVAVWGGAHEFGDMAWLPRQGKVIYREDDRVDVATPGNGLNDYLGFRAQPTLGLITARAAEERLERNGTDIARCLAARLPPSLFELQAYGFTHDGVFFTGWPVVGFQHRIQASGTCISSPEDGLLSSCTWDPRIRGPFLYNSGFSIALPRAAAFVADMMRLRDLNPRAFCDIDAKLGILMRYVKASSAYLGKPEDCVDFDVTYYRSYDDGEPRPHSDVFDELEQMALRKYGAVPHWGKNRNFAFDGAAAKYPNSGEFIKVKERYDPDGIFSSEWSDQVLGISGSPNIVDKRCAIEGLCVCSDDSHCAPELGYFCRPGKLFKEARVCSKDKSAAAGDDDLLDEL

SEQ ID NO: 4109 - protein, 220 aa, Oryza sativa
MVSSREDGARHRRHPRNRVNNVGTNIRKPTTEFSAEEYSFMMATNLESAYHLCQLSHPLLKASGSGSMVFISSVCGLVAVFSGSLYAMTKGAINQLTKNLACEWARDNIRSNSIAPWYIRTSLTEGVKLLLINHPDLSCLDTCHFKSEHVVKYSTNCQDTLLANKDFEGAVVSRTPLRRVGEPEEVSSLVAFLCMPGSSYITGQTISVDGGMTINGLYPS

SEQ ID NO: 4110 - protein, 269 aa, Pseudomonas putida GB-1
MIRGSTELVAIVGSPIAQVKSPENFNTWFTHNNCNLAMLPIDLHEAALDSFAGTLRGWQNLRGCVVTVPYKQALANRLDGLSERAAALGSVNVIRRERDGRLLGDNVDGAGFLGAARKHGFEPAGKRALVIGCGGVGSAIAYALGEAGIASITLSDPSTARMGAVCELLGSAFPGLTISTQFSGLEDFDLVANASPVGMGNSAELPLSAALVATLQPDTLVADVVTSPEITPLLNRARQVGCAIQTGPEMAFAQLGHLGAFMGVTPLEI

SEQ ID NO: 4111 - protein, 194 aa, Zea mays
EPLHLAAWAGHVDVVRCLCKHKADVGAAAMDDTAALHFASQKGHVEVARELLASGASVKAKNRKGFTALHFAAQNSHLDLVKYLVKKGVDVTAKTKGGQTALHVAEDDEVRAFLKECEQSLKKGAELPSEKDDSAEKEGDSKSSGEVMKDEEDAEQGEKRKSELVGASSLSGVKKAKVSLGHLVCENDMDEEEE

SEQ ID NO: 4112 - protein, 442 aa, Burkholderia xenovorans LB400
MSTVFHRLPKQLLPVAVAGEGIEIIDSTGKRYIDASGGAAVSCLGHSNQRVIDAIKRQSQQLPYAHTSFFTTEPAEALADRLVASAPQGLEHVYFVSGGSEAIEAALKLARQYFVEKGEPRRRHFIARRQSYHGNTLGALAIGGNAWRREPFLPILIEAHHVSPCYAYREQRADETEEAFAQRLADELERKILELGADTVAAFIAETVVGATAGAVPPVREYFRKIRAVCDRYGVLLILDEIMSGMGRTGYLYACEEDGVAPDILTIAKGLGAGYQPIGATLVSERIYQAIVGGSGFFQHGHTYIGHATACAAALEVQRVIEEDNLLPNVLARGEQLRVRLREHYAQHPHIGDVRGRGLFVGVELVRDRAGKTPFDAALKLHAAIRREAFARGLMVYPMGGTVDGKIGDHVLLAPPFICTARDIDEIVSRLTDAIDGALAAV

SEQ ID NO: 4113 - protein, 166 aa, Synedrella nodiflora
MFPMVTEFMNYGQQTVRAARYIGQGFMITLSHANRLPVTIQYPYEKLITSERFRGRIHFEFDKCIACEVCVRVCPIDLPVVDWKLETDIRKKRLLNYSIDFGICIFCGNCVEYCPTNCLSMTEEYELSTYDRHELNYNQIALGRLPMSIIDDYTIRTILNLPEIKN

SEQ ID NO: 4114 - protein, 166 aa, Stevia rebaudiana
MFPMVTEFMNYGQQTVRAARYIGQGFIITLSHANRLPVTIQYPYEKLITSERFRGRIHFEFDKCIACEVCVRVCPIDLPVVDWKLETDIRKKRLLNYSIDFGICIFCGNCVEYCPTNCLSMTEEYELSTYDRHELNYNQIALGRLPMSIIDDYTIRTILNLPEIKT

SEQ ID NO: 4115 - protein, 319 aa, Bacillus licheniformis ATCC 14580
MKRIGVLTSGGDSPGMNAAVRAVVRKAIYHDVEVYGIYNGYSGLISGKIEKLEIGSVGDIIHRGGTKLYTARCPEFKTVEGREKGIANLKKYGIEGLVVIGGDGSYMGAKKLTEHGFPCVGVPGTIDNDIPGTDLTIGFDTALNTVIDAIDKIRDTATSHERTYVIEVMGRHAGDIALWSGLAGGAESILIPEADYDMEEIIARLKRGHERGKKHSIIIVAEGVGSGVEFGKRIEEATNLETRVSVLGHIQRGGSPTAADRVLASRLGAFAVELLLEGKGGRCVGIQNNQLVHHDIIEILEQKHTIDQSMYRLSQELSI

SEQ ID NO: 4116 - protein, 166 aa, Steiractinia sodiroi
MFPMVTEFMNYGQQTIRAARYIGQGFMITLSHANRLPVTIQYPYEKLITSERFRGRIHFEFDKCIACEVCVRVCPMDLPVVDWKLETDIRKKRLLNYSIDFGICIFCGNCVEYCPTNCLSMTEEYELSTYDRHELNYNQIALGRLPMSIIDDYTIRTILNLPEIKT

SEQ ID NO: 4117 - protein, 335 aa, Pyrococcus abyssi GE5
MDKLKIIMEKGTERLKRGFAKMVKGGVIMDVTNAEQARIAEEAGAVAVMALHKVPADIRKAGGVARMAPVEKIQEIMDAVTIPVMAKCRIGHEAEARILEALGVDMIDESEVLTPADPFFHIYKKKFTAPFVCGARNLGEAVRRIWEGAAMIRTKGEAGTGNIVEAVRHVRLVNENIRLIQRMTDEEIYGVAEKFAEPYLRLAFSVKEISGLPKRVLENEPIYEGFTYREIVEGIYKILLEIKKLGRLPVVNFAAGGVATPADAALMMAMGMDGVFVGSGIFKSSNPPKMARAIVEAVNHWDEPDVLAEISREIGEPMRGQAIEELQVRMEERGV

SEQ ID NO: 4118 - protein, 384 aa, Bacillus anthracis str. A2012
  misc_feature (365)..(365): Xaa can be any naturally occurring amino acid
  misc_feature (374)..(374): Xaa can be any naturally occurring amino acid
MRKFDKSIAAFEEAQDLMPGGVNSPVRAFKSVGMNPLFMERGKGSKVYDIDGNEYIDYVLSWGPLIHGHANDRVVEALKAVAERGTSFGAPTEIENKLAKLVIERVPSIEIVRMVNSGTEATMSALRLARGYTGRNKILKFIGCYHGHGDSLLIKAGSGVATLGLPDSPGVPEGVAKNTITVAYNDLESVKYAFEQFGDDIACVIVEPVAGNMGVVPPQPGFLEGLREVTEQNGALLIFDEVMTGFRVAYNCGQGYYGVTPDLTCLGKVIGGGLPVGAYGGKAEIMRQVAPSGPIYQAGTLSGNPLAMAAGYETLVQLTPESYVEFERKAEMLEAGLRKAAEKHGIPHHINRAGSMIGIFFTDEXVINYDAAKXQTYILCGLLS

SEQ ID NO: 4119 - protein, 287 aa, Lupinus albus
GKEQDVSLGANKFPERQPLGIAAQSQDEFKDYQEPPPAPFFEPSELTSWSFYRAGIAEFVATFLFLYITILTVFGVQRSPTKCQSVGIQGIAWAFGGMIFALVYCTAGISGGHINPAVTFGLFLARKLSLTRAVFYIVMQVLGAIVGAGVVKGFEGKHRYTQYNGGANFVAPGYTKGDGLGAEIVGTFVLVYTVFSATDAKRSARDSHVPILAPLPIGFAVFLVHLATIPITGTGINPARSLGAAIIFNKDLGWNDHWIFWVGPFIGAALAALYHQVVIRAIPFKSK

SEQ ID NO: 4120 - protein, 411 aa, Bacillus licheniformis ATCC 14580
MSLKEKALHMHKVNQGKLESKSKVQVRNADDLSLAYSPGVAEPCKAIYDDNSKVYDYTMKGNMVAVVSDGTAVLGLGNIGPEAALPVMEGKAVLFKSFAGVDAFPICLNTSDVDKIVETVKLLEPTFGGVNLEDIAAPNCFVIEERLKKETKIPVFHDDQHGTAIVTVAGLVNALKLSGKTMSSVKVVANGAGAAGIAIIKLLYHFGVRDIIMCDTKGAIYEGRPNGMNAVKEEVAKYTNKNRIDGSLKDVIKDADVFIGVSVEGALTKEMVESMADKPIIFAMANPNPEIMPAEAHEAGASVVGTGRSDFPNQVNNVLAFPGIFRGALDVRATHINEEMKIAAVEAIASLVSDEELRPEYVIPAPFDPRVAPAVAKAVAKAAMETGVARIDVDPEEVAEKTRKLAVIEGK

SEQ ID NO: 4121 - protein, 665 aa, Pyrococcus abyssi GE5
MFIGDRVIRVVCPYCGFGCNLLIDPKTLKVKPYKGEPNRGKLCPKGLHALEFVLSKDRLRYPLKKVGSDFVRIGWDDAIREIASKLREIKERYGPNAIAFIASSKVSNEENYLLQKIARLLGTNNIDNCARLCHEASVHALKMTLGAGVQTNPYSDLENFKAIMIWGYNPAETHPVVMDYILNAKRKGAKIIVIDVRETTTMRLADYKLMINPGTDITLANALMNVIISEGLYDKEFVRSRTVGFSEVKMAVKKYTPEYAEKVTGIEAKLIREVAREFAKAGSGAIMWGMGLTQHVSGVENVIAVIDMALLLGYVGDKGGLYPMRGQNNVQGAAYMGALSEFLPGYVPLTDSTFRKRVASLWGVEDIPTERGLYLTELWDAILEGEVKALYIMGENPAVSEANVLKVRKALQKLELLVVQDLFLTRTARFAHYILPAAAFCEKEGSYMNSERRIQWSFKVCDPPGEAKPDWEILSLLGKELDLPGFPYEKVEDITEEYFKMFPELAGISVEELKNSNGIIIPYKRLHTIRFQTPDGKARLIAVEQIMPWEQPNGEYPLILTTVRVMSHYNTGEMTMRSPSLVKLMSEPVVYISESDAKKYGIKDGDLVKVETRRGSIVLKAKISKVKEGVIVVPFHFDANILTNDALNKAGTPELKYSSARIRKI

SEQ ID NO: 4122 - protein, 465 aa, Sesbania rostrata
  misc_feature (350)..(350): Xaa can be any naturally occurring amino acid
MEGFYRLVSYFQTQSEPAFCGLASLSMVLNALAIDPGRKWKGPWRWFDESMLDCCEPLEKIKVRGISFGKLVCLAHCAGAKVEAFHASHSSIDDFRKYVMKCSTSDDCHVISSYHRGALKQTGTGHFSPIGGYHVGKDMALILDVARSKYPPHWVPLTLLWEGMNYVDESTGQSRGFMLISRPHREPGMLYTLSCKHENWINIAKFLMDDVPFLLKSENVKDIHKVLSVIVTSLPSNFEEFIKWVAEIRRIEDAGSSLSVEEKARLAVKEEVLKQVQETRLFKHVASFLSNSCSRQIATSGDGDTLPVIACKCCCQGAEILGGKFSSPAGYCCQETCTKCWKAEDDKPIXMVCGTVVNGNTEQRVDVLIPSSSEKLCCSCSSTTEYIRMHPASTDVLTVLLLSLPSTTWAGITDEQLLREIHGLVSTENLPTLLQEEVLHLRRQLHILKRCQEGKIDEDLGVPFS

SEQ ID NO: 4123 - protein, 185 aa, Brassica napus
  misc_feature (175)..(175): Xaa can be any naturally occurring amino acid
STPRPIIFALMDRSEAELGDALTRFLPLGLGLLYLGKQESVEATAEVSKTFNEKIRKYCDMTLLSCAYAGTGNVLKVQDLLAQCGEHLEKGDIHQGPAVLGLAMVAMSEELGIDMEIRSLERMLQYGEQNIRRAVPLALGLLCISNPKVTVMDTLSRLSHDTDSEVAMAAIISLXLIGAGTNNAR

SEQ ID NO: 4124 - protein, 221 aa, Hordeum vulgare subsp. vulgare
MDTVAAWPQFEEQDYMTVWPEEQEYRTVWSEPPKRRAGRIKLQETRHPVYRGVRRRGKVGQWVCELRVPVSRGYSRLWLGTFANPEMAARAHDSAALALSGHDACLNFADSAWRMMPVHATGSFRLAPAQEIKDAVAVALEVFQGQHPADACTAEESTTPITSSDLSGLDDEHWIGGMDAGSYYASLAQGMLMEPPAAGGWREDDGEHDDGFNTSASLWSY

SEQ ID NO: 4125 - protein, 175 aa, Arabidopsis thaliana
MSLSRRDPLVVGSVVGDVLDPFTRLVSLKVTYGHREVTNGLDLRPSQVLNKPIVEIGGDDFRNFYTLVMVDPDVPSPSNRHQREYLHWLVTDIPATTGNAFGNEVVCYESPRPPSGIHRIVLVLFRQLGRQTVYAPGWRQQFNTREFAEIYNLGLPVAASYFNCQRENGCGGRRT

SEQ ID NO: 4126 - protein, 149 aa, Oryza sativa (japonica cultivar-group)
MEVAKPRWYERTLVLAVQRVFFNAYFLGYLLSPKLAHRVVGYLEEEAIHSYTEYLKDIEAGKIENVPAPPIAIDYWRLPAGATLKDVVVVVRADEAHHRDVNHFASDVHFQRMDLKDTPAPARLSLMINFQKKNITDEILRRLVSCSAL

SEQ ID NO: 4127 - protein, 97 aa, Vigna unguiculata
MAALGGNRDVAGNQNSLEIDSLARFAVEEHNKKQNALLEFGRVVSAQQQVVSGTLYTITLEAKDGGQKKVYEAKVWEKPWLNFKELQEFKHVGDAPA

SEQ ID NO: 4128 - protein, 398 aa, Ralstonia eutropha JMP134
MSSNRGVVYLGPGQVEVQKIDYPKMVDPSGRAIGHGVILKVVTTNICGSDQHMVRGRTTAPTGLVLGHEITGEVIEIGRDVETLKLGDLVSVPFNVACGRCAMCKEQHTGVCLTVNPSRAGGAYGYVDMGGWIGGQSEYVMVPYADFNLLRFPDRDQAMAKIRDLTCLSDILPTGYHGAVTAGVKPGSTVYIAGAGPVGMAAAASARLLGAACTIVGDMNPARLAHAKAMGFEVVDLSKDATLGEQIAEILGTPEIDCAVDCVGFEAHGHGSSGYVEEAPATVLNSLMEITRPAGAIGIPGLYVTDDPGAQDAAAQRGSLSIRFGLGWAKSHSFHTGQTPVLKYNRNLMQAILHNRLPIAEIVNVTVIPLDQAPEGYKQFDGGAPRKFVIDPHGLLAA

SEQ ID NO: 4129 - protein, 313 aa, Thermotoga maritima
MGSSHHHHHHSSGLVPRGSHMEIKKGTWIIKKGFAEMFKGGVIMDVTSAEQAKIAEEAGAVAVMALERVPADIRKEGGVARMASIAKIREIMEAVSIPVMAKVRIGHIAEAKILEELGVDFIDESEVLTPADDRFHINKHEFKVPFVCGARDLGEALRRIAEGAAMIRTKGEAGTGNVVEAVKHMRRVMEQIKQVTKMEDEELVAYGKEIGAPVELLREVKRLGRLPVVNFAAGGVATPADAALMMMLGADGVFVGSGIFKSKDPRKMAKAMVLAVTYWDNPRILLKISEDIGEPMRGLDVEELEVRMQERGW

SEQ ID NO: 4130 - protein, 606 aa, Delphinium x belladonna
MDSCACIDTQWPADELLVKYQYISDFFIALAYFSIPLELIYFVQKSAFFPYRWVLMQFGAFIVLCGATHLINLWTFSMHSKTVAMVMTIAKISTAVVSCATALMLVHIIPDLLSVKTRELFLKNKAEELDREMGLIRTQEETGRHVRMLTHEIRSTLDKHTILKTTLVELGRTLGLEECALCMPSRTGMNLQLSHTLRHQIPVGSTVSTNLPIVTQVFNSNQAIKIPHTCPLARIGPTAGRYVPPEVVAVRVPLLHLSNFQINDWPELSAKSYAVMVLMLPTDSARKWHDHELDLIEVVADQVAVALSHAAILEESMRARDMLMEQNIALDMARREAEMAIRARNDFLAVMNHEMRTPMKAVIALSSLLLEIELTPEQRVMIETVFKNSNLLAALINDVLELSRLEDGSLELDIRTFNLHGIFREVLNMIKPITAVKKLSLTLMLSPDLPVVAVGDEKRLMQIMLNVVGNAVKFTKEGYVSVIASVAKAESLRDWQAPEIFMVSSDSHFHLCVQVKDSGCGISPQEIPHLFTKFTQLRSGQNRGNDGAGLGLALCKRFLNLMEGHIWVDSDGTDKGCTVTIIVKLGICEGQPEPSNLQVVSRPRLS

SEQ ID NO: 4131 - protein, 596 aa, Oryza sativa (indica cultivar-group)
MEMSGAGAGGVPTKLEHDDAAAVAAEREPCGGGAPRREEKERWRRVLVVGCLVALLLFAFFVLGRESASEVLQIASSKLSAMNGGFTTKNPSHGGGAAKHADELLGGLLAPGMDRRSCRSRYQAAHYYKHFPYAPSPHLLDKLRAYEARHRRCAPGTPLYNRSVEQLRSGRSAGGVECNYVVWLPFDGLGNRMLSMVSGFLYALLTDRVLLVDLPHDSSDLFCEPFPGATWLLPPDFPVANLFGLGPRPEQSYTTLLNKKKITAVVNNDDDPASKNATAALPPPPAYVYLSLGYQMADKLFFCGDDQRALAKVNWLLLYSDLYFVPSLYSVAEFNGELRRLFPAKESACHLLARYLLHPTNAVWGMVTRYYNSYLAQASRRIGVQIRMFNFASIPVDDLYNQILTCSRQEHVLPETTTDNDNDDDLATAYDSNSSNGSGGGNYTAILIASLYPDYYERIRATYYEHATRGRVRVGVFQPTHEERQATQRLFHNQKALAEILLLGFSDELVTSGMSTFGYVGSSLAGVRPTILMPAHGHRVPAPPCRRAVSMEPCNLTPPRVGEAECREMAAVVDKEDVARHVKVCEDFDRGVKFFD

SEQ ID NO: 4132 - protein, 596 aa, Delphinium x belladonna
MMGSCDCIDTRWPANDLLVKYQYLSDFFIAVAYFSIPLELIYFVQKSAFFPYRWVLMQFGAFIVLCGATHLISLWTFSMHSKTLAMVMAIAKGATALVSCATALMLVHIIPDLLSVKTRELFLRNKAEALDRDLGLIRTEEETGRHVRMLTHEIRSTLDRHTILKTTLVELGRILDLEECALWMPSRNGMNLQLTHTLHHHIPVGSTVATNLPVVNLVFNSTEAIQIPPTCPLARIKPHTGRYLPPEIVAVRVPLLHLSNFEINDWPELSAKSYAVMVLMLPIDSARKWHDHELDLVEVVADQVAVALSHAAILEESMRARDKLMEQNIALDLARQDAERAIRSRNDFLAVMNHEMRTPMNAGMALSSLLLEIELTPDQRVMIESVLKNSNILETLINDVLELSRLEDGSLELNVKTFNLREAFREVLKLLKPIAAVKKLSLTLKVAPDLPVWAVGDETRIMQIILNVVGNAVKFTKEGHISVAACVAKAESIRGGLTPESHPLSSDSHFYLRIQVKDSGCGISSQDIPHLFTKFAQSRGGQIRNNDGAGIGLALSKRFLHLMGGHVSIESDGTGKGSTVTMVLKLGTSDGPNPQI

SEQ ID NO: 4133 - protein, 432 aa, Burkholderia xenovorans LB400
MNSKTHATLSFSDSDQTIDLPIYQGALGPDVIDIRKLYGQTGKFTYDPGFMSTAACNSAITYIDGDKGELLYRGYPIDNLAQNADFLETCYLLLKGELPNAQQKEEFVKTVTQHTMVHDQMHFFFRGFRRDAHPMAILVAAVGALSAFYHDSLDISNPEHREISAIRMIAKLPTLVAMAYKYTVGQPFVYPKNDLSYSANFMRMMFANPAEEYKVNDVLVRALDRILILHADHEQNASTSTVRLAGSSGANPFACIAAGIACLWGPAHGGANEAALNMLEEIGSVDNIPEFIAQVKDKNSGVKLMGFGHRVYKNYDPRAKLMRETCHEVLEELGLHDDPLFKLAMALEKIALEDDYFVSRKLYPNVDFYSGIVQRALGIPTAMFTCIFAMARTVGWIAQWNEMIADPEQKIGRPRQLFVGETQREAKPLAKR

SEQ ID NO: 4134 - protein, 511 aa, Coprinopsis cinerea okayama7#130
MSKPSLDSDLYGDIYGDELQDFLDDDGTANDATEQTSTEPQDASDDANRSASPQQAMDTSSSDNTQPGQLSYSAQIAQQFSAYKQTPSQERQQRAAQRPIPRVDSSTPAASSSDSIFGKKPSEMHDAGKMFIGGLSWDTTDEGLRDYFEQFGKVDACTIMRDPNTGTSRGFAFLTFEDPNCVDLVLKQSHSLDGKAIDPKRAIPREEHLRNTRFFVGGLAHSTTSESMKAFFSSYGKVVDATVMMDKETGRSKGFGFVTFEDVGTSLNHIVGKIGLVLDDKEIEIRLAQARNQRDQTRNLVNKITSDRGSTPDRSSTTPSPALSLPALNLAQMGPMAAMLFNRSMGNLGAMNMANMNNNPMSIPNTPMNNMGMPMNMSMNNMNPAAGGAMPLNVMAAMNPMMLASLNMANLASGNASGGNSNSAGAPIQNPLNAMAGMNMMLMNGLNPTMRMGMGGMIPGMAGAAGMQQGMAGMMNNSGRGKPGGMQPNGLGPARTHGAMRKQQGFHPYSR

SEQ ID NO: 4135 - protein, 466 aa, Rhodococcus sp. RHA1
MTSHYDVVVLGAGPGGYVAAIRAAQLGLSTAIIEQKYWGGVCLNVGCIPSKALLRNAELAHLFTKEAKTFGISGEASFDFGAAYDRSRKVADGRVKGVHFLMKKNKITEYDGKGSFTDANTLSVELSKGGTETVTFDNAIIATGSTTKLLPGTSLSENVVTYEEQILTRDLPESILIVGAGAIGMEFGYVLKNYGVDVTIVEFLDRALPNEDADVSKEIEKQYKKLGVTIKTGAAVQSIDDDGSKVTVSIKNNKSGDIETVVVDKVMQSVGFAPRVEGYGLEKTGVQLDRGAIGITDTMQTSVPHIYAIGDVTMKLQLAHVAEAQGVVAAETIAGVETLPIEDYRMMPRATFCQPQVASFGLTEQQAKDEGYDVKVATFPFTANGKAHGLGDPTGFVKLIADKKYGELLGGHLIGPDVSELLPELTLAQKWDLTVNELARNVHTHPTLSEALQEAIHGLAGHMINF

SEQ ID NO: 4136 - protein, 166 aa, Silphium perfoliatum
MFPMVTEFMNYGQQTVRAARYIGQGFMITLSHANRLPVTIQYPYEKLITSERFRGRIHFEFDKCIACEVCVRVCPIDLPVVDWKLETDIRKKRLLNYSIDFGICIFCGNCVEYCPTNCLSMTEEYELSTYDRHELNYNQIALGRLPMSIMDDYTIRTIFNLPEIKT

SEQ ID NO: 4137 - protein, 343 aa, Thiobacillus denitrificans ATCC 25259
MKNGAHTATIADFATAPPSPIVSLESLQSFLADDMRAVDHVIRERLYSDVVLIRQVSEYIINSGGKRLRPALVLLSAGCFGYRGQAHHELAAVVEFIHTATLLHDDVVDESELRRGRETANALFGNAASVLVGDFLYSRAFQMMVGVDNMEVMRILSDATNTIAEGEVLQLLNCHDPDIDEENYLRVIRYKTAKLFEAAGRLGAVIGGGSEADKDALARYGMHLGTAFQLIDDVLDYSGDFLKTGKNIGDDLAEGKPTLPLLYAMKHGSAAQAASIRHAIEHGGLTEFQSVLAAIKDTNALQYTREVAQREVQTANAAISRLPDSNSKTALLQLAAFAVERSF

SEQ ID NO: 4138 - protein, 125 aa, Salmonella enterica
SLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGIKNKIHPGEAMDKNLY

SEQ ID NO: 4139 - protein, 166 aa, Rensonia salvadorica
MFPMVTEFMNYGQQTIRAARYIGQGFMITLSHANRLPVTIQYPYEKLITSERFRGRIHFEFDKCIACEVCVRVCPIDLPVVDWKLETDIRKKRLLNYSIDFGICIFCGNCVEYCPTNCLSMTEEYELSTYDRHELNYNQIALGRLPMSIIDDYTIRTIFNLPEIKP

SEQ ID NO: 4140 - protein, 166 aa, Riencourtia oblongifolia
MFPMVTEFMNYGQQTIRAARYIGQGFMITLSHANRLPVTIQYPYEKLITSERFRGRIHFEFDKCIACEVCVRVCPIDLPVVDWKLETDIRKKRLLNYSIDFGICIFCGNCVEYCPTNCLSMTEEYELSTYDRHELNYNQIALGRLPMSIIDDYTIRTIFNLPEIKT

SEQ ID NO: 4141 - protein, 308 aa, Pyrococcus abyssi GE5
MNWEKFVEEKVKEIRETVGDSKAIIALSGGVDSSTAAVLAYKAIGDKLHAVFVNTGFLRKGEPEFVVKTFRDEFGMNLHYVDAQDRFFSALKGVTDPEEKRKIIGRVFIEVFEEVAREIGAEYLIQGTIAPDWIESQGKIKSHHNVGGLPERLNLKLIEPLRDLYKDEVRELAKFLGLPEKIYNRMPFPGPGLAVRVIGEVTPEKIRIVREANAIVEEEVERAGLRPWQAFAVLLGVKTVGVQGDIRAYKETIAVRIVESLDGMTANAMNVPWEVLQRIAFRITSEIPEVGRVLYDITNKPPATIEFE

SEQ ID NO: 4142 - protein, 188 aa, Pyrococcus abyssi GE5
MIVIMDNGGQYVHRIWRTLRYIGVESKIIPNTTPLEDIKAMNPSGIIFSGGPSLENTGNCEKILENYDEFNVPILGICLGHQLIAKFFGGKVGRGEKAEYSLVEIEILEEDEIFKGLPRKLRVWESHMDEVKELPPNFKVLARSETCPIEAMKHEELPIYGVQFHPEVAHTEHGEDILRNFAKLCGEL

SEQ ID NO: 4143 - protein, 166 aa, Raillardella argentea
MFPMVTEFMNYGQQTVRAARYIGQGFMITLSHANRLPVTIQYPYEKLITSERFRGRIHFEFDKCIACEVCVRVCPIDLPVVDWKLENDIRKKRLLNYSIDFGICIFCGNCVEYCPTNCLSMTEEYELSTYDRHELNYNQIALGRLPMSIIDDYTIRTILNLPEIKT

SEQ ID NO: 4144 - protein, 355 aa, Novosphingobium aromaticivorans
MRRYSIASIPGDGIGREVVPAAIEVLTAAAAKCGFVLEFRHFDWSCQTYLETGKMMPDDGLDRLRDHDAVFLGAVGFPGVPDHISLWGLLLPIRREFEQYVNLRPVRLLPGIASPLRDKAPGDIDFWVVRENSEGEYSQIGGRTGTGENEIVVQQAIFSRRGTDRILRYAFDFARRSGRRHVTSATKSNGLYHSMPFWDERFAAIGAEYPDVAADQYHVDILAARFVMSPERFNVVVGSNLFGDILSDLGPGITGTIAVAPSANLNPERRFPSMFEPVHGSAPDIAGQGIANPIGQIWSGAMMLEHLGEAEPAALVMRALETALIAPDIARTPDLGGNGTTAGFAQAVRSTLLGL

SEQ ID NO: 4145 - protein, 109 aa, Salmonella enterica
NLFSGDKYAGLSEQALYYIGGVIKHAKAINALANPTTNSYKRLVPGYEAPVMLAYSARNRSASIRIPVVASPKARRIEVRFPDPADNPYLCFAALLMAGLDGIKNKIHP

SEQ ID NO: 4146 - protein, 230 aa, Hordeum vulgare subsp. vulgare
MDTVAAWPQFEEQDYMTVWPEEQEYRTVWSEPPKRRAGRIKLQETRHPVYRGVRRRGKVGQWVCELRVPVSRGYSRLWLGTFANPEMAARAHDSAALALSGHDACLNFADSAWRMMPVHATGSFRLAPAQEIKDAVAVALEVFQGQHPADACTAEESTTPITSSDLSGLDDEHWIGGMDDEHWIGGMDAGSYYASLAQGMLMEPPAAGGWREDDGEHDDGFNTSASLWSY

SEQ ID NO: 4147 - protein, 216 aa, Bacillus cereus G9241
MTNNNQIGENKEQTIFDHKGNAIMTEDREIQIISKFEEPLIVVLGNVLSDEECDELIELSKNKLARSKVGSSRDVNDIRTSKGAFLDDNELTEKIEKRISSIMNVPASHGEGLHILNYEVDQQYKAHYDYFAEHSRSAANNRISTLVMYLNDVEEGGETFFPKLNLSVHPRKGMAVYFEYFYQDQSLNELTLHGGAPVTKGEKWIATQWVRRGTYK

SEQ ID NO: 4148 - protein, 392 aa, Corynebacterium glutamicum ATCC 13032
MTIDLQRSTQNLTHEEIFEAHEGGKLSISSTRPLRDMRDLSLAYTPGVAQVCEAIKEDPEVARTHTGIGNTVAVISDGTAVLGLGDIGPQASLPVMEGKAQLFSSFAGLKAIPIVLDVHDVDALVETIAAIAPSFGAINLEDISAPRCFEVERRLIERLDIPVMHDDQHGTAVVILAALRNSLKLLDRKIEDLKIVISGAGAAGVAAVDMLTNAGATDIVVLDSRGIIHDSREDLSPVKAALAEKTNPRGISGGINEAFTGADLFIGVSGGNIGEDALKLMAPEPILFTLANPTPEIDPELSQKYGAIVATGRSDLPNQINNVLAFPGIFAGALAAKAKKITPEMKLAAAEAIADIAAEDLEVGRIVPTALDPRVAPAVKAAVQAVAEAQNA

SEQ ID NO: 4149 - protein, 540 aa, Francisella tularensis subsp. tularensis SCHU S4
MLFCDDSKKYLKEQNINLKNEFDKDDKRVEKFSLKHQNIYFDYSKNLINDYILKSLLESAEKSSLKDKIKQMFNGAKINSTEHRAVLHTALRDLSSTPLIVDGQDIRQEVTKEKQRVKELVEKVVSGRWRGFSGKKITDIVNIGIGGSDLGPKMVVRALQPYHCTDLKVHFVSNVDADSLLQALHVVDPETTLFIIASKSFSTEETLLNSISAREWLLDHYEDEKAVANHFVAISSKLDKVKEFGIDLEHCYKMWDWVGGRYSLWSSIGMSIAFAIGYDNFEKLLAGAYSVDKHFKETEFSKNIPVIMALLASYYSCTYNSQSQALLPYDERLCYFVDYLQQADMESNGKSVNIAGETVNYQTGVVLWGGVGTNGQHAFHQLLHQGNIFIPVDFIAIATSHHNYDNHQQALLANCFAQSQALMFGQSYDMVYNELLKSGLNETQAKELAAHKVIPGNRPSTTILLDELSPYSLGALIALYEHKIFVQGVLWDINSYDQWGVELGKKLGKNILKAMNDDSSDEYQNLDDSTRQLIAKVKNK

SEQ ID NO: 4150 - protein, 888 aa, Novosphingobium aromaticivorans
MSSVFSFGSGVLVAGQIGLDKRVLGGKGANLAEMARIGLPVPPGFTISAGECLAYLDHGRASLDRIRDEVSAALGLVERATGKTFGNPRDPLLVSVRSGARVSMPGMMDTILNLGINDATVTGLGQSSGDERFALDSYRRFIQMYSSVVLEIEHGVFEAALDRIKEDRGVDEDIDLRVEDLRGVIATFKDLVLAHHGAAFPQDVQEQLWTAIEAVFRSWDSPRAKVYRRLNDIPGDWGTAVNVQAMVFGNLGETSATGVAFTRNPATGEKAYYGEWLANAQGEDVVAGIRTPQYLTRAAREAAGARLPSMQEAMPKAYAQLAEVFELLERHYRDMQDIEFTVERGRLYLLQTRSGKRTAKAALKIAVDMVEESLVDEVTALLRLDPASLDQLLHPSLDPNAPRVLLGKGLPASPGAASGGVVFDAETAARWAELGEKVILVRHETSPDDIHGMHVATGILTARGGMTSHAAVVARGMGRPCVAGTASLKIDPVARVAEIGGQRLEEGAFITIDGSTGEVFLGELPTILPKLSGDFATVMAWADKHRRLKIRTNAETPLDCEMARRFGAEGVGLCRTEHMFFDESRILAMRQMILADSEKERRSALDQLLPEQRTDFRRIFEIMEGLPVTIRLLDPPLHEFLPHTDSEFTELSRAMGIDVEQVRHRAIELAETNPMLGHRGCRLGVVYPEIYEMQARAIFEAALEVAGEAGMAVCPEIMIPLVGLPRELESLKDTLYRVAEVVFAEKGERIAFSVGTMIELPRAALVADEIAASGEFFSFGTNDLTQTTLGISRDDAARFLGAYVEKGIIAKDPFVTLDIEGVGKLIEMASRKGRETRPDLKLGICGEHGGDPATIAFCEEIGLDYVSASPFRVPIARLAAAQAALAPS

SEQ ID NO: 4151 - protein, 249 aa, Hordeum vulgare subsp. vulgare
MDMGLEVSSSSPSSSPVSSSPEHAARRASPAKRPAGRTKFRETRHPVYRGVRRRGNTERWVCEVRVPGKRGARLWLGTYATAEVAARANDAAMLALGGRSAACLNFADSAWLLAVPSALSDLADVRRAAVEAVADFQRREAADGSLAIAVPKEASSGAPSLSPSSGSDSAGSTGTSEPSANGEFEGPVVMDSEMFRLDLFPEMDLGSYYMSLAEALLMDPPPTATIIHAYEDNGDGGADVRLWSYSVDM

SEQ ID NO: 4152 - protein, 830 aa, Yersinia pestis CO92
MKLSRRDFMKANAAVAAAAAAGMTIPTVAKAVGETTNAIKWDKAPCRFCGTGCGVLVGTQNGRIVASQGDPDSPVNRGLNCIKGYFLPKIMYGKDRLTQPLLRMKDGQYDKEGDFTPISWEKAFDIMELKFKNALKEKGPTAVGMFGSGQWTVWEGYAALKLLKGGFRSNNLDPNARHCMASSVVGFMRTFGMDEPMGCYDDIEEADAFVLWGSNMAEMHPVLWSRMTSRRLTNAHVRIAVLSTYEHRSFELADNPIVFTPQTDLVIMNYIANYIIQNNAVDKDFLAQHVNFRRGATDIGYGLRPTHPLEKAAKNPGSDASEPMSFEDFKTFVAEYTLEKAAKMSGVPEDQLESLAQLYADPKVKLVSYWTMGFNQHTRGVWANNMCYNLHLLTGKISTPGSGPFSLTGQPSACGTAREVGTFSHRLPADMVVTNEKHRQIAETTWQLPAGTIPEKVGLHAVAQDRALKDGTLNAYWVMCNNNMQAGPNINEERMPGWRDPRNFIVVSDPYPTISALSADLILPTSMWVEKEGAYGNAERRTQFWRQQVPSPGEAKSDLWQIVEFAKRFNVEEVWPAELVNQKPEYRGKNLYEVLFANDVVSKYPLSEIPDDQLNDEARDFGFYIQKGLFEEYASFGRGHAHDLAPFDVYHQVRGLRWPVVDGKETLWRYREGFDPFVPKGEEVRFYGKPDGKAVIFALPYEPAAESPDQEYDLWLSTGRVLEHWHTGSMTRRVPELHRAFPEAVLFIHPLDAKARGLHRGDKVKVISRRGEVISLVETRGRNRPPRGLVYMPFFDAAQLVNNLTLDATDPLSKETDFKKCAVKLERVVA

SEQ ID NO: 4153 - protein, 368 aa, Ralstonia eutropha JMP134
MKTRAAVAWGAGKPLTIEDVDLEGPRAGEVLVEIKATGICHTDYYTLSGADPEGIFPAILGHEGAGIVTDVGAGVTSLKPGDHVIPLYTPECRQCKFCLSRKTNLCQAIRATQGKGLMPDGTSRFSIDGQPIFHYMGTSTFANHIVVPEIALAKIRPDAPFDKVCYIGCGVTTGVGAVIFTAKVEAGANVVVFGLGGIGLNVIQGAKMVGADKIIGVDLNPEREAMARKFGMTHFINPKDVGNVVDHIIQLTDGGADYSFECIGNTQVMRQALECCHKGWGKSIIIGVAEAGAEISTRPFQLVTGREWKGSAFGGARGRTDVPKIVDWYMDGKLNIDDLITHTLPLDRINEGFDLMKRGESIRSVVLY

SEQ ID NO: 4154 - protein, 589 aa, Triticum aestivum
MVEADPRGALLDWDEGHATPCSWFGVQCSDDGRVVGLNLSNLGLKGVLSPEIGQLINMHSLVLHKNLFYGTIPREIGDLRELKVLDLGYNNFNGSIPSELINILSLEFIFLKGNRLYGDLPLELNELISLCESQVHQGRALSNRMPTARGKDSATTRRLLAGKEIHSPKNEMLGSENSVLEPSDVSPFFKLHEPHKDPTPPVLPHALTPPPPSEPAPSLAPLVSPNKDQILSKGSKGKSGKSSSVTIYALIGAAICFVILSLSAAIFICYRRGKASSVVPMSSSRELQTTILGGIALFRRSELETACEDFSNVIGTLPGCTLYKGTLPCGAEIAVASTLIKHAYGWSAIAEAQFKNKVEMLSRVNHKNFLKLVGYCEDEKPFTRMMVFEYVSNGSLFEHLHVNEAEHLNWQSRLRMAMGVIYCLYHMYQQYPPVILRNLNSSCIYLTEDNAAKISDISFGDDWKEGEDEFDEPEECTIVYRFALLLLETISGRRPFSNDTGLLILWAHRYLTGEKPLAGMVDPTLRSVPLEQVAALTELVKLCIRDDPWRRPSVGEVTRRMQEITGFSQDQSTPRNSALWWAELEILTV

SEQ ID NO: 4155 - protein, 230 aa, Spinacia oleracea
GRGKIEIKRIENTTNRQVTFCKRRNGLLKKAYELSVLCDAEIALIVFSSRGRLYEYANQSVKGTIDRYKKACSDQTGAGSVAEANAQYYQQEAAKLRNQIRTATENNRLLSRHMMGEGLSSLSMKELKNLETKLEKGISRIRSKKNELLFAEIEFMQKREIELHNNNQFLRARISENERAQQSMSLMPPGGSDYDLVPSQSFDSRNYFQVNALQPNSQYARQDQTPLQLV

SEQ ID NO: 4156 - protein, 286 aa, Pseudomonas putida KT2440
MPQTKHPSNAPQLLSSVTVARLPARQAHAHKGDFGHVLVVGGDLGTGGAVLLSAEAALRCGAGLVSVATRPEHVSASLARLPEVMCLGVRSANQLMGVLERASVLVVGPGLGQAAWGCSLLSAVANAERPQVWDADALNLLARTPLALPSGSILTPHPGEAARLLGIATEAVQADRPGAARKLARRYNSVCVLKGAGTLVAAPSGQLALCERGHPAMAGAGLGDVLTGVLAALLAQGLDAWGAACLGVWLHACAGERLGKKGRGLAASDLAPVIRELLEEHSACLA

SEQ ID NO: 4157 - protein, 304 aa, Burkholderia xenovorans LB400
MNYASILEQIHGDLQPYLGSGKVADYIPELARVPADSFGMAIVTASGEVFRTGEADTRFSIQSISKLFACTMAFRLLGDALWQRVGREPSGNAFNSLVQLEAEQGKPRNPFINAGALVVTDVLCRRFVQAETALVEFMRRLTGEAGIDYDSRVAQSELQHAHRNRAMAHFMASFGNMEMPPEVVVDAYCRQCAISMSCVELAKAALFLTNHGVVPATGERILDTSSAKRLSALMLTCGTYDAAGDFVYRVGLPAKSGVGGGIVAVLPGEMAVCVWSPGLDSNGNSLAGVLALEWLTTCTGQSIF

SEQ ID NO: 4158 - protein, 300 aa, Brassica napus
  misc_feature (291)..(291): Xaa can be any naturally occurring amino acid
  misc_feature (298)..(298): Xaa can be any naturally occurring amino acid
SVLGEGGFGCVFKGWIDEKSLTATKPGTGLVIAVKKLNQDGWQGHQEWLAEVNYLGQFSHGHLVKLIGYCLEDEHRLLVYEFMPRGTLENHLFRRGLYFQSLSWKLRLKVALGAAKGLAFLHSSETRVIYRDFKTSNILLDSEYNAKLSDFGLAKDGPIGDESHVSTRVMGTHGYAAPEYLATGHLTTKSDVYSFGVVLLELLSGRRAMDRNRPSGERNLVEWAKPYLANKRKIFRVVDNRLQDQFSMEEACKVATLSLRCLTTEIKLRPDMKEVVSQLEHIQSLNASRGXNVDRTEXRV

SEQ ID NO: 4159 - protein, 384 aa, Clostridium acetobutylicum ATCC 824
MIKINNRLKSIDEYHFKKIEDKKRELIKKGKQIIDLGIGDPDLEVSNRVQNEIIKSLGIKDFNKYPPYSGIEKLKSRVIKYYRDIFQVNLDLDEIIITIGSKEGISSIIPSICDIGDYVIVPNPGYQVYTAASYLWGAVPYKIPLTDKNDYLPNLNVIPQNIALKSKLFFINYPNNPTGAEANKDFFKDIVEFCKKRNIVLVNDSAYNEIIKKESTPISLLQSDEDKKMIEIGSFSKTYNMTGFRVGYVVGNKGVIKALLKVKSNIDSGQFMPVQYAAAEAINLDRNEIKKSREIYDKRRSTAKKILSKKGIKYFDASAAFYIWCSVPKGYSTDEFCDKLLSEYGVVVTPGYCFGNLGYGFFRIALTTKIENIETALSKFEDFQ

SEQ ID NO: 4160 - protein, 160 aa, Glycine max
  misc_feature (34)..(34): Xaa can be any naturally occurring amino acid
  misc_feature (49)..(49): Xaa can be any naturally occurring amino acid
  misc_feature (53)..(54): Xaa can be any naturally occurring amino acid
  misc_feature (57)..(57): Xaa can be any naturally occurring amino acid
  misc_feature (63)..(63): Xaa can be any naturally occurring amino acid
  misc_feature (70)..(70): Xaa can be any naturally occurring amino acid
  misc_feature (91)..(91): Xaa can be any naturally occurring amino acid
MPNDSVLSLFFFVTLFTCLLSATSHDDHIFLPSXLHDDDSVSCTATDPXLNYXXVIXILTHPXRRGSGRXQHATGVFLTLPLPKVNSLKSXGGVKLIPLNYIGAPGKLKKKLQFGQREGPYLWGGAGFRPHFGEPLETFFKKVLKKNGGGEQFPRELPSN

SEQ ID NO: 4161 - protein, 675 aa, Myxococcus xanthus DK 1622
MTVEYKLTIRTGTKLGAGTDADISIVLVGTRGESAPRVLDKHFHNDFEAGAEDVYALSSEDLGDLVLLRFSNAGGVAADWLLDWAIVTAGEKQWHFPFYRWVLSGATVDVLEGTAKLARQASSERESTARRELLEARQRMYPWRAPEMTEGLPGALDLREGRPLPKDELYRGLTEGSYEVVIAKTLAAIKLNLPMLTRAWNGLVDIFDFFKHLEVPQLAQRWKDDLEFARQAVQGIAPLHITLVPSLPQGMPLTDDDVRGLLSPGTTLARALDAKRIFLIDFEILDDIRMYRKVGEDGVEERRWAPAARCLLYLDDQRQLRPLAIQLGRDAQKDPVFTPNDDAYDWLAAKIYLRCSEGNSHQMVSHALRTHFVAEPFVMATMRNLPDPHPVYKLLRRHFRYTLAINEGARKGLLDAGGVFDDFIATGGPDKGHLQLGKKGFQRWTLADNKPRADLERRGVLDPAVLPNYPYRDDALPLWDAFEEYVGGVLRHFYRTDADLEADTEMQQWWKDLTEHGLPVDKLPCRELRRVDDLVDILTTVLFTVSVQHAAVNYLQYEHYAFVPNAPLSMRREPPRQKGTLRAEDIPEMIPTKSQMLWQVAIGRALSSFGDDEEYLLHEGGWREEYFHEPELVAIRQRFQERLRAQREAVEARNAGAEVPYTILRPDRIPCGITV

SEQ ID NO: 4162 - protein, 166 aa, Psilostrophe gnaphalodes
MFPMVTEFMNYGQQTVRAARYIGQGFMITLSHANRLPVTIQYPYEKLITSERFRGRIHFEFDKCIACEVCVRVCPIDLPVVDWKLETDIRKKRLLNYSIDFGICIFCGNCVEYCPTNCLSMTEEYELSTYDRHELNYNQIALGRLPMSVIDDYTIRTILNLSEIKT

SEQ ID NO: 4163 - protein, 408 aa, Azoarcus sp. EbN1
MLTPVNLLDFDVDGLVTWFAERGEKPFRARQVMRWMHRFGETDFGNMTDVAKSLRAKLAEEACIRAPRAIRDAVSVDGTRKWLLDVGSANAVEAVFIPETNRGTLCISSQAGCALDCAFCSTGKQGFNRNLSAAEIIGQLWLANRLLGGSASPAGSKDGDGGPDHASRATKLDHRAADAKGVQSDSWRSSDPEEDHNGRVISNVVMMGMGEPLANFDNVVTALRLMLDDHAYGLSRRRVTVSTSGIVPAMDRLRDECPVALAVSLHAPDDALRDRLVPINRKYPLRELMAACQRYLERAPRDFVTFEYVMLDDVNDSDAHARALVELVRDVPCKFNLIPFNPFPNSGFDRSPAERIRRFAAILIDAGIVTTTRKTRGDDVNAACGQLAGQVQDRSRRTVRLVKPMEGR

SEQ ID NO: 4164 - protein, 289 aa, Pseudomonas putida GB-1
MSNFRGIWIALVTPMRDNEIDFPGLERLVKKLLEDGVAGFVVCGTTGEAAALSKAEQLAVLDAVLAWVEPGRVVMGLSGYNLRELLGLQAEIQQRDIGGLLVPAPCYIRPSQAGIEAFFATVADAARVPVIVYDIPYRTGVRIERETLRRIVRHPRIAAVKDCSGDSETTMALIEDGHAQVLAGEDLQIFNNLCLGGAGAISASAHVRADLYVRMLQQVDRGNWAAARGTFYQLLPWIKVAFAEPNPAVVKAALQMQGLTTDELREPMQSCSQAIRDKLAGVLGLSAAL

SEQ ID NO: 4165 - protein, 166 aa, Psathyrotes annua
MFPMVTEFMNYGQQTVRAARYIGQGFMITLSHANRLPVTIQYPYEKLITSERFRGRIHFEFDKCIACEVCVRVCPIDLPVVDWKLETDIRKKRLLNYSIDFGICIFCGNCVEYCPTNCLSMTEEYELSTYDRHELNYNQIALGRLPMSVIDDYTIRTILNLPEIKT

SEQ ID NO: 4166 - protein, 141 aa, Azoarcus sp. EbN1
MAIERTLSIIKPDAVAKNVIGKIYQRFEDAGLKIIASKMVHLSEREAGQFYAVHKERPFFKDLVSFMISGPVMIQVLEGESAIATNRDLMGATDPKKADAGTIRADFAESIDANAVHGSDAPETAAVEIAFFFPGMNVYTR

SEQ ID NO: 4167 - protein, 166 aa, Polymnia canadensis
MFPMVTEFMNYGQQTVRAARYIGQGFMITLSHANRLPVTIQYPYEKLITSERFRGRIHFEFDKCIACEVCVRVCPIDLPVVDWKLETDIRKKRLLNYSIDFGICIFCGNCVEYCPTNCLSMTEEYELSTYDRHELNYNQIALGRLPMSIIDDYTIRTIFNLPEIKS

SEQ ID NO: 4168 - protein, 120 aa, Salmonella enterica
CHMSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGIKNKIHPG

SEQ ID NO: 4169 - protein, 128 aa, Salmonella enterica
FMPKPMFGDNGSGMHCHMSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGI

SEQ ID NO: 4170 - protein, 249 aa, Hordeum vulgare subsp. vulgare
MDMGLEVSSSSPSSSSVSSSPEHAARRASPAKRPAGRTKFRETRHPVYRGVRRRGNTERWVCEVRVPGKRGARLWLGTYATAEVAARANDAAMLALGGRSAACLNFADSAWLLAVPSALSDLADVRRAAVEAVADFQRREAADGSLAIAVAKEASSGAPSLSPSSGSDSAGSTGTSEPSANGVFEGPVVMDSEMFRLDLFPEMDLGSYYMSLAEALLMDPPPTATIIHAYEDNGDGGADVRLWSYSVDM

SEQ ID NO: 4171 - protein, 166 aa, Perymeniopsis ovalifolia
MFPMVTEFMNYGQQTIRAARYIGQGFMITLSHANRLPVTIQYPYEKLITSERFRGRIHFEFDKCIACEVCVRVCPIDLPVVDWKLETDIRKKRLLNYSIDFGICIFCGHCVEYCPTNCLSMTEEYELSTYDRHELNYNQIALGRLPMSIIDDYTIRTILNLPEIKT

SEQ ID NO: 4172 - protein, 420 aa, Burkholderia mallei ATCC 23344
MKLHGFLIGQTEALLAEVLKFAGPADVTTSRFFRAHPKLGHAERGVIAEAVFAVLRRRMEYAHLAESGTGAPARRLALLGLMQTVGRSALKPFVSDAEWAWLDHVAKIDPASLPLRVRTNLPDWIHQALAERLGADELAQFAAAVNYPAPLDLRANALKATRDQVIDSLRAAGIDAGATPFAPFGVRVVGKPALAKLKLFEEGLIEVQDEGSQLLCSLVAPRRGEMIVDFCAGAGGKTLALGAMMRSTGRLYAFDVSEKRLAKLKPRLARSGLSNVNPVLIDSEHDAKIKRLAGKIDRVLVDAPCSGLGTLRRNPDLKWRQSRETVDELAPKQASILASAARLVKKGGRLVYATCSVLEAENEAIVSAFLAAHPAFELVPASRVLAEQRIALDTGDYLSLWPHRHATDGFFAAVLERRAQ

SEQ ID NO: 4173 - protein, 419 aa, Bacillus thuringiensis serovar konkukian str. 97-27
MIEIKVPELAESITEGTISQWLINVGDKVEKGGSVVELETDKVNVEIIAEDSGIVSKLLGEPGDTVEVGATIAILDANGAPVAVSTPAPAAEQPKQETAEAPKAAAPSAEQTATLQGLPNTNRPIASPAARKMARELGIDLNDVRSTDPLGRVRPHDVQAHAAAPKEAPAAPKSPAPAPVAKTEFEKPVERVKMSRRRQTIAKRLVEVQQTSAMLTTFNEVDMTAIMELRKERKDAFEKKHDVRLGFMSFFTKAVVAALKQFPLLNAEIQGDELIIKKFYDIGIAVAAPDGLVVPVVRDANQLNFAEIESEIRELGKKARDNKLSLKELQGGTFTITNGGVFGSLMSTPILNSPQVGILGMHKIQVRPVAIDNERMENRPMMYIALSYDHRIVDGKEAVSFLVAVKDMLEDPKSLLLEG

SEQ ID NO: 4174 - protein, 213 aa, Hordeum vulgare subsp. vulgare
ASPSGQQEQQGHRTVSSEPPKRPAGRTKFHETRHPLYRGVRRRGRVGQWVCEVRVPGIKGSRLWLGTFNTAEMAARAHDAAALALSGRAACLNFADSAWRMRPVLATTGSFGFSSTREIKLAVAVAVVAFQQQQIILPVACPSPEAPASPSAALFYISSGDLLELDEEQWFGGMDAGSYYASLAQGMLVAPPDERARPEHGEQTGVQTPIPLW

SEQ ID NO: 4175 - protein, 214 aa, Hordeum vulgare subsp. vulgare
MDHCGVGLYGEYATVTSAPPKRPAGRTKFRETRHPLYRGVRRRGAAGRWVCEVREPNKKSRIWLGTFATPEAAARAHDVAALALRGRAACLNFADSAALLRVDPATLRTPEDIRAAAMALAQAACPHDAASSSAPALKAASAPAPAMVMVQEAAAAPYDSYATALYGDLTDLDMHSYYCYDGMSGGGDWQSIPRMDGADEDGIYGAGDVALWSY

SEQ ID NO: 4176 - protein, 512 aa, Francisella tularensis subsp. tularensis SCHU S4
MKKTTLLVILDGWGYSDSDYFNAIKNANTPTWDSIWQEFPKTLINASSLEVGLPRSQMGNSEVGHVNIGCGRVVYQELTKIDKAIEEKTFGDNKAICAAIDNAIKNDSNLHLIGLLSPGGVHSHEEHIFEMIKIAKQKGIKRLYLHAFLDGRDTPPRSAEKSIKKADKLLQDLNLGYIASVCGRYYAMDRDNRWDRVEKAYNAIVNANADFIYDSALEALEQSYARDQSDEFVIPTCIKKDGHLVKVQDNDSVIFMNFRADRAREISHAFTDESFDHFPRKKHLNINFTTLTEYDSKLKCAVAFPPEQPINTLGEVLMKNHKTQLRIAETEKYPHVTFFFNGGREEQFEGEDRILIPSPKVATYDLQPEMSAPEVTDKLVAAINSGKYDCIVCNYANSDMVGHTGNYEAAMQAIEYLDKCIARLKDAILEHDGNMFITADHGNADMMVNPETQKPHTAHTTNLVPFIYVGHKKAQVALEHGKLSDIAPTLLNVMGIAQPKEMTGKTIFNFEK

SEQ ID NO: 4177 - protein, 214 aa, Hordeum vulgare subsp. vulgare
MDHCGVGLYGEYATVTSAPPKRPAGRTKFRETRHPVYRGVRRRGAAGRWVCEVREPNKKSRIWLGTFATPEAAARAHDVAALALRGRAACLNFADSAALLRVDPATLRTPEDIRAAAMALAQAACPHDAASSSAPALKAASAPAPAMVMMQEPAAVPYDSYATALYGDLTDLDMHSYYCYDGMSGGGDWQSISRMDGADEDGIYGAGDVALWSY

SEQ ID NO: 4178 - protein, 660 aa, Oryza sativa (indica cultivar-group)
MVGVLLLLSLMPLAAGELLAQLCGNGGNYTANGTYQSNLARLAAALPSNASSSPDHFATATAGKAPDAAYALALCRGDVANATACGDCVAASFRDARRACPSDKSATIFYDDCLLRFAGDDFLAAPNITENATLFQAWNQQNITGDAAVAAANVRELLTVTARTAAAAARRFATGFMDGSSESRQTLYSLAQCTPDLAAGDCLACLQRLIAMINSTTSVRLGGRVLLLRCNLRFEAFVFYAGEPTRRVSPPGSTPAPDSIDPTKNRKKSKSWVIAAIAAPVAAVLLCLIVCYYCRWSRRFRKDRVRLRERRSGRFQGGDELIIEMEGEISEFSVFEFREVIKATDNFSEENKLGEGGFGPVYKGLFSEGLEIAVKRLASHSGQGFLEFKNEVQLIAKLQHRNLVRLLGCCSQGEEKILVYEYLPNKSLDFYIFDESKKDLLDWNKRLVIIEGIAQGLLYLHKHSRLRVIHRDLKPSNILLDSEMNPKISDFGLAKIFGSNSNEGTTRRVVGTYGYMAPEYSSEGLFSPKSDVFSFGVIILEIISGKRNASLDQCEDFINLLGYAWKLWSEERWLELLDASLVTNWQSSCMMRCINIALLCVQENAVDRPTMSNVVAMLSSESMVLDEPKHPAYFHVRVTKNDESSTVGTCSTINDVTTNY

SEQ ID NO: 4179 - protein, 658 aa, Oryza sativa (indica cultivar-group)
MDIVVGVLLILGLMPMPFEVIMAAADDGGRVFCDNLRLVSATLPNKTSSSLHHYATAAAGQAPDVVYVLALCRGDLNDTACGKSVANTFTKLINESCDANYTAGAYYGDCAGVNSSHNFLEPSNDGDEMLLDKWNVNNITGDGENVRFIAGLIQQLLSETVETAAGAAGRFATGVVDTGRTFPLVYSLAQCTPDLSAGDCLACLRRLTGMINSTMAVRMGAQIHVTRCYFRYEAYVFYDSKPMLHLTGATAPPPAPAIPKRHKSKLWVIPIVVIPVVAFFCFIVYCGWRRRHRKGIMGLQARRTENLQGDEELVWDLEGKSPEFSVFEFDQVLEATSNFSEENKLGEGGFGAVYKGQFSDGTEIAVKRLASHSGQGFIEFKNEVQLIAKLQHRNLVRLLGCCSHGEEKILVYEFLPNKSLDLFIFDENKRALLDWYNRLEIIEGIAHGLLYLHKHSRLSVIHRDLKPSNILLDSEMNPKISDFGLARIFSSNDTEGNKTRRVVGTYGYMAPEYASVGLFSIKSDVFSFGVLFLEILSGKKNSGSHHSGDFINLLGFAWSLWGEGRWHELIDESLVSKYHPAENEIMRCINIALLCVQENAADRPTMSDVVAMLSSKMMVLAEPKHPGYFNVRVANEEQSVLTEPCSVNDMTISVISAR

SEQ ID NO: 4180 - protein, 175 aa, Oryza sativa
PRGSCGASARPHAGHSPVLVPRDISPLLKDPDSFRASIRLLASHLKSTHSGKIDYIAGLDSRGFLFGPSLAQELGVGCVLIRKQGKLPGPTVSASYSLEYGKAELEIQKDALEPGQRVVIVDDLLATGGTMFAACDLLHQLRAEVVECVSLVELTSLKGRERLGPIPFFSLLQYD

SEQ ID NO: 4181 - protein, 320 aa, Roseovarius nubinhibens ISM
MMSLPPKPAEIAREVLTIEGEALLAMREALSESFDRVIELLLDVRGRVIVSGMGKSGHIAHKIAATMASTGTPAQMVHPGEASHGDLGMITAQDAVILISNSGETRELADMIAHTRRFSIPLIAITKKAESTLGQQADHVLELPDAPEACGIGMAPTTSTTCTLALGDALAVALMTQRGFERENFLDFHPGGTLGAQLLKVGSVMHKGDALPIVHEHSSMGETLIEMTAKGFGVAAVVERGILTGVITDGDLRRNLDGLMERKAGEIATRHPRSTRPDILLTEALGVMNANKISALFVVDAEGRLQGLVHIHDALRAGVA

SEQ ID NO: 4182 - protein, 590 aa, Zea mays
  misc_feature (44)..(44): Xaa can be any naturally occurring amino acid
  misc_feature (93)..(93): Xaa can be any naturally occurring amino acid
  misc_feature (145)..(145): Xaa can be any naturally occurring amino acid
  misc_feature (182)..(182): Xaa can be any naturally occurring amino acid
PPVRPRVLPRVRPRVRGRGGLHLLLVLPNEQGLLCVTARGFTSXVMLPNDQRLLCVTADQQFLFYCPKRTDDGDFELSLYRRLIGYNDEILDXKFIGVEVLFLAVATNLEQVRVYDVVSLSCPDVLSCHTEKVFCIDTLVCSSRXSCIGIGKGHLGAVGSVVFSKKTKDFFVSGSSDRTHRXWSCTDSSGDVEDKVPLKAKAFVAAHDKDINSLAISPNDGLVCSGSEDRTACIWKLPNLVLSVVLKGHKRGIWSVEFSSVEQCVMTSSGDRTIKIWSVADGSCLKTFEGHTSSVLRASFLSRGTQVISCGSDGLVKLWTIKTNECIATYDKHDGKVWALAVGMKTEMVATGGTDAVLNLWHDCTMEDKQEDFRKKEQEVLRGQELENAVSDSDYAKAIQLAFELRRPHRLLDLFSKLARRADAEDPIEKALLGLPTDGLRVLLEYVREWNTKPKFCHVAQFVLFRLLRSFSPTDILEIKGISELLEGLIPYSQRHFSRVDRLVRSTFLLDYTLMRMSVVDPDVDAGTIKDEMNGSSAENGELAEPRPASPVPQKSSKKRKSGKSGKKGKEKKVKVASSGLLSKDVSVEP

SEQ ID NO: 4183 - protein, 166 aa, Perityle lindheimeri
MFPMVTEFINYGQQTVRAARYIGQGFMITLSHANRLPVTIQYPYEKLITSERFRGRIHFEFDKCIACEVCVRVCPIDLPVVDWKLETDIRKKRLLNYSIDFGICIFCGNCVEYCPTNCLSMTEEYELSTYDRHELNYNQIALGRLPMSIIDDYTIRTILNLPEIKT

SEQ ID NO: 4184 - protein, 405 aa, Burkholderia xenovorans LB400
MSTDRHVIVGAGHAARRAAETLRERDPGARIVMIGAEPHAPYDRPVLSKDALLAEGGEQKAFIRGLEWYAAHGIELRLGTTVESIDRTRNQVRLHDGSSIGYDRLLLATGSRVREFAGPMDERVRLYYVRTLADSLALRAALAPGRKVAILGGGFIGLEVAAAVTQVGCEATVIEPAATLLQRSLPPAASRFVASLHARRGVTLRLGETPLRIGYENRRALIETDRGTLAADLVVVGIGVLPNVELAREAGLQVDNGIVVDAQCRTSDPRIFAAGEVTMHFNPLLGRQARIESWQVAENQPVIAAANMLGDTQEYAEWPWLWSDQFDCNIQSLGMIDASHTLIERGDAHNGPFCVLALDAGRRLRAVVAINAGREMGACKRLVASGKVLDPALLADTAVALRSLL

SEQ ID NO: 4185 - protein, 166 aa, Parthenium hysterophorus
MFPMVTEFMNYGQQTVRAARYIGQGFMITLSHANRLPVTIQYPYEKLITSERFRGRIHFEFDKCIACEVCVRVCPIDLPVVDWKLETDIRKKRLLNYSIDFGICIFCGNCVEYCPTNCLSMTEEYELSTYDRHELNYNQIALGRLPMSIIDDYTIRTIFNLPERKT

SEQ ID NO: 4186 - protein, 166 aa, Palafoxia arida
MFPMVTKFMNYGQQTVRAARYIGQGFIITLSHANRLPVTIQYPYEKLITSERFRGRIHFEFDKCIACEVCVRVCPIDLPVVDWKLETDIRKKRLLNYSIDFGICIFCGNCVEYCPTNCLSMTEEYELSTYDRHELNYNQIALGRLPMSIIDDYTIRTILNLPEIKT

SEQ ID NO: 4187 - protein, 125 aa, Salmonella enterica
PKPMFGDNGSGMHCHMSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDG

SEQ ID NO: 4188 - protein, 115 aa, Azoarcus sp. EbN1
MSDCIFCRIVAGEIPAKKIHEDEDILAFHDIHPVAPVHFLVIPKLHIPSMAELRPEHAAVMGRVMTESARIAGELGCLDGFRTIINTGRVGRQEVYHLHVHILGGPEVLPAMLRR

SEQ ID NO: 4189 - protein, 133 aa, Azoarcus sp. EbN1
MSRPNSVRWLNEVQWDDQGLVPVIAQEAASGDVLMFAWMNREALQRTAETGEAIYWSRSRRRLWHKGEESGHIQKVLEIRLDCDSDVVLLKIEQIGGIACHTGRHSCFFQRYLADGSWETVDPVVKDPKDIYK

SEQ ID NO: 4190 - protein, 129 aa, Salmonella enterica
GSGMHCHMSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGIKNKIHPGEAMD

SEQ ID NO: 4191 - protein, 166 aa, Oblivia mikanioides
MFPMVPEFMNYGQQTVRAARYIGQGFMITLSHANRLPVTIQYPYEKLITSERFRGRIHFEFDKCIACEVCVRVCPIDLPVVDWKLETDIRKKRLLNYSIDFGICIFCGNCVEYCPTNCLSMTEEYELSTYDRHELNYNQIALGRLPMSIIDDYTIRTILNLPEIKT

SEQ ID NO: 4192 - protein, 131 aa, Salmonella enterica
FGDNGSGMHCHMSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGIKNKIHPGEA

SEQ ID NO: 4193 - protein, 126 aa, Francisella tularensis subsp. tularensis SCHU S4
MEKIKINTTNAPQAIGSYEQAIKVGNFVYTSGQIGLRADGTMSGECIKEQTTQVMQNLKAVLEAAGSSLDKVVKATIFIKDMTEFKLIDEVYGSFFNGNFPARSCVEVARLPRDVKVEIEAVAITN

SEQ ID NO: 4194 - protein, 146 aa, Brassica napus
VRVDAVIQEAEKVKGRDSLYIGNINFYHKPLRTGKWAVTYEEWPEESYPPYANGPGYILSYDIAKFIVDDFEQQRLRLFKMEDVSMGMWVEKFNETRPVAVVHSLKFCQFGCIEDYFTAHYQSPRQMICMWDKLQRLGKPHCCNLR

SEQ ID NO: 4195 - protein, 293 aa, Yersinia pestis CO92
MFTGSIVALITPMDDNGDVDRASLKSLIDYHVASGTAAIVSVGTTGESATLNHDEHVDVVMQTLELADGRIPVIAGTGANSTSEAISLTQRFNDTGVVGCLTVTPYYNRPMQEGLYQHFKAIAESTDLPQILYNVPSRTGCDMLPPTIARLAKIKNIVAVKEATGNLSRVSQIQVLVDDEDFILLSGDDASGLDFMQLGGKGVISVTANIAAREMVELCALAAQGNFAEGRRLNQRLMPLHQHLFVEANPIPVKWAAKRLGLMANDTMRLPMTPLTDPAKRIVEDALKSAGLL

SEQ ID NO: 4196 - protein, 398 aa, Thermotoga maritima
EKMTIRDVDLKGKRVIMRVDFNVPVKDGVVQDDTRIRAALPTIKYALEQGAKVILLSHLGRPKGEPSPEFSLAPVAKRLSELLGKEVKFVPAVVGDEVKKAVEELKEGEVLLLENTRFHPGETKNDPELAKFWASLADIHVNDAFGTAHRAHASNVGIAQFIPSVAGFLMEKEIKFLSKVTYNPEKPYVVVLGGAKVSDKIGVITNLMEKADRILIGGAMMFTFLKALGKEVGSSRVEEDKIDLAKELVEKAKEKGVEIVLPVDAVIAQKIEPGVEKKVVRIDDGIPEGWMGLDIGPETIELFKQKLSDAKTVVWNGPMGVFEIDDFAEGTKQVALAIAALTEKGAITVVGGGDSAAAVNKFGLEDKFSHVSTGGGASLEFLEGKELPGIASMRIKKA

SEQ ID NO: 4197 - protein, 509 aa, Clostridium perfringens SM101
MRDLVLVVDFGGQYNQLIARRVRECGVYCEIIPYTYSIEKIKEKNPKGIIFTGGPNSVYGENTPTLDKEIFNLNVPILGICYGDQLMAHLLGGKVATAPVREYGKTNVTLDNSSKLFAGIEADETCWMSHTDYIAEAPEGFKIIAHTDVCPVAAMENEERRLYGVQFHPEVEHTPFGQNMMRNFLYNICGLENSWSMASFAEEKIAEIKKIVGDKKLICALSGGVDSSVAAVMVHKAVGKQLTCIFVDHGLLRKDEGDQVEKIFKEGFDMNLIRVNAQDRFLGKLKGVSDPETKRKIIGEEFIRVFEEEAGKLGDIKFLVQGTIYPDVVESGTDTSAVIKSHHNVGGLPEDMEFSLIEPLRELFKDEVRAVGEELGIPHHLVWRQPFPGPGLAIRVLGEVTEDKLEVVREADAIFREEIALAGLESEIWQYFAVLPNIQSVGVMGDERTYCHTVGLRAVTSSDGMTSNWAHIPYEVIDKVSRRIVNEVKGVNRIVYDVTSKPPATIEWE

SEQ ID NO: 4198 - protein, 302 aa, Mycobacterium tuberculosis H37Rv
MSGNEVHPDLRRIAVVTPRQLVGPRTLPVMRALIVVAGLRMSRTPPDIEVLTLESGVGVRLYRPAGSNEPAPALLWIHAGGYVMGTAQQDDRLCLRFSSRLGITVASVDYRLAPENPYPAALGDCYSALTWLASLPAVDPARVAIGGASAGGGLAAALALLARDRGGITPAFQLLVYPMLDDRPSIAPANPHYRLWNGRANRFGWRAYLGDADARVAVPGRRDDLGGLAPAWIGVGTHDLLHDEDLAYAERLTAAGVPCQVEVVEGAFHGFDRVAPNVGVSQRFFTSQCNSLRAALALSNRT

SEQ ID NO: 4199 - protein, 292 aa, Bacillus anthracis str. Ames
MIDFGTIATAMVTPFDINGNIDFAKTTKLVNYLIDNGTTAIVVGGTTGESPTLTSEEKVALYRHVVSVVDKRVPVIAGTGSNNTHASIDLTKKATEVGVDAVMLVAPYYNKPSQEGMYQHFKAIAESTPLPVMLYNVPGRSIVQISVDTVVRLSEIENIVAIKDAGGDVLTMTEIIEKTADDFAVYSGDDGLTLPAMAVGAKGIVSVASHVIGNEMQEMIAAFQAGEFKKAQKLHQLLVRVTDSLFMAPSPTPVKTALQMVGLDVGSVRLPLLPLTEEERVTLQSVMQSIPR

SEQ ID NO: 4200 - protein, 339 aa, Acidovorax sp. JS42
MTERISLTRYLVEQQRVHGRIPPQLRLLVEVVARACKRISFAVNKGDLGDVMGTAGTENVQGEVQKKLDIIANEVLIEANEWGGHLAAMASEEMDGIYVVPNRFPQGEHLLMFDPLDGSSNIDVNVSIGTIFSVLHKHHDDPTTDEPVTEADFLQPGHQQVAAGYCIYGPQTTLVLTVGDGVAMFTLDREQGSFVLTRENIRIPEDTKEFAINMSNMRHWDAPVRRYIDECLQGKEGPRGKDFNMRWIASMVADVHRILMRGGIFMYPWDKREPNKPGKLRLMYEANPMGWLVEQAGGAATNGRQRILDIQPAQLHERVSVILGSKNEVDRVTSYHSGI

SEQ ID NO: 4201 - protein, 195 aa, Azoarcus sp. EbN1
MRQAEVTRDTLETRITARVDLDGSGKAAFATGVPFLDHMLDQIARHGAFDLDIRAEGDTHIDDHHTVEDVGITLGQAFARALGDKRGIRRYGHAYVPLDEALSRVVVDFSGRPGLHYFVSYTRARIGSFDVDLAREFFQGFVNHAGVTLHIDSLRGDNAHHQCETIFKAFGRALRMAAERDERAAGAIPSTKGAL

SEQ ID NO: 4202 - protein, 435 aa, Coprinopsis cinerea okayama7#130
MSTNKSSSKKRKRDASPSSTLTFELSSSKQTKGGPFLVNYPVVKAPEKTAFNCYANKKQKTSGDAEDERQNDILLAGETETVEFMTNEDETYRVAQGGCHYFIALHNKKTGKVAVLPQSTSPHILVHTVKALKSIAPAPAPSKTQFREAKNALGETFGTKKAKAAIRAQERNHVDVGAMEGVMGYVMDSIDKGAEGLMTTEEAKVASDTNRLIPPFSTEATSPDDIYPLYSIIPEAEWKALSISALDSTKNEKERLALLPYRYSEWLRQHLRNSGTAESPKTRKRNLKILLYISAMLAFRQATSRKEINKDQIYEKLAPLPSIVADSLLSRFTEVARGSTSYQSTSTTKTNLLTHIFALCLKVDQFATDTEMLAQDLSMKTAEVNQLFRSLGCKMVKLGDRERTRLGLSDESAEKKRAVLTAPVEFPKPRLRRKT

SEQ ID NO: 4203 - protein, 901 aa, Coprinopsis cinerea okayama7#130
MSAAATDNYPVSSDTLATDTNMALDTVQPGLEGEPMSVDVKPDLNLKTEDSLVPPSTSLADLDMKGEKSDSSSSLNGSPNESSKSSSPTATSSKPQKASTPGPQLIGDLPIAREDALKTFNEIPFNNYQFKSLGRSREVMESMTCDCVYEPGTAKLTLSIDFSGVDNEDNACGPYSDCINRLTQVECLPEDCRCRSHCQNQRFQKRQYANIEIVLTEKKGYGLRAEDDIPKDSFIYEYVGDVVSPNSFKKRMREYAEEGIQHFYFMMLQKDEFIDATKSGGIGRFANHSCNPNCYVAKWTVGDHVRMGIFSKRLIRKHEELTFNYNVDRYGHQAQTCYCGEPNCIGFIGGKTQTDVATMDDLYLDALGITDEDDVAALKGTKKKKGKKIDDPDFMPSVKPIVEKEVPKVVQAIRQTSNRKVLYKLLTRIKITDDQAALRQIMRLRGYSVMKNVLEDYVADLDLVELVLQCLESWPLLNRNKVDDSQIMTSVEGHATSERESLQALAKKLMEHWQSLPLYNRIPKRALPQDDGPSKDKPDTPTLDPYEEQIKRRRQEEEQKLRWVRIRAQQLEREKQQRQFREHQRGLVKDLYDPFPPQPQKPSVDTSSKMQEMLKAIIANATETVAAEEKRKAEEAEAKAKAEAAAAEKAARRKARAAAKKAMTPEEKEALKEKRLMKLIGAVVVKSMSKYARGLQKDYFKKYAKELTQVITEKEKKSSSYKEGRLESLSEEKVAKIKKFSKDYIAKVLRKLEKAGKYSSQSSRATTEQTGASSSTHTQTPNSLDGGDGSINGGGEVPMSVEEAMDMEEDSDVDADGSVAGDEEQRRAFRNGDGREDGNEPEAGPSSSRSGPSPRFEDDEMKGQPSSHYRSYHHQNGDAHGGSNAMRGGMKIRWGVVICIQ

SEQ ID NO: 4204 - protein, 535 aa, Mycobacterium sp. JLS
MSFASPYPAVQIPTTSVYDYLFSDLSDTDAQRVALIDTPSGNRMTYGEMLARIDAFAGALADRGIGVGDVVGLLAPNSSAFAIAFHGILRAGATATTVNALFTAKDIANQLADSRATMLVTVTPLLAHAAEGAAAVGLADDRVIVLDGPGAAADGHPNAADLLGPGFAPPEVSFDPATHLAVLPYSSGTTGNPKGVMLTHRNLTANVAQIRPVQGMTADDRILAVLPFFHIYGMTVLLNAALHARAALVIMPRFDLTEFLANIADHKCTYAFIAPPVAVALAKHPLIDEYDLSSLQGIMSGAAPLDADLGHAVAERLGCAVVQGYGMSELSPVSHVTPFDGGVGLVGSAAPLASSGWTVPNSESRITDPETGTEIDIPPSGMSATGELWFRGPNVMAGYLNNDEATRETIDDEGWLHTGDLAQVDAQGCVYIVDRLKELIKYKGYQVPPAELEAVLLSHDAIADVAVVGVVDTESGEEVPKAFVVRRPEASLTEAEVMEFVAGQVAPYKKVRKVEFIDAIPKSASGKILRKDLRH

SEQ ID NO: 4205 - protein, 166 aa, Melampodium leucanthum
MFPMVTEFMNYGQQTVRAARYIGQGFMITLSHANRLPVTIQYPYEKLITSERFRGRIHFEFDKCIACEVCVRVCPIDLPVVDWKLETDIRKKRLLNYSIDFGICIFCGNCVEYCPTNCLSMTEEYELSTYDRHELNYTQIALGRLPMSIIDDYTIRTILNLPEIKT

SEQ ID NO: 4206 - protein, 448 aa, Geobacter sulfurreducens PCA
MNQSTADPRRSAFDILVRIERERTFAEPLIDRELSGGALKGPDRGLLTELVYGVLRRTATLDYLVDLFCATRAAKLERSVLILLRLGLYQIFFLDRIPVSAAVNETVTLAREKSPRASGLVNAVLRRSDRERSSIAWPDRVRDPAGYLALRHSHPRWIVEGWIAQLGFEEAEALAEVMAAPPPLTLRVNTLRTSREAYLELLREAGTEAEPTRHSPHGIRILSRTAVPALPGFGEGLVIVQDESSQLASLLLEPRSGERVLDACASPGGKATHLAQIMADKGEVIAWDVSEKKLSPIAENARRLGIGIIRPAMADARNPEQNAAPFDRILVDAPCSALGVLRRTPEGKWWKTPDDVARLAQSQCRILAGAASLLKPGGTLLYSTCSTTTDENESIIEDFLSRRADFMLEDLNYLFPGLSECITDRGMFRSWPHRHGMDGFFAARLRRA

SEQ ID NO: 4207 - protein, 291 aa, Hordeum vulgare subsp. vulgare
MSNPIQTDVAGIASPSGQQEQQGHRTVSSEPPKRPAGRTKFHETRHPLYRGVRRRGRVGQWVCEVRVPGIKGSRLWLGTFNTAEMAARAHDAAALALSGRAACLNFADSAWRMLPVLAAGSFGFGSAREVKAAVAVAVVAFQRRQIIPVAVAVVALQKQQVPVAVAVVTLQQKQQQVPVAVAVAALQQQQVPVAVAVVALQQLQVPVAVAVVALQEQQIILPVACLAPEFYMSSGDLLELDEEQWFGGMDAGSYYASLAQGMLVAPPDERARPEHGEQTGVQTPLWSCLFD

SEQ ID NO: 4208 - protein, 403 aa, Mycobacterium tuberculosis H37Rv
MNQRRAAGSTGVAYIRWLLRARPADYMLALSVAGGSLPVVGKHLKPLGGVTAIGVWGARHASDFLSATAKDLLTPGINEVRRRDRASTQEVSVAALRGIVSPDDLAVEWPAPERTPPVCGALRHRRYVHRRRVLYGDDPAQLLDVWRRKDMPTKPAPVLIFVPGGAWVHGSRAIQGYAVLSRLAAQGWVCLSIDYRVAPHHRWPRHILDVKTAIAWARANVDKFGGDRNFIAVAGCSAGGHLSALAGLTANDPQYQAELPEGSDTSVDAVVGIYGRYDWEDRSTPERARFVDFLERVVVQRTIDRHPEVFRDASPIQRVTRNAPPFLVIHGSRDCVIPVEQARSFVERLRAVSRSQVGYLELPGAGHGFDLLDGARTGPTAHAIALFLNQVHRSRAQFAKEVI

SEQ ID NO: 4209 - protein, 334 aa, Haemophilus influenzae R2846
MKTLSEFIVERQAEYPNAKGELSGILSSIRLLAKIIHRDINKAGLTNILGQSGVENVQGESQMKLDLFAHNTMKAALMAREEVAGFASEEEESFIAFDTERGRNAKYIILTDPLDGSSNIDVNVSVGTIFSIYRRVSPIGTPVTLEDFLQPGNKQVAAGYIVYGSSTMLVYTTGNGVNGFTYDPSIGTFCLSHENMQMPKTGRIYSINEGQYLKFPQGVKKYIKYCQEEDKATNRPYASRYIGSLVADFHRNLLKGGIYIYPSATNYPNGKLRLLYEGNPIAFLAEQACGVATDGYRRILDIQPTELHQRVPLFVGSEDMVKKAQEMMEEFKEE

SEQ ID NO: 4210 - protein, 853 aa, Ralstonia eutropha JMP134
MKLIIVGHGMVGHKFLECLAEAGAQNLDVTVLCEEPRPAYDRVHLSEFFAGKSAEDLSLVPAGFFEQHNNILLRLNARAVSIDRAARTVTVSTGETLAYDKLILATGSYPFVPPVPGKERKDCFVYRTIEDLEAMRECGARSKRGVVIGGGLLGLECAKALRDMDLETHVVEFAPRLMAVQVDEGGGRMLRQKIEGLGVTAHTGKNTVEIIDGADGTHRMVFADGTHLDTDMIVFSAGIRPRDELARAAGLAVGERGGITVDNNCRTSDPDVYAIGECALWQGKIYGLVAPGYDMARVAARHLRGEAAEFAGADMSTKLKLMGVDVASIGDPHGTVPGARLYQFSDDSKQVYKKLVVSDCGKYLLGGVLIGDASEYGTLLQMMLNKIELPESPEFLILPDSSGKAKPALGADALPDTAQICSCNNVSKGEICAAVCDGATSIGAMKSCTKAGTACGGCVPLVTQIMKAEMKKQGMAVNNHLCEHFPYSRQELYHLVRVGKFKTFDALLEAHGKGLGCDICKPTVGSILASCWNEFVLKEEHAALQDSNDYYLANIQKDGTYSVVPRMPGGEVTPEGLIAVGQVAKKYGLYTKITGGQRVDLFGARAEELPYIWEELIAAGFESGHAYGKALRTVKSCVGSTWCRYGVDDSVGLAIELENRYKGLRAPHKIKFGVSGCTRECAEAQGKDVGVIATEKGWNLYVCGNGGMKPRHAELLAGDLDRDTLIRYIDRFLMFYVRTADRLQRTSVWRDNLEGGLDYLKDVVLDDKLGIAADLEAEMQHVVDTYEDEWKKAVTDPETRKRFRHFVNSERRDDNLVFIEERGQIRPATPEERNLQRSRLSHIPVVAVPAKAA

SEQ ID NO: 4211 - protein, 413 aa, Ralstonia eutropha JMP134
MTPSAPSQSRPRLIVVGNGMAGMRTVEELLKLAPDLYDITVFGAEPHGNYNRILLSPVLAGEKTVDDIMLNTREWYAQNGIELLAGDPVVAIDRPRRTVRAQSGREVRYDRLLLATGSKPFILPVPGHQLDGVIAFRDIQDVEIMLDAARNHRHAVVIGGGLLGLEAANGLLRQGMDVTVVHLCDSLMERQLDKPAATLLKGALERKGLRFMLGAQTAEILGDTRVTGVRFKDGNEIPADLVVMTAGVRPNIELAAGAGLRCERAIVVDDTLQTYDPRIYAVGECVQHRQATFGLVAPIWDQARVCAAHLAGAGHRRYIQQATATKLKVTGVDLYSAGDFIGGEGSEDLVLRDARRGVYKRLVLQDGRLIGAVLYGDVQDGPWYFDLIQQCAPVAALRQRLLFGKAQCEALAA

SEQ ID NO: 4212 - protein, 833 aa, Oryza sativa (japonica cultivar-group)
MPPWWGKSFSKDAKKTTKENLIDTFHRLISPNDQKGSTKSKRSCRRGNDSSVEKSCRSTTVSRPTSPSKEVSRCQSFSADRPHAHPLPIPGVRPPVTRTVSDITESKPILEKRGKPPLLLPLPKPNRPPRRHGNSEVVSEIVVASPSSNCSDSDDHGDSQLQSPVGNDAENATLVTLKNKSSNARKECPGPITAKNMKEIHRPANQVHGSHILSTSPRGVAADSYQSNLQNPRPLVLDSAPNSLMSSPSRSPRRICPDHIPTSAFWAVKPHTDVTFVGSGQCSSPGSGQTSGHNSVGGDMLAQLFWQPSRSSPECSPIPSPRMTSPGPSSRVHSGSVSPLHPRSGGMAPESPTNRHDDGKKKQTHKLPLPPLSISHSSFHPNNSTPTSPISVPRSPGRTENPPSPGSRWKKGKLIGRGTFGHVYVGFNSDSGEMCAMKEVTLFLDDPKSKESAKQLGQEISLLSRLQHPNIVQYYGSETVDDKLYIYLEYVSGGSIHKLLQEYGQLGEQAIRSYTQQILSGLAYLHAKNTVHRDIKGANILVDPSGRVKLADFGMAKHINGQQCPFSFKGSPYWMAPEVIKNSNGCNLAVDIWSLGCTVLEMATSKPPWSQYEGIAAMFKIGNSKELPPIPDHLSEPGKDFIRKCLQRDPSQRPTAMELLQHPFVQKAVSLEKSVLSEPLEHLAVISCRSSAKFSDGCAYKKYFLIGIGGSDNLPEKRCKIFFKTQQSTYSNEGFAIPSRSPDDLFASRPTDPDLGQFIRVHQVSQGLQERVVSEADILSPQFGKRLGNVFDLRDKLSPSERFTHHAFVDHVKLNPSLDLTSGSPHLGLKHGN

SEQ ID NO: 4213 - protein, 906 aa, Ralstonia eutropha JMP134
MNLSDIPVVSATPTTTTATTCPYCGVGCGVRATVRADGQVEIAGDAEHPSNHGRLCVKGSALGETVDLQGRLLHPKVRHEDGTLEQVSWDHALDTVAQGFSRIVREHGPDAVALYVSGQLLTEDYYVANKLMKGFIGTANIDTNSRLCMSSAVAGHKRAFGEDLVPGNYEDLELADLVVLVGSNTAWCHPILFQRLSKAKEARPEMKIVAIDPRRTATCELADLHLPVRAGTDVWLFNGLLSYLAREGKADTAFVAASTAGLDDALQATVDCSDPKAVARACKLDVEDVLAFYRLFADTEKVVTAFSQGVNQSSAGTDKVNSIINCHLLTGRMGRAGMGPFSLTGQPNAMGGREVGGLANMLAAHMELANPLHREIVQDLWQSPVMADQAGLKAVDLFNAIEQGRVKAVWVIATNPVVSLPDADQVRRALAKCELVVSSDIIERTDTNDAAHVLLPALGWGEKDGTVTNSERRISRQRAFLPAPGEARADWRVLCDVAQRMGFAGFDYAGPHEIFDEHARLSAWRNDEAPRAFDIGGMAGMDKDSYDTFEPLQWPVVAGSAAGTRRLFENGRYAHPDGLARFVATRTRAPAHAPDDDYPLILNTGRVRDQWHTMTRTGKSAKLADHLPEPFVDMHPQDALLCGVGEGKLARVATRWGAMVARVRHGGGIPRGSVFVPIHWNGQFSSDARVGALVNPVVDPVSGEPEFKHTPVSVEPFGVNWHGFVLSRRELPADTLTYWTRVQGKRFQRYEFAGREAIVDRAAWARSLLGVTDPEADWLEYEDRSAGTYHAGYVVNDRLEACVYVATRPELPSRSWLAELFGRDRLEDADRIGLLMGQPIEKGADAGPTVCSCFGVGRNTICDAVRKHGLTTPAEITACVKAGGNCGSCVPELKKLLVEVRVAEVA

SEQ ID NO: 4214 - protein, 487 aa, Mycobacterium tuberculosis H37Rv
MSDSATEYDKLFIGGKWTKPSTSDVIEVRCPATGEYVGKVPMAAAADVDAAVAAARAAFDNGPWPSTPPHERAAVIAAAVKMLAERKDLFTKLLAAETGQPPTIIETMHWMGSMGAMNYFAGAADKVTWTETRTGSYGQSIVSREPVGVVGAIVAWNVPLFLAVNKIAPALLAGCTIVLKPAAETPLTANALAEVFAEVGLPEGVLSVVPGGIETGQALTSNPDIDMFTFTGSSAVGREVGRRAAEMLKPCTLELGGKSAAIILEDVDLAAAIPMMVFSGVMNAGQGCVNQTRILAPRSRYDEIVAAVTNFVTALPVGPPSDPAAQIGPLISEKQRTRVEGYIAKGIEEGARLVCGGGRPEGLDNGFFIQPTVFADVDNKMTIAQEEIFGPVLAIIPYDTEEDAIAIANDSVYGLAGSVWTTDVPKGIKISQQIRTGTYGINWYAFDPGSPFGGYKNSGIGRENGPEGVEHFTQQKSVLLPMGYTVA

SEQ ID NO: 4215 - protein, 361 aa, Stevia rebaudiana
MALVNPTALFYGTSIRTRPTNLLNPTQKLRPVSSSSLPSFSSVSAILTEKHQSNPSENNNLQTHLETPFNFHSYMLEKANMVNEALDASVPLKDPIKIHESMRYSLLAGGKRIRPMMCIAACEIVGGNILNAMPAACAVEMIHTMSLVHDDLPCMDNDGFRRGKPTSHKVYGEEMAVLTGDALLSLSFEHIATATKGVSKDRIVRVIGELARSVGSEGLVAGQVVDILSEGADVGLDHLEYIHIHKTAMLLESSVVIGAIMGGGSDQQIEKLRKFARSIGLLFQVVDDILDVTKSTEELGKTAGKDLLTDKTTYPKLLGIEKSREFAEKLNKEAQEQLSGFDRRKAAPLIALANYNAYRQN

SEQ ID NO: 4216 - protein, 447 aa, Enterococcus faecalis
MKVIVLGSSHGGYEAVEELLNLHPDAEIQWYEKGDFISFLSAGMQLYLEGKVKDVNSVRYMTGEKMESRGVNVFSNTEITAIQPKEHQVTVKDLVSGEERVENYDKLIISPGAVPFELDIPGKDLDNIYLMRGRQWAIKLKQKTVDPEVNNVVVIGSGYIGIEAAEAFAKAGKKVTVIDILDRPLGVYLDKEFTDVLTEEMEANNITIATGETVERYEGDGRVQKVVTDKNAYDADLVVVAVGVRPNTAWLKGTLELHPNGLIKTDEYMRTSEPDVFAVGDATLIKYNPADTEVNIALATNARKQGRFAVKNLEEPVKPFPGVQGSSGLAVFDYKFASTGINEVMAQKLGKETKAVTVVEDYLMDFNPDKQKAWFKLVYDPETTQILGAQLMSKADLTANINAISLAIQAKMTIEDLAYADFFFQPAFDKPWNIINTAALEAVKQER

SEQ ID NO: 4217 - protein, 447 aa, Enterococcus faecalis
MKVIVLGSSHGGYEAVEELLNLHPDAEIQWYEKGDFISFLSSGMQLYLEGKVKDVNSVRYMTGEKMESRGVNVFSNTEITAIQPKEHQVTVKDLVSGEERVENYDKLIISPGAVPFELDIPGKDLDNIYLMRGRQWAIKLKQKTVDPEVNNVVVIGSGYIGIEAAEAFAKAGKKVTVIDILDRPLGVYLDKEFTDVLTEEMEANNITIATGETVERYEGDGRVQKVVTDKNAYDADLVVVAVGVRPNTAWLKGTLELHPNGLIKTDEYMRTSEPDVFAVGDATLIKYNPADTEVNIALATNARKQGRFAVKNLEEPVKPFPGVQGSSGLAVFDYKFASTGINEVMAQKLGKETKAVTVVEDYLMDFNPDKQKAWFKLVYDPETTQILGAQLMSKADLTANINAISLAIQAKMTIEDLAYADFFFQPAFDKPWNIINTAALEAVKQER

SEQ ID NO: 4218 - protein, 447 aa, Enterococcus faecalis
MKVIVLGSSHGGYEAVEELLNLHPDAEIQWYEKGDFISFCSCGMQLYLEGKVKDVNSVRYMTGEKMESRGVNVFSNTEITAIQPKEHQVTVKDLVSGEERVENYDKLIISPGAVPFELDIPGKDLDNIYLMRGRQWAIKLKQKTVDPEVNNVVVIGSGYIGIEAAEAFAKAGKKVTVIDILDRPLGVYLDKEFTDVLTEEMEANNITIATGETVERYEGDGRVQKVVTDKNAYDADLVVVAVGVRPNTAWLKGTLELHPNGLIKTDEYMRTSEPDVFAVGDATLIKYNPADTEVNIALATNARKQGRFAVKNLEEPVKPFPGVQGSSGLAVFDYKFASTGINEVMAQKLGKETKAVTVVEDYLMDFNPDKQKAWFKLVYDPETTQILGAQLMSKADLTANINAISLAIQAKMTIEDLAYADFFFQPAFDKPWNIINTAALEAVKQER

SEQ ID NO: 4219 - protein, 1083 aa, Gloeobacter violaceus PCC 7421
MPRRTDIHKILLIGAGPIVIGQACEFDYSGTQACKALREEGYEIVLVNSNPATIMTDPATADRTYIEPVTAEFVERIIERERPDALLPTMGGQTALNVTVELAESGVLDRYGVELIGAKLPAIKKAEDRELFKQAMEKIGLAVPRSGFAHTLEEARVVAEEIGSFPLILRPSFTLGGTGGGIAYNREEFERMIRVGLDASPTSQVLVEESALGWKEYELEVMRDLADNVVIICSIENFDPMGVHTGDSITVAPAQTLTDKEYQRLRDAAIKVIREIGVETGGSNIQFAVHPENGRVIVIEMNPRVSRSSALASKATGFPIAKIAAKLAVGYTLDEITNEITQKTPASFEPTIDYVVTKIPRWAFEKFPGTEPVLTTAMRSVGEVMAIGRTFCESLQKALRSLEIKRFGFGADRSEEIPDAETLKSQLRTATPDRIFQIRQALMAGFSVEQVHELTAIDPWFLDKLAELVAFERAYQGRDLASLTAAEWLEAKQKGYSDMQLAFLTGTDEQSVRSTRQELGVTPVFKTVDTCAAEFEAFTPYHYSTYASESEIASGEKPKAMILGGGPNRIGQGIEFDYCCCHACFALSEDGFETIMVNSNPETVSTDYDTSDRLYFEPLTREDVLNIVEAEKPVGVIVQFGGQTPLNLAVPLEKAGVPIWGTSPDSIDIAEDRERFEQLCQQLGIRQPANGMARSTADAVAVAGRIGYPVVVRPSYVLGGRAMEIVYTDEGLGRYMAHAVQVEPDRPILIDKFLEDAVEVDVDAICDRTGQVVIGGIMEHIEQAGIHSGDSACVLPTRTLDESVLAVIRDWTVKLARALKVVGLMNIQYAVKAHREGAEVYVLEANPRASRTVPFVAKATGVPLAKIAARVMAGRTLEELGFTEEVIPGHIAVKEAVLPFEKFAGTDTILGPEMRSTGEVMGIDTDFGRAFAKAQIGAGQKLPTAGTLFVSVTDRDKHAVVPIVQQMLDLGFRVIATEGTQRFLQEQGLAVEKVLKIHEGRPHIGDLLKNRRIQLVFNTPSGSEAQTDAQVIRRTALAQKIPVITTLAAARAVTAAIAALQKGPLEVKSLQEYHQPSLTAGSR

SEQ ID NO: 4220 - protein, 550 aa, Aspergillus nidulans FGSC A4
MGVESSSYHGESITPAPAPQPQQYSSQESIGSTKPEPGVDTPIPRITLRATIMGLFVSMGGLLFGYDTGQISGFQEMSDFLERYGELQSDGSYSFSHVRSGLIVSLLSIGTLIGALCGAPLADKLGRKWSITVWCIILMVGIIVQISAPSGNWVQIVMGRWTTGLGVGGCSLVVPMYQGESAPKHVRGAMISSYQLFVTLGIFLAYCINLGTESLDGSAQWRITLGLTFLFALILGLGMAMFPESPRFNYRHGKIDTARTTMARLYGVPENHVVIVRELAEIQSQLDAEKEQSQKWNEFITAPRMLYRILLGIVLQALQQLTGANYFFYYGTTIFQGAGISNSFITQVILGAINFGTTFGGLYVVENFGRRKSLIAGASLMFICFMIFASIGHFMLDVEHPENTPGPGKGMVVVASFFVLFYATTWGPIVWSIVAELFPSKYRAKGMALATASNWLWNFLIGCLSFFTPFITGAIDFAYGYVFAGCLLVAVFVVYFFVIEGKDRTLEELDWMYVNHVKPWESSKYEIPRITYHDDARGARKENTEHAEVA

SEQ ID NO: 4221 - protein, 520 aa, Mycobacterium sp. JLS
MTTTEPAPPESATGRPSPRWRALLLAAVAACAACGLVYELALLTLSSSIHGGGIVATSLIVAGYVAALGAGALAVKPLLGHAAITFVAVETLLGVIGGLSAAALYVTFAFIGGSTWVLVVGTALIGGLVGAEVPLLMTLLQRGRTAGAADSGRVLANLNAADYFGALVGGLLWPFLLLPHLGMIRGAAATGVINLVAAAGVAVFLLRHIVSGRQLAVALGALSAALVLLVTLLIRADGIETTTRQRLYNDPIVAFARSPYQEIVVTRRGDDLRLYLDGGLQFSTRDEFRYTESLVYPALGQGARSVLILGGGDGLAARELLRQNQIRDITQVELDPAVIDLARTTLREANRGALDDPRVTVVVDDAMTWLRSVDRTFDAVIVDLPDPDTPVLGRLYSTEFYALVTRALAPDGLMVVQAGSPYSTPTAFWRTVSTIESAGFAVTPYHVHVPTFGDWGFALARRGPTPPAPTVPEGVGPLRFLNQEVLDAATVFSADVARQRLEPSTLEHPRIVDDIRKGYR

SEQ ID NO: 4222 - protein, 394 aa, Acidovorax sp. JS42
MKFSTRAERIEPFYVMEVAKAAQALAREVAGTREPMIFLNIGEPDFTAPPLVVEAADRAVRSGVTQYTNALGLEALRERISGWYAERFGVDVPARRIVVTAGASAALQLACLALIDAGDEVLMPDPSYPCNRHFVSAAEGKAVLIPTTAEERFQLSAAKVEAAWGTKTRGVLLASPSNPTGTSIAPNELRRIHDVVRGKGGLTIIDEIYLGLSYDDAFGQTALALGEDIISINSFSKYFNMTGWRLGWMVVPEAMVPVVERLAQNLFICASTVSQHAALACFEPDSIAEYERRRAEFKARRDYFIPALDALGLTVPVQPDGAFYAWADCTQAAERLGVAGSWDFAYELMRRAHLAITPGRDFGTADTQRFVRFSTANSMAQLQEAAARLQRLIG

SEQ ID NO: 4223 - protein, 289 aa, Glycine max
MATSQSQHRCVFVGNIPYDATEEQLIEICQEVGPVVSFRLVIDRETGKPKGYGFCEYKDEETALSARRNLQGYEINGRQLRVDFAENDKGNDRNREQGRGGPGMTTNVDHQKQVGIPAVLGEAVQHQPIGLHIAITAAAVMTAALGGAQFGIQSNQNSLQSQSALAHDPLTLHLAKMSRSQLTEIISELKGMATQNKELARQLLLSRPQLPKALFQAQIMLGMVTSQVLQMPNLRLVSDQTSQSLMNEGQLGQPSLVQTLSGLPPPGQGKLQPGLTPYAQEGQAQHHTS

SEQ ID NO: 4224 - protein, 166 aa, Trilisa paniculata
MFPMVTEFMNYGQQTVRAARYIGQGFMITLSHANRLPVTIQYPYEKLITSERFRGRIHFEFDKCIACEVCVRVCPIDLPVVDWKLETDIRKKRLLNYSIDFGICIFCGNCVEYCPTNCLSMTEEYELSTYDRHELNYNQIALGRLPISIIDDYTIRTILNLPEIKT

SEQ ID NO: 4225 - protein, 73 aa, Vicia sativa
KGKVDVADDVTLEYLGSVHVQKGVIDLHFMVFKKAMLKTIKMAVEDKWSEELDCAWGKAYDELAAAIKKAMGW

SEQ ID NO: 4226 - protein, 548 aa, Rhodococcus sp. RHA1
MSTNVSTATSVTTGPIEGSTKQYLLSADDVRVPVRRVHLTNGEHLDVYDTSGPYTDADATIDLEAGLPHLRAPWIADREGTQLDAARAGVVTPEMQYCAAREGVSPETVRTEVAAGRAVIPANRCHPELEPMIIGKAFAVKINANIGNSAVTSSIAEEVEKMVWATRWGADTIMDLSTGKNIHETREWILRNSPVPVGTVPIYQALEKVGGDPTALTWEIYRDTVIEQCEQGVDYMTVHAGVLLRYIPLTARRVTGIVSRGGSIMAAWCLAHHRESFLYNHFDELCEILHRYDVTFSLGDGLRPGSIADANDEAQFAELRTLGELTRIAKSHGVQVMIEGPGHVPMHKIVENVRLEEELCEEAPFYTLGPLATDIAPAYDHITSAIGAAMIAQAGTAMLCYVTPKEHLGLPNRDDVKTGVITYKIAAHAADLAKQHPRAQERDDALSKARFEFRWHDQFALSLDPDTAREFHDETLPAEPAKTAHFCSMCGPKFCSMRISADVREYAQQHGLDSVEAIEAGMAEKSSEFVDAGGRVYLPVESVTSENR

SEQ ID NO: 4227 - protein, 157 aa, Zea mays
  misc_feature (28)..(28): Xaa can be any naturally occurring amino acid
  misc_feature (40)..(40): Xaa can be any naturally occurring amino acid
  misc_feature (51)..(51): Xaa can be any naturally occurring amino acid
  misc_feature (73)..(74): Xaa can be any naturally occurring amino acid
  misc_feature (90)..(90): Xaa can be any naturally occurring amino acid
  misc_feature (105)..(105): Xaa can be any naturally occurring amino acid
  misc_feature (120)..(120): Xaa can be any naturally occurring amino acid
  misc_feature (122)..(122): Xaa can be any naturally occurring amino acid
  misc_feature (126)..(126): Xaa can be any naturally occurring amino acid
YSLNGPKEVDPPFILVKGPGGFLLRKRXVEGASKKFRVIXVDESKLVKHLXGSGLAVPVRFVPACWDSTRGSXXGAFQRSGCKAKLRVRXGGETAAVTDTGNFVXDLYLERDMEDLEPAXEXILRXPGVVEHGMFLGIATTLIVAGKSGVTVKDRFG

SEQ ID NO: 4228 - protein, 376 aa, Azoarcus sp. EbN1
MECARCGGRLARLLYFAASICTAGPAVRRRFSGCLVRQSVTASNPMNPVPPALPDETRCVALARRVLHIEAAAVAALAERLGADFERAVQLILQRRGRVIVTGIGKSGHIARKLAATLASTGTPAYFVHAAEAAHGDLGMITAEDVVIALSNSGASEELLTIVPLVKRQGAKLISMTGKPDSPLAREADVHLDAAVSEEACPLNLAPTASTTAALALGDALAVALLDARGFGADDFARSHPGGSLGRRLLTHVSDVMRGADRVPQVPETVPMTSALLEMTRGGMGMTAVVDARGAPIGIFTDGDLRRALERGCDARTAALAEVMTRAPRSIDPDALAVEAAEIMERLRISQLLVVDADGTLAGALTTHDLMLAKVI

SEQ ID NO: 4229 - protein, 274 aa, Oryza sativa (japonica cultivar-group)
MAVENGAALFGEEELRDVSGVRVGDRFVEVTCGCTSARYGDAVGRLRLFASGELQVSCDCTPGCDQDKLSPAAFEKHSGRETAGRWQNTVWVMVKGDKVALSKTCLLRYYHKKLKSSSANGGGRRPPCHRDEFVRCAGCGKERRFRLRTKEECRLYHDAMARHDWTCKDMPPAGRCRVRVSCEEEEERASRKASRGCTRAATCKGCVRTWVLGRQWHSMNVEAVASALCTFTCAADRDGFDVRTVVCSVQTVQTYRGSLQDIHVSIFSYMEEIK

SEQ ID NO: 4230 - protein, 776 aa, Pseudomonas sp. SMP1
MKCPKILAALLGCAVLAGVPAMPAHAAINSMSLGASYDAQQANITFRVYSSQATRIVLYLYSAGYGVQESATYTLSPAGSGVWAVTVPVSSIKAAGITGAVYYGYRAWGPNWPYASNWGKGSQAGFVSDVDANGDRFNPNKLLLDPYAQEVSQDPLNPSNQNGNVFASGASYRTTDSGIYAPKGVVLVPSTQSTGTKPTRAQKDDVIYEVHVRGFTEQDTSIPAQYRGTYYGAGLKASYLASLGVTAVEFLPVQETQNDANDVVPNSDANQNYWGYMTENYFSPDRRYAYNKAAGGPTAEFQAMVQAFHNAGIKVYMDVVYNHTAEGGTWTSSDPTTATIYSWRGLDNTTYYELTSGNQYFYDNTGIGANFNTYNTVAQNLIVDSLAYWANTMGVDGFRFDLASVLGNSCLNGAYTASAPNCPNGGYNFDAADSNVAINRILREFTVRPAAGGSGLDLFAEPWAIGGNSYQLGGFPQGWSEWNGLFRDSLRQAQNELGSMTIYVTQDANDFSGSSNLFQSSGRSPWNSINFIDVHDGMTLKDVYSCNGANNSQAWPYGPSDGGTSTNYSWDQGMSAGTGAAVDQRRAARTGMAFEMLSAGTPLMQGGDEYLRTLQCNNNAYNLDSSANWLTYSWTTDQSNFYTFAQRLIAFRKAHPALRPSSWYSGSQLTWYQPSGAVADSNYWNNTSNYAIAYAINGPSLGDSNSIYVAYNGWSSSVTFTLPAPPSGTQWYRVTDTCDWNDGASTFVAPGSETLIGGAGTTYGQCGQSLLLLISK

SEQ ID NO: 4231 - protein, 447 aa, Enterococcus faecalis
MKVIVLGSSHGGYEAVEELLNLHPDAEIQWYEKGDFISFLCCGMQLYLEGKVKDVNSVRYMTGEKMESRGVNVFSNTEITAIQPKEHQVTVKDLVSGEERVENYDKLIISPGAVPFELDIPGKDLDNIYLMRGRQWAIKLKQKTVDPEVNNVVVIGSGYIGIEAAEAFAKAGKKVTVIDILDRPLGVYLDKEFTDVLTEEMEANNITIATGETVERYEGDGRVQKVVTDKNAYDADLVVVAVGVRPNTAWLKGTLELHPNGLIKTDEYMRTSEPDVFAVGDATLIKYNPADTEVNIALATNARKQGRFAVKNLEEPVKPFPGVQGSSGLAVFDYKFASTGINEVMAQKLGKETKAVTVVEDYLMDFNPDKQKAWFKLVYDPETTQILGAQLMSKADLTANINAISLAIQAKMTIEDLAYADFFFQPAFDKPWNIINTAALEAVKQER

SEQ ID NO: 4232 - protein, 701 aa, Oryza sativa (indica cultivar-group)
  misc_feature (504)..(504): Xaa can be any naturally occurring amino acid
MAGVLPATTTTNNIVGLIFFFFSVFCDDLYSPAPVAVALTFNHTNFGPDEQTNIRLEGDAAFSADVSFSGDGGGWVDISANRLDGSIDHSRGRVSYALPVPLWDAATGEVASFTTGFSFVINPPKEDGGINNKGAGMAFFLAGFPSRLPSAGSYAYNLGLTNQTAEQVAAGDDRFVAVEFDTFNDTIVHDPDATYDHLGVDVNSVVSKRILTLPSFTLVGNMTAVVEYDNVSSILAMRLHLGYGLSGPRHRPDYNLSYKVDLKSVLPEQVAVGFSAATSTSVELHQLRSWYFSSSLEPKAAPPPVAPPSPSPPPTSGSGSGGVVAGATVGAALFVVLLLAMVAVVVLVRRRHQRKKMREAEEANDDDDDTEGDPIMEIENGTGPRRFAYHVLVNATKSFAAEEKLGQGGFGAVYRGYLREQGLAVAIKRFIKDSSNQGRREYKSEIKVISRLRHRNLVQLIGWCHGRNELLLVYELVPNRSLDVHLYGNGSTLLLGSDPPLLYXHEECEQCVVHRDIKPSNVMLDESFNTKLGDFGLARLIDHADGVQTMTHPSGTPGYIDPECVITGKASAESDVYSFGVVLLEVVCARRPMSLLDDQNNGLFRLVEWVWDLYGQGAIHNAADKRLNNDYDVVEMERVIAIGLWCAHPDRCQRPSIRAAMMVLQSSGPMPMLPARCPWQHMHRRWPHRRGSSRRRRIDKL

SEQ ID NO: 4233 - protein, 401 aa, Synechococcus sp. WH 5701
MAKRSLTSLSAADLQGKRVLVRVDFNVPLDESGAITDDTRIRAALPTIHDLISKGAKVILAAHFGRPKGEVNEAMRLTPVAARLSELLGKPVVKTDSCIGPDAEAKVAAMADGDVVLLENVRFFAEEEKNDTEFAKKLAALAEVYVNDAFGAAHRAHASTEGVTEYLKPNVAGHLMEKELQYLQGAIDEPKRPLAAIVGGSKVSSKIGVLEALIDKCDKVLIGGGMIFTFYKARGLAVGKSLVEEDKLELAKELEAKAKAKGVQLLLPTDVVLADSFSPDAKTLTTSVNVIPDGWMGLDIGPDSLKAFQAALADCKTVIWNGPMGVFEFDKFAAGTNGVAHTLAELSGKGCCTIIGGGDSVAAVEKVGVAEKMSHISTGGGASLELLEGKVLPGVAALDDA

SEQ ID NO: 4234 - protein, 721 aa, Oryza sativa (indica cultivar-group)
MTVAGSLVSSTTAVGIIFFSVCYLRPAPVAALYFNYSTFSQDDGNTIRLEGDASFGDGWIDISANRYGHRGHSKGRASYNARPMLLWSRDTGEVASFTTRFSFVINPLEEYGGINNKGTGMAFFLAAYPSMLPSGVDELGYNIGLTDQGPDAIASGDSRFVAVEFDTFNNTMVHDPDATYDHLGIDVNSVVSNKTLTLPSFTLVGNMTAVVEYDNVSSILAMRLHLGYGLSGPRHRPDYNLSYKVDLKSVLPELVSVGFSASTTTSFELHQLHSWYFSSSLEPKAAVRGRVVAGATVGTVMFVILLFAMVAVLVRQRQSKKRETEEAKNGGMDGSDDDDDDDGETIVEIEMGTGPRRFPYYELVEATKSFAAEEKLGQGGFGTVYRGYLREQGLAVAIKRFTKDSSKQGRKEYKSEIKVISRLRHRNLVQLIGWCHGHDELLLVYELVPNRSLDIHLHGNGTFLTWPMRVKIILGLGSALFYLHEEWEQCVVHRDIKPSNVMLDESFNAKLGDFGLARFIDHIVGMQTMTAVSGTPGYVDPECVITGRASAESDVYSFGIVLLEVACGRRPMSLLDSQKNGIFRLVEWAWDLYGKGDILMAADERLNGNYDAAEMERVIVIGLWCAHPDPNARPSIRNAMAMLQSGGQLPVLPAKMPVPMYIPPVVSVDELFTSPAGMSSSSATQSSTTTVSGYATHISTSSDTSTSAGSKDSSSLLKHQF

SEQ ID NO: 4235 - protein, 368 aa, Oryza sativa (japonica cultivar-group)
MTKQEILLEKKRVITVQGRDKAGRPIVRIVGKNFPARELGGGGHAEAALKGYVRRRVTPAIGDAEFVVVYMHSGVDRRENFPGVGAVRTAYESMPAAVRERLHAVYFLHPGLQSRLFFSTLGRFLFSSGLYGKLRYVSRLEYLWAHVRKGELDVPEAVRRHDDELEQRPLMDYGIEASERTSKNGPKPHCTPPSPPKHRRHLNHMNMARSNLLCCLGTRREDNARQRQTRPTPRPRLRRLMSGMKRVFGRSPPCGQTAVAPDSGIVVVEPRRQTAARRVGKGARDGGVNNREEISREEAAAATIQAGFRGHLARRAFRALRSLVKLQALARGSYVRKQAGVAIRFMKVLVRLQVRVRARQLLHRSKDQ

SEQ ID NO: 4236 - protein, 508 aa, Corynebacterium glutamicum ATCC 13032
MTDIKATSSTSATTAPTAGRPARRLGQISLVACLGGLLFGYDTGVANGAEGHMAQELGLNVLQLGVVISSLVFAAAFGALFAGRISDEIGRRKAIITLSVLFFLGSILVVFSPAGELGQFYGPGFATLVTGRIMLGLAVGGASTVVPVYLAELAPLEIRGSLTGRNELAIVTGQLLAFVINALIAVTLHGVIDGIWRIMFAVCALPAVALFLGMLRMPESPRWLVNQGRYDDARRVMETVRTPERAKAEMDEIIAVHSENNAALPGVKQSSGQASGQVSSKHTHMSIGEVLSNKWLVRLLIAGIGVAVAQQLTGINAIMYYGTRVLEESGMSAEMAVVANIAFGAVAVIGGLIALRNMDRLDRRTTFIIGLSLTTTFHLLIAAAGTLLPEGNSIRPFAIMILVVGFVLSMQTFLNVAVWVWLAEIFPVRMKGIGTGISVFCGWGINGVLALFFPALVSGVGITFSFLIFAVVGVIALAFVTKFVPETRGRSLEELDHAAFTGQIFKKA

SEQ ID NO: 4237 - protein, 670 aa, Oryza sativa (indica cultivar-group)
MAAGVLMTKPFMAALACLLVMPSVVATTVSFNYSSFSNASKNITLQGSAALAGAAAEWIELTKGKGNNLSSGGTMGRMVYTPPVQLWDAATGEVASFTTRFSFNITPKNKSNKGDGMTFFLVSYPSRMPYMGYGGALGLTSQTFDNATAGDRFVAVEFDTYNNSFLDPDATYDHIGIDVNALRSVKTESLPSFILIGNMTAIVDYNSNSSIMSVKLWANGSTTPYNLSSKIDLKSALPEKVAVGFSAATGSSFEQHQLRSWYFNLTLEQKQPTGQHSRGGVVAGATVGAILFIVLLFTMVAILVRRRQRKKMREEEEDDSEGDPIVEIEMGTGPRRFPYHILVNATKSFAAEEKLGQGGFGAVYRGNLRELGIDVAIKRFAKDSSKQGRKEYKSEIKVISRLRHRNLVQLIGWCHGRNELLLVYELVSNRSLDVHLHGNGTFLTWPMRINIVLGLGNALLYLHEEWEQCVVHRDIKPSNVMLDESFNTKLGDFGLARLIDHAIGAQTMTHPSGTPGYVDPECVITGKASAESDVYSFGIVLLEVACGRRPMNLLDDQNNGLFRLVEWVWDLYGQGAVLKAADERLNGDYDATDMECVLVVGLWCAHPDRCARPSIRVAMAVLQSNGPLPMLPTKMPVPTYGPPVASSEGQHSASTGISSSSLTQTSITPR

SEQ ID NO: 4238 - protein, 114 aa, Triticum aestivum
MAMAPSASVVSFSARPSAALRPRAASVTAGAGGRVRAGAPKGGKWWAPLVGWSGRADYMEAAAPTRVVEQEEEKTFVGLTEEKARQLRARMSEMESFHDAMYHSAIASRLARST

SEQ ID NO: 4239 - protein, 374 aa, Glycine max
MDNDLAGDMLCQNVNYNSAYRKLARSYHPDVNKEPDAEQKFKELSNAYEVLSDDEKRSIYDTYGEAGLKGSGMGMGDFSNPFDLFETLFEGMGGMGGSRGSWNGAVEGEDEYYSLVLNFKEAIFGVEKEIEIRRLESCGTCNGLGAKPGTKSSKCSTCGGQGRVVTSTRTPLGIFQQSMTCSSCSGTGETSTPCSTCAGEGRVRKTKRISLKVPAGVDSGSRLRVRNEGNAGRRGGSPGDLFVVLEVIPDPVLKRDDTNILYTCKVSYIDAILGTTIKVPTVDGMVDLKIPAGTQPSSTLVMAKKGVPLLNKKNMRGDQLVRVQVEIPKKLSKEERKLIEELADLSKGKTAATNSQLGAAAIHFRTVVGLVSIY

SEQ ID NO: 4240 - protein, 478 aa, Rickettsia akari str. Hartford
MKFMNLLKNITGKNYINGEFVEFGKQISIINPSTLKEIATVPNLELSEINSAINNTVQTFASWSQSSFEERIAILRKWYNLVIENIDELSHILTLEQGKVLSESKKEILYGASFIDWYTYVIHNIHGTIKPGSSKAHKIVTQYEPVGPSAAITPWNFPNAMITRKVIPAIAAGCSVILKPSSLTPLSALILTKFASDAGLPAGVFNVITGDSDIIGQSFCEDFRLRKLSFTGSTNVGKILYQNAANTLKRLSLELGGNAPFIITADNKLEKVARDLVVAKTRNSGQSCTSPNRIFIEESIYEKFIEILKAKFTQLKAGDGFDKESDVGPLISSAAIEKIQKLLTDAQSKEAQLICGGKAVDNFIEPTIIIDCLDNMDIFRTEIFGPVVACYKFKDLDEVIERANNTEYGLQGYVYSNNISTAQMIATRLDFGMVSINNPLPGNAKAPFAGRKASGFGVVGSFEGIFEYLNTKYINLQN

SEQ ID NO: 4241 - protein, 793 aa, Clostridium perfringens SM101
MKVPFNWLKDYVDIDMTAEELGDALTLSGSKVEEVVTAGAEIENIVTCQIDKIEQHPDAEKLKICQVNIGSEMIQIVTAADNMKEHDKVPVALHGAILADGSKIKKGKLRGEVSNGMFCSEEELGIADGKEVIGLMILPEDAPIGVCIKEYLGLNKQVLDFEITSNRPDCLSVLGMARETAATTRKTYRMPNTKFEVKCDKKINDEIKVTVNDKLCNRYMARGVKNVKVAPSPTWMQERLLDAGVRPINNIVDITNFVMLELGQPMHAFDRRELKSSNIVVERAKDGDKFVTLDEIERELNSEVLCIKDGEEIVALAGIMGGLNSGVKDDTTEIVFESANFDGTNIRVNSKNLGLRTESSSRFEKDIDPNLAALALDRACALVEELGCGEIMEGTIDVYNNVKEEKTLEVSVNWINKFLGTSLEAEEMKRCLDSLDLKTTINGDTLEILVPTFRIDVDIREDVAEEVARIYGYNNIPATLISTSTEKEAKDKKQLLDEKVIDTMLASGLNQSISYSFVSPKVFDKICVPEDSSLRNVVKIKNPLGEDYSVMRTSTLPSMMESLARNYSRSNEIVRLFEIGKTYIPNSDENELPTERNILTIGIYGQCDYFDLKGIVENLLDSLGLKSASFKRMSENPSYHPGKTAELILGRTSLGVLGEIHPDVNENYGVDVPCYVAELDLDAMYNFSKTEKAYKPLPKYPAITRDIALLVDDAVLVQEIEDAIRKAGGQVVEKVELFDVYKGAQIPEGKKSIAYAIAYRDPSKTLKDKDINKVHDKILRALEYKLGAQLREQ

SEQ ID NO: 4242 - protein, 728 aa, Oryza sativa (indica cultivar-group)
MAVGELVTRSSVAAASASAIACLLFLGFLPSLATAVSFSYSTFSNGTKNITLQGSAAIAGDGWIEITTGSNLPSGGTMGRVAYSPPVQLWDAATGEVASFTTRFSFNITPTNLDNKGDGMAFFLVGYPSRMPDTADGGALGLTSRTFDAVMSGDNRFVAVEFDTFNNSFDPSATYDHIGVDVNSIVSVQTESLPSFSLTGNMAAIVDYNSSSSILSVQLVKTWTNGSTTLYNLSTTVDLKIALPEKVSVGFSAATGSSLELHQLHSWYFNSSFQQNPPPAAQPSPTTSGPGLAGVIAGATAGGALFVVLLFAMIVVLVRRRRSKKRREAEEAEEARHVGLAGDDDDDDDGEPIVEIEMGMGPRQIPYHELVEATKSFAAEEKLGQGGFGAVYRGYLREQGLAVAIKRFAKDSSKQGKKEYRSEIKVISRLRHRNLVQLIGWCHGRDELLLVYELVPNRSLDIHLHGNGTFLTWPMRVKIVLGLGSALFYLHEEWEQCVVHRDIKPSNVMLDESFNAKLGDFGLARFIDHAVGMQTMTAVSGTPGYVDPECVITGRASSESDVYSFGIVLLEVACGRRPMSLQDNQKNGIFRLVEWVWDLHGQGDVISAADERLNGDYDVSEMERVITVGLWCAHPDPSARPSIRAAMAMLQSSGQLPVLPAKMPVPTYAPPVASVEGLFTSSTGMLSSSATQSSSTTSGYITHTSSSSNTSTSAGSKDSSSLLKHQYL

SEQ ID NO: 4243 - protein, 113 aa, Triticum aestivum
MGCAGSTPKSDDSSKKLKKPKPWKHTQSITPAQLKQMREEFWDTTPHYGGQKEIWDALRAAAEADLALAQTIVDSAGIIVSNSDMTLCYDERGAKYELPKYVLSEPTNLIREK

SEQ ID NO: 4244 - protein, 444 aa, Bradyrhizobium sp. BTAi1
MPPCAPPSRIPIPASRSSINAPPSSSHRAAGTNRKDHRHEARRTSLVPQVCCGARPDRPQQPRPMGRAGAGRTLWRPVRQPRRGDQICAVRKRSSSGDDRRVVANDRARHQRTPRAHRSAARQRQATGRMTAAAPMQREAARGWLAGAIADIPTPFDRSGALDIAALARLCERQIEAGASAILVCETAGEASTLTAAEREAVIRTAVTVACNRIHVIAGAGSNSTLQAVQNTRQAAAAGADAIMSVVPYYNRPTAEGIYAHFRAVGDATALPIILHDCPARTGRGLPDETLIRLAQWAQFIGLRDSTGDIARVVHLRARVPLGFRLLGDDLTALAYAAAGGDGCFSLAANIAPQLCNALLESCRRGRWRTARRLHQQLLQLSEATSRELPAALKYALSLQGLAMPHVRLPLTELDQPAQAMVAQAMAELNAWLATAPGIPACQS

SEQ ID NO: 4245 - protein, 1122 aa, Arabidopsis thaliana
MSGSRPTQSSEGSRRSRHSARIIAQTTVDAKLHADFEESGSSFDYSTSVRVTGPVVENQPPRSDKVTTTYLHHIQKGKLIQPFGCLLALDEKTFKVIAYSENASELLTMASHAVPSVGEHPVLGIGTDIRSLFTAPSASALQKALGFGDVSLLNPILVHCRTSAKPFYAIIHRVTGSIIIDFEPVKPYEVPMTAAGALQSYKLAAKAITRLQSLPSGSMERLCDTMVQEVFELTGYDRVMAYKFHEDDHGEVVSEVTKPGLEPYLGLHYPATDIPQAARFLFMKNKVRMIVDCNAKHARVLQDEKLSFDLTLCGSTLRAPHSCHLQYMANMDSIASLVMAVVVNEEDGEGDAPDATTQPQKRKRLWGLVVCHNTTPRFVPFPLRYACEFLAQVFAIHVNKEVELDNQMVEKNILRTQTLLCDMLMRDAPLGIVSQSPNIMDLVKCDGAALLYKDKIWKLGTTPSEFHLQEIASWLCEYHMDSTGLSTDSLHDAGFPRALSLGDSVCGMAAVRISSKDMIFWFRSHTAGEVRWGGAKHDPDDRDDARRMHPRSSFKAFLEVVKTRSLPWKDYEMDAIHSLQLILRNAFKDSETTDVNTKVIYSKLNDLKIDGIQELEAVTSEMVRLIETATVPILAVDSDGLVNGWNTKIAELTGLSVDEAIGKHFLTLVEDSSVEIVKRMLENALEGTEEQNVQFEIKTHLSRADAGPISLVVNACASRDLHENVVGVCFVAHDLTGQKTVMDKFTRIEGDYKAIIQNPNPLIPPIFGTDEFGWCTEWNPAMSKLTGLKREEVIDKMLLGEVFGTQKSCCRLKNQEAFVNLGIVLNNAVTSQDPDKVSFAFFTRGGKYVECLLCVSKKLDRKGVVTGVFCFLQLASHELQQALHVQRLAERTAVKRLKALAYIKRQIRNPLSGIMFTRKMIEGTELGPEQRRILQTSALCQKQLSKILDDSDLESIIEGCLDLEMKEFTLNEVLTASTSQVMMKSNGKSVRITNETGEEVMSDTLYGDSIRLQQVLADFMLMAVNFTPSGGQLTVSASLRKDQLGRSVHLANLEIRLTHTGAGIPEFLLNQMFGTEEDVSEEGLSLMVSRKLVKLMNGDVQYLRQAGKSSFIITAELAAANK

SEQ ID NO: 4246 - protein, 166 aa, Hulsea algida
MFPMVTQFMNYGQQTVRAARYIGQGLIITLSHANRLPVTIQYPYEKLITSERFRGRIHFEFDKCIACEVCVRVCPIDLPVVDWKLETDIRKKRLLNYSIDFGICIFCGNCVEYCPTNCLSMTEEYELSTYDRHELNYNQIALGRLPMSIIDDYTIRTILNLPEIKT

SEQ ID NO: 4247 - protein, 166 aa, Hofmeisteria fasciculata
MFPMVTEFMNYGQQTVRAARYIGQGFIITLSHANRLPVTIQYPYEKLITSERFRGRIHFEFDKCIACEVCVRVCPIDLPVVDWKLETDIRKKRLLNYSIDFGICIFCGNCVEYCPTNCLSMTEEYELSTYHRHELNYNQIALGRLPMSIIDDYTIRTILNLPEIKT

SEQ ID NO: 4248 - protein, 167 aa, Ananas comosus
VSELTHACTTIIWVASALHAAVNFGQYPYAGYLPNRPTISRRFMPEPGSADYEELKTNPDKVFLRTVPSELETILGVSLIEILSTHSSDEVYLGQRDTPEWTADQSALQAFERFKARLAQIEADIVKRNGDPSLKNRNGPVKMPYTLLYPTSTVGITGKGIPNSVSI

SEQ ID NO: 4249 - protein, 166 aa, Guardiola tulocarpus
MFPMVTEFMNYGQQTVRAARYIGQGFMITLSHANRLPVTIQYPYEKLITSERFRGRIHFEFDKCIACEVCVRVCPIDLPVVDWKLETDIRKKRLLNYSIDFGICIFCGNCVEYCPTNCLSMTEEYELSTYDRHELNYNQIALGRLPMSIIDNYTIRTILNLPEIKT

SEQ ID NO: 4250 - protein, 505 aa, Populus tremuloides
MDLLLLEKTLLGSFVAILVAILVSKLRGKRFKLPPGPLPVPVFGNWLQVGDDLNHRNLTDLAKKFGDILLLRMGQRNLVVVSSPDLAKEVLHTQGVEFGSRTRNVVFDIFTGKGQDMVFTVYGEHWRKMRRIMTVPFFTNKVVQQYRYGWEEEAAQVVEDVKKNPEAATHGIVLRRRLQLMMYNNMYRIMFDRRFESEEDPLFNKLKALNGERSRLAQSFDYNYGDFIPILRPFLRGYLKICKEVKERRLQLFKDYFVEERKKLGSTKSMSNEGLKCAIDHILDAQKKGEINEDNVLYIVENINVAAIETTLWSIEWGIAELVNHPEIQKKLRDELDTVLGPGHQITEPDTYKLPYLNAVIKETLRLRMAIPLLVPHMNLHDAKLGGFDIPAESKILVNAWWLANNPAKWKNPEEFRPERFFEEEAKVEANGNDFRYLPFGVGRRSCPGIILALPILGITLGRLVQNFELLPPPGQSKIDTSEKGGQFSLHILKHSTIVAKPRSF

SEQ ID NO: 4251 - protein, 1004 aa, Geobacter sulfurreducens PCA
MLNSELNTKIVNRGKEFFGSISGEKPSLFNKGAWMGKAMDWSMQNEQFKIQMFRFVDVFPSLTTSKLLTEHIREYFGNEQDMPAFMSTGAKVAGMLGSFGGAVLNKVLTSNIEEMARQFIVGETTKEAVKNLEKLRKDGFAAVVDVLGEATLSEEEAEVYTNTYLELLEALKKEQGSWKGLPGKGGDPGLDWGHAPKVNIAVKPTALFCLANPQDFEGSVVAILDRMRRIFKKVMELNGFLCIDMESYRHKEIILEVFRRLKLEYRDYPHLGIVLQAYLKDNDKDLDDLLAWAKEHKVQISVRLVKGAYWDYETVKAKQNDWEVPVWTIKAESDAAYERQARKILENHQICHFACASHNIRTISAVMEMARELNVPEDRYEFQVLYGMAEPVRKGILKVAGRIRLYAPYGNMVPGMGYLVRRLLENTANESFLRQSFAEDAQIERLLEDPAVTVERERAARAAKPKKERKGLGGLPPFNNEAMVDFTRADHRAAFPKHIAQVRTQLGKTYPLFINGKEVRTNDLIPTVNPNKPSEVLGQICQAGTTEVGDAIAAAKAAFPAWRDTDPRTRAEYLLKAAQAARKRLFELSAWQVLEIGKQWDQAYADVTEAIDFLEYYAREMIRLGQPQRVGHAPGELNHYFYEPKGVAAVIAPWNFPLAISMGMASAAIVTGNCVVFKPSGITSIIGWHLVELFREAGLPEGVFNFTPGRGSVMGDYLVDHPDISLIAFTGSMETGLRIIERAAKVHPGQANVKKIISEMGGKNAIIIDDDADLDEAVPHVLYSAFGFQGQKCSACSRVIVLDAVYDKFIERLVSMAKATKVGPSEDPANYMGAVADDKAMKSIKEYAEIGKREGHVLYESPVPAGEGYFVPMTIIGGIKPEHRIAQEEIFGPVLAVMRAKDFDQAIEWANSTQFALTGGIFSRSPEHLAKARREFRVGNLYINRNNTGALVERQPFGGARMSGVGTKAGGPDYLLHFMDPRVVTENTMRRGFAPIEEDDDWVD

SEQ ID NO: 4252 - protein, 364 aa, Solanum lycopersicum
MIFQATIQNSYDKMSDLIAFDDTKAGVKGLVDSGINKVPQVFILPPKYRVKTCETHISFPVIDLKGIDEDPIKYKEIVDKVRDASETWGFFQVVNHGIPTSILEKTLLGTRQFFEQDTEIKKQYYTRDIGEKVIYTSNLDLYSPSVPAASWRDSIFFFMAPNPPSPQEFPTACGEILMDYSKYVTELGFSLLELLSEGLGLDRSYLKDYMDYCHQSCLCHYYPSCPQPELTMGISQHSDTEFITVLLQDDIGGLQVLHQNQWFDVPPIRGALVVNIGDFLQLMSNDKYMSVEHRAIAKKDGSRMSVACFFGENPLQSSKLYEPITELLSEDNPPKYHATTVIDYKNYVLNKGLDGTSALLSYKI

SEQ ID NO: 4253 - protein, 563 aa, Bacillus anthracis str. A2012
  misc_feature (327)..(328): Xaa can be any naturally occurring amino acid
MKVEKPWLKSYPEEIPSTISYDIQPLHKYVEQMASRYPEKKALHFLGKDITFSVFHDKVKRFANYLQKLGVGKGDRVAIMLPNCPQAVIGYYGTLLAGGIVVQTNPLYTERELEYQLHDSGAKVILCLDLVFPRVTNVQSATKIEHVIVTRIADFLPFPKNLLYPFVQKKQSNLVVKVSESETIHLWNSVEKEVNTGVEVPCDPENDLALLQYTGGTTGFPKGVMLTHKNLVSNTLMGVQWLYNCKEGEEVVLGVLPFFHVYGMTAVMNLSIMQGYKMVLIPKFDMKMVFEAIKKHKVTLFPGAPTIYIALLNSPLLKEYDISSIRXXISGSAPLPVEVQEKFETVTGGKLVEGYGLTESSPVTHSNFLWEKRVPGSIGVPWPDTEAMIMSLETGEALRPGEIGEIVVKGPQIMKGYWNKPEETAAVLQDGWLHTGDVGYMDEDGFFYVKDRKKDMIVASGFNVYPREVEEVLYEHEKVQEVVTIGVPDPYRGETVKAFVVLKEGTECSEEELNQFARKYLAAYKVPKVYEFRDELPKTTVGKILRRVLIEEEKRKNEDEQTG

SEQ ID NO: 4254 - protein, 422 aa, Pyrococcus abyssi GE5
MDPLKFHKGGKIGVISKVPLKTREHLSLAYTPGVAEPCKAIAKDPEKVYEYTSKGNSVAVVSDGSRILGLGNIGPLAGLPVMEGKALLFKRFGGIDAFPIMIGEQDPDKFIEVVKAISPTFGGINLEDIASPKCFYILDKLREELDIPVFHDDQQGTAAVVLAGLINALEVVGKRLDEISVALFGAGAAGFATLRILVKAGVKPGNVRVVELVNGKPMVLTKDLDLEKLFPYRGWLLEKTNDEGIEGGPEEALKGADVLISFTRPGPGVIKPEWIREMSDDPIVFPLANPVPEILPDEAKKAGARIVATGRSDYPNQINNLLGFPGIFRGALDVRARSITDDMIIEAAKAIASVVEEPSEENIIPSPFNPIVYAKEARAVAEEAMKEGVARVKVKGEEIEERTLKLISLWDDILGEVADKLS

SEQ ID NO: 4255 - protein, 218 aa, Hordeum vulgare subsp. vulgare
MEWACCGSGYSSSGTQSPAAGDGEEGSYMTVSSAPPKRRAGRTKVRETRHPVYKGVRSRNPGRWVCEVREPQGKQRLWLGTFDTAEMAARAHDVAAMALRGRAACLNFADSPRRLPVPPQGAGHDEIRRAAVEAAELFRPAPGQRNAATVAAATAPPVALGNAELVADSPYYPMDGLESEMQGYLDMAHGMLIEPPPMAWPSTWIEEDYDCEISLWNY

SEQ ID NO: 4256 - protein, 291 aa, Triticum aestivum
ITDSSTHASDQGASKITKGLLDKYGPDRVLDTPITEAGFTGIGVGAAYQGLRPVVEFMTFNFSMQAIDHIINSAAKSNYMSAGQISVPIVFRGPNGAAAGVGAQHSQCYAAWYAHVPGLKVLTPYSAEDARGLLKAAIRDPDPVVFLENELLYGESFPIKAEVLDSSFSVPIGKAKIEREGKDVTITAFSKMVGYALQAAEILSKEGISAEVINLRSIRPLDRAAINASVRKTSRLVTVEEGFPQHGVGAEICMSVVEDSFEYLDAPVERIAGADVPMPYAANLEDWQSTG

SEQ ID NO: 4257 - protein, 471 aa, Oryza sativa (japonica cultivar-group)
MAEESDEITPVVEPILVVDTSGEMETEANGGREAKAMKDHIDLECSQAKKPQPKDLKEIAGSFWLAASVFSKKWQKWRRKQKLKKQDAAGSKAAAAAMPPPEKPSKPSFLRRSRLRGEACSEFAGGRRSCDTDPRFSLDAGRMSVDDVGFSWDEPRASWDGYLFGAGTGIGLGRAPPPLSRLPPILSAMEDSPAGIVERSDGQIPVEDDSQPEPDPDADTPGGSVQTRDYYDTSSSSRRRRSLERTSSVRRPSFEVTDAKPVLPAAAAITSVKDSPLIGSSEFYHFQHAEDLLEHHRFSTSSLIEDFPMSLDAAFPGPDKKPRRWRKAWSLWGLIHRRAAGRRGGASDVADRAFSEPWPELRVRGCNARMQRCNSNASARSSFSSNSGGLGSSRRSYVDGNGNVVKRRREECALERNRSARYSPGHADNGMLRFYLTPMRSASGRRAPGLPAKGGRQLRSQSFARSMLRLY

SEQ ID NO: 4258 - protein, 327 aa, Gloeobacter violaceus PCC 7421
MKAFVLAAGKGTRLRPFTDALPKPLMPVINKPVMAHILGLCRKHGFDEIVANLHYRGEKIVERFADGHDHGVCLQYSWEEQLLGTAGGVRRQAGFLAGGPFLVISGDVMTDLDLGALVRFHKQSGAVATMAVKEVGDPSRFGVVVADPDGRVRSFQEKPAKGTERSRLANTGIYVLEPEVFEYIPEAAFFDFGNDLFPLLVCKGAPVYAMGTGAYWSDVGTLSQYLYTHWELLTHPEIAQRIGEGTVVQAGAVVSEQALIGSGCTIEKGARVLGYSCVSDGCTIRADSVVVDSVVWTSERWGHKLKGDLVRSIWGDGMQVSLGLPNL

SEQ ID NO: 4259 - protein, 290 aa, Triticum aestivum
  misc_feature (109)..(109): Xaa can be any naturally occurring amino acid
  misc_feature (168)..(168): Xaa can be any naturally occurring amino acid
  misc_feature (180)..(180): Xaa can be any naturally occurring amino acid
  misc_feature (208)..(208): Xaa can be any naturally occurring amino acid
  misc_feature (227)..(227): Xaa can be any naturally occurring amino acid
MATSPSPKKKQVLLPIVAGTEPIEASIPIDILRRAGADVTVASAGDALLVEIMYGVKIMADELLADCAAASYDLIVLPGGVPGAVNLGGSATLESIVRKHAEKGGLYAXAICAAPPLALASWGLLNGHKATGHPWFVEKFPPEVTAVDANVVVDSNARDGHWGPATSXSLRLALVEQLYXKEKAQQIAKPMLVRYECGYSMKELNSVXWHCSGTPQGPSSNYPNGFXEMEAIILVDALRRAKADVVVASIEGGVEITARYGTRIVADVMLGEAADRAPFDLIIVPGGMPG

SEQ ID NO: 4260 - protein, 433 aa, Isochrysis galbana
MCNAAQVETQALRAKEAAKPTWTKIHGRTVDVETFRHPGGNILDLFLGMDATTAFETFHGHHKGAWKMLKTLPEKEVAAADIPAQKEEHVAEMTRLMASWRERGLFKPRPVASSIYGLCVIFAIAASVACAPYAPVLAGIAVGTCWAQCGFLQHMGGHREWGRTWSFAFQHLFEGLLKGGSASWWRNRHNKHHAKTNVLGEDGDLRTTPFFAWDPTLAKKVPDWSLRTQAFTFLPALGAYVFVFAFTVRKYSVVKRLWHEVALMVAHYALFSWALSAAGASLSSGLTFYCTGYAWQGIYLGFFFGLSHFAVERVPSTATWLESTMMGTVDWGGSSAFCGYLSGFLNIQIEHHMAPQMPMENLRQIRADCKAAAHKFGLPYRELTFVAATKLMMSGLYRTGKDELKLRADRRKFTRAQAYMGAASALVDTLKAD

SEQ ID NO: 4261 - protein, 879 aa, Oryza sativa
MGMVLGKITVETPKHEVLHTGAGYEVRKYPPCVVAEVTYDPAEMKGDRDGGFTVLGNYIGALGNPQNTKPEKIDMTAPVITSGEPESIAMTAPVITSGEPEPVAMTAPVITAEERSQGKGQMTMQFLLPSKYSKVEEAPRPTDERVVLRQVGERKYGVVRFSGLTGDKVVKEKAEWLKAALEKDGFTVKGPFVLARYNPPFTLPPLRTNEAGRRDRIWPILVSGAAPFRFNVGPTKRSDPYPQGCNPVYGFGRNPTSLTVAKPFNANWIESNTFVFYQASHRRREPAMAMAASPFLILPSLFPKPTILAARIHPSIFRGRHIRCSPNGAAVPESPEPAPRRGRRKSPSPSPPKAKTTRRRTKKNTQESDSEGEEEPPKRRGRRTRKSKQEAEQEAAEKEDEVRAASPGTEDSKRAVQDEDGEAEATGSDSEDGEDSPYDWPPLVCCFGAPRWEFVPTVRVSDRQMHPDIYSTWLHLQWEPPEFARAPGSAASNVAIALTRLGGRAAVLGKVGDDDFGRELVYRMNCERVQTRAIRFDDGAATATARMKVGFRDREDGSGGTRLVAETVKSAAEDSLSKAEINVDVLKEARVFHFNSEVLLTPSMESTLFRAIELSKKFGSKIFFDLNLPLPLWRSRDETKELINKAWNEADIIEVSRDELEFLLDHEYYQYKRANPPQYYLDGFHLTRNWPQYYHYTPEEIAPIWHDGIKLLLVTYGTLRIHYYTPKFHGCVIGTEDALITPYTTDRTGSGDAVVAAAIRKLTSCPEMYEDQDTLERNLRFAVAAGIISQWTIGAVRGFPTESAAQNLKEQNNAHDIQVYFMSAATEVVKGKVLPKQLTGFSVFSFSWKNVSATWRLPLLYSFEELCLPIDFHGRDASV

SEQ ID NO: 4262 - protein, 166 aa, Coespeletia timotensis
MFPMVTEFMNYGQQTVRAARYIGQGFMITLSHANRLPVTIQYPYEKLITSERFRGRIHFEFDKCIACEVCVRVCPIDLPVVDWKLETDIRKKRLLNYSIDFGICIFCGNCVEYCPTNCLSMTEEYELSTYDRHELNYNQIALGRLPMSIIDDYTIRTILNLPEIKI

SEQ ID NO: 4263 - protein, 191 aa, Brassica napus
  misc_feature (141)..(141): Xaa can be any naturally occurring amino acid
  misc_feature (146)..(146): Xaa can be any naturally occurring amino acid
  misc_feature (152)..(153): Xaa can be any naturally occurring amino acid
VVLNECEYLKAIARPRLQVSTVVDIKTGKGVKSDVRTSSGMFLNHVERSYPVIQAIEKRISVFSQVPAENGELIQVLRYEPNQFYRPHHDYFSDTFNLKRGGQRVATMLMYLTDDVEGGETYFPLAGDGECTCGGKIMKGXSVKPXKGDAVXXWSMGLDGQSDPKSIHGGCEVLSGEKWSATKWMRQKATS

SEQ ID NO: 4264 - protein, 70 aa, Ananas comosus
DGLAIWHAIVTWVSDYCSIYYPSDAEVQADAELQAWWKEVREVGHGDKKDEPWWPQMQAVSELTHACTDT

SEQ ID NO: 4265 - protein, 331 aa, Ananas comosus
EPFVIATNRQLSALHPINKLLSPHYRDTMNINALARQTLINAGGILELTVFPARYSMEMSSYVYKSWNFMEEALPADLIKRGILVGDGEHPDKQQLLIKDYPYAVDGLAIWHAIETWVSDYCSIYYPSDAAVQADAELQAWWTEVREVGHGDKKDEPWWPEMQAVSELTHACTTIIWVASALHAAVNFGQYPYAGYMPNGPTISRRFMPAPGTVEYDELKTNPDKAFVRTTTGMLQTILVLSLIEILSTHTSDEKYLGQRDTPEWTTDQSALRAFERFNAALAQIEADIVKRNRDPSLKNRNGPVKMPYTLLYRTSEAGITAKGIPNSVSI

SEQ ID NO: 4266 - protein, 166 aa, Enydra sessilis
MFPMVTEFMNYGQQTVRAARYIGQGFMITLSHANRLPVTIQYPYEKLITSERFRGRIHFEFDKCIACEVCVRVCPIDLPVVDWKLETDIRKKRLLNYSIDFGVCIFCGNCVEYCPTNCLSMTEEYELSTYDRHELNYNQIALGRLPMSIIDDYTIRTILNLPEIKT

SEQ ID NO: 4267 - protein, 853 aa, Mycobacterium tuberculosis H37Rv
MPTAGSSRAPAAAREIVVVGHGMVGHRLVEAVRARDADGSLRITVLAEEGDAAYDRVGLTSYTESWDRALLALPGNDYAGDQRVRLLLNTRVTQIDRATKSVVTAAGQRHRYDTLVLATGSYAFVPPVPGHDLPACHVYRTFDDLDAIRAGAQRTLDGGHTDGGVVIGGGLLGLEAANALRQFGLQTHVVEMMPRLMAQQIDEAGGALLARMIADLGIAVHVGTGTESIESVKHSDGSVWARVRLSDGEVIDAGVVIFAAGIRPRDELARAAGLAIGDRGGVLTDLSCRTSDPDIYAVGEVAAIDGRCYGLVGPGYTSAEVVADRLLDGSAEFPEADLSTKLKLLGVDVASFGDAMGATENCLEVVINDAVKRTYAKLVLSDDATTLLGGVLVGDASSYGVLRPMVGAELPGDPLALIAPAGSGAGAGALGVGALPDSAQICSCNNVTKGELKCAIADGCGDVPALKSCTAAGTSCGSCVPLLKQLLEAEGVEQSKALCEHFSQSRAELFEIITATEVRTFSGLLDRFGRGKGCDICKPVVASILASTGSDHILDGEQASLQDSNDHFLANIQKNGSYSVVPRVPGGDIKPEHLILIGQIAQDFGLYTKITGGQRIDLFGARVDQLPLIWQRLVDGGMESGHAYGKAVRTVKSCVGSDWCRYGQQDSVQLAIDLELRYRGLRAPHKIKLGVSGCARECAEARGKDVGVIATEKGWNLYVAGNGGMTPKHAQLLASDLDKETLIRYIDRFLIYYIRTADRLQRTAPWVESLGLDHVREVVCEDSLGLAEEFEAAMQRHVANYKCEWKGVLEDPDKLSRFVSFVNAPDAVDSTVTFTERAGRKVPVSIGIPRVRS

SEQ ID NO: 4268 - protein, 729 aa, Bradyrhizobium sp. BTAi1
MAAAMSATSARSMPLKINSSTSSSRPWQRYFSSRKPDAMRLSAGSHARLGATWDGRGTNFALFSANAEKVELCLFDSQGRREIERIELPERTEDVWHGYLNDVSPGQLYGYRVYGPYEPERGHRFNANKLLLDPYAKRLAGRLVWSDAHFAYRAGSPREDLSFDRRDNARGMPKAVVIDETFNWGRREMRPQIPWEDTIIYEAHVKGLTNRRDDVPPNLRGTFGGLSAPAMIKHLKRLGVTTIELLPIHAFIDDRMLVEKKLVNYWGYNTISFFAPEQRYAQDNPLDAFRTTVARLHDAGIEVMLDVVYNHTAEGNHLGPTLCYRGIDNASYYWLQPDNPRFYDDFTGCGSSVNLTHPRVLQMVMDSLRYWVEVCHVDGFRFDLATTLAREKHGFDRRSGFLTAVRQDPVLAGVKLVAEPWDVGLGGYQVGAFPSQWSEWNDRYRSAMRRYWSGEGSLIGEVSSRMTGSSDIFNHDGRTQRASVNHVTVHDGFTLADLFSYNSKHNEANGEDNRDGSNDNHSNNCGHEGPSSDPAINALRRQLRKNQLACLFLAQGLPLLLAGDEVGNSQSGNNNAYCQDNEVGWVDWSGIGREGDDLTDFIAHMTELRRRFGQIRARRWLDGRRADGSFGVLWLTPSAEEMTQTDWTFPDGRFLAYVLAPVEQEQAPIFIVLNAAPEEIGFKLPKLAEYKTWQQVLDTTEIQQKPADFAAGADLKAPPRSVLAYAGVS

SEQ ID NO: 4269 - protein, 549 aa, Haemophilus influenzae
MKNINPTHTHAWKSLEAHKAELSNITIQDLFKQEKNRFDDYSLTFNNQILIDFSKNNINQTTLSHLRQLAQECALDSAKEAMFTGEKINRTENRAVLHTALRNRTNTPVLVDGKDVMPEVNAVLAKMKDFCQRIISGEWKGYTGKAITDVVNIGIGGSDLGPYMVTEALRPYKNHLNMHFVSNVDGTHIAETLKKVNPETTLFLVASKTFTTQETMTNAQSARDWLLKAAKDESAVAKHFAALSTNAKDVEKFGIDTNNMFEFWDWVGGRYSLWSAIGLSIALSIGFENFEALLNGAHEMDKHFLSTPIEQNIPTTLALVGLWNTNFLGAQTEAILPYDQYLHRFAAYFQQGNMESNGKYVDRDGNVIKNYQTGPIIWGEPGTNGQHAFYQLIHQGTTLIPCDFIAPAQRHNPLADHHNKLLSNFFAQTEALAFGKTKEEVEAEFVKAGKSLDDVKNIVPFKVFTGNKPTNSILVQKITPFTLGALIAMYEHKIFVQGVIFNIFSFDQWGVELGKQLANRILPELTDSEKVASHDSSTNGLINQFKAWR

SEQ ID NO: 4270 - protein, 817 aa, Zea mays
MGRGSCGCRHPLLAVLLPLLLVLAMVPESAQLQSSQTWSLLKIQQLLSYPPVLRTWGNGTDFCYGGDYKTASAFVECYGDSVTQLHIMGPGGAPPLPKTFSLDALFTTLTRLPDLRVLTLTGLGLWGPLPGKVSRLASLEIVNVSGNYLYGQLPEGLSRLGGLQTFIADDNMLSGELPGWLGRLASLAVLSLRNNSLQGAVPESVRDMGSLRSLALACNNLSGQVPDLSALTNLQAVDLSNNSLGPAFPRLGRKVASVVLSGNRFGNGVPAEEVASLYLLERLDVSRNRFVGPLPPALLALPSIEYLSVAGNRFTGLLAANMSCGENLRFVDVSSNLLTGTLPSCLKTLPSSSNSKQVTVLAASNCLSGGAGSTQHPALFCQNQALAVGIVPVQARGGGKAKGKAGAVAGAVAAALAAALLAGVAAFLFARRAAVRRAKARPPRRLVEHAASSMSVGGGGAYPSQLFADARYILQTVNLGALGVPAYRSFSLVELEAATNDFEVSRLMGQDAHGQMYRGTLGNGTVVTIRSLWVRRSQTSHAFNRHVEMISRLRHRHLESAVGHCFHCIPDDTTEARLALLFEYVHNGNLRSRISQGTEGRKLPWVQRISAAIGVAKGIQFLHGGIMPGLFANNLKITNILLDQNLVAKIGSYNIPILAETAKSEGGGGGGGGSKYPSDSRVPPNGDKIDIYDFGVILLEVVTGRPITSIHEVEVMKEQLQSALTSESPGRRRALVDQAVSRACSDESARTVMEICLRCLAKEAEQRPSVEDVLWNLQFAAQVQDDWRGDSRSSASEESPLSPSQIPPRRDRETSAW

SEQ ID NO: 4271 - protein, 103 aa, Zea mays
MSGRGKGGKGLGKGGAKRHRKVLRDNIQGITKPAIRRLARRGGVKRISGLIYEESRGVLKIFLENVIRDAVTYTEHARRKTVTAMDVVYALKRQGRTLYGFGG

SEQ ID NO: 4272 - protein, 948 aa, Fulvimarina pelagi HTCC2506
MSLIEEKDYGTPASKAEKLVTLTIDGQSVTVPEGTSIMRAAAEAEILVPKLCASDMLDAFGSCRVCVVEIEGKNTTPASCTTPVGEGMFVKTESDRLSRIRKGVMELYVSDHPGQWDERKGGGDCEVREVAERVGLSDVRYDSSERNHFDAELDESNPYFTFDSSKCIVCSRCVRACNEVQGTFALTVEGRGFDSRISAGTPVDEFLTSECVSCGACVQACPTEALQEKTVKEKGLPTSSKITTCAYCGVGCSFKAEMQGEEVIRMIPYKDGKANRGHSCVKGRFATEYAKHEERVLEPMIRETYKDPWQVVSWDEAISFAANKIKDIQAKYGRGAVGGISSSRCTNEEVYVVQKMVRAGFGNNNIDTCARVCHSPTGYGLATTYGTSAGTQDFDSIEHTDVMVVIGANPTDAHPVFASRMKKRIREGAKVIVIDPRRIDLVKTPHVEADVHLPTRPGTNVAILTALAHVIVTEGLVDEEFVKERCEVDEFEDWKEFVSAENRSPEAMEIVTGVPADLVRRAARLYATGGNGAIYYGLGVTEHSQGSTSVIAIANLAMATGNIGRKGVGVNPLRGQNNVQGSCDMGSFPHEMPGYRHISHDETRKIYEDLWKVKIDREPGLRIPNMFDAAIEGTFRGLYCQGEDILQSDPDTKHVSAGLGALDLLIVQDLFLNETANYANVFLPGSTFLEKDGTFTNAERRINRVRKVMEPKNGYADWEVTQLLARAIGMDMNYAHPSEIMAEIAATTPSFAGVTYELLDKEGSVQWPCNEEHPVGSPVMHVGAFMRGKGKFVRTEYVATDEKVGPRFPLLLTTGRILSQYNVGAQTRRTLNTVWHPEDLLEMHPHDAEERGIREGDFVKLQSRVGETSLKVHITEKMAVGVVHTTFHHPSTQINVITTDFSDWATNCPEYKVTAVQVSPTNGPTEWQEDYRELTETSRRVRSLEAAE

SEQ ID NO: 4273 - protein, 458 aa, Streptococcus agalactiae A909
MENHRYEDEGKFQRKMTSRHLFMLSLGGVIGTGLFLSSGYTIAQAGPLGAVLSYLIGAVVVYLVMLSLGELAVAMPVTGSFHTYATKFISPGTGFTVAWLYWICWTVALGTEFLGAAMLMQRWFPDVPAWAFASFFALVIFGLNALSVRFFAEAESFFSSIKVIAIIIFIILGLGAMFGLVSFEGQHKAILFTHLTANGDFPNGIVAVVSVMLAVNYAFSGTELIGIAAGETDNPKEAVPRAIKTTIGRLVVFFVLTIVVLASLLPMKEAGVSTAPFVDVFDKMGVPFAADIMNFVILTAILSAGNSGLYASSRMLWSLANEGMLSKSVVKINKHGVPMRALLLSMAGAVLSLFSSIYAADTVYLALVSIAGFAVVVVWLAIPVAQINFRKEFLKENRLEDLSYKTPFTPVLPYITIVLLLISIVGIAWDSSQRAGLYFGVPFIILCYIYHKLRYKTW

SEQ ID NO: 4274 - protein, 429 aa, Bradyrhizobium sp. BTAi1
MGPPSPELVRVADKAAMARTAADLLLARIAENAGRIAICLTGGSSPKQLYELLATQAYRDRIPWPRVHWFIGDERFVPAGDALHNMTMARHAFLDACAPAANIHPIPTDTGSPKRSANAYARELITFYGADQLDPARPLFDVVLLGIGPDGHVASLFPGYPAVEVRDRWVVGVDQAHVAPFVPRVSLTLPALASCRTMLFEVAGADKQPILTRVLAGEDLPANRARSTHETTFLIDAAAWPETAADRSPPGLPHALIVMGVSSSGKSTVGQALGRRLGWRFEDGDSFHPPANVAKMSAGQPLTDADRWPWLQAIADEIARCRAQGEPIIIACSALKKAYRKILVGDCGDVRLVYLEGDRELIGDRMGHRKGHFMPTGLLDSQFATLEPPGVDEHPVTVSVDAPVETIVDDILQQLHIGQDRPDCEWNGS

SEQ ID NO: 4275 - protein, 1674 aa, Arabidopsis thaliana
MFAMNVKIDKFSGRNSFSLWQIKMQALLKQQGLWAPLSNDSKGKSDAAGMVVMEEKAHSTIMLCLEDEVIIEVSGETTSANLWKKMQEGTPLKDHLDQLNSVLLELRNIDVKVEDEDAALLLLVSLPLSYENFVESFIVNKVTVTLEEVRSALHSRVLRHQAAGTVTDYQASGLVASGSSGLGHAKKNRSRNDCPKRKQQGSAAVAEDDNKSEHDVALVADGNAHNSDVWVLDTGASYHMCPWREWFSTYAQVENGCIKMANSSVSQVAGIGSIQIRTHDGRFCTLNDVRHVPSMEKNLISLSLLDSRGFTVIGTSNVASAEIHKEDMTKLWHMRLGHMSERGMQILSKEDLLCGHEVKSLEFCEHCVYGKLHRSKFPKAVHITKGTLDYIHSDCWGPARVESLAGHRYFMSMIDDYSRKTWVIMLKHKSEAFKNFREWKILVENQTGKKIKRLRTDNGLEFCSSEFNQLCKDEGAARHHTVRDTPHQNGVAERMNQTLLERARCMLSNAGLEKRFWAEAVSTACYLINRGPHTGIKCRTPAEMWSGKSADYSNLKIFGCTVYYHVNEGKLEPRARKGVFVGYGDRVKGFRVWSPLENRVILSRNVVFDEVSMLGRSEKSTTTEESSSFDKQVELTPNQKADVQKPEDSKELQAADGSADTIKPELKPYSIAQNRTRRIGVGPPQRYGYEDMAGFCLEDMARYALQVAEEVDTHEPTTYREAVSWIEAEKWFAAMGDEMESHRRKIVTCKWIFKIKEWISPVERVKYKARVVARGFSQREGVDYNEIFSPVVRHTSIRMLLAIVANQDLELEQLDVKTAFLHCILEEEIYMTQLDGLQVPGKKDHVCKLNKSLYGLKQSPRQWYKRFDSYMMELGYNRSPYDCCVYISKLKDESYVYLVLYVDDMLIAAKLMCDIQRLKDLLSAEFEMKDLGATKKILGMEILRDRNQNKLFLSQKGYIQKVLNRFGMLSTKPVDTPFATNIHLTMFAPQSKEDKEYMSRVPYANAVGSLMYAMVCTRPDLAHAVSVVIRFMRQPGKEHWLAVKRILRYLKGTYDGGLIYGGEAPSLIAGDVDSRRSMTGYVFALGNSVISWKATLQPTVTLSTIEAEYMALTEAAKEGIWLKGLVSDMGLHQDQATVYCDSLSAICLAKDQVDHERTKHIDVRYHFLRNEKRIQVKKVGTVDNPADMFTKPVPHSKSIWFLMGHLRQRRILLNLVHLSNEEGSYNTVSSVSSTSMWRIQVKVPLVKGSMNCLPDELLVQILSFLPTKEATSTSLLSKRWRTLFTLSPNLDFDNSLLLQSKKRKWNMRNIQKSFVGFVDSTLALQGGKGIKSFSLKFKETLGDVNGEVDVNRWICNALEHGVSELHLRIDYTKRCHLPSEIFTSTKLVKLSLVTQSCFPVVPNCISLPSLKVLFLDSIWFEVPQFLIFLTACPALEDLTIYQKPHSVGMPYHISSKTIKRLSVTYTCGYFVDYGLKLFNTPSVVDLYYSDYVRHKYPHMNLDSLPKATLDIHFLDDNAANVTELLSGIRNVKTLHLTSSTVKVILLCCKGEIPMFENLINLKFSGKTRQWKFLLPLLLEICPNLTTLVLSGLDQNWFVGFRTPPNNQVKMLSIMQYQGSERELKLISYFVLKMECLQVVKVYVSSPMNDLKKMQLTEDLLKLPKASPKLNIQVL

SEQ ID NO: 4276 - protein, 527 aa, Candidatus Desulfococcus oleovorans Hxd3
MTNTIGDLETADVILATGTNTTENHPVISTFIKRAVEKRGAKLVVIDPRKIRLTNFARKWVRQNLGTDVAWINGLMHVIIKEDLYDKAFVSKRTAGFEDLKAMVEKFTPAFVESITGIAADDIVEIARLYAKARAASIVYCMGITQHTTGTDNVKSLANLSMLCGHLGIEGGGVNPLRGQNNVQGACDMGGLPNVFTGYQPVTSEEARKKLEAAWGVTGIPDKPGYTVTEMIPKAIEGTVKALYIVGENPMVSDPDLHHVKHGLEALDFMVVQDIFMTETAQLADVVLPSACFAEKEGTFSNTERRVQRVRKAVEPPGQARDDWRITAAISTAMGFPMGYDSAEQIMAEIAKLTPSYGGITYERIDRVGLHWPCPTPDHPGTPVLHTVQFPIGKGKFHAIDYIPPAEQTDDAYPLYLTTGRIIYHYHTGTMTRKSEGLNERAPENFVEISAEDAGRYGIEDGSMVTIASRRGKIKAKAAVSEKGVAGTVFIPFHFAESAVNELTHAALDPVSKIPEYKVCAVVLEKA

SEQ ID NO: 4277 - protein, 376 aa, Cladophora rupestris
LDTYRSIFKYKYRTMQTSMVGNMRVAQPTGRRTATVANAKKLKVAINGFGRIGRNFLRCQFLRENSNLEVVVVNDSGGVKQAAHLLKYDSILGTFERTVEKIDDSTMAVDGKNIRIVSNRDPTKLPWADMGVDLVIEGTGVFVSEEGAGKHLQAGAKKVIITAPGKGDIPTFVMGVNSDDYKHEYPIISNASCTTNCLAPFVKVIVEKFGVVKGTMTTTHSYTGDQRLLDASHRDLRRARAAALNIVPTTTGAAKAVALVLPQLKGKLNGIALRVPTPNVSVVDLVVQVEKKTLAEEVNQAFRDAAAGPLKGVLGVADIPLVSMDFKKSDVSTTIDSALTMVMGDDMVKVVAWYDNEWGYSQRVLDLAELCAEKWE

SEQ ID NO: 4278 - protein, 457 aa, Fulvimarina pelagi HTCC2506
MAPLPNSIEARDIAHHFHPFTNARRHEEIGPIVMAKGDGVFVEDIDGKRYIEAMSGLWSVAVGFSEKRLVDAAVKQMAELPYYHSFTHKSHAPVVDLAEKLINIAPVPMAKVHFTNSGSEANDLIVKLLRYRANGMGEPRRKKIISRLRGYHGITLAAASLTGLPNNHASFDLPIEGILHTICPHYWREGREGESEEAFATRCAAELEAMIEAEGPETIAAFIAEPVMGAGGVVIPPVTYWEKIQAVLSRYPEIVFVADEVICGFGRTGEMFGSVTYDLKPDIITVSKGLSSSYLPISAVIMNDRVYQPIADETARIGTFGHGFTTTGHPVAAAVALENLKIIEERDLVGNARARGPRLQDGLRRLADHPLVGEVRGVGLIAGVELVTDKEKKVAVQPPGALAAKAFGLIQERGVISRAIGDTLAFCPPLIIEDEHIDTILATTREGLDALAAEMGM

SEQ ID NO: 4279 - protein, 401 aa, Fulvimarina pelagi HTCC2506
MAFLADALDRVKPSATIAVTQKARELKAKGMDVIGLGAGEPDFDTPDTIKEAAIAAIARGETKYTPVSGIPQLREAIAAKFKRENGLDYKPEQTIVGTGGKQILFNAFMATLNKGDEVIIPAPYWVSYPEMVAICGGTPVFVEAGIETNFKLTPEKLEAVITPRTKWFLFNSPSNPSGAAYTKDEIKALTDVLMRHGHVWVLTDDIYEHLVYGDFTFHTPAEVEPGLYDRTLTMNGVSKAYSMTGWRIGYGAGPIQLIKAMDMIQGQQTSGAASISQWAAVEALNGTQDFIPKNREIFQGRRDLVVSMLNQATGLKCPVPEGAFYVYPSCAGLMGKTTPDGKVLKTDEDFVTSLLETEGVAVVQGSAFGLGPNFRISYATSEALLEEACSRIQRFCGSLKD

SEQ ID NO: 4280 - protein, 166 aa, Encelia californica
MFPMVTEFMNYGQQTVRAARYIGQGFMITLSHANRLPVTIQYPYEKLITSERFRGRIHFEFDKCIACEVCVRVCPIDLPVVDWKLETDIRKKRLLNYSIDFGICIFCGNCVEYCPTNCLSMTEEYELSTYDRHELNYNQIALGRLPMSIIDDYTIRTILNLPERKT

SEQ ID NO: 4281 - protein, 166 aa, Eatonella nivea
MFPMVTEFMNYGQQTVRAARYIGQGFMITLSHANRLPVTIQYPYEKLITSERFRGRIHFEFDKCIACEVCVRVCPIDLPVVDWKLETNIRKKRLLNYSIDFGICIFCGNCVEYCPTNCLSMTEEYELSTYDRHELNYNQIALGRLPMSIIDDYTIRTVLNLPEIKT

SEQ ID NO: 4282 - protein, 166 aa, Dimeresia howellii
MFPMVTEFINYGQQTVRATRYIGQGFMITLSHVNRLPVTIQYPYEKLITSERFRGRIHFEFDKCIACEVCVRVCPIDLPVVDWKLETDIRKKRLLNYSIDFGICIFCGNCVEYCPTNCLSMTEEYELSTYDRHELNYNQIALGRLPMSIIDDYTIRTILNLPEIKT

SEQ ID NO: 4283 - protein, 505 aa, Populus tremuloides
MDLLLLEKTLLGSFVAVLVAILVSKLRGKRFKLPPGPLPVPVFGNWLQVGDDLNHRNLTDLAKKFGDILLLRMGQRNLVVVSSPDLAKEVLHTQGVEFGSRTRNVVFDIFTGKGQDMVFTVYGEHWRKMRRIMTVPFFTNKVVQQYRYGWEEEAAQVVEDVKKNPEAATHGIVLRRRLQLMMYNNMYRIMFDRRFESEEDPLFNKLKALNGERSRLAQSFDYNYGDFIPILRPFLRGYLKICKEVKERRLQLFKDYFVEERKKLGSTKSMSNEGLKCAIDHILDAQKKGEINEDNVLYIVENINVAAIETTLWSIEWGIAELVNHPEIQKKLRDELDTVLGPGHQITEPDTYKLPYLNAVIKETLRLRMAIPLLVPHMNLHDAKLGGFDIPAESKILVNAWWLANNPAKWKNPEEFRPERFFEEEAKVEANGNDFRYLPFGVGRRSCPGIILALPILGITLGRLVQNFELLPPPGQSKIDTSEKGGQFSLHILKHSTIVAKPRSF

SEQ ID NO: 4284 - protein, 442 aa, Burkholderia mallei ATCC 23344
MTEHVSQTPDLSAFWMPFTANRQFKEAPRLLVAAKGMYYTSHDGRRILDGTAGLWCVNAGHGRDEIVAAVQAQAEEMDFAPTFQMGHPKAFEAATKIARHTPGDLKHIFFTNSGSEAVDTALKIALAYHRARGEGQRTRFIGRERGYHGVGFGGISVGGIAPNRNAYSGALLPSVDHLPHTLNLKEAAFSKGQPAWGAQLADELERLVALHDASTIAAVIVEPVAGSTGVLIPPRGYLERLRELCDKHGILLIFDEVITGWGRLGAPFAAQFFGVTPDLLTMAKGTNNAAVPMGAVAASGAIHDAIVGGAPAGIELFHGYTYSGHPLAAAAAVATIDLYEREGLLTRAARIAPIFEREIHKLKDARHVIDVRNLGLVGGVELTPRDGKPGARAYEVFVKCFEKGAMIRYTGDILAFSPPLIVEEAQIVELFSIVAQALKETE

SEQ ID NO: 4285 - protein, 261 aa, Israeli tick typhus rickettsia
AAVGSLSAFYPDLLNFKEADYELTAIRMIAKIPTIAAMSYKYSIGQPFIYPDNSLDFTENFLHMMFATPCTKYTVNPIIKNALNKIFILHADHEQNASTSTVRIAGSSGANPFACISTGIASLWGPAHGGANEAVINMLKEIGSSEYIPKYIAKAKDKNDPFRLMGFGHRVYKNYDPRAAVLKETCKEVLKALGQLDNNPLLQIAIELEAIALKDEYFIERKLYPNVDFYSGIIYKAMGIPSQMFTVLFVIARIVGWMAQW

SEQ ID NO: 4286 - protein, 143 aa, Glycine max
MEPVRLKTDYRCVPALQQFYTGGPFVVSSDSSFIACACGESIKIVDSATAAIRSTLDADSESFTALALSPDDRLLFSSGHSRQIRVWDLSTLKCVRSWKGHEGPVMCMTCHPSGGLLATGGADRKVLVWDVDGGYCTHYFKGH

SEQ ID NO: 4287 - protein, 393 aa, Nitrosomonas europaea ATCC 19718
MSHVMNTYARLPVTFVKGEGVWLWDDQGNRYLDALSGIAVCGVGHCHPVLVKALCEQVSTLIHTSNVYHIQHQERLADRLTSLSGLEKAFFCNSGAEANEAAIKLARLYGHNQGINLPTIIVMERSFHGRTMATLTATGNRKTQAGFEPLLTGFVRVPYDDLEAVNKVAANNREIVAILLETYQGEGGVNFPQANYLQGLRRICDQNGWLLMLDEVQCGLGRTGKWFAFQHSEVMPDAMTLAKGLGSGVPIGACLAGGKAAEVFKPGNHASTFGGNPLACRAALTTLDIIEQEGLMDNAVTIGNFMWEEFGRRLQAWQDVLKIRGQGMMIGIELPVPCSELVPEALKRRVLVNVTSEKVVRLLPALNMQKAEAEQVVTEVSALITWFLESRVK

SEQ ID NO: 4288 - protein, 187 aa, Yersinia pestis CO92
MTVSASKTAQQLKYIKDSIKTIPDYPKAGILFRDVTSLLENPKAYSASIKLLSEHYSESGVTKVVGTEARGFLFGAPVALALGVGFVPVRKPGKLPRETISESYELEYGTDTLEIHTDSIQPGDKVLVVDDLLATGGTIEATVKLIRRLGGEVVHAAFIINLPELGGEARLTQQGIHCYSLVSFDGH

SEQ ID NO: 4289 - protein, 462 aa, Oceanobacillus iheyensis HTE831
MVKMQEWIEVTNPATGEVIDRVERGGKVEAREAVDKASEAFNDWSKRTAYERSELLMNWNALITKHQDELAEIMTMEQGKPIKEALGEVQYANNFVSWYAEEGKRLYGETIPASKADKRILVQRQPVGVIAAITPWNFPAAMITRKVAPALAVGCTAVVKPASATPRTAIRLAELAEEAGIPKGVLQVVTGSSGDISDAWMQDSRVRKISFTGSTEVGKILMKKSAETVKKVSLELGGHAPLIVMKDADIEKAAEGATASKFRNAGQTCVCTNRIYVHESIKDEFIKAFERKVRELRVGNGLEEGIDIGPLIDHDALEKVETHIRDAAHKGASIVYGGDKVGDDSLFYKPTILSNVTDNMLCMTEETFGPVAPVTTFSTEEEAVKRANHSPYGLAAYLFTENLATAIRISEQLEYGIVGINDGVPSTAQAPFGGFKESGIGREGGHHGMEEYVEVKYISIQL

SEQ ID NO: 4290 - protein, 395 aa, Pisum sativum
VEAAHLKTDIMSVFDDLTQDDQDSFRFLAVEGCAALGKLLEPQDCLAHILPVIVNFSQDKSWRVRYMVANQLYELCEAVGPDSTKTELVPAYVRLLRDNVAEVRIAAAGKVSKFSRILSPELAIQHILPCVKELSTDSSQHVRSALASVIMGMAPVLGKDATIEQLLPIFLSLLKDEFPDVRLNIISKLDQVNQVIGIDLLSQSLLPAIVELAEDRHWRVRLAIIEYIPLLASQLGVGFFDDKLGALIMQWLKDKEYSIRNAAANNVKRLAAEEFGPEWAMQHIIPQVLDMINDPHYLYRMTILHAISLLAPVLGSEITSTNLLPLVVNASKDRVPNIKFNVAKVLQSLIPIVDESVVESTIRPCLVELSEDPDVDVRFFASQALQSSDQVKMSS

SEQ ID NO: 4291 - protein, 319 aa, Rickettsia akari str. Hartford
MNHTNNYQIIAKRVISSAASALEKLSKNIPEDFSRIIEFLLSFKGRIILTGIGKSGYIARKIAASFSSTGMPAFYLHPAEASHGDLGMVTRHDLVIMLSNSGETKELFNVVEYCKNFSIKIAAMTMDKNSTLAKRSDFLLIVPEHPEASLIGAPTISSLIMLSLGDALITVIHEQRGFTKDDFKIYHPGGIIGANLTKIKNLMRSGDEIPLVYEDTSFADTIIIMNKKRLGCTLVTDKNQNLIGIITDGDLRRHINDQIHLKTASSVMTKNPIYISSEIFAKEALNLMQAKNITNIPIVDDNIIIGIIHIHDLLRMGVS

SEQ ID NO: 4292 - protein, 318 aa, Chara vulgaris
KVGINGFGRIGRNFLRCWHTRKDSPLEIVAINDTGGVKQASHLLKYDSMLGVFSGNVKIEAEDVISVDGKSIQIVSNRNPLNLPWGEMGIDLVIEGTGVFVDREGAGKHLQAGAKKVLITAPGKGDIPTYVVGVNDADYDPSETIISNASCTTNCLAPFVKVLDNKFTIVKGTMTTTHSYTGDQRLLDASHRDLRRARAAALNIVPTSTGAAKAVALVLPQLKGKLNGIALRVPTPNVSVVDLVVQTAKKTFAEEVNNAFRESADGPLKGILAVCDEPLVSVDFRCTDVSSTVDSSLTMVMGDDMVKVVAWYDNELGY

SEQ ID NO: 4293 - protein, 602 aa, Zea mays
TFGFTVTITPSCSAPSLYTPTAHPSTPNHHYQPAAAPLFRSPSPSPSTYALASRDDILRGACAGTARRWPRPGRRRPRPRRAPWRSSRGCTGSCRRARPWRRWRRRRRCWRRRPRRRRRASPEIDREEARARGGAPPELLDVLWEARRSSVRLRALQQRKEAAHVLELERRFRLFDDLIQRASRLLSPGGGAGARIGTGGAAVDHDEVVEVEATRDTELDAAPAEIGRGSKGGLGLEPKSVSSLRRAASAGTDTEKLGLIQVASLIESSAKKGTTELNLRGKLVDQVEWLPVSLGKLQDVTELDLSENRIMALPSTIGSLRYLTKLDLHSNQLINLPDTFGELSSLIDLDLRANQLKSLPTSFGNLTSLANLDLSSNLLKVLPDCLGKLKNLRRLIAETNELEELPYTIGSCTSLVELRLDFNQLKALPEAIGKLENLEILTLHYNRIKGLPTTIGHLTRLRELDVSFNEVETIPENICFAASLVKLNVSRNFADLRALPKSIGELEMLEELDISSNQIRVLPDSFGHLSKLRVFHADETPLEVPPKEVVKLGAQELVNYMKNMVAAREVSQNQTDKRSFWTWLRSLFGCYKKNQGLGPVPA

SEQ ID NO: 4294 - protein, 289 aa, Candidatus Desulfococcus oleovorans Hxd3
MSSILIALGLTLFAGMATGIGSAIAFFAKKQNYRFLSVATGFSAGVMLYVAFVEILAKGATALARAYGEIPGAWINAAAFFGGILLIGVIDNLIPSAENPHEVPSETQMADFRDACTLSDTGAADCDDAGRKAKLLRMGLFTALAIGIHNFPEGLATFLAALSDPALGVAIALAIALHNIPEGISVSVPIFYATGNKTKAFAWSLVSGMAEPVGALLGYLGLLFFFGNPAGGMPPQIMGILFAGVAGIMVYISVDELLPTSRAYGRGHDSILGMVAGMAVMAASLLMMK

SEQ ID NO: 4295 - protein, 184 aa, Arabidopsis thaliana
  misc_feature (38)..(38): Xaa can be any naturally occurring amino acid
  misc_feature (82)..(82): Xaa can be any naturally occurring amino acid
  misc_feature (95)..(95): Xaa can be any naturally occurring amino acid
  misc_feature (154)..(154): Xaa can be any naturally occurring amino acid
MASSMLSSTAVATSPVQDTMVRLHCTGLKSSASFPVTXRKANNYFTSITRNGGKDICMKVCTPVGKNKCETLSYLPDLTDVXELAKEVDYLLRNXRIPCVEFELEHGFVYREHCNTPVYYDGRYWTMCKLPLVGCTDSAQVLKEAEECKKEYPXVFIMIIGFDNARIVQCIRFIVQKPPRFPKA

SEQ ID NO: 4296 - protein, 447 aa, Enterococcus faecalis
MKVIVLGSSHGGYEAVEELLNLHPDAEIQWYEKGDFISFLSCGMQLYLEGKVKDVNSVRYMTGEKMESRGVNVFSNTEITAIQPKEHQVTVKDLVSGEERVENYDKLIISPGAVPFELDIPGKDLDNIYLMRGRQWAIKLKQKTVDPEVNNVVVIGSGYIGIEAAEAFAKAGKKVTVIDILDRPLGVYLDKEFTDVLTEEMEANNITIATGETVERYEGDGRVQKVVTDKNAYDADLVVVAVGVRPNTAWLKGTLELHPNGLIKTDEYMRTSEPDVFAVGDATLIKYNPADTEVNIALATNARKQGRFAVKNLEEPVKPFPGVQGSSGLAVFDYKFASTGINEVMAQKLGKETKAVTVVEDYLMDFNPDKQKAWFKLVYDPETTQILGAQLMSKADLTANINAISLAIQAKMTIEDLAYADFFFQPAFDKPWNIINTAALEAVKQER

SEQ ID NO: 4297 - protein, 506 aa, Saccharomyces cerevisiae
MPTLYTDIEIPQLKISLKQPLGLFINNEFCPSSDGKTIETVNPATGEPITSFQAANEKDVDKAVKAARAAFDNVWSKTSSEQRGIYLSNLLKLIEEEQDTLAALETLDAGKPFHSNAKQDLAQIIELTRYYAGAVDKFNMGETIPLTFNKFAYTLKVPFGVVAQIVPWNYPLAMACRKMQGALAAGNTVIIKPAENTSLSLLYFATLIKKAGFPPGVVNVIPGYGSVVGKALGTHMDIDKISFTGSTKVGGSVLEASGQSNLKDITLECGGKSPALVFEDADLDKAIEWVANGIFFNSGQICTANSRVYVQSSIYDKFVEKFKETAKKEWDVAGKFDPFDEKCIVGPVISSTQYDRIKSYIERGKKEEKLDMFQTSEFPIGGAKGYFIPPTIFTDVPETSKLLRDEIFGPVVVVSKFTNYDDALKLANDTCYGLASAVFTKDVKKAHMFARDIKAGTVWINQTNQEEAKVPFGGFKMSGIGRESGDTGVDNYLQIKSVHVDLSLDK

SEQ ID NO: 4298 - protein, 506 aa, Saccharomyces cerevisiae
MPTLYTDIEIPQLKISLKQPLGLFINNEFCPSSDGKTIETVNPATGEPITSFQAANEKDVDKAVKAARAAFDNVWSKTSSEQRGIYLSNLLKLIEEEQDTLAALETLDAGKPYHSNAKGDLAQILQLTRYFAGSADKFDKGATIPLTFNKFAYTLKVPFGVVAQIVPWNYPLAMACWKLQGALAAGNTVIIKPAENTSLSLLYFATLIKKAGFPPGVVNIVPGYGSLVGQALASHMDIDKISFTGSTKVGGFVLEASGQSNLKDVTLECGGKSPALVFEDADLDKAIDWIAAGIFYNSGQNCTANSRVYVQSSIYDKFVEKFKETAKKEWDVAGKFDPFDEKCIVGPVISSTQYDRIKSYIERGKREEKLDMFQTSEFPIGGAKGYFIPPTIFTDVPQTSKLLQDEIFGPVVVVSKFTNYDDALKLANDTCYGLASAVFTKDVKKAHMFARDIKAGTVWINSSNDEDVTVPFGGFKMSGIGRELGQSGVDTYLQTKAVHINLSLDN

SEQ ID NO: 4299 - protein, 296 aa, Magnetospirillum magnetotacticum MS-1
MTDTHARLRGSMTALATPFRDGEFDEAAFRKFVNWQIEQGTHALVPTGTTGESPTLSHAEHDRVVESCIAEAAGRVPVIAGAGSNSTAEAVARARHAEAAGADAVLIVTPYYNKPTQDGMYAHFKAVNDAVGIPIIIYNIPGRSVVDMSVDTMKRLFELKNIAGVKDATAKIDRVSLQRQALGEGFIQLSGEDATALGFNAHGGHGCISVVSNVAPRLCADLQEASLSGDYAKALSIQDRLMPLHVQMFYESNPVPAKYALSRLGLMSEEVRLPLVPATEGCRKAVDAALAHAGLI

SEQ ID NO: 4300 - protein, 431 aa, Clostridium perfringens ATCC 13124
MKQYIEIIDVVARQILDSRCFPTVEVEVYLEDGTVGRAAVPSGASTGIYEAVELRDGDKDKYLGKGVEKAVANVNDTIAEEIIGLNVLDQAYIDKTLIELDGTKNKGKLGANAILGVSLAVAQAAANYLGMPLYQYIGGVNAKVLPVPMMNIINGGSHADNSVDIQEFMIMPVGFDCFERAVRACAEVYHALKKTLNSKGYSTGVGDEGGFAPNLKSNAEAIEVILEAIEKAGYEPGKEFFIAIDAASSEYYKDGKYVLEHEGKTLTAAEMVDFFEDWVNKYPIISIEDGMAEEDWEGWKLMTERLGKKVQLVGDDLFVTNTERLKTGIEKGIANSILIKLNQIGTLTETLNAIEMANRAGYTAVVSHRSGETEDTTIADLVVAVNAGQIKTGAPARSERVAKYNQLIRINEELGEVAEYRGRNAFFNLSK

SEQ ID NO: 4301 - protein, 878 aa, Rickettsia akari str. Hartford
MKKLIYYFGSNGSDGNASMKNVLGNKGAGLAEMSNLKLPIPDGFTITTDLCNYFYTHNNNFPKNFQNDLKKAITKLEITTGKIFGSTSNPLLLSVRSGSTISMPGMMDTILNLGMNNEVCNALADSCGDKRFALDSYKRFLEMYGSTVLSIPSDLFEQIYEKHKIQADIHKDSDITVELLEKIIEDFKRLHIKYTKQLINDPYEQLESAIKAVLHSWMSNRAVIYRKINNISECFGTAINIQAMVFGNLGKTSATGVAFTRSPATGEKKLFGEFLINAQGEDIVSGTRTPMPIIANGSNSMQAMMPEVFKELSQIARKLEEHYLDVQDIEFTIENNKLYILQTRTAKRTAIAAINIAVQMVEEKLISKEQALMRIDPESLNQLLHTSIDYSKGFTSIADGLPASPGAATGIAVFSPYDAEKLSHHHKVILVRHDTSPEDINGMHVSSGIVTIRGGMTSHAAVVARGMGKPCVCGTSNLSIDEKKQILTAGDIVIKQGDIITIDGGSGKIFLGEMPLIQPTFSEESKLILDWADEISSLKVRANAETVNDALVSIKLGAQGIGLCRSEHMFFDKNKIPLVREMIIAPDIERRKLAVQKLLPLQTEDFKALFRVMKDKPVNIRLLDPPLHEFLPTTEEDKKDLANSLNLPLSMINQRLHAMHEVNPMLGHRGCRLGICSPEIYKMQIEAVFTAMFELHKKEHIECNLELMIPLISNVGEIKKLKMDIYEVIEELEQRYRYKFSFTLGTMIELPRAALDSKKIAKEVDYFSFGTNDLTQTTYGISRDDIASFLPYYLEEKIFESDPFTTLDEEGVGELIEIAIKRGKSSNANLKLGACGEHAGNPASIAFFHRMNLKYVSCSPYRIPIARIAAAQAKIKHG

SEQ ID NO: 4302 - protein, 362 aa, Bacillus anthracis str. Ames
METTVRKQKKNLETKKPSIYSLQLHEMQDWLKEQGEPKFRAGQIFDWLYKKRVKNYEDMSNLSKGLREKLSNSFDITTLNTLVKQTSSDGTIKFLFQLYDGYSIETVLMRHEYGNSICVTTQVGCRIGCTFCASTLGGLKRNLEAGEIVAQVVEVQRALDESEERVSSLVVMGIGEPFDNYDNLMGFLRIINHEKGLHIGARHMTVSTSGIIPKIYKFAEEDLQINFAISLHAPNSELRSKLMPINRAYKLPDLMEAIKYYVNRTGRRITFEYGLFGGENDQVEHAEELAALLKGVKCHVNLIPVNYVPERDYVRTPREQIFLFEKTLKDRGVNVTIRREQGHDIDAACGQLRAKERKEETR

SEQ ID NO: 4303 - protein, 347 aa, Chlorokybus atmophyticus
KVGINGFGRIGRNFLRCWWGREDSPLELVAINDTGGVKQASHLLKYDSMLGTFAPDVKAVGDNKISVDGQEFMIVSSRNPLDLPWKELDIDLVIEGTGVFVDSAGAGKHIEAGAKKVLITAPAKGSDIPTYVVGVNDQDYDPSAPIISNASCTTNCLAPFVKILSDKFGIVKGTMTTTHSYTGDQRLLDASHRDLRRARAAALNIVPTSTGAAKAVALVLPQLKGKLNGIALRVPTPNVSIVDLVIQTEKKTFAEEVNAAFREAANGPLKGILAVCDEPLVSVDFRCTDVSSTIDSSLTMVMGDDMVKVVAWYDNEWGYSQRVVDLADIVANNWNSTVEQAKELSAV

SEQ ID NO: 4304 - protein, 190 aa, Zea mays
MDRRRLSRTGSGTSSPHGPFDSGLFFVVSDSVRGIRTLEQGIIPTSSRAAAGDRVSHHLSTRRGRRAPRAGKWEPFVQHRYLCSPNATTAASWFKCGERSRRPVEEIKRRRSGMGCDDKCGCAVPCPGGKDCRCTSGSGGQREHTTCGCGEHCECSPCTCGRATMPSGRENRRANCSCGASCNCASCASA

SEQ ID NO: 4305 - protein, 1015 aa, Yersinia pseudotuberculosis IP 32953
  misc_feature (196)..(196): Xaa can be any naturally occurring amino acid
MQVSRRQFFKICAGGMAGTTVAALGFAPSVALAETRNYKLLRARETRNTCTYCSVGCGLLMYSLGDGAKNAKESIFHIEGDPDHPVNRGALCPKGAGLVDFIHSESRLKYPEYRAPGSDKWQRITWDDAFTRIAKLMKEDRDANFIQTNDAGVTVNRWLSTGMLCASASSNETGYLTQKFSRALGMLAVDNQARVXHGPTVASLAPTFGRGAMTNHWVDIKNADLIIVMGGNAAEAHPVGFRWAMEAKIHNNAKLLVIDPRFTRTASVADFYTPIRSGTDIAFLSGVLLYLISNNKINREYVEAYTNASLLVREDYAFDDGLFSGYDAENRQYDKTSWNYQLDEDGFAKRDVTLQHPRCVWNLLKEHVSRYTPEVVSNICGTPKDDFLQVCEYLAETSVSNKTATFLYALGWTQHSVGAQNIRTMAMIQLLLGNMGMAGGGINALRGHSNIQGLTDLGLLSQSLPGYLNLPSEKQPDIDTYLKANTPKTLLPGQVNYWSNYPKFFVSLMKSFYGDNAQKENGWGYDWLPKWDKGYDVLQYFEMMSQGKVNGYLCQGFNPIASFPDKNKVTAALSKLKFLVTIDPLNTETANFWQNHGEFNDVDPSKIQTEVFRLPSSCFAEENGSIVNSSRWLQWHWKGADSPGEALNDGAILAGIFMRMREMYQREGGAVPEQVLNMTWDYLTPENPEPEEVAMESNGRALADLTDADGKVLVKKGEQLSTFAQLRDDGTTSSGCWIFAGSWTPAGNQMARRDNADPSGLGNTLGWAWAWPLNRRILYNRASADPQGKPWDPKRQLLEWDGAKWAGIDVADYSAAAPGSDVGPFIMQPEGMGRLFAIDKMAEGPFPEHYEPFETPLGTNPLHPNVISNPAARVFKDDLAAMGSHEQFPYVGTTYRLTEHFHYWTKHALLNAIAQPEQFVEIGEKLAAKKGIKQGDTVKVSSNRGFIKAKAVVTKRIRTLNVHGQEVDTIGIPIHWGYEGVAKKGFLANTLTPYVGDANTQTPEFKAFLVNVEKV

SEQ ID NO: 4306 - protein, 260 aa, Sulfolobus tokodaii str. 7
MLEINYDTKLLGVVGENISYTLSPAIHNYSFQELGINAVYLAFDIKSDEFKEIFPGLVKIAYGLNITIPYKEIAIKYVEAQSEAKRIGAINTIFNGKGYNTDYIAIKSLVQERIDKFETCTIFGAGGAARAAIFALHDLDCSINVINRSKEKAEKLIEEMRNKNIEIKITYNCKSDIIVNSTPNPDFVPDECVNGKLVIDFVYKPVITSLIKRAQNKNIKTINGIEILVRQAMEAEKIWFGKSLEDEEVVNYLYARKLIW

SEQ ID NO: 4307 - protein, 473 aa, Arabidopsis thaliana
MDSVSKDMINVLPDALLCHILSFLTTKEAASTSLLSRRWRYLLAFVPNLEFDDSVYLHRDKRVKNTLHEKGFVGFVLLVNNKRKKLSTSFPDFVDRILALQGNSPLDKFSLKMVDGHDPVDPDSVVPWIHKVLVRGVSDLHLVVDMNEWTSDPLPSRIFLSETLVKLTIKIRDGPFIDVKHVHLPKLKTLYLQSVMFDENDIGFRKLLSGCPVLEELVLDGMGSCVWTSFTVSVATLKRLTFCCQKMSSFGYMHDDENPNNVSFDTPNLVYLEYAQVIANNYPKVNFDLLVEAKIDIWMTVDQIREVRLRKNEVNCMVGNATDFIVGLRNVRVLYLSPETLEVLTYCCKQIPIFENLSHLTIKSDPNVGWKPLTKLLKNSPKLETLVFQGLLHRDNKEDVAISSSSVKVLKIFLSGDKLKKQIEKVKHFLKTMPRLEQLVFYYDVKVLSQLHMLSRLASPKCKIHLIPSRESV

SEQ ID NO: 4308 - protein, 797 aa, Oryza sativa (indica cultivar-group)
MDVNEEAMAAHKRAFLDFLDQDVGKGVYMQAVRDMVQNKRHRLIIGMDDLRNHSLDLARRVIRSPAEYMQPASDAVTEVARNLDPKFLKEGQRVLVGFSGPFGFHRVTPRDLMSSFIGTMKFKLSYNVLQLILLVEKVYITVQSVSSDGSLVRPKVVKSVHYCPATGGTLSREYRDITSFVGLPTGSVYPTRDENGNLLVTEYGMCEYKDHQTLSMQEVPENSAPGQLPRTVDIIVEDDLVDSCKPGDRVSIVGVYKALPGKSKGSVSGVFRTVLIANNVSLMNKEANAPVYTREDLKRMKEISRRNDTFDLLGNSLAPSIYGHLWIKKAVVLLMLGGVEKNLKNGTHLRGDINMMMVGDPSVAKSQLLRAVMNIAPLAISTTGRGSSGVGLTAAVTSDQETGLSDFLWLGERRLEAGAMVLADRGVVCIDEFDKMNDQDRVAIHEVMEQQTVTIAKAGIHASLNARCSVIAAANPIYGTYDRSLTPTKNIGLPDSLLSRFDLLFIVLDQMDPEIDRQISEHVARMHRYCTDDGGARSLDKTGYAEEDDGDVNAAIFVKYDRMLHGQDRRRGKKSKQDRLTVKFLKKYIHYAKNLIQPRLTDEASDHIATSYAELRDGGANAKSGGGTLPITARTLETIIRLSTAHAKMKLRHEVLKTDVEAALQVLNFAIYHKELTEMEEREQREMEMKQQADHDAGASGGNADEHRSSGNDPMDVDVGNASNDQDVPAERIEAFEAILGQHVLANHLDQISIDEIEQTVNREAAAPYNRRQVEFILERMQDANRIMIRDGIVRII

SEQ ID NO: 4309 - protein, 464 aa, Delftia sp. AN3
MRWHTTAPQRAAQRLLRRPRLRPTTRPARPAEARPATRLHPPGHRPRRIRPSLARPRLPGAGASFRISPVMKFSTRADRIEPFYVMEIAKAAQEMARGCADSDTPMIFLNIGQPDFTAPPLVQEAAARAVQDGATQYTPALGLPQLRERISHWYAQRFGVDVPARRIVVTAGASAALQLACLATIDAGDEILMPDPSYPCNRHFVSAAEGRAVMVPTTAAERYQLSADKVEAAWNAHTRGVLLASPSNPTGTSIAPAELRRILDVVRARGGLTIIDEIYLGLSYDAAFGQTALALGEDVISINSFSKYFNMTGWRLGWMVVPEAMVPVVERVAQNLFICASTVSQRAALACFEPESIAEYERRRAEFKARRDFFIPALEALGLPVPVQPDGAFYAWADCRAAAARLGVQGSWDFAYAVMERAHLAITPGRDFGTFETADFVRFSTANSMEQLQEAVRRLQRLLA

SEQ ID NO: 4310 - protein, 216 aa, Triticum aestivum
MAMVVAAGARMPVSVLVLVALVVVCLSANGAAAQQASSVAATYNLYNPEKINWDLRVASIFCATWDADMPLAWRQRYGWTAFCGPAGAHGQPSCGRCLQVTNRATGARTVARVVDQCDRSAGSTLTSPCSGRSTPTEAASPMATSSSTTSSSAARTDHARDHRMLLHIPTIVAANKYAWEISSIGKNKTQPKSISASMFYRGMQRMLSSDSEYLVM

SEQ ID NO: 4311 - protein, 368 aa, Oceanobacillus iheyensis HTE831
MKTDEKFVPGLDGVIASETAISFLDVEKEKIIINGHDLIELSLKQDYLDILYLLLEGDLPKKVEITKTEKLLKDHYEVPQAVLDILKLLPKETHPMDGMRTALSVLAGYDKNIEDRSASANKDRAYQLLGQLPTITVNSYRILNNQEVVQPATELSYSANFLYMITGKEPSDLQVEIFDRLLLLYSEHEMPNSTFTARVISSTNSDMYGALTGAISSLKGNLHGGANEAVMYMLNEVETADEFEQLLYKKLENKEKIMGFGHRVYMKKMDPRALITKEALKKLCEKDNDYTLLEMCEAGEEVMKKEKGLYPNLDYYAAPVYWKLGIPISLYTPIFFSARTAGLAAHIVEQHSNNRIFRPRVKYIGKDY

SEQ ID NO: 4312 - protein, 562 aa, Shewanella sp. MR-4
MDDNKRPLYLPFAGPAILEAPLINKGSAFSEEERIFFNLEGLVPYAIETIEEQASRAYDQFRSFNNDLDKHIYLRNIQDTNETLFYRLVQNHISEMMPIIYTPTVGLACERFSKNYRRNRGLFISYPNKDRIDDILNNSTRQKVKIIVVTDGERILGLGDQGIGGMGIPIGKLSLYTSCGGISPAYTLPITLDVGTDNPQLLEDPMYMGWRHPRIGGEEYAEFIEAFMQAVHVRWPDTLIQFEDFAQKNAMPILERYKERYCCFNDDIQGTAAVTVGSLLAACKAAGTELNKQRVAFLGAGSAGCGIAEAIVAQMVSEGISDEQARSQVCMVDRWGLLLDNMPNLLPFQQKLAQKCADISHWNNFSDNISLLDVVNNVKPTVLIGVSGAPGLFTEEIVRAMHSHCERPIIFPLSNPTSRVEATPKDILHWTSGQALVATGSPFEPVVVDGETYEIAQCNNSFIFPGIGLGVLASGARHVSDAMLMASSRALAECSPLAINGSGPLLPKLEDIHSVSKHIAFAVGKVAIEQGLSLPASDELLMQSIEDNFWKPEYRRYKRTSF

SEQ ID NO: 4313 - protein, 398 aa, Nitrosomonas europaea ATCC 19718
MDDIASILMNGLIDLPWWGYIVVALVFTHITIASITIFLHRYQAHRSLELHPIPSHFFRFWLWLTTGMVTKEWAAVHRKHHAKCETVDDPHSPQVFGIKKVLGEGAELYKVETKNQETLDRYGHGTPDDWIERNVYTKHSVAGIASMLIINVILFGPLGLTIWAVQMMWTPVMAAGVINGIGHYWGYRNFRSEDASRNIVPWGILIGGEELHNNHHAYPTSARLSNKWYEFDIGWMYIRILEMMGLARVKKIAPKLQLNKAKTECDLETLQAVISHRYEILAKYTKSLKIALKNELVHLQQAAIENGVDGLTLRNWVLADAKTLKEEERTKLETVLSHAQKLDKLYRMREELSLIWERSAATKDELLKQLEDWCRRAEESGIELLEKFSRRLRCYAMA

SEQ ID NO: 4314 - protein, 501 aa, Delftia sp. AN3
MPENPETKMSQKFIDRHGLWSDAQKAAAVEVLKKIEQDGIQMIRLSWPDQYGLLRGKMLSVAALRSAFGSGSEITMAPFFFDTVSTFVFNPFSSDGGFGNPELAGSPNVVMVPDPTTFRVLPWADRTGWMLADLYMRSGRPFPLSPRALLKKALGQLADLGYDFHGGLEVEWYLTRIVDPCLEPETLGGPGTPAAPPKVMPVAKGYSYLLENHLDEVEPIMAEVRQHLLTLGMPLRSIEDELGPSQMETTFDVMSGLDMADTMVLFRNAVKQICRRRGYLASFMCKPKIEGFIASGWHLHQSLAARDSGVNAFVPQTGEPLSALGRAYVGGLLKHACAASSFTTPTVNGYRRRRPFSLAPDRVTWAEDNRAAMARVIAAPEDSASRVENRVGEPAANPYLYLASQLFSGIDGIRRQLDPGPLQETPYAADVPILPRNLAEALDVLEGSSFFREAFGEEFIHYWLHLRRSEWARFVAAEGADVDMAGDPVTDWEHREYFELF

SEQ ID NO: 4315 - protein, 279 aa, Oryza sativa (japonica cultivar-group)
MATARAVRLIASRPPSTNLRSLVVVPGRRRLLSTSTEAGGAGDPSVHSGDPPSDDYPDRPPKFSGAEEATGGGDHGKNPSTAAATPSESTKERVPPFAMSDKLGSQELADPAGGSSFTQKRRRSSSSRPADSREEATPGGEEAAGRKVREEDREYYQTHKPSPLAELEFADTRKPITRATDGGSAADRLSDVPGKVAEDTADDSLARAEAMFREVTPSGRTRARSRRCWRGAAAKETLRGAGAVRLGEASQASADPRECRRAVVAWGVCKKKCYSCCVY

SEQ ID NO: 4316 - protein, 521 aa, Solanum tuberosum
MAASIGALKSTPSSNNCINERRNDSTRAVSSRNLSFSSSHLAGDKLMPVSSLRSQGVRFNVRRSPLIVSPKAVSDSQNSQTCLDPDASRSVLGIILGGGAGTRLYPLTKKRAKPAVPLGANYRLIDIPVSNCLNSNISKIYVLTQFNSASLNRHLSRAYASNMGGYKNEGFVEVLAAQQSPENPNWFQGTADAVRQYLWLFEEHNVLEYLILAGDHLYRMDYEKFIQAHRETDADITVAALPMDEKRATAFGLMKIDEEGRIIEFAEKPQGEQLQAMKVDTTILGLDDKRAKEMPFIASMGIYVISKDVMLNLLRDKFPGANDFGSEVIPGATSLGMRVQAYLYDGYWEDIGTIEAFYNANLGITKKPVPDFSFYDRSAPIYTQPRYLPPSKMLDADVTDSVIGEGCVIKNCKIHHSVVGLRSCISEGAIIEDSLLMGADYYETDVDRKLLAAKGSVPIGIGKNCHIKRAIIDKNARIGDNVKIINKDDVQEAARETDGYFIKSGIVTVIKDALIPSGIII

SEQ ID NO: 4317 - protein, 254 aa, Triticum aestivum
  misc_feature (168)..(168): Xaa can be any naturally occurring amino acid
MGRKFFVGGNWKCNGTVEQVESIVNTLNAGQIASTDVVEVVVSPPYVFLPTVKGKLRPEIQVAAQNCWVKKGGAFTGEVSAEMLVNLGVPWVILGHSERRSLMGESSEFVGEKVAYALAQGLKVIACVGETLEQREAGSTMAVVAEQTKAIADKIKDWTNVVVAYEPXVWAIGTGKVASPAQAQEVHANLRDWLKTNVSPEVAESTRIIYGGSVTGASCKELAAQPDVDGFLVGGASLKPEFIDIINAATVKSA

SEQ ID NO: 4318 - protein, 519 aa, Candida apicola
MNINFSDALMLGGISLSFLLASQAIYFYFIYSPRAKKLGCAPPPIFFSFPLGIPDLIRLVNAWFHDDLLEWFTHRFEEFGRRTAFQSVAGQLWIGTIEPENIKTMLATSFKDYSLGFRYNAMYGLLGNGIFTLSGDGWKNSRALLRPQFSREQVSHLESMRTHINMMINNHFKGGQVVDAQVLYHNLTIDTATEFLFGESTNTLDPALAQQGLPGPKGLVTGEQFAEAFTSALELLSVRVMAGAAWFLVWTPKFWRSCKVCHNFIDYFVYKALATPMEKGQDADRYVFIRELTKETSDPRVIRDQALNILLAGRDTTAALLSFTTYYLGAYPEVYDELREAVIADFGSADAEPPTFEQLKQCKVLQNVIREVLRLHPNVPLNFREAIADTTFPTGGGPNGDQPIFVPKGQKVFYATYVMQRNAGIWGPDSTSFRPDRWNEPREALASGWDYIPFNGGPRICLGQQFALTEASYTLVRICQEFSRIEVLHPDVITARNVMKQRMRLPNSSSGGVITRFIR

SEQ ID NO: 4319 - protein, 549 aa, Mycobacterium smegmatis
MSADITETPAWQALSDHHAEIGDRHLTELFADDPARGTELALTVGDLYIDYSKHRVTRRTLDLLVDLARAAGLEERRDAMFAGEHINTSEDRAVLHTALRLPRDAKLVVDGQDVVADVHDVLDRMGDFTDRLRSGEWTGATGERITTVVNIGIGGSDLGPVMVYDALRHYADAGISARFVSNVDPADLVAKLDGLEPAKTLFIVASKTFSTLETLTNATAARRWLTDALGDAAVAKHSSRCPPTRSWSTKFGINTDNMFGFWDWVGGRYSVDSAIGLSVMAVIGKERFAEFLAGFHIVDEHFRTAPLHQNAPALLGLIGLWYSNFFGAQSRAVLPYSNDLSRFAAYLQQLTMESNGKSVRADGTPVSTDTGEIFWGEPGTNGQHAFYQLLHQGTRLVPADFIGFSQPTDDLPTADGTGSMHDLLMSNFFAQTQVLAFGKTADAIASEGTPADVVPHKVMPGNRPTTSILATKLTPSVVGQLIALYEHQVFTEGVIWGIDSFDQWGVELGKTQAKALLPVLTGDKSPAAQSDTSTDALVRRYRTERGRPA

SEQ ID NO: 4320 - protein, 229 aa, Solanum tuberosum
MAAILARKSLSALRSRQLVLAGQAWQGTNTPNGTLLGTRSFATKHSFSTDKDDEEREQLAKELSKDWNSVFERSINTLFLTEMVRGLMLTLKYFFEKKVTINYPFEKGPLSPRFRGEHALRRYATGEERCIACKLCEAICPAQAITIEAEEREDGSRRTTRYDIDMTKCIYCGFCQEACPVDAIVEGPNFEFATETHEELLYDKEKLLENGDRWETEIAENLRSESLYR

SEQ ID NO: 4321 - protein, 505 aa, Candida maltosa
MAIFTPELWLICFAVTVYIFDYIYTKYLMYKLGAKPITHVIDDGFFGFRLPFLITLANNQGRLIEFSVKRFLSSPHQTFMNRAFGIPIILTRDPVNIKAMLAVQFDEFSLGLRYNQFEPLLGNGIFTSDGEPWKHSRIMLRPQFIKSQVSHVNRLEPHFNLLQKNITAQTDNYFDIQTLFFRFTLDTATEFLFGQSVHSLNDGENSLQFLEAFTKSQAILATRANLHELYFLADGIKFRQYNKMVQDFSQRCVDKVLNMSNSEIDKLDRYFFLYEMVKITRNPQVLRDQCLNILLAGRDTTASLLSFAFFELALNEPIWIKLRTEVLHVFQTSLELITFDLLKTKCPYLQAILHETLRLYPSVPRNARFSKKNTTLPHGGGVDGMSPILIKKGQPVAYFICATHVDEKFYTKDALIFRPERWCEEPLIKKNLAWSYLPFNGGPRICLGQQFALTEASYVLTRLAQCYTKISLQPNSFEYPPKKQVHLTMSLLDGVHVKISNLSIS

SEQ ID NO: 4322 - protein, 360 aa, Candidatus Desulfococcus oleovorans Hxd3
MFLQRFSFAFLFRFRSRFRHGQPDMKLPRTILGIETSCDETGAAVVADGRRVLSSVVSSQVALHSPYGGVVPELASRKHIEHILPVVRQALAEAGLKTGDIDAVAATQGPGLVGALLVGFSFAKAFAYAANVPMVGVNHLNGHLASLFLTDDPPAIPFVALLASGGHTAIYHVTGPVTSTLMGQTRDDAAGEAYDKVAKMMGLGYPGGAVIDNLAAQGDPAKYAFTRPYLDKAAFDFSFSGIKTAARRFIQEAGDALAPESPHIAAGFQEAVADVLCYKLVHAAKVKKCGHMALVGGVAANRRIGEKLRHAAKQEGLVVHIPPPAWCGDNAAMIGAAGFFQLAAGAEPVDLSADVYSRVA

SEQ ID NO: 4323 - protein, 521 aa, Candida maltosa
MIDEILPKLVQYWYIVLPTLLIIKHVVSYINTQRLMRKFRAKPVTNVLNDGFFGIPNGIKAIKEKNKGRAQEYNDEKFAAGPKPKVGTYLFKLFTKDVLVTKDPENIKAILATQFEDFSLGKRLDFFKPLLGYGIFTLDGEGWKHSRAMLRPQFAREQVGHVKLIEPHFQSLKKHIIKNKGQFFDIQELFFRFTVDSATEFLFGESVESLKDESIGYDQQDFDFDGRKNFAEAFNKAQEYLGTRAILQLFYWLVNGADFKKSVAEVHKFTDYYVQKALDATPEELEKHSGYIFLYELVQQTRDPKVLRDQSLNILLAGRDTTAGLLSFALFELARNPEVWSRLREEIGDKFGLDEDATIEGISFESLKQCEYLKAVVNECLRMYPSVPRNFRIATKHTTLPRGGGPDGKDPIFIKKGAVVSYGINSTHLDPMYYGPDARLFNPDRWSKPETKKLGWAFLPFNGGPRICLGQQFALTEASYVLVRMIQNFKELELTPNTVYPPRRLTNLTMSLYDGAYIKVN

SEQ ID NO: 4324 - protein, 827 aa, Vibrio vulnificus YJ016
MESIVIIGNGMVGHQLVEQLVATGSHLEKRIIVIGEERFVAYDRVHLSAMFSGQSHQDLLLSSEEWYQKHGIELILGVAVVGIDRQSKRVTLEDESQLSYDQLVFATGSYPFVPPMAGSERSKVFVYRTLDDLSQIKQACLGAKKGAVIGGGLLGLEAANALRLLGLETHVVEFAPRLMPVQLDEGAGAVLKSKIEQLGLTVHTSTATEKIIDGETAYHRMVFKDAPSLEVDVIVFSAGIRPRDQLARDCGLELGERGGIVVNNACQTSDSEIYAIGECALWQGKIFGLVAPGYAMARVVAQQLRGGSEAEFSGADMSTKLKLLGVDVASIGDAHKATPKATEMVLHDAAAGIYKKLVVDQSGTTLLGAILIGDNQDYDVLLQSYLNKTPLPQPVVSLLFDTSALKGDVSDNTVICSCHNVTKGDLISAIQAGAHELGELKAQTKAGSGCGGCSAMVKSVLDQQLSVMGLEVNTQLCEHFSQTRQALYHICQVEKIRDFDSLLAKHGKGHGCDICKPTAGSIFSSLWNEHIMEPEHSPLQDSNDAFMANLQKDGSYSIVPRIPGGEITPEKLIVLGEVARQYDLYTKITGGQRVDLFGAQVEQLPEIWQTLIDAGFETGHAYGKSVRTVKSCVGSTWCRYGVDDSVGLAIELENRYKGLRAPHKLKFAVSGCTRECAEAQSKDIGVIATEKGWNLYVCGNGGMRPRHADLLAADLSKAELITLIDRVLMFYVRTADRLQRTSVWLENLDGGLDYLKSVVLDDSLHLCEQLEQQMAHVVDTYHCEWQQTLTNPEKLMRFRPFINSTQQSTLLGYQRTRGQRIPVKLEE

SEQ ID NO: 4325 - protein, 510 aa, Candida maltosa
MIDALYILIVALVIYKTAQFVHRKSLEKKHHCQPVKQIPLVSILSGLGFDMFFKDTAEMTKNGGLHKKLQQMLESLQTTTFRSRMLTGSQIVTMEPENERTMCSSAHMKDWTIGYRPFALKPLLGDGIFSSEGESWKHSRIMLRPIFAKEHIKQITAMEPYMLLLIEIIKSSSANEGPVDLQPLFHAFTIDYASDFLFGESCDVLKENLGGKSTSGMDAQVKRDFASVFNDVQNYLTKRMMLGPLAFLVSSKDFHDGIKKQHEFVSYFVQKAISMSDEELNDESKNYVFLYQLAKQTKDAKVLQDELLSILLAGRNTTASLLSFLFFELSHHENVWTTLKEVVDQSFPDVESITFETIQNCDYLRWCLFESLRVNPSVPFNSRTANKDTILPRGGGEDCSHPILVKKGDQVLFPLYASNRQEKYFGRKPEEFIPERWRDLPKTGGPAFMPFSTGPRMCLGQQFALIEASYVTIRLVQTFSKLKSHSLEYAPKRLVAATIRLIDGCFVSFE

SEQ ID NO: 4326 - protein, 519 aa, Candida maltosa
MIFTAFILDYWYFTLLFLIAAYFIGKHVYTNYLMRKHHAEPILDVVDDGAFGFKFGFQSLKAKKIGNQIDLLFLKFNEAKHPSIGTFVTRSFGMQFIATKDPENIKAMLATQFNEYTLGQRLNFLAPLLGKGIFTLDGNGWKHSRAMLRPQFSRDQIGHVKMLEPHFQLLKKHIIKNKGTFFDIQELFFRFTVDSATEFLFGESVSSLKDESIGYDQEEIDFAGRKDFAEAFNKSQVYLSTRTLLQLLYWLVNSADFKRCNKIVHKFSDYYIKKALTATPEELEKHSSYIFLYELAKQTRDPIVLRDQSLNILLAGRDTTAGLLSFAVFELGRNPEVWSKLRQEIGHKFGLDSYSRVEDISFELLKLCEYLKAVLNETLRLYPSVPRNARFAAKNTTLPHGGGPDGMSPILVRKGQTVMYSVYALQRDEKYYGKDANEFRPERWFEPEVRKLGWAFLPFNGGPRICLGQQFALTEASYVLARLIQSFETLELSPEAAYPPAKLSHLTMCLFDGTPVRFE

SEQ ID NO: 4327 - protein, 519 aa, Candida maltosa
MVFTAFILEYWYFTLLSLAAGHFIGKHVYTNYLMRKHHAEPILDVVDDGAFGFKFGFQALKAKKIGKQIDLLFKKFNEAKHPSIGTFVTRSFGMQFIATKDPENIKAMLATQFNDFTLGQRLSYFAPLLGKGIFTLDGEGWKHSRAMLRPQFSRDQVGHVKMLEPHFQLLKKHIIKNKGSFFDIQELFFRFTVDSATEFLFGESVSSLKDESIGYDQEEIDFAGRKDFAEAFNKSQVYLSTRSLLQLLYWLVNSSDFKRCNKIVHKFSDYYIKKALTATPEELEKHSSYIFLYELAKQTRDPIVLRDQSLNILLAGRDTTAGLLSFAVFELGRNPEVWSKLREEIGDKFGLDPDSRIEDISFELLKLCEYLKAVINETLRLYPSVPRNGRFAAANTTLPHGGGPDGMSPILVRKGQTVMYSVYALQRDEKYYGKDANEFRPERWFEPEVRKLGWAFLPFNGGPRICLGQQFALTEASYVLVRLIQSFETLELSPDAPYPPAKLTHLTMCLFDGAPVRIE

SEQ ID NO: 4328 - protein, 394 aa, Synechococcus sp. WH 5701
MTQLETRTEPMVVNFGPHHPSMHGVLRLVVTLDGEDVVDCEPVIGYLHRGMEKIAENRTNVMFVPYVSRWDYAAGMFNEAITVNAPEKLASIQVPKRASYIRVLMLELNRIANHLLWLGPFLADVGAQTPFFYIFREREMIYDLWEAATGQRLINNNYFRIGGVAADLPYGWLEKCLDFCDYFGPKIDEYEKLITNNPIFKRRIEGLGVISREMAINWSLSGPMLRASGVPWDLRKVDKYECYDDFEWDVAWEKEGDCYARYRVRIEEMRQSLKILRQACTAIPGGPTENLEAQRMNEGKKSSWYDFDYQYVAKKVAPTFKIPGGELYARVESGKGELGVFIMGNDDVTPWRWKIRAADFNNLQILPHILTGAKVADIMAILGSIDVIMGSVDR

SEQ ID NO: 4329 - protein, 479 aa, Streptomyces coelicolor A3(2)
MPASRVKSPHLLVAESGADREGHGLKRTMGLFQLVCFGVGAIVGTGIFVGLSDSVAEAGPAVVVSFVLAAITCVFTAFAFAELGGAIPVSGSSYSFAYAGLGERTAFLVGWCLLLEYGVSVSAVAVGWSQYVNELLDTVLGVQLPHALSAGPGDGGAVNLPAVVVIALASVLLMRGVRESARATAAMAVLKLAVLLAFCAIGFYAFQDGNLTPFSPAGLGGIGAGTTAAFFSYIGFDAITTAGEEAKNPRRDIPVAILVCIGLVTLLYCAVAVAAIGAVGGDQVGNRPAALSYVVDRVTGSAIGGGVVAFGAVVAIASVVLAVMYGQTRILMSMSRDGLIPRVFEKVSPRTATPVAGTLIVGVVFALPAAFAPLDAVVNLCTIGTLATMAAVNVSVITLRRREPGLARTFRVPLYPATPLLGVGFCLYLMYETGGATWLQFAVFLAVGLLVYSAYGRRHSRLARTAVSADDAERVPQEA

SEQ ID NO: 4330 - protein, 385 aa, Kineococcus radiotolerans SRS30216
MPSTEPGLAHTITDCDDRSGDATRAGRAVSPALPAPERRLHAVDVVVVGAGQGGLAAAHFLDRAGLSPGRGYVVLDAGEEPGGAWRHRWPGLRMDRVNGVHDLPGFPLGAVDPAAPAREVVPAYFAEYERRLGWPVLRPVAVEEVRSAGARLLVDSTAGTFAARAVVNATGTWTKPFWPSYPGRDSFRGRQLHTADYRGPEEFLGRHVVVVGGGISAVQHLEDLAGLGIATTWVTRREPDFREDFGVEARRAAVEVVARRVAAGEPPGSVVSATGLPLTPAVAALRESGVLKRHPAFARVVPDGVVWADGSAQEADVLLWATGFRPAVDHLRPLRLRERGGGILVEGTRAVREPRLHLLGYGPSASTIGAGRAAREAVREVLAGR

SEQ ID NO: 4331 - protein, 218 aa, Zea mays
MVIPLLIVLFLLVLCDEHTWMRLQYAWNAIPFILLFCAISTNKIFSNNKPFSFTIASARSLLQIDPNSGLVQELGNSFLDFVANLNDSKVKVGQILEEDTQNIVNMTMNVSSGWSIVKEELILPARGAPFNSCHASTIVQDGHWHPPVVADEQDGVPMWNPVLFQLPSRELLLFYKIGQEVQKWSGAMKRSLDGGVTWSPREQLPPGILGPIKNKACK

SEQ ID NO: 4332 - protein, 357 aa, Sulfolobus tokodaii str. 7
MVSAIVLAGGYATRLRPLSLTKPKALLPILDKPLLDYILDSLEIAGINEVYLSLRVMADKILSHIEGENRKVIPVIEKERLGDAGPLKLISQRYNLSDDVLVIYGDIYNELDIKSLLKFHEKEGCDATIVGKPVEDPRRYGVLITEGERLVQIIEKPKNPVSNLINAGIYVFKKKLLEKIDGQSIAKNFLPKLLSDNTCIAVYKYDGLWMDIGVPSDYIRINLQLLSLKYPKGYINEEAKVSEKVNLIPPYYISSGVNISEDSFIFNSIIGKNTSIGNGVYIDQSILMEDVKVDSFSYIRDSILGDKDNLGKWVRLDSVILGDEVVIYDGVFVNRDTIILPYKEVNESVYDKGKIIL

SEQ ID NO: 4333 - protein, 164 aa, Triticum aestivum
MAARLALVAALLCAGATAAAAQQASNVRATYHYYSPAQNGWDLGAVSAYCSTWDAGKPFSWRSKYGWTAFCGPAGPRGQASCGRCIRVTNTGTGAQITARIVDQCANGGLDLDWDTVFVKIDTDGMGYQRGHLIVNYQFVDCGDNHINFHGKNETLPASIHAVE

SEQ ID NO: 4334 - protein, 527 aa, Triticum aestivum
MAIGGAFVEGPAGGAGYSGRVTSFVVLSCIVAGSGGILFGYDLGISGGVTSMESFLKKFFPDVYHQMKGDKAATVSNYCRFDSELLTVFTSSLYVAGLVATLFASSVTTRYGSRASILIGGSVFIAGSAFGGAAVNVYMLLVNRILLGIGLGFTNQSIPLYLSEMAPPQYRGAINNGFELCISIGILIANVINYGVQKIEGGWGWRISLSMAAVPAAFLTIGAIFLPETPSFLIQRDGNVDEAKMMLQRLRGTTGVQKELDDLVTASNISRAIKNPYRNILKKKYRPQLVIALLIPFFNQVTGINVINFYAPVMFRTIGLGESAALMSAVVTRLCATVANIVAMIVVDKFGRRKLLLVGGVQMILSQFTVGAILAVKFKDHGVMDKEYGYLVLVIMCVFVAGFAWSWGPLTYLVPTEICPLEIRSAGQSVVIAVIFLMTFVIGQTFLNMLCHLKFGTFFLFGGWVCVMTLFVFFFLPETKQLPMEQMEQVWRKHWFWKRIVGEGEEEADQAQTGAGAIALSAAAHSS

SEQ ID NO: 4335 - protein, 463 aa, Kineococcus radiotolerans SRS30216
MANIAVVPAWLKPPADVNELLPQLWARTVGRDAAGALHVGGVAVADLAATYGTPLFVVDELDFRTRAVAFRDAFADAFADLCGGADVYYASKAFTATGVTRWIAADGLHLDTASAGELELGLRGGVPPARIALHGNNKSRREIVRALEVGVGRIVVDSPAEIDVIADLARERGVVAPVMLRVTVGVEAHTHQYIATAHEDQKFGVSLASGQAEAAVARILARPELRLLGLHSHIGSQIFDLGGFEVSARRLLELHHKVERDHGVELPELDLGGGYGVAYTSEDAPLAPTEIAGRLAEIVARECLVQGIAVPRVSVEPGRAIAAPSTFTLYEVGTTKEVELDGGTRRRYVSVDGGMSDNIRTALYGADYSATVASRASTAPGVLSRVVGKHCESGDVVVRDEFLPEDLGGGDLLAVPGTGAYCRSMASNYNQLPRPGVVAVRDGSATVLVRRETPEDLLALDAG

SEQ ID NO: 4336 - protein, 147 aa, Oryza sativa (indica cultivar-group)
MPFSLLLFTGAVAGVAMLVLPWWCAVGEDDDTYIDGVVDDSYDSDSWYTDYSDEDDDDVGGDNKDGLTPDQLRRLPWFAYCGGGGRSCSICLEEMRDGERCRRPGRCRHAFHAACVDEWLTTRRTCPCCRELVLVPPAARLAAPTYR

SEQ ID NO: 4337 - protein, 387 aa, Thiomicrospira crunogena XCL-2
MSKRDYYEILEVSATASEGEIKKAYRKLAMRYHPDRNPDDEEAEDKFKEASEAYEVLSDAQKRQAYDQFGHAGVDGSAGQGGFGGGGFADFGDIFGDIFGGGFGGGHRGPQPGSDLQYELEVSLEDAVAGTTVDVRIPTKELCESCDGSGAEPGSDVQTCPTCQGIGQVRVQQGFFAVSRTCPNCHGTGKLVKTPCKTCRGEGYKHSSKTLSVKIPAGVDNGDRIRLQGEGEAGEPGAPHGDLYVRIRVKEHKIFQRDGNTLFCDMPLSFATATLGGTMDVPTLNGKANLKIPAGTQSGQRFKLAGKGVKSVRSSHVGDMIVEVHIETPVKLTSEQKELLKAFDESLQGKHHKQHSPKTHSFFDSVKAFFKGDDEDGGNDKKDGPWN

SEQ ID NO: 4338 - protein, 495 aa, Bradyrhizobium sp. BTAi1
MIARKNVCVIGAGVSGLAAAKAFKARGHDVTIIERSADLGGVWEPARSYPDVQTQSPKELYRYTDKAMPDAYPEWPKGPQVYAYLADYARSNDLTRLTRLNTTVRSMQRRADGKPGWTLDLETGDGARREDFDFVAVCTGQFNEPQTLSLPGEDQFKAAGGAIMHSSKYNDATLAKGRNIVVLGGSKSATDIAVNAVRSGARSVTIVFREPVWRIPYFIGGLINFKRILYIRAQEQMFASWGIGPLSRLAHMLAKPFVWANWRGLESLLKAQLKLGKCNMVPKERIEDGVNCSVPIATPDFYPMVADGRIKAVLGTFDHYEPNTIVASGGERIAADVAILAIGYKLGVPFLSDTDRAKLVDPDGQYRLYRLIANPDLPDMGFVGFNSSFCTVLCADMAAHWLVRYADRQLARQPSDREMRDNIEMMLRFKRVERPAAGVYGGLCVAPYHFKHFDELLADIGATRRKRSALAEMFTPPDADAYGDFLASAPVYQAG

SEQ ID NO: 4339 - protein, 277 aa, Brassica napus
MGNKANLIFLWAMLVAVVAMANEHRPFERTKGINGLEKIIVRDRRGRSFEVYLYGGQVTSWKNEKGEDLLFMSTKAIFKPPTPIRGGIPVLFPQYANTGPLPSHGFVRQRFWEIDANPPHLPSHPSSGAHVDLILKSSEADLKIWPNKFVYRLRVALGHGGDLTLTSRVKNSDVKPFNFTVGLHPYFSVSDISQIQVEGLQNLDYLDQQKNRTRFTDHGKVITFNSQLDRLYLRTPKKIRIVDHNKKKTIVVHKEGYADAGNALDFLIHNFMKQMDT

SEQ ID NO: 4340 - protein, 314 aa, Coleochaete scutata
INGFGRIGRNFIRCWHGRGKDSPLEVIAINDTGGVKQASHLLKYDSMLGTFGAEVKIVGDDAISVDGHVIKVVSDRNPLNMPWGKMGVDLVIEGTGVFVDSEGAGKHITAGAKKVLITAPGKGKDIPTYVVGVNAQNYKHTDTIISNASCTTNCLAPFVQILDAKFGLIKGTMTTTHSYTGDQRLLDASHRDLRRARAAALNIVPTSTGAAQAVALVLPQLKGKLNGIALRVPTPNVSVVDLVIQTEKKTFAEEVNAAFREAANGPLKGILAVCDEPLVSADFRLSDVSSTVDSSLTMVMGDDMVKVVAWYDNE

SEQ ID NO: 4341 - protein, 484 aa, Delftia sp. AN3
MKQFLNFINGDFVATAKTFENRNPATNEVVGLVHEAGQAEVDAAVAAGRAALKGEWGTMSVVKRAELLHAVADEINRRFDDFLAAELADTGKPRSLASHIDIPRGAANFKIFADIVKNVPTESFQMTTPDGGTAISYGLRTPLGVVGVICPWNLPLLLMTWKVGPALACGNTVIVKPSEETPATATLLGEVMNAVGVPKGVYQVLHGFGPGSAGEFITKHPGVNGITFTGETRTGEAIMAAAAKGVRPVSFELGGKNAGIVFADADFDKAIAGITRSAFENCGQVCLGTERVYVQRPIFDKFVAALKEKAEGLKIGGPDMPGVGIGPLISAEHKQKVMGYYAKARAEGATVVTGGGEPAMTGEYANGHFVQPTIWTGLPESASVIREEIFGPCCHIAPFDTEEEAIALANATDYGLATTVWTQDLGKAHRMASAIEVGLCWINSWFLRDLRTAFGGSKASGIGREGGVHSLEFYTELRNVMVKL

SEQ ID NO: 4342 - protein, 392 aa, Oceanobacillus iheyensis HTE831
MQSLYKSNIVRNMPPYLFAHIQKKKQKLMEQGSDVIDLGIGAPDLPPPSYIIEELSKHIKNRHLHRYSPYQGIPELRQAVATFYQEKYNVTLDPEEEILILIGSKEGLVHLIQSVINPGDKVILPDPGYPVYKMGVHMTQGRAVYLPLDKNKEYKPNWKMLSEQDKEEAKLLFLNYPNNPTGATAQKETFVKAVQIANKYNICIAHDAAYDHVTFSDYKSPSLLQVDGAKKVGVELGSLSKNFNMTGWRIGYIVGNSSVIQALATLKSNIDTSQFIPVQIAAIKALEQSEDEIRTIHHTMEKRMLKTWKLLKNAGFEVKKTKGTIFLWVKVPKGYTSSSFTEQVLDQAHVIVTPGSAFGEQGEGFFRIALTVPEERLIEAVQRIDSWLNGGK

SEQ ID NO: 4343 - protein, 412 aa, Rickettsia akari str. Hartford
MPIKILMPALSPTMTAGNLARWLKKEGDKVNPGEVIAEIETDKATMEVEAVDEGILAKIVIPQNSQNVPVNSLIAVLSEAREEKADIDAFIAKNNNVSPSPKPDTNLPKHHENIAKVEEQVAVIKHDTSKIFASPLAKRLAKMGNIKLESVKGSGPHGRIVKQDVLSYTPSTVHNKIVSRNPEEYRLVPNNNIRKIIAKRLLESKQTVPHFYLSIECNVDKLLDIREDINKSFSEDKATRISVNDFIILAVAKALQAVPNANASWREDAIRYYNNVDISVAVAIENGLVTPIVKNANQKNIIEISREMKKLIKKAKDNKLTPEEFQGGGFTISNLGMYGVKNFNAIINPPQSCIMGVGASAKRAIVKNDQITIETIMDVTLSADHRVVDGAVGAEFLAAFKKFIESPALMLI

SEQ ID NO: 4344 - protein, 391 aa, Candidatus Desulfococcus oleovorans Hxd3
MDMTKKFGRLDRLQPYVFATVNAIKMEARRAGRDIIDLGMGNPDLPTPNHIIEKMVEAARKPHNHRYSASMGIRKLRLAISDWYKRRYDVPIDHEEEAIVTIGVKEGFSHLILVTINPGDLVFTPNPTYPIHPYATIIAGGNVRGIPVGPGQDFLKNLIDGTRQSWPKPKVLVISYPHNPTTEVVDLNFFKEIVAYAKKYDVMIIHDFAYADLVFDGYEAPSFLQVEGARDVGVEFFSLSKSYSMAGWRVGFCVGNPHIVAALRRIKSYLDYGIFQPLQIASIIALNEDQQCVADIRETYRSRRDTLVNGLNRVGWEIEKPKATMFVWAQIPEKHRHLGSVEFSKMMIREAQVAVSPGLGFGEYGDDYVRFALIENEMRTNQAVRGIKKIL

SEQ ID NO: 4345 - protein, 1025 aa, Arabidopsis thaliana
HEFGNKLGHIHSAPEASLCQDRSLGNFHGYASSSASGSLTAKVKVLCSFGGKILPRPGDSKLRYVGGETHIISIRKDISWQELRQKVLEIYYRTHVVKYQLPGEDLDALVSVSCDEDLLNMMEEYNEMENRGGSQKLRMFLFSVSDLDGALLGVNKSDVDSEFQYVVAVNDMDLGSRSNSTLNGLDSSSANNLAELDVRNTEGINGVGPSQLTGIDFQQSSMQYSESAPPTSFAQYPQSIPHNGAFQFQQAVPPNATLQYAPSNPPSSSVHYPQSILPNSTLQYPQSISSSSYGLYPQYYGETEQFPMQYHDHNSSNYSIPIPFPGQPYPHPGITQQNAPVQVEEPNIKPETKVRDYVEPENRHILATNHQNPPQADDTEVKNREPSVATTVPSQDAAHMLPPRRDTRQNTPVKPSTYRDAVITEQVPVSGEDDQLSTSSGTCGLVHTDSESNLIDLDYPEPLQPTRRVYRSERIPREQLEMLNRLSKSDDSLGSQFLMSHPQASTGQQEPAKEAAGISHEDSHIVNDVENISGNVVASNETLDKRTVSGGGIETEARNLSHVDTERSHDIPEKQTSSGVLIDINDRFPQDFLSEIFAKALSDDMPSGANPYQHDGAGVSLNVENHDPKNWSYFRNLADEQFSDRDVAYIDRTPGFPSDMEDGGEIARLHQVAPLTENRVDPQMKVTESEEFDAMVENLRTSDCEQEDEKSETRNAGLPPVGPSLADYDTSGLQIIMNDDLEELKELGSGTFGTVYHGKWRGSDVAIKRIKKSCFAGRSSEQERLTGEFWGEAEILSKFHHPNVVAFYGVVKDGPGATLATVTEYMVDGSLRHVLVRKDRHLDRRKRLIIAMDAAFGMEYLHAKNIVHFDLKCDNLLVNLKDPSRPICKVGDFGLSKIKRNTLVSGGVRGTLPWMAPELLNGSSSKVSEKVDVFSFGIVLWEILTGEEPYANMHYGAIIGGIVNNTLRPTIPSYCDSDWRILMEECWAPNPTARPSFTEIAGRLRVMSTAATSNQSKPPAHKASK

SEQ ID NO: 4346 - protein, 275 aa, Geobacillus kaustophilus HTA426
MELWFTEKQTEHFGITARIIRTLHTEQTPFQKLDMVETAEFGNMLILDGMVMTTQKDEFVYHEMVAHVPLFTHPNPENVLVVGGGDGGVIREVLKHPSVKKATLVEIDGKVIECSKTYLPEIAGKLDDPRVEVKVDDGFMHIAKSENEYDVIMVDSTEPVGPAVNLFTKGFYAGIANALKEDGIFVAQTDNPWFKADLIRNVYRDVKEIFPITRLYTANIPTYPSGLWTFTLGSKKYDPLAVSDDRFHDIETKYYTKELHKACFVLPKFVADLVK

SEQ ID NO: 4347 - protein, 1072 aa, Bacillus anthracis str. Ames
MPKRLDINTILVIGSGPIVIGQAAEFDYSGTQACQSLKEEGYKVILVNSNPATIMTDTATADKVYIEPLTLEFVSRIIRKERPDAILPTLGGQTGLNMAVELAKSGVLEECGVEILGTKLSAIEQAEDRDLFRTLMQELNEPTPPSEIIHNLDEAYGFVNEIGYPVIVRPAFTLGGTGGGICHNEEELIEIVTSGLKHSPVTQCLLEKSIAGCKEIEYEVMRDSNDNAIVVCNMENIDPVGVHTGDSIVVAPSQTLSDREYQMLRNTSLRIIRALGIEGGCNVQLALDPYSFQYYVIEVNPRVSRSSALASKATGYPIAKLAAKIAVGLTLDEIVNPVTQKTYACFEPALDYVVSKIPRWPFDKFESANRTLGTQMKATGEVMSIGRNLEESLLKAVRSLELGIYHLELDHLKELDKETMKKRIIKADDERLFIVAEAIRQGVTKEEINEWCEMDFFFLQKVENIVNMEREVKANVGNMEVLQTAKEMGFSDHYIAAAWNKTEREIYDMRKENNMTPVFKMVDTCAAEFESATPYYYSTYADENELIVTDRKSVVVLGSGPIRIGQGVEFDYATVHSVWAIKEAGYEAIIINNNPETVSTDFSISDKLYFEPLTIEDVMHIIDLEKPEGVIVQFGGQTAINLAAKLEEHGVKILGTSLEDLDRAEDRDKFEAALTKLGIPQPVGKTATTVEQAVAIAEEIGYPVLVRPSYVLGGRAMEIVYRQEELLHYMKNAVKVHADHPVLIDRYMVGKEIEVDAISDGENVFIPGIMEHIERAGVHSGDSIGVYPPQSLSEKLKEQIIEHTIALGKGLNIVGLLNIQFVVFKDQVYVIEVNPRASRTVPFLSKITGVPMANVATKVILGQDLVEQGYGTGYHPEEKEVYVKAPVFSFAKLRSVDTTLGPEMKSTGEVMGKDLTLEKALYKGLVASGINIPTHGSVIITVADKDKEEAMEIAKRFHEIGYNLLATAGTAQSLTEQNIPVQVVNKIDSEDYNLLDIIRQGKAQFVINTLTKGKQPARDGFRIRRESVENGVACLTSLDTTRAILRVLESMTFSAHSMKEITQTKRHEVVHA

SEQ ID NO: 4348 - protein, 486 aa, Pseudomonas sp. ST41
MKEIKHFINGAFVYSADGRTFEDINPVNGQVIGRVHEAGRAEVDAAVKAARAALKGPWGKMTVAERAEILHRVADGITARFDEFLEAECLDTGKPKSLASHIDIPRGAANFKVFADLIKNVPTEAFEVATPDGAGALNYGVRRPKGVIGVISPWNLPLLLMTWKVGPALACGNCVVVKPSEETPLTATLLGEVMQAAGVPAGVYNVVHGFGGDSAGAFLTEHPDVDAYTFTGETGTGETIMRAAAKGVRQVSLELGGKNAGIVFADCDMDKAIEGTLRSAFANCGQVCLGTERVYVERPIFDAFVARLKAGAEALKIGEPNDPEANFGPLISHKHREKVLNYYQQAVDDGATVVTGGGVPDMSAHLAGGAWVQPTIWTGLADDSAVVTEEIFGPCCHIRPFDSEEEAIELANSLPYGLASAIWTENASRAHRVAGQIEAGIVWVNSWFLRDLRTAFGGSKQSGIGREGGVHSLEFYTELKNICVKL

SEQ ID NO: 4349 - protein, 880 aa, Vibrio vulnificus YJ016
MHGCSKTTCPYCGVGCGVEVKPDELVGDKEHPANHGALCVKGAALAESLNMPSRLLYPKLSGEQVSWELASDWIAQRFHQAMEEYGPDSVAMYVSGQLLTEDYYVANKLMKGYVGSANIDTNSRLCMSSAVAAHVRAFGEDVVPVSYDDLEHAELIVISGANTAWTHPVLFRRIQQIRENNPNVKLVVIDPRKTVTAEQADLHLPIANDSDITLFNGLLAYLLKQGSDKGIDTEFIDQHTQGFAALQALVSSGAYQLEQVASHCGIDVQALRTFYQWFSRSNATMTLFCQGVNQAQNGVDKANAIINAHLATGQIGKRGAGPFSLTGQPNAMGGREVGGLANQLAAHRGFDPDSIRAVQQFWQSPRIAEQPGLKALDLFKAVERGEIKVLWIMATNPVVSMPDNRWIRQALERCPCVIVSDITADSDVAHYADLLLPAAGWGEKQGMVTNSERRMSRQRRFISPPGEAKPDWQAICEVGARLSLKLQAKNGFAFESEAAIFREFAGLTAINSDSHYKLDLAQYQNLSDEAYEQWRPTQWGGESPYADGRFSHPDGKARFVAVTELANSSDEPIGRGLWRLNSGRQRDQWHTMTRTGHIEKLAASELEPSVYLNRLSAEKLELQAGELAYITNPQTLQSLLAKVVIDESMAFGELFMSMHWAGRYGGQSQVNAVVSATGDPISGQPAFKSSLVEVEKAPVVSFGVMISDFSPAIATNYCTYQHQDQSGVWRVASLTLPPQQLAEINLPAVSQVRRVSWQHELGWITLQLQSDTDEANQAKLQAIFIASSQPLKADYQQLLKLIGEPINWQALMHAGFATRVSQLVCSCLRVTDTQIEQAIEQKGVTTLTQLQNQLQCGTNCGSCIPQLKQYFAPAIAQPSR

SEQ ID NO: 4350 - protein, 403 aa, Robiginitalea biformata HTCC2501
MKFGLIRERKNPPDRRVVLSPAACQKVLNQFDGIEIVAESSPIRVFEDAEYRAADIPVADDVSDCDVLLGVKEVPIDALIPEKKYFFFSHTIKKQPYNRDLLRAILEKRIELYDHEVLTNTKGVRLVAFGRYAGIVGAYNGIRAYGLKYGDFKLPKAETLSDREALIEALRGIELPAIKILLTGRGRVGSGAREILDGMGLRQVTVADYLEKEFREPVYCQIDASEYNKRKDGVRGNKADFFANPEAYRSNFFRFARVTDLFIAGHFYGQGAPYLFTREDARHPEFRIRVVADISCDIDGPVASTIRPSTIADPVYGYDPATESETDFKNPRAIAVMAVDNLPAELPRDASEGFGAAFVKQVIPAFFDGDADGILERARMTKDGTLTDRYAYLQDYVDNIPAP

SEQ ID NO: 4351 - protein, 428 aa, Oryza sativa (japonica cultivar-group)
MIEGSRFQNMLGGAGIGGGIGCRGRQENEMNGFHNMPYYHKVGESSHMSVDNADNLNMMNFVGGSVAMSVDNSSVGSNESRTVMLKHPGLRDMPAPSYSVHNSVIHPNRAMAPTLNEDALARVLMDPSHPTEILSNYEEWTIDLGKLDMGAPFAQGAFGKLYRGTYNGEDVAIKLLEKPENDPERAQLMEQQFVQEVMMLSTLRHPNIVRFIGACRKSIVWCIITEYAKGGSVRQFLARRQNKSVPLGLAVKQALDVARGMAYVHALRFIHRDLKSDNLLISADKSIKIADFGVARIEVQTEGMTPETGTYRWMAPEMIQHRPYDHKVDVYGFGIVLWELITGMLPFTNMTAVQAAFAVVNRGSRPAIPQDCVDSLSKIMTCCWDANPEVRPSFAEIVVMLENAEIEVMRNVRRARFRCCIAGPMTTD

SEQ ID NO: 4352 - protein, 598 aa, Robiginitalea biformata HTCC2501
MRDIRNVAIIAHVDHGKTTLVDKILHFCQLFRENEQTGDLILDNNDLERERGITIVSKNVSVTYKDTKINIIDTPGHADFGGEVERVLNMADGVLLLVDAFEGPMPQTRFVLQKALDMGLKPCVVINKVDKPNCTPEEVHEKVFDLMFELGAEEWQLDFPVVYGSAKENWMGEDFKQPTDSIAPLLEMVLDHIPTFEPEKGTTQMLITSLDYSSYTGRIAIGRLQRGPLREGQDITLVKRDGRKVRSRIKELYSFEGLGRARVKELQTGDIGALVGLEGFDIGDTIADAEAPEALASIAIDEPTMSMLFTINDSPFFGKDGKYVTSRHIKERLERELEKNLALRVEETDSADKFLVYGRGVLHLSVLIETMRREGYELQIGQPQVIIKEIDGQKCEPVESLTIDLPEEVSGKAVEMVALRKGEMTRMESRGDRMVCEFLIPSRGIIGLRNQLLTATAGEAIMAHRFLEYQPMKGEVPQRQNGSMVSMETGKAIPYSIDKLQERGRFFIDPGEDIYEGQVIGENSRGDDMVVNVTKTKKLTNVRASGSDDRARIVPAVKFSLEEALEYIQKDEYVEVTPKNLRLRKILLKETDRKRSKD

SEQ ID NO: 4353 - protein, 473 aa, Pseudomonas fluorescens Pf-5
MPVGNQLPHGETAQGGPLKRELGERHIRLMALGACIGVGLFLGSAKAIEMAGPAIMLSYIIGGLAILVIMRALGEMAVHNPVAGSFSRYAQDYLGPLAGFLTGWNYWFLWLVTCVAEITAVAVYMGIWFPDVPRWIWALAALVSMGSINLIAVKAFGEFEFWFALIKIVTIIAMVVGGIGIIAFGFGNDGVALGISNLWSHGGFMPNGVTGVLMSLQMVMFAYLGVEMIGLTAGEARNPQKTIPNAIGSVFWRILLFYVGALFVILSIYPWNEIGTQGSPFVMTFERLGIKTAAGIINFVVITAALSSCNGGIFSTGRMLYSLAQNGQAPAGFAKTSNNGVPRRALLLSIFALLLGVLLNYLVPEKVFVWVTSIATFGAIWTWVMILLAQLKFRKGLSPAERAGLKYRMWLYPISSYLALAFLVLVVGLMAYFPDTRVALYVGPAFLVLLTVLFYLFKLQPTNVQQGSARSAS

SEQ ID NO: 4354 - protein, 364 aa, Arabidopsis thaliana
MAPLPISSIRVGKIDDVQELIKSKPNKVPERFIREEYERGVVVSSLKTHHLHHQIPVIDLSKLSKPDNDDFFFEILKLSQACEDWGFFQVINHGIEVEVVEDIEEVASEFFDMPLEEKKKYPMEPGTVQGYGQAFIFSEDQKLDWCNMFALGVHPPQIRNPKLWPSKPARFSESLEGYSKEIRELCKRLLKYIAISLGLKEERFEEMFGEAVQAVRMNYYPPCSSPDLVLGLSPHSDGSALTVLQQSKNSCVGLQILKDNTWVPVKPLPNALVINIGDTIEVLSNGKYKSVEHRAVTNREKERLTIVTFYAPNYEVEIEPMSELVDDETNPCKYRSYNHGDYSYHYVSNKLQGKKSLDFAKILN

SEQ ID NO: 4355 - protein, 222 aa, Yersinia pseudotuberculosis IP 32953
MNQIQCVMFDCDGTLVDSEVLCCQAYVLMFAHYNIHLSLEEVIKRFKGVKLYEIVGIVCKEYGLDQPIKVLEKLYREEVARLFDAELQPIAGVKALLEQIVLPVCVVSNGPVSKMQHSLGLTGLLPFFEDRLYSSYDIQRWKPDPALIYHAAEHMQVAAEHCILIEDSAAGAQAGIAAGIPVFYYCADPHNQPINHPLVTTFTDIQQLPDLWKERGWHITRD

SEQ ID NO: 4356 - protein, 1070 aa, Thiomicrospira crunogena XCL-2
MPKRSDLESILIIGAGPIIIGQACEFDYSGVQACKALKEEGYRVVLVNSNPATIMTDPEMADATYIEPIEWKTVRNIIAKERPDAILPTMGGQTALNCALDLDNHGVLEEFGVELIGANADAIDKAENRDRFRQAMNRIGLDMPVSDVAHNLEEAWEIQQRVGFPTIIRPSFTLGGSGGGIAYNKTEFEQICKFGLDLSPTKELLIEESILGWKEYEMEVVRDKNDNAIIICSIENLDPMGVHTGDSITVAPAQTLTDKEYQIMRNASLAVLREIGVETGGSNVQFSINPESGRMIIIEMNPRVSRSSALASKATGFPIAKVAAKLAVGYTLDELSNDITDGATPASFEPSIDYVVTKIPRFTFEKFPQADKRLSTQMKSVGEVMAMGRNFQESIQKAMRGLETGKNGFDEIMPLATMDEKEVKDILRQELRAPGPDRLWYVADAFRAGWSLETVFDISKIDPWFLSQIKQLIDMEDDIKQRGLDALDEHVLRSLKRKGFSDNRIADLLDTDAAFIRKFRHTLNIRPVYKRVDTCAAEFETSTAYMYSTYEEECEANPTDREKIMVLGGGPNRIGQGIEFDYCCVHAAMAMREDGYETIMVNCNPETVSTDYDTSDRLYFEPLTLEDVLEIVEVEKPKGVIIQYGGQTPLKLAEDLEAAGVPIIGTSPESIDLAEDRERFQQLLHGLELKQPPNRTARSEDQALALANEIGYPLVVRPSYVLGGRAMEIVYNDTDLTRYMTEAVKVSNDSPVLLDRFLDDAIELDVDAVCDGEQVVIGGVMEHIEQAGIHSGDSACSLPPYSIPMHIQDEIRNQVEKMALGLNVVGLMNTQFAVKGEDIYVLEVNPRASRTVPFVSKAIGSPLAKIAARCMVGQKLAAQNFTKEVRPTYFSVKEAVFPFIKFLGVDPILGPEMKSTGEVMGVGETFPEAYQKAQLAGGTILPTSGKAFLSVRQADRVKVIDLAKKLIKKGFTILATRGTAKSLEEAGIECEIVNKVTEGRPNIVDSIVNEEVDLIVNTSDGSVSIKDSSSIRREALMHKTCYTTTMAGALAMVASMDYLDNQKVTKLQAD

SEQ ID NO: 4357 - protein, 378 aa, Zea mays
MPACSQTARNQIRPPPDISPRRGISSNAPLTAPMGSLPVPASTECTPQGRATVSASDLAPLFSAQRRHLDHFFDRLDMSQAAAFAQVLLDAPGAVFFTGVGKSGIVARKTAQTLASLGFARAGFLAPVDALHGDIGALFPGDVLVLLSKSGASDELLALVPCARAKGGYLVSVTSAASGADCPLAAACDLNVHLPLQGEVCPFGLAPVTSTAIQMVFGDTVIAAIMEARRLSRDQYASNHPAGKIGKTLIFKVKDVMKKQNELPLCKEGDMIMDQLTELTSKGCGCLLVVDEEHHLIGTFTDGDLRRTLKASGPAIFSLTVGEMCNRNPRTITADAMAVEAMEKMESPPSPVQFLPVVNDNNVVCGIITLHGLVSAGL

SEQ ID NO: 4358 - protein, 511 aa, Triticum aestivum
MIARGLLRSNSSTQASKLVKYLTSAGSLQGHAESLSDASVRHFSSASSPQTNSTEENGFKGHGMLAPFTAGWQSNDVHPLVIDRSEGSYVYDINGNKYLDSLAGLWCTALGGSEPRLVKAATDQLNKLPFYHSFWNRTTKPTLDLADDLLSMFTASKMGKAFFTNSGSEANDSHVKLVWYYNNALGRPNKKKFIARSKAYHGSTLISASLTGLPALHQKFDLPAPFVLHTDCPHYWRFHLPGETEEEFATRLAKNLEDLILKEGPETIAAFIAEPVMGAGGVIPPPKTYFDKVQAVVKKYDILFIVDEVITAFGRLGTMFGSDMYNIKPDLVTLAKALSSAYVPIGATLVSPEIAAVVDSQSNKLGSFAHGFTYSGHPVACAVAIEALKIYRERNIPDHVKQIAPRFQEGLKAFAGSPIVGEIRGVGLIIGTEFTDNKSRDSPFPAEWGVGAIFGQECQKRGMLVRVAGDSIMMSPPLTMTAGEVEELVSIYGEAMKSTEMKVAELKSKKN

SEQ ID NO: 4359 - protein, 419 aa, Oceanobacillus iheyensis HTE831
MKDREIQVDERLPLLQSFPLSLQHLFAMFGSTVLVPILFGVDPATILLMNGIGTLLYIFITKGKIPAYLGSSFAFISPVTMVLTEGGGYGAALGGFFVVGLVLVIVGLIVRYAGTSWIDVIFPPAAMGAIVAVIGLELVPTAADMAGLLPQADVPRDTTAILVSLITLGATIIYWVTMRGFLKIIPILLGIITGYVVATMFGIVDFSAVREASWIQMPTYYQIEFNWSDILIILPAALVLVPEHIGHLVVTGNIVKKDLVKEPGLDRSLFGNGFSTMISSFLGSTPNTTYGENIGVLAISKVYSTWVIGGAAIIAVVLSFCGKLAALISSIPTPVMGGISLLLFGIIAVSGLRMLVEQQIDYSKSQNLILTCVVLAIGVSGAAINVGSVELKGMGLATIIAIVVSLFFKLLDVLKLSNE

SEQ ID NO: 4360 - protein, 427 aa, Bacillus anthracis str. Ames
MEQKPVLDVNEVPKPGKWLFLSIQHLFAMFGSTVLVPFLTGLNPSVALISSGLGTLAFLLITKGQVPAYLGSSFAFIAPIITAKTAGGPGAAMLGGLLAGLVYILISLGIKKSGSKWIMKLLPPIVVGPVVMVIGLALAHTAVNMAMNGADGKYSFTHFSVALVTLAITIICSIFGRGFFSIIPVLLGIIGGYIFAYFQGLVDLKPVAEAKWFVVPDFTVPFVTYTPEFSWKIVLLMVPVALVTISEHIGHQIVLGNVIKRDLIEKPGLHRSIFGDGVATLIASLIGGPPNTTYGENIGVLAITRAYSVYLFIGSAVFAIMFGFIGKISALIHSIPTPVMGGVSILLFGVIASSGLRMMVDDKTDLSDKRNLMIASVILVIGIGGAVLHVGESFQVEGMALAAIVGVLLNLLLPETKQIKQSKQIAS

SEQ ID NO: 4361 - protein, 193 aa, Exophiala dermatitidis
MVVATIKCVVVGDGAVGKTCLLISYTTNKFPSEYVPTVFDNYAVTVMIGDEPYTLGLFDTAGQEDYDRLRPLSYPQTDVFLVCFSVTSPASFENVREKWFPEVHHHCPGVPCLIVGTQTDLRDDPQVREKLAKQKMQPVRKEDGERMAKELGAVKYVECSALTQYKLKDVFDEAIVAALEPPPKKSSKKCTIL

SEQ ID NO: 4362 - protein, 327 aa, Rickettsia akari str. Hartford
MNIIVKIQQDLKDEVTKLNDLIISCLKSDEELIEKVGKYLLEAGGKRIRPLLTIITAKMFDYKGDNHIKLASAVEFIHTATLLHDDVVDDSTLRRFKPTANVIWGSKTSILVGDFLFSQSFKLMVASGSIKAMNVLAKASAIISVGEVIQLVKLNERRIITIEEYYQIVKSKTAELFGASCEVGAIIAEQVDHISKDIRYFGTLLGTIFQVIDDLLDYLGNDQQVGKNIGDDFLEGKVTLPLIFLYNKLEQDKRLWLENIIKCDKRTNDEFMQIRDLMVKHEIYNETINYLSNLEHEITKLLNKIPVQNIYKDYLFSIIRFILDRSY

SEQ ID NO: 4363 - protein, 247 aa, Synechococcus elongatus PCC 7942
MFALSGTLDALATVPRVALDLWSFCCRLRWQVRRGHPTAVKSPLSVRTPTMRLVVRSLVSLAAIASLASGLPARAQSGSSVPAPERVTTQSNLNYDSVMRIMAEGDAAVAAQKFPVALDKYDLARKSFGALVQFHQGLAGSFSGIDVKIANDQRQRAAQAAQGRDQAGYKLALLYRRLNQPEVAIPLLVQVVQSQNPTTDLGKQAYAQLYELGFTSLPYPRSVDGTQPAPQQSPAPQTPPAQQPPAR

SEQ ID NO: 4364 - protein, 333 aa, Mesostigma viride
GINGFGRIGRNFLRCWHGRENSPLEVVAINDSGGVKQASHLLKYDSMLGTFAADVKAVSDDTISVDGKLIKIVSSRDPLSLPWKEMGIDIVIEGTGVFIDEAGAGKHITAGAKKVLITAPGKGPNIPTYVVGVNADQYKSTDTIVSNASCTTNCLAPFAKVLDEKFGIIKGTMTTTHSYTGDQRLLDASHRDLRRARAAALNIVPTSTGAAKAVALVLPKLKGKLNGIALRVPTPNVSVVDLVIQVEKKTFAEEVNAALREAANGPMKGVLAVCDEPLVSVDFKCSDVSSTIDASLTMVMGDDMVKVVAWYDNEWGYSQRVVDLAHIMAKEMK

SEQ ID NO: 4365 - protein, 321 aa, Brassica oleracea
MEKNIKFPVVDLSKLNGEERDQTMALVDDACQNWGFFELLNHGIPYDLMDNIERMTKEHYKKFMEQKFKEMLRSKNLDTLETEVENVDWESTFFLHHLPQTNLYDIPDMSDEYRAAMKDFGKRLENLAEELLDLLCENLGLEKGYLKKVFSGTKGPTFGTKVSNYPPCPKPEMIKGLRAHTDAGGLILLFQDDKVSGLQLLKDGVWVDVPPLKHSIVINLGDQLEVITNGKYKSIMHRVMTQKEGNRMSIASFYNPGSDAEISPAPSLVEKDSDEYPSFVFDDYMKLYAGVKFQPKEPRFEAMKNVAATTDLNPVATVETF

SEQ ID NO: 4366 - protein, 151 aa, Brassica napus
  misc_feature (150)..(150): Xaa can be any naturally occurring amino acid
MAISTLTLTSSHYTRSFRPTISSSSSSSSSFSCLCSSSSSSTDCQQKQRSFTAAKTNVFGVGLGLLAATILSITPLDADATRIEYYATVGDPLCEYSYAKSGLGFCDIAVGFGDKAPRGVLVNVHYTARFADGTLFDSTYKRARPLTMRXG

SEQ ID NO: 4367 - protein, 556 aa, Robiginitalea biformata HTCC2501
MCGIVCAFDLKQPAEDLRPQMLEMSRVLRHRGPDWNGIHMSDTAILAHERLAIVDPASGKQPLYSPDGNLVLAANGEIYNHQSLRKRFEGTYDFRTESDCEVILALYQEQGPAFLDELNGIFGFALYDSQADRYFIARDHMGIIPLYIGWDRHGTFYVASELKALEGTCTRIELFPPGHYMLSDQEGFQRWYSRDWMEYDAVEDNPTDIAALRKALEDAVHRQLMSDVPYGVLLSGGLDSSVTSAIAKKYAQKRVESGDQADAWWPQLHSFSVGLEGSPDLAAARKVADHIGTVHHEIKFTIQEGLDAVRDVIYHLETYDITTVRASTPMYLMARVIKSMGIKMVLSGEGADELFGGYLYFHKAPGPRDFHEETVRKLDKLHMYDCLRANKSLAAWGIEGRVPFLDKEFMDVAMRLNPRDKMITPERMEKWVVRKAFEDYLPESVAWRQKEQFSDGVGYSWIDTLKEVVAEAVSDEQLANAHFRFPIQTPTSKEEYYYRSIFESHFPSDAAAESVPQEPSVACSTRIALEWDEAFRNMNDPSGRAVARVHADAYEK

SEQ ID NO: 4368 - protein, 959 aa, Saccharomyces cerevisiae
MTVTTPFVNGTSYCTVTAYSVQSYKAAIDFYTKFLSLENRSSPDENSTLLSNDSISLKILLRPDEKINKNVEAHLKELNSITKTQDWRSHATQSLVFNTSDILAVKDTLNAMNAPLQGYPTELFPMQLYTLDPLGNVVGVTSTKNAVSTKPTPPPAPEASAESGLSSKVHSYTDLAYRMKTTDTYPSLPKPLNRPQKAIAVMTSGGDAPGMNSNVRAIVRSAIFKGCRAFVVMEGYEGLVRGGPEYIKEFHWEDVRGWSAEGGTNIGTARCMEFKKREGRLLGAQHLIEAGVDALIVCGGDGSLTGADLFRSEWPSLIEELLKTNRISNEQYERMKHLNICGTVGSIDNDMSTTDATIGAYSALDRICKAIDYVEATANSHSRAFVVEVMGRNCGWLALLAGIATSADYIFIPEKPATSSEWQDQMCDIVSKHRSRGKRTTIVVVAEGAIAADLTPISPSDVHKVLVDRLGLDTRITTLGHVQRGGTAVAYDRILATLQGLEAVNAVLESTPDTPSPLIAVNENKIVRKPLMESVKLTKAVAEAIQAKDFKRAMSLRDTEFIEHLNNFMAINSADHNEPKLPKDKRLKIAIVNVGAPAGGINSAVYSMATYCMSQGHRPYAIYNGWSGLARHESVRSLNWKDMLGWQSRGGSEIGTNRVTPEEADLGMIAYYFQKYEFDGLIIVGGFEAFESLHQLERARESYPAFRIPMVLIPATLSNNVPGTEYSLGSDTALNALMEYCDVVKQSASSTRGRAFVVDCQGGNSGYLATYASLAVGAQVSYVPEEGISLEQLSEDIEYLAQSFEKAEGRGRFGKLILKSTNASKALSATKLAEVITAEADGRFDAKPAYPGHVQQGGLPSPIDRTRATRMAIKAVGFIKDNQAAIAEARAAEENFNADDKTISDTAAVVGVKGSHVVYNSIRQLYDYETEVSMRMPKVIHWQATRLIADHLVGRKRVD

SEQ ID NO: 4369 - protein, 275 aa, Arabidopsis thaliana
MGIYLSTPKTDKFSEDGENHKLRYGLSSMQGWRASMEDAHAAILDLDDNTSFLGVYDGHGGKVVSKFCAKYLHQQVLSDEAYAAGDVGTSLQKAFFRMDEMMQGQRGWRELAVLGDKINKFSGMIEGLIWSPRSGDSANKPDAWAFEEGPHSDFAGPNSGSTACVAVVRDKQLFVANAGDSRCVISRKNQAYNLSRDHKPDLEAEKERILKAGGFIHAGRVNGSLNLSRAIGDMEFKQNKFLPSEKQIVTASPDVNTVELCDDDDFLVLACDGIW

SEQ ID NO: 4370 - protein, 434 aa, Oryza sativa (japonica cultivar-group)
MQRRRGLAALAVLLALAARGADASVHEYSGGGFAPRANSFFFHGGSEGLYASDPTSNSSASFIRFDSVTFRRTQESAGRHEAMQQKTGLVEAIIVEIQDRSKIGGSYLHSDAICCTPELDKEKSCKVGEVIIQPNPDNPDWPKRVQTFFSGRDEEASMVTQVVSINKTGMYYLYFMFCDPQLKGLKITGRTVWRNPQGYLPGKMAPMMTFYGFMSLAYLVLGLLWFLQFVRCWKDILQLHYHITAVIALGMCEMAFWYFEYANFNSTGNRPMAITLWAVTFTAVKKTISRLLLLVVSMGYGVVRPTLGGVTSKVGALGVVYFIASEGLELVENLGNINDFSGKTRLFLVLPVAILDATFIIWIFSSLSRTLEKLQLRRSMAKLELYRKFTNSLALSVLISIAWIGYELYFNATDPLSELWRRAWIIPAFWNAVL

SEQ ID NO: 4371 - protein, 490 aa, Sinorhizobium meliloti 1021
MTISETLLVKLKDPSLAVDKGLIGAEWLDRSDSGKTFDVSNPATGEVIAILPDMSRSETARAIDAAHAAQRAWAEKTGKERAAVLRNLYDLVVANADDLATILTMEMGKPLTEAKGEILYGASYVEWFGEEAKRVYGDTIPGHQPDKRIIVLKQPIGVVAAITPWNFPNAMLARKLAPAAAAGCAVVSKPAAETPLSALALALLAERAGLPAGVFNVILSTDSAEVGKEMCANDKVRKLTFTGSTNVGKILMRQGADQIMKLGLELGGNAPFIVFDDADLDAAVEGAMVAKYRNNGQTCVCANRIFVQAGIYDAFAARLTAKVSEMTIGDGFEPDVDAGPLISEKALAKVEEHIRDAVTKGADLVLGGNARGGLFFEPTVLTGATMDMKIAGEETFGPVAPLFKFETENEVVSMANKTEFGLASYFYSKDVSKVFRVAEALEYGMVGINTGLISTEVAPFGGVKQSGQGREGSKYGIDDYVETKYLCLSI

SEQ ID NO: 4372 - protein, 91 aa, Synechococcus sp. CC9605
MPADPLTDAVSTRICKHMNDDHAEAVLAYAKHYGGVSNPAAARMVSVKAETMELEVDGASVSIAFDHTLTDSEDAHRTLVAMLRAMPKEGA

SEQ ID NO: 4373 - protein, 163 aa, Dianthus caryophyllus
MAEVEYRCFVGGLSWGTDDRSLAEAFNKFGEVTDSKIINDRETGRSRGFGFVTFANEQSMRDAIDEMNGKELDGRSITVNEAQSRGSGGGGGGGGYRSGGGGGGGYGGGGGGYGGRREGGGGGGYGGGSGGGYGGRREGGGGGGYGGGGGGGYRGNSDGNWRN

SEQ ID NO: 4374 - protein, 421 aa, Oryza sativa (japonica cultivar-group)
MARNPTRTVYIGNLDEKVTERILYEILIQPGRVVDLCIPRDKETSCPKGYAFAEYETEEIAQYAVQLFSGLVRLYGKTLKFAISGQDKPSSNGNNPVMPKLNPVPLPKQPQFVHHSDMHVLHTPADPMHYQLDPCIATEGSAMVWRLCFECCWPWSSEATNVVSVLLGTKEGNLPREEAMKMESPGVQPAAAGEEEGGGGVFFCVAVTSRGRTDRLSYFQAEGDGDDAEEVARATAALCLDHAPEHHHWHHHTVVGRRTFAFLAGDDGRTYFAVADPTPGSAETVRFLQRVRDAFGSCGGGGGGGATRRRNQRDDAVDAVVWQFVRALRASAGRGTAALFPGDDSRGGGDASSADGDKDDEEEEDDRGGEAMAVAADGARRRTRRSWWRYSKVVIGVELVLFLVLFVVWMIVCKGFNCVQR

SEQ ID NO: 4375 - protein, 635 aa, Clostridium perfringens ATCC 13124
MDFIKVGAASPKLKISDTKYNLKEIETMILNAIEEEVKVLVFPELSISAYSCGDLFTNKKLIENCNLAIKNLVEFSKGKDILMAVGAPFLYRYSLYNCAYVILNGKVLGIVPKSYIPNYSEFYEKRWFTEGFNIKGLNVDLDFQKEVPFGTDLIFSFKNLKVGFEICEDLWVTIPPSSNLALMGANLICNLSASNELVSKSSYRKSLVQNQSARTMCSYIYSSAGVHESTTDLLFSGHMIIAENGTIIKENNRFKRENDLLTGIVDLFKLDAERIKNISFRNSTFNENNEPRFIPFNLENTEIKNFDREIDKHPFLPKSQYAMEARCEEILNIQAAALAKRLEHTNLKKAVIGISGGLDSTLALLVVVKTFDMLNIPRENIITITMPGFGTTDRTYNNAVTLCKELHCDFREINIVNAALQHFEDIGHDKDIHDVTYENVQARERTQILMDLANKEGGLLIGTGDLSELALGWCTYNGDHMSMYSVNCSIPKTLVRFLVNYFANHEISNDAKEALLDILDTPVSPELLPKDKEGKIAQKTEDIVGPYELHDFFLYHFIKHGSSPERILFLAKEAFKNDYNEETLKKWLDKFIRRFFTQQFKRSALPDGPKVGSISLSPRGDWRMPSDAVYNDFLI

SEQ ID NO: 4376 - protein, 63 aa, Zea mays
MSDFADRALTAGIGGFVGTGQTSPMLALRRAVPYKCRLAWVTNDIYTKEDGEGQMKHGALPAE

SEQ ID NO: 4377 - protein, 342 aa, Oryza sativa (japonica cultivar-group)
MVISFPSFFFVFLLALVVAVPAAFEDGGSFLGGEGGDEHQPMLAVELDLDATTSFFGVYDGHGGAEVAMYCAKRFHTMLLEDVDYINNLPNAITSVCFRLDDDLQRSNEWRESLNPCANRNCLTNICANLHHFTEDYVPPSYEGSTACVVIIRGNQIIVGNVGDSRCVLSKNGQAISLSFDHKPHHEAERERIQRAGGHVFLQRILGMLATSRAIGDFAYKQNRNMPPSQQMVTCVPDIRVENITDDTEFLVIASDGVWDGMRNNNVVQFVRQELRPGEENLRETCEKLVGHCLHSNDNATAILVKFKPIEEDPDEVASARDEHQHNPEGGDEKLDINNDND

SEQ ID NO: 4378 - protein, 390 aa, Oryza sativa (japonica cultivar-group)
MDSIMEPYVADLLADDITASMVELLSGDGGAAQMDVGVLDAYLRAIGALPAHPAAPGADLAAAAEVESMASNDDTNGNWDTKVDAKVPSAFLPPPPGFPPLPVPALADEPVYAAPVDEGDAIRAFMQQLEWSEQYNGDDDAPAPDDSMASRPQLCAPYDDDIDANLRAMEKDAAERPSPDYLDTVHNGQISAASRASLVAWMGRLTHRYELAAGTLHRAVSYFDRFLSARALPSYTEHQLSLVGATAVYTAAKYEDQGTVFKLDAREIASYGEFASAQEVLAMEREMMAALGYRLGGPNAETFVEHFTRYSKGKEELRVQRLARHIADRSLESYGCLGYLPSVVAAAVISIARWTLNPPGALPWSSELHELTGYSSQDISSCVLTVLNTQ

SEQ ID NO: 4379 - protein, 529 aa, Arabidopsis thaliana
GSSSSASMAEFPEPGTVNPDSDLSNGRAEKPEIDTSAPFESVREAATRFGGFGFWRPSLNKLPDASQENIQEPDIMGLKAQAFELQRELIVKERETLEVLKELEATKATVLKLQQRNEAYEEDTLREEVDSHIKPAGVVLKDLSQAKMNLCKIASIRESVEQLKNKLNEERAALEKTRERLMEKSLKVFSLEEEEVRVRFAKEGQTGEKDLGMLNEVQRLSRQAQEVKKTGENAELEVVKAMAETESTRDKIRTAKIRLVAARKMKEAAREAEAVAIAEIEAVTGSMNVGKAEAVTISAEEYSVLARSARDAEEEARKRVEDAMSRVEEANVSKKDVLKKVDEAAQEIETSKRVLEEAVERVDAANASKIEAEEALRKWRSENGQRRRLSSSVNNTSKFKSRRETTTRLMDVNGLHLTYDVVDGSSSSSTVPVLKPTMSIGQILSKKLLLAEDSDMNVANERRKMSLGQMLAKNSSSDKTVSKRSEGKENEKRTKTRKRKSFGFAKISVLLNKESKNKKKKKKIALNLR

SEQ ID NO: 4380 - protein, 296 aa, Solanum tuberosum
MNLNSVKVPKMPGGGATSALIKFGVIAGLGVYGVANSLYNVEGGHRAIVFNRIGGVKNKVYPEGTHFMIPWFERPVIYDVRARPHLVESTSGSRDLQMVKIGLRVLTRPVSDQLPTVYRSLGENYNERVLPSIIHETLKAVVAQYNASQLITQRENVSREIRKILTERAANFNIALDDVSITSLTFGKEFTAAIEAKQVAAQEAERAKFVVEKAEQDKRSAVIRAQGEAKSAQLIGQAIANNPAFITLRKIEAAREIAQTISHAANKVYLSAMICCLTFRTSTWTLQESDLDSATD

SEQ ID NO: 4381 - protein, 424 aa, Ustilago maydis 521
MSAHPSNPHRTPYNVLNQTFLIDNAYAITKDLGQGAYGCVAAATHKGTGESVAIKKITNVFTKKILTKRALREIKLLRHFRGHKNITCLYDMDIIDPVGFNEVYLYEELMEADLHAIIRSGQPLSDAHFQSFIYQTLCGLKYIHSASVLHRDLKPGNLLICDFGLARGFETDPELAKQVGAGFMTEYVATRWYRAPEIMLSFQNYTTAIDIWSLLGGRPIFKGRDYVDQLNQILHYLGTPSEETLRRVGSPRAQDYIRSLPYQPRIPFDRLYPQANPQALNLLERMLEFDPAKRISCEEALQHPYLSVWHDPADEPVCPRKFDFGFESVDEVQGMKTLILEEVRSFRTEVRRQARLMQQPKRQESLPIPSREDIQRSSPTEEGNPAYSVLGASAGIIQGATNSEHASGVLNDACSKDVGLGSLG

SEQ ID NO: 4382 - protein, 561 aa, Oryza sativa (japonica cultivar-group)
MVISVPLFSSVLLALVVAVPADFDVGGRLLGVGLCSVRGDPNEHYDPHGDLYLRPFLQLDSVHQFYSLVFARKASSAMGASTSTKRPLTSKVTNEGENDRVKYASSAMQGLRMSMQDALAVELDLDALKSTSFFGVYDGHGGAEVAMYCAKRFHVMLREEESFLNNLSYAITSVCSRLDDELEAPNVWRASLYPHRSSESSSESSDCFQFLSTGSCANVWRSSEAVSYKLPSYEGSTACVVIIRGNQITVGNVGDSRCVLSKNGQAIDLSTDHKPNVPLERQRILRVGGQVWREKFPAKDSGGEIREQWGPYCIEGKLSTSRALAGIFLTTISGDFAYKNIVYRPQYQMVTHFPDIRVAKITGDTEFLVIASDGICSIQILIVDLNTFFPFRDHMSSQDVVDFVHEKLNSRRQELCQSLINQGKKRECFTEDSQLATNKNIAPNTTTLGEETLHTTCEKLVENCLESRNNATAILVQFKPGADQPIPALPNIQEGSDEVAGGADQPIPVLPNIQQEGSDEVAGGAAVAEQHQHNPEGGGEQQLDLDDALDGEALALLFGQP

SEQ ID NO: 4383 - protein, 742 aa, Saccharomyces cerevisiae
MGSSINYPGFVTKSAHLADTSTDASISCEEATSSQEAKKNFFQRDYNMMKKAPAPTKSKLSLALQTSKSSSSANGTVQEDTSSKTEDFSTKSIKKKPDSGVESHVSIQSDSGPQSDSDLDSDSSISSCDERNEESLKDYRPGGYHPAFKGEPYKDARYILVRKLGWGHFSTVWLAKDMVNNTHVAMKIVRGDKVYTEAAEDEIKLLQRVNDADNTKEDSMGANHILKLLDHFNHKGPNGVHVVMVFEVLGENLLALIKKYEHRGIPLIYVKQISKQLLLGLDYMHRRCGIIHTDIKPENVLMEIGDVEGIVQMVEALDKQKREAKRLQRHVSRSSDITANDSSDEKWAECQTSMPCGSSSNSKSRSIEKDLSKRCFRRPRRHTIITGSQPLPSPISSSNFFEMRAHFCGSSHNSFSSVSGNRNIPSSINNNSINNGIGIKNSNNSFLNSVPHSVTRMFINEDSNDNNNNDNSKNKNNNNNNSNNNNNEDIMNTPLHEEQLADSLSTFDISNISQSSDTNGPYISNTMDSNSNVSTDINSPENLIQIKIADLGNACWYDEHYTNSIQTREYRSPEVLLGAPWGCGADIWSTACLIFELITGDFLFEPDEGHSYTKDDDHIAQIIELLGELPSYLLRNGKYTRTFFNSRGLLRNISKLKFWPLEDVLTEKYKFSKDEAKEISDFLSPMLQLDPRKRADAGGLVNHPWLKDTLGMEEIRVPDRELYGSGSDIPGWFEEVRDHKRH

SEQ ID NO: 4384 - protein, 525 aa, Saccharomyces cerevisiae
MAAGEQVSNMFDTILVLDFGSQYSHLITRRLREFNIYAEMLPCTQKISELGWTPKGVILSGGPYSVYAEDAPHVDHAIFDLNVPILGICYGMQELAWINGKQVGRGDKREYGPATLKVIDDSNSLFKGMNDSTVWMSHGDKLHGLPTGYKTIATSDNSPYCGIVHETKPIYGIQFHPEVTHSTQGKTLLKNFAVDLCHAKQNWTMENFIDTEINRIRKLVGPTAEVIGAVSGGVDSTVASKLMTEAIGDRFHAILVDNGVLRLNEAANVKKTLVEGLGINLMVVDASEEFLSKLKGVTDPEKKRKIIGNTFIHVFEREAEKIKPKDGKEIQFLLQGTLYPDVIESISFKGPSQTIKTHHNVGGLLENMKLKLIEPLRELFKDEVRHLGELLGIPHDLVWRHPFPGPGIAIRVLGEVTKEQVEIARKADNIYIEEIKKAGLYNQISQAFACLLPVKSVGVMGDQRTYDQVIALRAIETTDFMTADWFPFEHSFLKKVASRIVNEVDGVARVTYDITSKPPATVEWE

SEQ ID NO: 4385 - protein, 403 aa, Oryza sativa (japonica cultivar-group)
  misc_feature (7)..(7): Xaa can be any naturally occurring amino acid
MEHWEAXGTGGRWGRLGEEDRRGEDDGAMGGGAMTWGMRTGVDVSIRCGSPIDLKPVLDDHESEFQHQFMIWVDYVLHGPEFQTPVLKSKQCMNENARLLDSFPRTSSCRLRKHMPIVIPSNTECAAHNNIKHPVLKSFNAYNSWPTQPAGWWAAGKAEVKLILGGRDELGGGTWLGCTRDGKLAFLTNVREPGTLVGPNVRGELPVRFLQGNQCPLEYAEEIAKEADQYNGFNLVLADVQSGNMAYISNRPEGDPVVQKVLPGFHVLSNAAIDCPWPKMLRLGQSFNRFLATQDGAEVSLQQMVEELMMDPVKADKSAVPDTGVDPDWEYQLSSIFIDTEKGQARYGTRSMTALAVKFNGEVTFYERYLESNLWKENLMQFELEMSQWEDLRGTSNISPKSC

SEQ ID NO: 4386 - protein, 845 aa, Pseudomonas fluorescens Pf-5
MAITQPLQLLAPLSGVLLPLDQVPDPVFSSRVIGDGVCIDPTSQTLCAPLSGVISNLQRSGHAVSITGEQGQQVLMHIGLDTVNLAGKGFTCLVEEGQQVSAGQPLIEFDADYLARHARSLLTLMLVVSGEAVTGLVSGSLLVELGQPVLQIEPACAEEGAKVEGAEAEALFSKPLILGNPQGLHARPAALLAQAAKGFAANICLHRRQDSANAKSLVSIMALQTVQGDVLQVSAAGADAERAIQVLVELLVSGCGEKISPAASSPEPVAARDESQETVLRGVCASPGSAVGQVLQVAERRLQISELAANPQQEREVLERALREAVRGLQQLRDNAPGEAQQEIFRAHQELLDDPSLLQQTEALIVTGKSAAFAWNSAIEVTAELFKGLGSTLLAERAVDLADVGQRVLKLILGVQEHALSLPDQAILIAEQLTPSQTASLDTAKVLGFATVGGGATSHVAILARALGLPAICGLSPRVLSLANGTRVLLDADRGELHTDPDPQRLQQLEALRQQQRLRQRQDLAQAAQPAVTRDGHHLEVTANIASLAEAEQAMSLGGEGVGLLRSEFLYQDRSHAPSPEEQAETYRAIAQALGPERNLVVRTLDVGGDKPLAYVPMDSEANPFLGLRGIRLCLERPELLREQFRAILASAGQARLHIMLPMVSQLAELRQARQLLDDEVRALGLEERPKLGIMIEVPSAALMADRFAPEVDFFSIGTNDLTQYTLAMDRDHPRLASQADSFHPSVLRLIARTVQAAHAHGKWVGVCGALASETLAVPLLLGLGVDELSVSVPLIPAIKARVRELDLSECQALAARIIDLEDAVQVREYLHKQQVAADSLVLEN

SEQ ID NO: 4387 - protein, 123 aa, Solanum berthaultii
MATSSEEGQVIGCHKVEDWEVQPQKGVETKKLVVVDFTASWCGPCRFIAPILADIAKKMHHVIFLKVDVDELKKVAEDWNVEAMPTFVFIKEGKEVDRVVGANKDGLLQTIEKHGAAPAIVTA

SEQ ID NO: 4388 - protein, 1124 aa, Nicotiana tabacum
MSSSRPSQSSTTSARSKHSARIIAQTTIDAKLHADFEESGDSFDYSSSVRVTSVAGDERKPKSDRVTTAYLNQIQKGKFIQPFGCLLALDEKTFKVIAFSENAPEMLTMVSHAVPSVGELPALGIGTDIRTIFTGPSAAALQKALGFGEVSLLNPVLVHCKTSGKPYYAIVHRVTGSLIIDFEPVKPYEVPMTAAGALQSYKLAAKAITRLQALPSGSMERLCDTMVQEVFELTGYDRVMTYKFHDDDHGEVVAEITKPGLDPYLGLHYPATDIPQAARFLFMKNKVRMICDCRAKHVKVVQDEKLPFDLTLCGSTLRAPHYCHLQYMENMSSIASLVMAVVVNDGDEEGESSDSTQSQKRKRLWGLVVCHNTTPRFVPFPLRYACEFLAQVFAIHVNKELELESQILEKNILRTQTLLCDMLMRVAPLGIVSQSPNIMDLVKCDGAALLYKNKIHRLGMTPSDFQLHDIVSWLSEYHTDSTGLSTDSLYDAGFPGALALGDVVCGMAAVRISDKGWLFWYRSHTAAEVRWGGAKHEPGEKDDGRKMHPRSSFKAFLEVVKTRSVPWKDYEMDAIHSLQLILRNASKDADAMDSNTNIIHTKLNDLKIDGLQELEAVTAEMVRLIETASVPIFAVDVDGQLNGWNTKIAELTGLPVDEAIGNHLLTLVEDSSVDTVSKMLELALQGKEERNVEFEIKTHGPSGDSSPISLIVNACASRDVGDSVVGVCFIAQDITGQKNIMDKFTRIEGDYRAIIQNPHPLIPPIFGTDQFGWCSEWNSAMTKLTGWRRDDVIDKMLLGEVFGTQAACCRLKNQEAFVNFGVVLNNAMTGQECAKISFGFFARNGKYVECLLCVSKRLDREGAVTGLFCFLQLASHELQQALHIQRLSEQTALKRLKVLAYIRRQIRNPLSGIIFSRKMLEGTNLGEEQKNILRTSSQCQRQLNKILDDTDLDSIIDGYLDLEMLEFKLHEVLVASISQIMMKSNGKNIMIVNDMVEDLLNETLYGDSPRLQQVLANFLLVCVNSTPSGGQLSISGTLTKDRIGESVQLALLEVRISHTGGGVPEELLSQMFGTEAEASEEGISLLISRKLVKLMNGEVQYLREAGRSTFIISVELAVATKSSC

SEQ ID NO: 4389 - protein, 345 aa, Oryza sativa (indica cultivar-group)
MAGGVSSVEVVKDGATGLEKLVLREAHGCSVQVDPLSSTLAFSCNVDKLFIGGGHHDAIVSCGFDWPFAIILSILGNVILDNLTGSLLSFFFLRNGQVRYFSLFSVGNHGVLEQHGFARNRLWSVDETPPPFPATTSNCHIDLILKQSPEDLKIWPHSFEFRLRVALSPTGDLMLTSRIKNTNADGKPFKFGFSYNTYFSVSDISEVRVEGLETLDYIDNLQCGKRCTEQGDAVVFESEAEKVYLSAPPKIVIIDHDKKRTFELRKEGLPDVVVWNPWDRKAKTILDFGEEEYKCMLCVGAANAEKPITLRPGEEWQGRQEISVVPSSYSSGQWDPEIIHRIQDI

SEQ ID NO: 4390 - protein, 503 aa, Streptomyces coelicolor A3(2)
MSNTLFRTKKIEQSIRDTEEPEHALKKSLSALDLTVFGIGVVIGTGIFVLTGTVAKDNAGPATALAFVVAGVVCALAALCYAEFASSVPVAGSAYTFSYASLGELPAWIIGWDLVLEFALGTAVVAVGWSGYIRSLMDNAGWHMPAELGGRDGAEGFGFDILAAALVLVLTAVLVLGMKLSARITSLVVAIKVAVVLIVIIAGAFFVKSANYDPFIPKSQPVEAGGGLHSPLIQLMFGWAPSNFGVMGIFTAASVVFFAFIGFDIVATAAEETRNPQRDMPRGILGSLIICTLLYVGVSIVVTGMQHYTKLSVDAPLADAFKATGHPFFSGVISFGAAVGLTTVCMILLLGQSRVFFAMSRDGLLPRFFSHVHPKFRTPYRPTILLGVIIAIVAGFTSLSELAELVNIGTLFAFVVVAISVIILRRTRPDLPRAFRTPLVPLLPIVSVAASLWLMLNLPAETWVRFAIWMAIGFVVYFLYGRTHSRLARGEEAPADPAEPSGT

SEQ ID NO: 4391 - protein, 1123 aa, Solanum tuberosum
MSSSRPSQSSTTSSRSKHSARIIAQTSIDAKLHADFEESGDSFDYSSSVRVTNVAEGEQRPKSDKVTTAYLHQIQKGKFIQPFGCLLALDEKTLKVIAFSENAPEMLTMVSHAVPSVGEHPVLGIGIDIRTIFTGPSGAALQKALGFGEVSLLNPVLVHCKNSGKPFYAIVHRVTGSLIIDFEPVKPYEVPMTAAGALQSYKLAAKAITRLQSLPSGSMERLCDTMVQEVFELTGYDRVMGYKFHDDDHGEVVSEITKPGLEPYLGLHYPATDIPQAARFLFMKNKVRMICDCRAKHVKVVQDEKLPFDLTLCGSTLRAPHYCHLQYMENMNSIASLVMAVVVNDGDEEGESSDSSQSQKRKRLWGLVVSHNTTPRFAPFPLRYACEFLAQVFAILVNKELELENQFLEKNILRTQTLLCDMLMRDAPLGIVSQSPNIMDLIKCDGAALLYKNKIHRLGMNPSDFQLHDIVSWLCEYHTDSTGLSTDSLYDAGFPGALALGDAVCGMAAVRISDKDWLFWYRSHTAAEVRWGGAKHEPGEKDDGRKMHPRSSFKGFLEVVKTRSIPWKDYEMDRIHSLQLILRNAFKDADAVNSNTISIHTKLNDLKIDGMQELEAVTAEMVRLIETASVPIFAVDVDGQVNGWNTKVAELTGLPVDEAIGKHLLTLVEDSSVDTVNKMLELALQGQEERNVEFEIKTHGPSRDSSPISLIVNACASKDVRDSVVGVCFIAQDITGQKSIMDKFTRIEGDYRAIIQNPHPLIPPIFGTDQFGWCSEWNSAMTMLTGWRRDDVMDKMLLGEVFGTQAACCRLKNQEAFVNFGVILNNAITGQESEKIPFGFFARYGKYVECLLCVSKRLDKEGAVTGLFCFLQLASHELQQALHVQRLSEQTALKRLKVLAYIRRQIRNPLSGIIFSRKMLEGTSLGEEQKNILHTSAQCQRQLDKILDDTDLDSIIEGYLDLEMLEFKLHEVLVASISQVMMKSNGKNIMISNDMVEDLLNETLYGDSPRLQQVLANFLLVSVNSTPSGGKLSISGKLTKDRIGESVQLALLEFRIRHTGGGVPEELLSQMFGSEADASEEGISLLVSRKLVKLMNGEVQYLREAGRSTFIISVELAVATKSS

SEQ ID NO: 4392 - protein, 353 aa, Mannheimia succiniciproducens MBEL55E
MIILFNLNIIGENLMAIKIGINGFGRIGRIVFRAAQTRDDIEVVGINDLIDVEYMAYMLKYDSTHGRFDGSVEVKDGNLVVNGKTIRVTAERDPANLNWGAIGVDIAVEATGLFLTDETARKHITAGAKKVVMTGPSKDATPMFVRGVNFSAYAGQDIVSNASCTTNCLAPLARVVHETFGIKDGLMTTVHATTATQKTVDGPSAKDWRGGRGASQNIIPSSTGAAKAVGKVLPALNGKLTGMAFRVPTPNVSVVDLTVNLEKPASYETIKQAIKDAAEGKTFNGELKGVLGYTEDAVVSTDFNGCALTSVFDADAGIALTDSFVKLVSWYDNETGYSNKVLDLVAHIYNYKG

SEQ ID NO: 4393 - protein, 510 aa, Arabidopsis thaliana
SLICAPVMADSIDKMVIETSKAHELGADLVEIRLDWLKDFNPLEDLKTIIKKSPLPTLFTYRPKWEGGQYEGDENERRDVLRLAMELGADYIDVELQVASEFIKSIDGKKPGKFKVIVSSHNYQNTPSVEDLDGLVARIQQTGADIVKIATTAVDIADVARMFHITSKAQVPTIGLVMGERGLMSRILCSKFGGYLTFGTLDSSKVSAPGQPTIKDLLDLYNFRRIGPDTKVYGIIGKPVSHSKSPIVHNQAFKSVDFNGVYVHLLVDNLVSFLQAYSSSDFAGFSCTIPHKEAALQCCDEVDPLAKSIGAVNTILRRKSDGKLLGYNTDCIGSISAIEDGLRSSGDPSSVPSSSSPLASKTVVVIGAGGAGKALAYGAKEKGAKVVIANRTYERALELAEAIGGKALSLTDLDNYHPEDGMVLANTTSMGMQPNVEETPISKDALKHYALVFDAVYTPRITRLLREAEESGAITVSGSEMFVRQAYEQFEIFTGLPAPKELYWQIMSKY

SEQ ID NO: 4394 - protein, 1132 aa, Nicotiana tabacum
MASGSRTKHSHQSGQGQVQAQSSGTSNVNYKDSISKAIAQYTADARLHAVFEQSGESGKSFDYSQSIKTTTQSVVPEQQITAYLTKIQRGGHIQPFGCMIAVDEASFRVIAYSENACEMLSLTPQSVPSLERPEILTVGTDVRTLFTPSSSVLLERAFGAREITLLNPIWIHSKNSGKPFYAILHRVDVGIVIDLEPARTEDPALSIAGAVQSQKLAVRAISHLQSLPGGDVKLLCDTVVESVRELTGYDRVMVYKFHEDEHGEVVAESKIPDLEPYIGLHYPATDIPQASRFLFKQNRVRMIVDCHATPVRVVQDESLMQPLCLVGSTLRAPHGCHAQYMANMGSIASLTLAVIINGNDEEAVGGRSSMRLWGLVVGHHTSARCIPFPLRYACEFLMQAFGLQLNMELQLASQLSEKHVLRTQTLLCDMLLRDSPTGIVIQSPSIMDLVKCDGAALYCQGKYYPLGVTPTEAQIKDIVEWLLTYHGDSTGLSTDSLADAGYPGAALLGDAVCGMAVAYITSKDFLFWFRSHTAKEIKWGGAKHHPEDKDDGQRMHPRSSFKAFLEVVKSRSLPWENAEMDAIHSLLILRDSFKDAEASNSKAVVHAQLGEMELQGIDELSSVAREMVRLIETATAPIFAVDVEGRINGWNAKVAELTDLSVEEAMGKSLVHDLVHKESQETAEKLLFNALRGEEDKNVEIKLRTFGPEQLKKAVFVVVNACSSKDYTNNIVGVCFVGQDVTGQKVVMDKFIHIQGDYKAIVHSPNPLIPPIFASDENTCCSEWNTAMEKLTGWSRGEIIGKMLVGEIFGSCCRLKGPDAMTKFMIVLHNAIGVQDTDKFPFSFFDRNGKYVQALLTANKRVNMEGQIIGAFCFIQIASPELQQALRVQRQQEKKCYSQMKELAYLCQEIKSPLNGIRFTNSLLEATDLTENQKQYLETSAACERQMSKIIRDVDLENIEDGSLTLEKEEFFLGSVIDAVVSQVMLLLRERSVQLIRDIPEEIKTLTVHGDQVRIQQVLADFLLNMVRYAPSPDGWVEIQLQPNMKQISDEVTVVHIEFRIVCPGEGLPPELVQDMFHSSRWVTKEGLGLSMCRKILKLMNGDIQYIRESERCYFLIILDLPMTRRGSKSLG

SEQ ID NO: 4395 - protein, 391 aa, Pisum sativum
TLEFRSVAEPIGSIQDALSKDPNSHFLLASCTNIDTNKHEVYCETVSNGGLSREPYQFKVAYDKLVIASGAEPSTFGIKGVKEHAFFLREVNHAQEIRKRLLLNLMLSENPGISEGGKEGLLHCVVVGGGPTGVEFSGELSDFITKDVRERYTHVKDYIHVTLIEANEILSSFDVSLRQYAMKHLTKSGVRFVRGVVKEVHPQKIVLSDGTKVPYGLLVWSTGVGPSEFVKKLYLPVSPGGRIGVDGWMRVPSVEDVFALGDCAGFLEQTGRPVLPALAQVAERQGKFLVELFNKIGKQDGGKALSANGIPFGDPFVYKHLGSMASVGAYKALVDLRQSKDAKGLSLAGFVSWLIWRSAYLTRVLNWRNRFYVAVNWGTTFVFGRDNSRIG

SEQ ID NO: 4396 - protein, 219 aa, Mannheimia succiniciproducens MBEL55E
MNQLEMKKVAAKAALQFVKPDMIVGVGSGSTVNCFIEELGAFRDQIKGAVAASKASEELLRKQGIEVFSANDVSSLDIYVDGADEINPQKMMIKGGGAALTREKIVSSLAKNFICIVDSSKQVDILGSTFPLPVEVIPMARSQVARKLVALGGSPEWREGVITDNGNVILDVHNFIIMNPIEMEKELNNVAGVVTNGIFALNAAHTVIVGTPDGAKIIE

SEQ ID NO: 4397 - protein, 90 aa, Malus x domestica
SNRPTLSRRFMPEEGTPEYEELRTNPDKAFLQTFAPQLPTLLGMATVEILSRHPTDELYLGQRDTAEWTTDADILQASEDFKKNLEAIEA

SEQ ID NO: 4398 - protein, 378 aa, Physcomitrella patens
SGMKSTNAVTFGKRSDDLASIVAAQSAVSASSGATRAVTEAKIKVAINGFGRIGRNFIRCWQGRKDSPLDVVVINDTGGVKQASHLLKYDSMLGTFNADVKVEGNNAISVDGKVIKVVSDRNPLNLPWGDMDIDLVIEGTGVFVDEAGAGKHIQAGAKKVLITAPGKGAIPTFVVGVNEQDYKHSDAIISNASCTTNCLAPFVKVLDEKFGIIKGTMTTTHSYTGDQRLLDASHRDLRRARAAALNIVPTSTGAAKAVALVLPNLKGKINGIALRVPTPNVSVVDLVVQVEKKTFAEEVNQAFRDACQTEQLKGVLAVCDEPLVSVDFRCTDVSSTVDSSLTMVMGDDMVKVVAWYDNEWGYSQRVVDLANLVAEKWE

SEQ ID NO: 4399 - protein, 338 aa, Fulvimarina pelagi HTCC2506
MVAANRVEQTQARATIDTIVTLTQRDMGRVNDLILSMAGSRVELIPEIANHLISSGGKRLRPMLTIASALAHGYEEGDAHVKLAASVEFMHTATLLHDDVVDESDLRRGRRTARTIWGNQASVLVGDYLLGQAFKMMVDVGSMAALAILSDASAVIAEGEVWQLAAAKRMTTSEADYLSVVDAKTAALFAAAAEVGPVIAGKSMREREAMRRYGRSLGISFQLIDDVLDYGGVATDLGKNTGDDFREGKITLPVILAYEAGSDEEKAFWRSAMEEGRNDDLALAKAVDLIDRHGTLKATIDRARAYGAEAYEAAASLPPSLAREALLDVVEFCVARIR

SEQ ID NO: 4400 - protein, 69 aa, Arabidopsis thaliana
  misc_feature (29)..(29): Xaa can be any naturally occurring amino acid
  misc_feature (33)..(33): Xaa can be any naturally occurring amino acid
  misc_feature (36)..(36): Xaa can be any naturally occurring amino acid
  misc_feature (47)..(51): Xaa can be any naturally occurring amino acid
  misc_feature (54)..(54): Xaa can be any naturally occurring amino acid
  misc_feature (57)..(57): Xaa can be any naturally occurring amino acid
  misc_feature (66)..(66): Xaa can be any naturally occurring amino acid
MASSMLSSATMVASPAQATMVAPFNGLKXSAAXPAXRKANNDITCIXXXXXRVXCMXGWPAIGKKXGRL

SEQ ID NO: 4401 - protein, 315 aa, Oryza sativa (japonica cultivar-group)
MHIAACEGQGEVVRLLLSWKANMNARDRWGSTPAADAKHYGHFEVYNLLRARGAKTPGHYVARWYGSKVFVKILDKDSFSDANSINEFKHELTLLEKARHPNLVQFVGAVTQNVPMMIVSEYHQKGDLASYLETKGRLQPYKAIRFSLDIARGLNYLHECKPEPIIHGNLSTKSIVRDDEGKLKVAGFGSRSLIKVSEDNPQMDQTTSKFNSVYTAPEMYRNGTFDRSVDVFAFGLILYEMIEGTHAFHPKPPEEAAKMICLEGMRPPFKNKPKYYPDDLRELIQECWDPTPSVRPTFEEIIEGKQIMKYMRNIP

SEQ ID NO: 4402 - protein, 492 aa, Polaromonas sp. JS666
MTSSFSNLSLAEPLARAVAEMGYETMTPIQEQAIPVVLQGKDVMGAAQTGTGKTAAFSLPLLQRMLKHENASTSPARHPVRALVLLPTRELAVQVAEQVKLYAKHTNLRSAVVFGGMDMKPQTLELKQGVEVLVATPGRLLDHIEAKNTVLNQVEYVVLDEADRMLDIGFLPDLQRILSYLPKQRITLLFSATFSPEIKRLASSYLQDPVTIEVARSNATASTVEQHFYSVGADDKRRALHQILKERGMKQAFVFVNSKLGCARLARSLEREGLKTTALHGDKSQDERLKALDAFKKGEVDLLVCTDVAARGLDIKDVPAVFNFDVPFNAEDYVHRIGRTGRAGASGLAVSFVASSDQRLVADIEKLIKTKIELEPIEFDEDRPRISEQGRINDGRRMYRQGNEGEEGAGREAFVSREPRDRERRERREYTPHRQPAAPRDPFFDQPYEATTVIADAQPSWEAAAKAGPARSSVSANIKPKKKVAALFKTSD

SEQ ID NO: 4403 - protein, 525 aa, Pseudomonas fluorescens Pf-5
MALDIHAHRILILDFGSQYTQLIARRVREIGVYCELHPFDMDDEAIREFAPKGVILAGGPESVHEANSPRCPQAVFDLGVPVFGICYGMQTMAEQLGGKVEGSELREFGYARVDVVGKSRLLDGIEDHVDADGLFGLDVWMSHGDKVTKMPEDFHILASTPSCPIAGMFNDDLRYYGVQFHPEVTHTKQGGRILSRFILDICGCEALWTPSKIAEDAIAQIRAQVGTDNVLLGLSGGVDSSVVAALLHKAIGDQLTCVFVDNGLLRLHEGEQVMAMFAENMGVKVIRANAEEQFLNNLAGEADPEKKRKIIGRTFIDVFDAESCKLENIKYLAQGTIYPDVIESAGAKSGKAHVIKSHHNVGGLPEEMNLKLVEPLRELFKDEVRRLGLELGLPYDMVYRHPFPGPGLGVRILGEVKKEYADLLRRADHIFIEELRKADWYHKVSQAFVVFQPVKSVGVVGDGRRYAWVVALRAVETIDFMTARWAHLPYELLETVSGRIINEIEGISRVTYDVSSKPPATIEWE

SEQ ID NO: 4404 - protein, 213 aa, Pyrococcus furiosus DSM 3638
LMAGTTLEKIEEVIGKKIIVLNREDVEMNFEKIVLPEAKEKEVAFLTAGDPMVATTHAELRIRAKRMGVESYVIHAPSIYSAVAITGLHIYKFGKSATVAYPEGNWFPTSYYDVVKENLERGLHTLLFLDIKAEKGKYMTANEAMELLLKVEEMRGENVFTPNIWWLSLEGLARSTQQLGLDTKRYDKGRLWKATSCSNSSRETSRCRGRVFS

SEQ ID NO: 4405 - protein, 485 aa, Synechococcus sp. CC9605
MPTRFTEQSQRFRPNSNEGQVLQKAREHFEATLIGVQGELAGSVAAMEHRRSDDALNYGEIFLRDNVPVMIYLMLEGRFAIVKQFLSVSLQLQSTNVQTRGVFPTSFVEEEGELVADYGQRSIGRITSVDASLWWPILCWIYVKRSGDVDFGRSPEVQRGLQLLLDLVLHPSFEGTPVLFVPDCAFMIDRPMDVWGAPLEVEVLLFAALRSCVGLMELCQRHENSVLLAERLRLSRQWTHDLRQFLLKHYWVTSKTMQVLRRRPTEQYGENQHHNEFNVQPQVIPDWLQDWLENRGGYMIGNMRTGRPDFRFYSLGNSLASLFGLLTAPQQRALFRLVLHNRDHLMAQMPMRICHPPMEGVEWENKTGSDPKNWPWSYHNGGHWPSLLWFFGASILLHERLNPQADVLLMGQMKTLMDECYWSHLNQLPRQQWAEYFDGPTGTWVGQQSRTYQTWTIVGFLLMHHFLHINPDDVLMLNLDESMGH

SEQ ID NO: 4406 - protein, 574 aa, Oryza sativa (indica cultivar-group)
MVRTGLLRHCSFFFLCVCVWQLVMGSSDFSWTLPDHPKLPKGKPVAVVVLDGWGEADADQYNCIHVAETPTMDSLKKGAPEKWKLVKAHGTAVGLPSDDDMGNSEVGHNALGAGRIFAQGAKLVDTALASGKIFEGEGFKYIKESFDQGTLHLIGLLSDGGVHSRLDQLQLLLNGASANGAKKIRVHILTDGRDVLDGTSVGFVETLENDLSQLCAKGIDACIASGGGRMYVTMDRYENDWDVVKRGWDAQVLGEAPHKFQNAVEAVKTLRSETKANDQYLPPFVIVDDSDKAVGPIVDGDAVVTFNFRADRMALEYEDFDKFDRVRVPKIRYAGMLQYDGELKLPSHYLVSPPEIERTSGEYLVKNGIRTFACRQFGHVTFFWNGNRSGYFDETKEEYVEIPSDSGITFNVKPKMKALEIAEKARDAILSGKFDQVRVNLPNGDMVGHTGDIEATVVACKAADEAVKMILDAIEQVGGIYLVTADHGNAEDMVKRNKSGQPQLDKKGEIQILTSHTLQPVPVAIGGPGLHSGVRFRNDVQTPGLANVAATVMNLHGFEAPADYEPTLIEVVDK

SEQ ID NO: 4407 - protein, 475 aa, Gibberella zeae PH-1
MSSALRRGTAQPLRWATASSSAITINTLRPCLAARRHIHSSDRRTNTIVEQRQIRDPLPSVPSKAPLSVLPLIMILRSLATMTVSSSPLLLPPSLHVMGILANTSNPILNPDKNPLLRFFLKKTFYAQFCAGEKSPEIKKTIDGLKNIGFNGVILNYAKEVVLTKDEGADLKNAAVETESAIQNEILPWARGTLETVRLAEPGDFVALKFTGAGSIALHQLKERMPPSPAMYKAIDSICQLAHERGVRLLFDAEQDMLQDGIDDWTLEFIRKYNKGLGEAVIFGTYQAYKKKCPEVLSAHLKLAKEEGFALGVKLVRGAYLNSDPRELFHDTKEDTDACFDSLSASVLTREWNADVKGSGPYPAASLVVASHNAESVRLSRAIMEAGRAKSDIAFAQLQGMADEVSCELVEANQQDKTMNLPAYKYLVWGTTGECMKYLLRRAHENKDAVQRTKGSRDALWHELVRRCKSVVGLA

SEQ ID NO: 4408 - protein, 178 aa, Arabidopsis thaliana
  misc_feature (45)..(45): Xaa can be any naturally occurring amino acid
MNRGRRNLKQAASDQDFTLEECQSIAQVVSLRGSNQIELFCCLFXIMDAKGENSLALFPAKFRESMWIRRGSFVVIDHTGKEKAQESGSKVTSIVCKVLFFEQVRLLQKSPEWPEIFKDTRPIPAEKSSPIEQHEDDGEVDSSDDDDGMPPLQANTNRLRPFGVKCDAETDSGSDSDS

SEQ ID NO: 4409 - protein, 585 aa, Gibberella zeae PH-1
MEGYVEVMADGGTGQKLTYATTVVAGVASVIATILSVISIMLQAKNYRKPLLQRYVVRILLMVPIYSIASWTSMVSLKAAAFLDPIRDIYEAFTIYTFFQLLINYLSGERSLIIMTHGRAPVHHLWPLNHVLPKVDISDPHTFLSIKRGILQYAWLKPILATSAIIMKATGTYQEGYIGLTSGYLWSGIIYNISVTVSLYALGLFWVCMNKDLKPFRPVPKFLCIKLIIFASYWQGFFLSILVFLGAIPDDVEGYTSDNLAAAIQDALICVEMPIFAVAHWYAFSWHDFADNSILSARMPLRHAFKDAFGIRDLIEDSKLTFRGDTYGYRVFDSGDKVMAHEDSKSRLARLKEGMRYERGGKGKYWLPKPGEINSTTPLLRGNGESSDNRPDQINENTHGTFEEPEVDPDEDRLYEQARQLEYGDWNYPVITASEPLRERYRSPGSFGGRSAYNSPSVRSPAAEYPPNNKGKQRSSAHTPARTPRVEPQAESVVPIKKKKKPKKVVKHDEPDPNKLGLNKGPPAPVETVQVGGHDGQASPGNNESRTLNDGEDQSEHQTTSNYESHHGIDEEEFRNVWGRDEESR

SEQ ID NO: 4410 - protein, 252 aa, Helianthus annuus
QYGRETRHTGDYENPIHSTGGQYEQEVLQTDEYGNPVRRTGQTDEYGNPVRRTDEYGNPVHSTTGGTMGDYGSTGLGQGTGTGGTGTGGYGTTGHHGLGTGIGHTTGGTGTDYTSGGRSTGQTGYQGLGTESEFGGKTGTFQNQPSATPVGGVGLSSGTGAGVGGTGTGTGILHRSGSSSSSSSEDDGQGGRRKKKGVMQKIKEKLPGGHRQEEQYQSQTTTTTTGGGAGYGETHEKKGMMEKIKEKLPGHH

SEQ ID NO: 4411 - protein, 175 aa, Triticum aestivum
MAPTVMASSATSVAPFQGLKSTVGLPVRRRSISAGLSRVSNGGRIRCMQVWPIEGIKKYESLSDLPPLSTEALLKQVDYLIRSKWVPCLEFSKVGFVSREHNRSPGYYDGRYWTMWKLPMSGCTDATQVLNEVEEVKKEYPDAYVRVIGFDNLRQVHCVTFIAFRPPGSEESDKA

SEQ ID NO: 4412 - protein, 252 aa, Helianthus annuus
QYGRETRHTGDYENPIHSTGGQYEQEVLQTDEYGNPVRRTGQTDEYGNPVRRTDEYGNPVHSTTGGTMGDYGSTGLGQGTGTGGTGTGGYGTTGHHGLGTGISHTTGGTGTDYTSGGRSTGQTGYQGLGTESEFGGKTGTFQNQPSATPVGGVGLSSGTGAGVGGTGTGTGILHRSGSSSSSSSEDDGQGGRRKKKGVMQKIKEKLPGGHRQEEQYQSQTTTTTTGGGAGYGETHEKKGMMEKIKEKLPGHH

SEQ ID NO: 4413 - protein, 387 aa, Zea mays
  misc_feature (140)..(140): Xaa can be any naturally occurring amino acid
  misc_feature (153)..(153): Xaa can be any naturally occurring amino acid
MAQKDKAVAGLTKGIEGLFKKNKVTYVKGFGKLSSPSEVSVDLIDGGSTIVKGKNIIIATGSDVKSLPGITIDEKKVVSSTGALCLSEIPKKLVVIGAGYIGLEMGSVWNRLGSEVTVVEFAPDIVPSMDGEVRKQFPVXHSRLEKQKFKFMXLKTKVVGCDTSGDGVKLTLEPAAGGEQTILEADVVLVSAGRSPFTSGIGLETLGVETDKAGRILVDKRFMTNVKGVYAIGDAIPGPMLAHKAEEDGVACVEFIAGKEGHVDYGTVPGVVYTHPEVASVGKTEEQVKALGIAYNVGKFPLLANSRAKAIDDAEGVVKVIAEKETDKILGVHIMAPNAGEIIHEAVVALQYGASSEDVARTCHAHPTVSEALKEACLQTFDKAIHI

SEQ ID NO: 4414 - protein, 252 aa, Helianthus annuus
QYGRETRHTGDYESPIHSTGGQYEQEVLQTDEYGNPVRRTGQTDEYGNPVRRTDEYGNPVHSTTGGTMGDYGSTGLGQGTGTGGIGTGGYGTTGHHGLGTGVGHTTGGTGTDYTSGGRSTGQTGYQGLGTESEFGGKTGTFQNQPSATPVGGVGLSSGTGAGVGGTGTGTGILHRSGSSSSSSSEDDGQGGRRKKKGVMQKIKEKLPGGHRQEEQYQSQTTTTTTSGGAGYGETHEKKGMMEKIKEKLPGHH

SEQ ID NO: 4415 - protein, 381 aa, Gibberella zeae PH-1
MLAIRALRTPASRQALRTAAPRAAIFYNRCYSTSGDRVAKYNGTKDAKGNFLVSLIEGDGIGPEIAQSVKDIFAAAKTPIAWEPVDVTPIIKDGKTAIPDAAIDNIKKNKIALKGPLATPIGKGHVSLNLTLRRTFNLFANLRPCRSVAGYETPYDNVNTVLIRENTEGEYSGIEHVVVDGVVQSIKLITREASERVLRFAFQHAESIGRKKVRVVHKATIMKLSDGLFLKVAQEVAKDFPGIEFDAELLDNSCLKMVTDPTPYNDKVLVMPNLYGDILSDMCAGLIGGLGLTPSGNIGDECSIFEAVHGSAPDIAGKNLANPTALLLSSIMMLRHMGLNEHATRIEKAIFDTLAEGKALTGDLGGKAKTNEYAAAIISRL

SEQ ID NO: 4416 - protein, 252 aa, Helianthus annuus
QYGRETRHTSDYESPIHSTGGQYEQEVLQTDEYGNPVRRTGQTDEYGNPVRRTDEYGNPVHSTTGGTMGDYGSTGLGQGTGTGGIGTGGYGTTGHHGLGTGAGHTTGGTGTDYTSGGRSTGQTGYQGLGTESEFGGKTGTFQNQPSATPVGGVGLSSGTGAGVGGTGTGTGILHRSGSSSSSSSEDDGQGGRRKKKGVMQKIKEKLPGGHRQEEQYQSQTTTTTTGGGAGYGETHEKKGMMEKIKEKLPGHH

SEQ ID NO: 4417 - protein, 212 aa, Triticum aestivum
TRHHKPKVLLDKIAYWTVKSLRVPTDIFFQRRYGCRAMMLETVAAVPGMVGGMLLHLRSLRRFEQSGGWIRALLEEAENERMHLMTFMEVAKPKWYERALVLAVQGVFFNAYFLGYIVSPKFAHRVVGYLEEEAIHSYTEFLRDLEAGRIENVPAPRIAIDYWRLPADARLKDVVTVVRADEAHHRDVNHFAADIHFQGLELNKTPAPLGYH

SEQ ID NO: 4418 - protein, 1080 aa, Aspergillus oryzae
MDELFDVFEDQPQAVKPSDGAPKRPKKDKSKKRQVNGDVKESGATVEAKEPVAVVDTPVEETSEPEEGDAPTTDNNEQPDAKRPRLEKEPEPVVADLFETAQEREVAGSAGLQAANDSASVVLSHQIRHQVAIPPNYPYVPISEHKPPENPARVWPFTLDPFQQVSIASIQREESVLVSAHTSAGKTVVAEYAIAQSLKNNQRVIYTSPIKALSNQKYREFAAEFGDVGLMTGDVTINPTATCLVMTTEILRSMLYRGSEIMREVAWVVFDEIHYMRDATRGVVWEETIILLPDKVRYVFLSATIPNAMQFAEWIVKMHNQPCHVVYTDYRPTPLQHYFFPAGADGIHLVVDEKGVFREENFQKAMSTIADKKGDDPADAMAKRKGKGKDKKLNKGKNKGPSDIYKIVKMIMIKNYNPVIVFSFSKRECESGALQMSNLAFNDDSEKEMVSKVFNSAIEMLSEEDRNLPQIQNILPLLRRGIGVHHSGLLPILKETIEILFQEGLIKVLFATETFSIGLNMPAKTVVFTSVRKFDGFSQRWVTPSEFIQMSGRAGRRGLDDRGIVIMMVGEEMDPAVAKEIVRGEQDRLNSAFHLGYNMILNLMRVEGISPEFMLERCFYQFQNTAGVATLEKELAELEEKRANMTISDEGTIREYYDLRKQIRQFTDDMQAVISHPNYCLPFIQPGRLISIKHKDVDFGWGVVVNYKQRKAPKNSTEEPTPYQKYVVDVLLRIADGPSVGTKTFEDLPSGVRPPKEGENSRMEVVPVVLSCLQSISHIRIFLPKDLHSADSRNGVKKALDEVQKRFPDGIAVLDPIENMNIKDDNFKKLLRKIEVLESRLLSNPLHNSPRLPELYEQYSDKVETGSKIKATKKKISEAMSIMQLDELKCRKRVLRRFGFINEAEVVQLKARVACEISTGDELMLSELLFNGFFNNLTPEQVASVLSVFVFEEKSKETPALTRDELAKPLKEIQAQARIVAKVSQESKLAVNEEEYVQSFHWELMEVIYEWANGKSFVDICKMTDVYEGSLIRVFRRLEECLRQMAQASKVMGSEELESKFETALTKVRRDIVAAQSLYL

SEQ ID NO: 4419 - protein, 368 aa, Haemophilus ducreyi
AVTPTCPIAAMSDEKRRFYGVQFHPEVTHTKSGLALLTNFVENICGCARSWTPENIIEDAVAKIKQKVGNDQVILGLSGGVDSSVTALLLHRAIGKNLHCVFVDNGLLRLNEGDQVMEMFGDKFGLNIIRVNAEERFLEALKGIDEPEAKRKIIGKVFIDIFDDEAKKLTDVKWLAQGTIYPDVIESAASKTGKAHVIKSHHNVGGLPDYMKLGLVEPLRELFKDEVRKIGLTLGLPAEMLNRHPFPGPGLGVRVLGEIKKEYCDLLRNADAIFIEELYKSGWYYKVSQAFTVFLPVKSVGVMGDGRKYDWVVSLRAVETIDFMTAHWAHLPYELLGKISNRIINEVNGISRVVYDVSGKPPATIEWE

SEQ ID NO: 4420 - protein, 776 aa, Arabidopsis thaliana
MDVPEETRLRHKRDFIQFLDSMYMEEIKALVHQKRHRLIINISDIHHHFREVASRILKNPNEYMQSFCDAATEATRAIDPKYLKEGELVLVGFEGYFVSRVVTPRELLSDFIGSMVCVEGIVTKCSLVRPKVVKSVHFCPSTGEFTNRDYRDITSHAGLPTGSVYPTRDDKGNLLVTEYGLCKYKDHQTLSIQEVPENAAPGQLPRSVDVIAEDDLVDSCKPGDRVSVFGIYKALPGKSKGSVNGVFRTILIANNIALLNKEANAPIYTKQDLDNIKNIARRDDAFDLLARSLAPSIYGHAWIKKAVVLLMLGGVEKNLKNGTHLRGDINMMMVGDPSVAKSQLLRAIMNIAPLAISTTGRGSSGVGLTAAVTSDQETGERRLEAGAMVLADKGIVCIDEFDKMNDQDRVAIHEVMEQQTVTIAKAGIHASLNARCSVVAAANPIYGTYDRSLTPTKNIGLPDSLLSRFDLLFIVLDQMDAGIDSMISEHVLRMHRYKNDRSEAGPDGSLPYAREDNAESEMFVKYNQTLHGKKKRGQTHDKTLTIKFLKKYIHYAKHRITPKLTDEASERIAEAYADLRNAGSDTKTGGTLPITARTLETIIRLATAHAKMKLSSEVTKADAEAALKLMNFAIYHQELTEMDDREQEERQREQAEQERTPSGRRGNQRRNNEDGAENDTANVDSETADPMEVDEPSVEQFSGTVSAARIETFERVFGQHMRTHRLDDISIADIETVVNNNGVGASRYSADEIMALLEKLQDDNKVMISDGKVHII

SEQ ID NO: 4421 - protein, 406 aa, Pseudomonas fluorescens Pf-5
MPGVWAILGDLRAAVVRTAQQGILMIISKLPNVGTTIFTQMSQLAVETGALNLSQGFPDFDGPQALRDALGWHAANGHNQYAPMTGLPALRQQVAAKIARSYGVQVDADAEVTITPGATQAIFCAIQAVIQRGDEVIVFDPSYDSYEPSVELAGGRCVHVPLAGQGFALDWQKLGEALSPRTRMIILNSPHNPSGALISRAELDQLAALIRDRDIYLVSDEVYEHLVFDGVPHVSVLAHEELYQRAFVVSSFGKTYHVTGWKTGYVVAPPALSAELRKVHQYVSFCGVTPLQYALADFMAEHPEHVEELPAFYQAKRDLFCDLLSASRFSFNRVSGTYFQLVDYSQIRPDLNDVDMAIWMTREHGVAAIPVSVFYQQPPQGQRLVRLCFAKREETLRQAAEKLCVI

SEQ ID NO: 4422 - protein, 291 aa, Sulfolobus tokodaii str. 7
MITVVGSYNVDFILKVDEFPNEGETVFAKEIYINHGGKGSNQAVSASRLKAKVRIIAAVGNDEFGKNAIRFWEDEGIDTAYVKIKNSVTGSAYIIVNSRGENVIVVNRGANALLNEEDIDNALSGDILLTQLEIDEKVVKKALKEFNGIKILNPAPAILKDFSILDYVDILTPNEIEFKELTNTDDIDSGIQLLLKKVKKAVIITLGERGALIATKHEKILVPTIKVNPIDTTGAGDVFNAALAVYLERNYDLRTAVRIANKLASYSTTIIGALGPRYEEVKNLIEEENEN

SEQ ID NO: 4423 - protein, 570 aa, Oryza sativa (indica cultivar-group)
MGGSHSREDLDLSDSEDDDSASHASDASSDFATPPPSSSAKPSAAKSSAAAATPASIDAIDRHLRSLHLKVGPELQLKTFPAQRRVDFVADGVWALKFLHADGYPNFYAKYQSCLFENSYGVAATDEGRAKVFGKDFAAWARPEDGDESIWEDATDGFVPSPSRSPMPSRSPILKPLMEDLREYEEPVEEGGGIQSLALGALDNSFLVGDSGIQVVRNFEHGIHGKGMSVKFSGGSTNFSTPKKALLMRAETNMLLMSPATDGKPHAKGVHQLDIETGKVVSEWKFGKDGADINMRDITNDSKGAQMDPSESTFLGLDDNRLCRWDMRDRRGIVQNIASATESPVLQWTQGHQFSRGTNFQCFASTGDGSIVVGSLDGKIRLYSKSSMRMAKTAFPGLGSPITHVDVTYDGKWILGTTDTYLILICTIFIDKDGKEKTGFGGRMGNRIAAPRLLKLTPLDSHLAGQNNIFREGRFSWVTENGKQERHLVATVGKYSVVWNFLQVKNSHHECYQCQEGLKSCYCYKVIPKDESIVASRFMHEKYAVSDTPEAPLVVATPMKVTSFSISSKH

SEQ ID NO: 4424 - protein, 400 aa, Chlorobium tepidum TLS
MNTPAINLETEKQLFFHNYARLPLDIASGKGSFLYTASGERYLDMIAGVGVNAIGYGDKRLEQAITEQASKYIHVSNLFMQKPQFDLAAKLLEISRMSKVFFCNSGTEAIEAAIKLARRFAARNGDTDKTQVLSLTNCFHGRTYGALSLTAKPKYVDGFEPLVPETGMIDFNDVEDLERKVSNRTAAVFVEFVQGEGGIHKVSEAFIAKLKELAKEHDFLIVADEIQAGCGRTGAFFSYMPFDIQPDLVCVAKPLGGGLPLGAIIGSEKVAEVFTPGSHGTTFGGNPVACAAGLAMIEAILADGLMQNALEVGSMMRTAFEKMAEKHAQILEIRQYGLMIGVTVHREAKYYVEEALKRGVLVNATSNNVIRLLPPLSISKEEAQLCLDTLDAIFTEEAKA

SEQ ID NO: 4425 - protein, 430 aa, Chlorobium tepidum TLS
MKKKVVIVGGGFTGLNTARILSNRKDVEVTLIDRKNYHLFQPLLYQVAMAALGEGDIATPLRNMLAGYDNVTVFKGNVCNVDLEQKKVKTDFGDIEYDYLVLACGAQHHYFGKNDWEEHAPGLKNLAQASEIRRRVMEAYEAAERTNDMKERKKQLTFVIVGGGPTGVELAGSIGEMSRYTLSKFYRHIDPKLTRIFIVEAAERILGTFSPELSSKATRELEKLGVQVWTSSMVSDVDADGVQIGRERIEAATVLWAAGVKASEIGQNMGVQTDRSGRIMVEADLSLPGHPEVFVGGDQACYTLENGSTLPGMAPVAMQEGKAIGRMILDDLKGKPRKPFKYRDKGQMATIGRNRAIVEIGNLKFDGAIAWFTWLLVHIYYLSTFKHRVFVLMQWAWSYFTFGYGARLIVNKDWRFYREQKSSPCDDKKA

SEQ ID NO: 4426 - protein, 502 aa, Pseudomonas aeruginosa PAO1
MTMTFQHDDLPLALYSAAQVRDLDARLIAAGTPGFELMQRAAHAAWRALRRRWPEAAALTVLAGHGNNAGDGYLIAALAQRAGWRVRVLAVAAPQRLAGDAAQAHAAALATGVVVEPWSECAVLEGVVVDALLGTGLAGAVREPFAQAIRLANAADLPVLAVDIPSGLSADTGAVLGEAIRADLTVTFIGLKIGLFTGEAPARVGELVFDELGSDAVVLQGLQPRAHRLARNALPSLAARPRTAHKGLFGHLLVVGGDTGMGGAVLLAAESALRCGAGLVSAATRVEHVPALLSRCPEVMAHGVASANQLLALAERASVLVLGPGLGQRAWGRSLLSAVRSRPLPQVWDADALNLLALEPVGAGPRTWILTPHPGEAARLLGRSTAEVQADRPAAALELARRYQAVVVLKGAGSLVAAPDGRLAVCSQGHPAMAGAGLGDVLSGITGALLAQRVEAFEAACLAVWLHAAAGERLGAQGRGLAATDLIPTVRQLLEECSPCLK

SEQ ID NO: 4427 - protein, 363 aa, Oryza sativa (indica cultivar-group)
MKLTVKTLKGTQFEIRVQPNDTIMAVKKIIEEIQGKDSYPWGQQLLIHNGKVLKDESTLEENKVSEVGFLVVMLSKSKASGSSGALSSLTSSTPLTRQETPADASRAAPQPLVAPTRTPQPERPPAEAPSNAYGQAASNLLSGSNLDTTINQLMEMGGGSWDRDKVQRALRAAYNNPERAVEYLYSGIPITAEVAVPAGGQGANTTEPSSTREASLSGIPNASPLNLFPQHTLSSFVLEQRTTLYGFQALREMVHTNPQILQPMLQELSKKNPQLLRLIQENHDEFLQLINEPFDGADGDFLDQPDQDEMPHSINVTPEEQEAIGRLEGMGFDRARVIEAFFACDRNEQLAANYLLEHAADED

SEQ ID NO: 4428 - protein, 462 aa, Frankia sp. EAN1pec
MVGSVPDVPWKSAGGDRPGVSRVVVVGGGFAGVSLLRRLESALPAGRAELAVVSPVDHLLYTSLVPQVCASTVEPRHLAVALRAVLRRTLLRLGDVVAADLSARTVTVRSADAATRTVGWDRLVLAPGSVTRTLDVPGLDEHALGLKNLDEAVALRDHVLRRLELADAADDPRRRAALCTFVVVGGGYTGTELAAQMVGFTRHAAAAYQRLRPSDVRWLLVDHAPRVLHELAPALGHRAARVLAGRGVEVHLGTSVVEIGAEAVTLAAGGPTVRTRTSVPTHTVVWCAGVSPSPLVAALGLPTTHGRLIVDEFFRVPTADGVFALGDAAAVPDVTRGGAPAGQTAQHAIRQGRAAARNVAASLGYGSPRRYRHRDLGFVVDLGGRAAVANPFGLTLSGPPAALLTRAYHLAALPAGANRVRVATDWVLNSVLGQEITHFDESVPGRAEIATSEHTRIYQPTR

SEQ ID NO: 4429 - protein, 490 aa, Mycobacterium sp. MCS
MAGRWRTKSVEQSIADTDEPGTRLRKDLSWWDLTVFGVSVVIGAGIFTITASTAGNLTGPAISISFVLAAIACGLAALCYAEFASTVPVAGSAYTFSYATFGEFVAWIIGWDLILEFAVAAAVVAKGWSSYLGTVFGFGGGVANFGGFEVDWGALVIIAVVTLLLARGTKLSAEVSLIITVIKVAVVLLVVIVGSFFIKAANYSPFIPPAESGEGGTGTEQSLFSLITGAEGSAYGWYGLLAGASIVFFAFIGFDIVATTAEETKNPQRDVPRGILSSLAIVTVLYVAVAVVLSGMVSYTELRDAGSGANLATAFAANGVDWAATVISIGALAGLTTVVIVLMLGQTRVLFAMSRDALLPRQLAQTGEHGTPVRITVIVGVVVAVAATVFPIGKLEEMVNIGTLFAFVLVSAGVIVLRRTRPDLKRGFKAPFVPLLPIAAIIACVWLMLNLTGLTWIRFLIWMAIGVVVYFLYGRRHSLVGRREQEAVTE

SEQ ID NO: 4430 - protein, 891 aa, Glycine max
ITNMLTWWGKSSSKETKKKANKESFFDTLHRKLRISSKGKVSIRSGGSRRHCNDTISEKGDHSPCGSRSPSPSKVARCQSFIDRPHAQPLPLPGLHPSSVGRVDSEISISSKSRLEKVSKPLSFLTLPTPGCIRCRPNPADLDGDMVTASVFSDCSADSDEPADSHNRSPLAIDCETGTRTAAGSPSSLMLKDQPPAVSQLNSTGVKKPGNILSNHMSSTSPKRRPLRNHVPNLQVPPHGAFYSAPDSSLSSPSRSPLRAFGTDQVLNSAFLAGKPYPEINFVGSGHCSSPGSGHNSGHNSMGGDMSGPLLWQPSRGSPEYSPVPSPRMTSPGPSSRIQSGAVTPIHPKAGGTPTESQTHRLPLPPLSVSNSSLFSHSNSAATSPSMPRSPARADNPNSGSRWKKGKLLGSGSFGHVYLGFNSERGEMCAVKEVTLFSDDPKSMESAKQFMQEIHLLSRLQHPNIVQYYGSETVDNKLYIYLEYVSGGSIHKLLQEYGQFGELVIRSYTQQILSGLAYLHAKNTLHRDIKGANILVDPTGRVKLADFGMAKHITGQSCLLSFKGTPYWMAPEVIKNSNGCNLAVDIWSLGCTVLEMATTKPPWFQYEAVAAMFKIGNSKELPTIPDHLSNEGKDFVRKCLQRNPYDRPSACELLDHPFVKNAAPLERPILAPEVLDPVSGIIQGAKALAAGQGKNLSSLDSDRLSIHSSRFLKTNPRESEIHIPRNISCPVSPIGSPLLRSRSPQHRNGRMSPSPISSPRTASGASTPLAGGSGAIPFGNHSKQPIYFQEGFGSIPKSSNGVYINGHSHHDSSVDIFRGMQIGSHIQPELVSSENDVLVNQFARHPHAEPYDFQSVLADRVGRQLLREHVKINPSIDLSPNSSLLSRPNGL

SEQ ID NO: 4431 - protein, 460 aa, Yersinia pestis KIM
MTGYLMETTLMTKHYDYLAIGGGSGGIASINRAAMYGKKCALIEAKQLGGTCVNVGCVPKKVMWHAAQIAEAIHLYGPDYGFDTTVNHFDWKKLIANRTAYIDRIHQSYERGLGNNKVDVIQGFARFVDAHTVEVNGETITADHILIATGGRPSHPDIPGAEYGIDSDGFFELDEMPKRVAVVGAGYIAVEIAGVLNGLGTETHLFVRKHAPLRTFDPLIVETLLEVMNTEGPKLHTESVPKAVIKNADGSLTLQLENGTEVTVDHLIWAIGREPATDNLNLSVTGVKTNDKGYIEVDKFQNTNVKGIYAVGDNTGVVELTPVAVAAGRRLSERLFNNKPDEHLDYSNIPTVVFSHPPIGTIGLTEPQAREKFGDDQVKVYTSSFTAMYSAVTQHRQPCRMKLVCVGAEEKIVGIHGIGFGMDEILQGFAVAMKMGATKKDFDNTVAIHPTAAEEFVTMR

SEQ ID NO: 4432 - protein, 673 aa, Fulvimarina pelagi HTCC2506
MRLPRKLTAMLDKPSPETTDRNPRDMANAIRALAMDAVQKANSGHPGMPMGMADVATVLFQKFMRVDPSKPNWPNRDRFVLSAGHGSMLLYAIHHLLGYEDMPIEQIKNFRQLGSRTAGHPEYGHAAGIETTTGPLGQGLATSVGMAIGERLMNARFGDDLVDHYTYVIAGDGCLMEGISHEAIDLAGTLKLKKLIVLWDDNGISIDGKVEIASKTDQVARFEAAGWKTFSVDGHDADAVEKAIEDARQSDRPAFIACKTVIGYGAPNKAGTHKVHGEALGDDEIALARQKLVWKSEPFELPEAVVKGWREVAAKGRDSRETWERKLADHPERDRYEVFSSGTLPAGFKGEMLNFRAALIQDKPKVATRKASEMTLEVVNHVIETTIGGSADLTGSNNTKTKGLQPVTAEDFSGRYIHYGVREHGMSAAMNGLSLYGGLIPYGGTFLVFSDYARGAMRLSALMGTRVIYVLTHDSIGLGEDGPTHQPVEHLTMLRATPNLLVFRPCDVIETVEVWEAALLEHDRPSVLALTRQGLPTVREDISENLSLKGGYVLKEAAGERDVTLIASGSEVEVALKAAEALKGEGLNAAVVSMPCMELFAEQDDTYRASVLGSVPRVAIEAGVRMSWDRWLGDRGRFVGMTGFGASGPGPKLFEHFGITPDKVVQAAKDAAA

SEQ ID NO: 4433 - protein, 345 aa, Fulvimarina pelagi HTCC2506
MPSSLDAHLRSALDADEGQRRIAEAIRHLCTASVKVRNQIIEGGSNLGEQRGDTNTDGDVQKELDVLADRAFLQAAKDSGFMFFGSEEQEGPVTLDENGDFAIAIDPLDGSSNISTNVSIGTIFSILPVSDANRADPKTVFMQKGANQLAAGFFVYGPQLQLVLTVGDGTHVFLFSPKFGGFVEQTASVTIADKAKEFSVNMSNYRHWDTHIRNYVDDLLAGEEGPRERDFGMRYVGSLVADAYRILQRGGVFLYPSDGRKGYQNGRLRLMYEANPVAMLVEQAGGAATDGTTRILDIEPEGLHVRTPLVFGSKREVERIGRYIADPDALAERSPLFGKRTLFRP

SEQ ID NO: 4434 - protein, 268 aa, Triticum aestivum
MDVADIASPSGQQEQGHRTVSSEPPKRPAGRTKFHETRHPLYRGVRRRGRVGQWVCEVRVPGIKGSRLWLGTFNTAEMAARAHDAAVLALSGRAACLNFADSAWRMLPVLAAGSFGFGSASEIKAAVAVAVVAFQRKQIIPVAVAVVALQQQQVPVAVAVVALQQKQVRVAVAVVALQQLQVPVAVAVVALQQQQIILPVACLAPEVYMSSGDLLELDEEQGFGGMDPGSYYPSLAQGILVAPPDEKPRPKHGEQRGSRTPLWSCLAP

SEQ ID NO: 4435 - protein, 239 aa, Robiginitalea biformata HTCC2501
MNKTASESEALLDELAAKLPDCSAEVMVAPVFVNLAEAVRRLEHSKIEAIAQNMHFADSGAYTGEVAADMLLGIGVDTVILGHSERRAYFGEDDDLLAKKVGQAIEKGMRTIFCFGEELKDRQAGKHFEVVESQLKNALFQLPEEAWGRIVLAYEPVWAIGTGETASPEQAQEMHAFIRKIVSDAYTDAVAQKVSILYGGSVKPGNAAEIFSKPDVDGGLIGGASLKADDFVAIIKAIG

SEQ ID NO: 4436 - protein, 462 aa, Geobacillus kaustophilus HTA426
MEQKQPQLHRGLEERHISLMSLGAAIGVGLFLGSASAIEMAGPAILLGYAVSGAIMFFIMRALGEMAVEHPVAGSFSRYAYQYLGPLAGYLTGWNYWFLWVVTCIAEITAVGIYMQFWFPDTPRWAWALAALVLMTFINFLAVKAYGEFEFWFALIKIVTIVAMIIIGLGMILFGIGNGGVATGISNLWKHGGFFPHGISGVLMSLQMVMFAYLGIEMIGVTAGEVKNPQKSLTKAINSVFWRILIFYVGALFVIMSIYPWNEIGEKGSPFVLTFEKIGIHAAAGIINFVVLTAALSSCNSGIFSTSRMLFNLAEQQEAPSAFGRLTKRGIPGAALIATALVMLVGVYLNYVSEKVFQWVTSIATFGAIWTWAVILLSQLKFRKQLSAEQAQRLTFKLPLYPYSSYVSLAFLIGVAALMAYFPDTRIALIIGPAWLLLLTAVYFAKGMHRRQHGQAEEKQAG

SEQ ID NO: 4437 - protein, 448 aa, Yersinia pestis KIM
MMNGLVSLESFLESLQRRDANQPEYLQAVREVFTSLWPFLEQNPHYREQSLLERLVEPERVIQFRVAWTDDKGHVQVNRAWRVQFSSAIGPYKGGMRFHPSVNLSILKFLGFEQTFKNALTTLPMGGGKGGSDFNPKGKSQAEVMRFCQALMTELYRHLGPDTDVPAGDIGVGGREVAFMAGMMKKLSNNTACVFTGKGLSFGGSLIRPEATGYGLVYFTDAMLKRHGLGFEGRKVSVSGAGNVAQYTIEKAMELGAKVVTASDSGGTVVDEVGFTPEKLAHLAEIKNKRYGTIEDYARERNLVYLAGQQPWSVPVDIALPCATQNELDLPAALQLIANGVKAVAEGANMPTTIQATDAFLEAGVLFAPGKAANAGGVATSGLEMAQNAARMSWKSEKVDVRLHHIMLDIHQSCVEYGGEGKQTHYVHGANIAGFVKVADAMLAQGVL

SEQ ID NO: 4438 - protein, 176 aa, Solanum tuberosum
MFFCSDLLCFGCYFVDLFGSDVIVMVFISIFQIINDRETGRSRGFGFVTFKDEQAMRDAIEGMNGQDLDGRKITVNEAQSRGGGGGGGGGGRGGGGYVRWRREGGGGGYGGGGGYGGGRREGGGGGGYSGGGGGYGGGRREGGYGGGGGGYGGGDRYSDRSSRGGGGGSSDGNWRS

SEQ ID NO: 4439 - protein, 382 aa, Pseudomonas fluorescens Pf-5
MTASIGKTNLLGLTQPEMEKFFDSIGEKRFRAGQVMKWIHHFGVDDFDAMTNVGKALREKLKAVAEIRGPEVVSEDISSDGTRKWVVRVASGSCVETVYIPQGKRGTLCVSSQAGCALDCSFCSTGKQGFNSNLTAAEVIGQVWIANKSFGSVPATVDRAITNVVMMGMGEPLLNFDNVIAAMHLMMDDLGYGISKRRVTLSTSGVVPMIDELAKHIDVSLALSLHAPNDALRNQLVPINKKYPLKMLLESCQRYMSALGEKRVLTIEYTLLKDVNDKLEHAVEMIELLKDVPCKINLIPFNPFPHSGYERPSNNAIRRFQDQLHHAGFNVTVRTTRGEDIDAACGQLVGQVLDRTRRSERYIAVRELSADADMPQSAATRT

SEQ ID NO: 4440 - protein, 305 aa, marine gamma proteobacterium HTCC2143
MAHAKKFGSRTDSDQVLDGLDLTGKKVVVTGANTGIGYETARSLAVAGAEVVVACRSEDKGKSAVDAIQKCHNDVRVEFKKLDLSSIESVKAFSENLSWDTIDVIIGNAGLVPTNYQQTDEGIEQCVGVCHFGHFALCKLLLPRLLKSKDPRVVMVSSESHRAPKKLNFKKFPLTKTNFAVFTAYGQAKLCNVLFVNELQRRFGDQGLNACSLHPGTLITTDIGRNSGLFSLLMTLISPLTKTPNQGASTTVYCAAYINGKDMQGAYFSHCKRGKSSAEANDPEVAKHLWDISEAFCEEHNVANI

SEQ ID NO: 4441 - protein, 141 aa, Pseudomonas fluorescens Pf-5
MAVQRTFSIIKPDAVAKNVIGKIVSRFEEAGLRVVASKMKQLSKAEAEGFYAEHSERGFFGELVAFMTSGPVVVQVLEGENAIVRNRELMGATNPKEAAAGTIRADFAESIDANAVHGSDSEAAAAREIAYFFAATEVTAR

SEQ ID NO: 4442 - protein, 294 aa, Anabaena variabilis ATCC 29413
MGDFGTVLTAMITPFKADGSVNYAVAAELAAHLVDNGTDTLVVCGTTGESPTLSWDEEYNLFVEVLQTVAGKAKVIAGCGSNSTKEAIAATQKAAKIGVHGTLQVVPYYNKPPQAGLYQHFQAIAQACPDLPLLLYNVPGRTGQNLSPETVVRLAEIDNIIGVKEASGNLDQAGEIRRSTPKEFQIYAGDDSLTLPLLAIGAKGVVSVASHLVGNQLQQMIQAFNSGQVTVASDIHLRLLPLFKALFITTNPIPIKQALKLQGWEVGSTRPPLSDADAEVSQKLEAVMKHLNLI

SEQ ID NO: 4443 - protein, 634 aa, Arabidopsis thaliana
MGCAPMSHILYDEVMKYNPKNPYWFNRDRFVLSAGHGCMLQYALLHLAGYDSVREEDLKSFRQWGSKTPGHPENFETPGVEATTGPLGQGIANAVGLALAEKHLAARFNKPDNEIVDHYTYSILGDGCQMEGISNEVCSLAGHWGLGKLIAFYDDNHISIDGDTDIAFTESVDKRFEALGWHVIWVKNGNNGYDEIRAAIREAKAVTDKPTLIKVTTTIGYGSPNKANSYSVHGAALGEKEVEATRNNLGWPYEPFHVPEDVKSHWSRHTPEGAALEADWNAKFAAYEKKYPEEAAELKSIISGELPVGWEKALPTYTPDSPGDATRNLSQQCLNALAKAVPGFLGGSADLASSNMTMLKAFGNFQKATPEERNLRFGVREHGMGAICNGIALHSPGFIPYCATFFVFTDYMRAAMRISALSEAGVIYVMTHDSIGLGEDGPTHQPIEHLSSFRAMPNIMMFRPADGNETAGAYKIAVTKRKTPSVLALSRQKLPQLPGTSIESVEKGGYTISDNSTGNKPDVILIGTGSELEIAAQAAEKLREQGKSVRVVSFVCWELFDEQSDAYKESVLPSDVSARVSIEAGSTFGWGKIVGGKGKSIGIDTFGASAPAGKLYKEFGITIEAMVEAAKSLI

SEQ ID NO: 4444 - protein, 556 aa, Borrelia garinii PBi
MNTSLFQQERKKYVPKLPNILKKDFKNISLVYGEKTEAIQDRQALKEFFKNTYGLPIVSFTEGESSNLSFSKALNIGIILSGGPAPGGHNVISGIFDAIKKFNANSKLFGFKGGPLGLLENDKIELTESLVNSYRNTGGFDIVSSGRTKIETEEHYDKALLVAKENNLNAIVIIGGDDSNTNAAILAEYFKKKGENIQVIGVPKTIDADLKNNHIEISFGFDSATKIYSEMIGNLCRDAMSTKKYWHFVKLMGRSASHVALECALKTHPNICIVSEEVLAKKKTLFEIVDEMVFVILKRSLNGDNFGIVIVPEGVIEFIPEVKSLMVELCNIFDKNIVEFKGLNIEGMKEVFVAKLSDYMKKVYLSLPLFIQFELVNSILERDPHGNFNVSRVPTEKLFIEMVQARLSEMKKRGEYKGSFIPVDHFFGYEGRSAFPSNFDSDYCYSLGYNAAILILNGLTGYMSCIKNLNSKPTDWIAGGVPLTMLMNMEERYGVQKPVIKKALVDLEGRPFKEFVENRDKWAFNNLYLYPGPVQYFGSSEIVDEITETLKLELLK

SEQ ID NO: 4445 - protein, 339 aa, Sulfolobus tokodaii str. 7
MKAVLLENGKVVIKEIPKPIIKDKGDVIVKMKACGLCGTDVEKICGQYTASQPILGHEPAGIIDESSVDFLKSGQRVFAHHHVPCYECYYCTHGSPTMCPYYRKTNLDPGGFAEYFRVPAWNVIRGGILILPDSVSFDEGAFIEPLATVVRAQRRVKINKGDSVLVVGAGPMGLLHVMMAKANGASTVITSDVSDFRIEYATKVGADYSLNARKTDIPSEVKKLTDGRGADVAIIASGSPSAILSGLLSVRKGGYVLLFGVPYKGTVLNYDISELLNNEISIISSNAAVEEDTKEALKLIYERKVDVKKLITHRFPLDEFNEAVRVAKQGEAIKVIIYD

SEQ ID NO: 4446 - protein, 370 aa, Sulfolobus tokodaii str. 7
MSFDPQKFVDEISPQLKEIVDGRAIAAVSGGVDSTTAAVLSYKILGDKVIPVMIDTGFLRENEAENVKNMLKDLMPLQVIDEREKFISSLEGMSDAEEKRKKFRQLFYDTLSRIVKEFNAKYLIQGTIAADWVETQGGIKTQHNVLVQLGIDTEKEWGFKVVEPLADLYKDEVRALAKYLGLPRDIYNRQPFPGPGLLVRVVGKLTREKLEILRKVTTTVEKNLSELNLSQYFAVIFDSAAEYNKELSNEVGCDVKVYKTLATGVKGDVRAYGNIAGIECRKDYESLREIMEKLTSYNITHVVVKIKDKNPEGIYTIGIRAVNTQDFMTADFAKINWNILEKIANEINDKKIKEVVYDITTKPPATIEYE

SEQ ID NO: 4447 - protein, 1285 aa, Oryza sativa (indica cultivar-group)
MPSGRPVFVGPCLGRGCSLWAGKARIRMSSKKVPFHRHKENEEARKKREQDEAARVYEEFVESFKGDSTSGSKFVRGGVIDPNAKLRIDSEGGKSKDGGSVPKKGSRYVPSFLPPSFGKEPDKKKEEERPKEKERRKPRVIDEFMEELKFEKELRQKRNQEREQWREGRHTDTSASSSRFDELPDELDPIGKLPGSFDDGDPQTTNLYVGNLSPKVDENFLMRTFGRFGPIASVKIMWPRTEEERRRQRNCGFVAFMNRADGQAAKDEMEGVVVYDYELKLGWGKSVALPSQALPAPPPGHMAIRNKEGGTVILSGPGGPPLASVKPQTSELVLTPNVPDIVVAPPDDAHVRHVIDTMALHVLDGGCAFEQAVMERGRGNSLFSFLFDLKSKEHTYYVWRLYSFAQGSGDSILLEVNCDSKEGDTLQRWRTEPFIMITGSGRWVPPALPSSRSPEREKESTFAAGRSRRVEVERTLTDSQRDEFEDMLRALTLERSQIKEAMGFALDNADAAGEIVEVLTESLTLKETPIPTKVARLMLVSDILHNSSAPVKNASAFRTKFEAALPDVIESFNDLYRSITGRITAEALKERVLKVLQVWADWFLFSDAYLNGLRATFLRSSHSGVIPFHSLCGDTPEIEKKASSEDGSDGFRLNEDGALATGKAAATRELLGLPLAELERRCRHNGLSLCGGKEMMVARLLSLEEAEKERVYEKDAGIKYGQGESHRTGRDDIAVNARNASRPGEGTDSGESDMLGLSHYAMEAGYKRSNESTPAEPVPSKKPKVDPVLPASKWSREDDVSDDEDRKGGRGLGLSYSSGSDIAGDSGKADATEVSTDHSNHHQDTILDEEHRKKLRQIEIAVMQYRESLEEKGLRNTEEIEKKVASHRRRLQSEYGLSFSNDGANSRRSSERTTSERRDRHDDSSRKRHRSLSRSRSPPRRSLERDREHNRNRDTDRSHGNDAGRERDRLINMGIYLSTPKTDKFSEDGENDKLKFGLSSMQGWRASMEDAHSALLNLDNETSFFGVFDGHGGRVVAKFCAKYLHSQVLRSEAYSAGDLGTAVHRAFFRMDEMMRGQRGWRELSALGDKINKIGGMIEGLIWSPRGSYSNNGQDDWSFEEAYNLSRDHKPELEAERDRIVKAGGFIHMGRINGSLNLTRAIGDMEFKQNKFLPPEKQIVTANPDINVVELCDNDDFLVLACDGIWDCMSSQQLVDFIHEHIQKESSLSAVCERVLDRCLAPSTIGGEGCDNMTMVLVQFKKPITQNKKADVGEQSAKGVEEAEIK

SEQ ID NO: 4448 - protein, 85 aa, Triticum aestivum
TPSEESVATLDYSEHLVRVKWIQIEAAKIIRYRLCWSWRMEGVHLLQKSPHLVDQHLESIRGVGWGKYHRPSGLHDTMKVFEVAE

SEQ ID NO: 4449 - protein, 133 aa, Sulfolobus tokodaii str. 7
MEEEIVKEYMKTQVISVTKDAKLNDIAKVMTEKNIGSVIVVDGNKPVGIITERDIVKAIGKGKSLETKAEEFMTASLITIREDSPITGALALMRQFNIRHLPVVDDKGNLKGIISIRDITRAIDDMFETMGEY

SEQ ID NO: 4450 - protein, 397 aa, Bacillus cereus
AMARYKRMQGYNVHYLTGTDEHGQKIQKKAEELNVTPQAYVDNIVAGIKELWEKMDISYDDFIRTTEDRHKDVVEKIFKQLVDQGDIYLDEYEGWYSVQDETFYTEHQLVDPIMEGDKVVGGKSPDRGHDVELVREESYFFRMGKYVDRLLKFYEENPHFIQPESRKNEMINNFIKPGLEDLAVSRTSFDWGVRVPGNPKHVIYVWVDALSNYITALGYGTENEEMYKKFWPADVHLVGKEIVRFHTIYWPIILMALDLPLPKKVFAHGWILMKDGKMSKSKGNVVDPVTLIDRYGLDALRYYLLREVPFGSDGVFTPEGFVERINFDLANDLGNLLNRTVAMIDKYFNGEIPAFKENVTEFDETLVTFAKDTLKKVEEAMENMEFSVALSSIWQLV

SEQ ID NO: 4451 - protein, 410 aa, Bacillus cereus
IGHAYTTVAGDAMARYKRMQGYNVHYLTGTDEHGQKIQKKAEELNVTPQAYVDNIVAGIKELWEKMDISYDDFIRTTEDRHKDVVEKIFKQLVDQGDIYLDEYEGWYSVQDETFYTEHQLVDPIMEGDKVVGGKSPDSGHDVELVREESYFFRMGKYVDRLLKFYEENPHFIQPESRKNEMINNFIKPGLEDLAVSRTSFDWGVRVPGNPKHVIYVWVDALSNYITALGYGTENEQMYKKFWPADVHLVGKEIVRFHTIYWPIILMALDLPLPKKVFAHGWILMKDGKMSKSKGNVVDPVTLIDRYGLDALRYYLLREVPFGSDGVFTPEGFVERINFDLANDLGNLLNRTVAMIDKYFNGEIPAFKENVTEFDETLVTFAKDTLKKVEEAMENMEFSVALSSIWQLVSR

SEQ ID NO: 4452 - protein, 411 aa, Bacillus cereus
HIGHAYTTVAGDAMARYKRMQGYNVHYLTGTDEHGQKIQKKAEELNITPQAYVDNIVAGIKELWEKMDISYDDFIRTTEDRHKDVVEKIFKQLVDQGDIYLDEYEGWYSVQDETFYTEHQLVDPIMEGDKVVGGKSPDSGHDVELVREESYFFRMGKYVDRLLKFYEDNPHFIQPESRKNEMINNFIKPGLEDLAVSRTSFDWGVRVPGNPKHVIYVWVDALSNYITALGYGTANEEKYKKFWPADVHLVGKEIVRFHTIYWPIILMALDLPLPKKVFAHGWILMKDGKMSKSKGNVVDPVTLIDRYGLDALRYYLLREVPFGSDGVFTPEGFVERINFDLANDLGNLLNRTVAMIDKYFNGEIPAFKENVTEFDETLVAFAQDTLKKVEEAMENMEFSVALGSIWQLVSR

SEQ ID NO: 4453 - protein, 418 aa, Bacillus cereus
HIGHAYTTVAGDAMARYKRMQGYNVHYLTGTDEHGQKIQKKAEELNITPQAYVDNIVAGIKELWEKMDISYDDFIRTTEDRHKDVVEKIFKQLVDQGDIYLDEYEGWYSVQDETFYTEHQLVDPIMEGDKVVGGKSPDSGHDVELVREESYFFRMGKYVDRLLKFYEDNPHFIQPESRKNEMINNFIKPGLEDLAVSRTSFDWGVRVPGNPKHVIYVWVDALSNYITALGYGTANEEKYKKFWPADVHLVGKEIVRFHTIYWPIILMALDLPLPKKVFAHGWILMKDGKMSKSKGNVVDPVTLIDRYGLDALRYYLLREVPFGSDGVFTPEGFVERINFDLANDLGNLLNRTVAMIDKYFNGEIPAFKENVTEFDETLVAFAQDTLKKVEEAMENMEFSVALGSIWQLVSRTNKYIDK

SEQ ID NO: 4454 - protein, 416 aa, Bacillus cereus
HIGHAYTTVAGDAMARYKRMQGYNVHYLTGTDEHGQKIQKKAEELNITPQAYVDNIVAGIKELWEKMDISYDDFIRTTEDRHKDVVEKIFKQLVDQGDIYLDEYEGWYSVQDETFYTEHQLVDPIMEGDKVVGGKSPDSGHDVELVREESYFFRMGKYVDRLLKFYEDNPHFIQPESRKNEMINNFIKPGLEDLAVSRTSFDWGVRVPGNPKHVIYVWVDALSNYITALGYGTANEEKYKKFWPADVHLVGKEIVRFHTIYWPIILMALDLPLPKKVFAHGWILMKDGKMSKSKGNVVDPVTLIDRYGLDALRYYLLREVPFGSDGVFTPEGFVERINFDLANDLGNLLNRTVAMIDKYFSGEIPAFKANVTEFDETLVAFAQDTLKKVEEAMENMEFSVALGSIWQLVSRTNKYI

SEQ ID NO: 4455 - protein, 265 aa, Solanum tuberosum
MDAKKFMQLVEEKKKRALEKKEGHLKWEQKLEASANLKSDAEAGEKTKAAKHKRKSDSGSDGGSDTDSEYEKKKSTRKSHKKHRKHHSSDLIDLDRKDKKSKRKPKRRSSDSGDDSCREYNGDSEEERRRKKRGHKKHRHHDRYSDYNSSDSSDDEDVGRKHHSKHHKRHRRSQPNGSESSSDDDHVAARKRSNTKHHKRHGRLDSDASVSSSDEEKVNRSNHGKHKKRHHRHHSHDSRSSDPEDFRHGRSRFLGKSSDENEELD

SEQ ID NO: 4456 - protein, 531 aa, Zea mays
MALEPVALLLTVLVAAPLTVLLLLFLVAGNKRPARAASPTPRHRLRLPLPPSPRGLPLLGHLHLLGSLPHRALASLARAHGPVLLLRLGRVPTVVVSSAAAAEEVMRARDLAFANRPASAMAERLLYGRDVAFAPYGEYWRMVRRVCVVHLLSARRVGSFRRVREQEAAALVARVARDSAGGAAVGLSDLLTEYANAVVSRAAFGDESARGLLDEFDSGRRHRKVLTDFQKLLGTTPVGEVLPWLGWVDAVTGLEGKIRRTFEGLDGLLEKVIDDHRRRPRSGEDGGDRDFVDVLLDVHNKDQEHGIQLETNEIKAIILDMFSAGTDTTTSVMEWAMAELVTHPRAMRRAQDEVRAAAAGSTGVNEDHVAQLDYLKAVLKETLRLHAPVPLLVPREPPADTEILGYHIPARTRVLVNAWAIGRDPATWERAEEFVPERFLGGGAAANVGFKGQHFELLPFGAGRRMCPGIAFAEGSAEMALASLLYHFDWEVSRGQNREGTSSLDMTEMSGITVHIKSGLPLVAKPWSGSP

SEQ ID NO: 4457 - protein, 180 aa, Triticum aestivum
MGDGGGGDGAAASSSPPAAAAAPGFSYLAVFHNFPLVAALLGFAIAQSIKFFLTRYKEKRWDPKRLIGSGGMPSSHSATVTALSVAIGFQEGFGSALFATSTIFASVVMYDASGVRLHAGKQAAVLNQIVCELPAEHPLAETRPLRELLGHTPTQVVAGAVLGCMIGIAGQIIIAVTSVV

SEQ ID NO: 4458 - protein, 114 aa, Aspergillus oryzae
MDPEEKTPDHVINGILEILLNKANHPILIHCNKGKHRTGCVVACFRKVQGWNLRDVLDEYLSYSWPKSRALDERFIGAFDATKLDQVAKESGAKLWKPTGSHRNPEPYMLRSTF

SEQ ID NO: 4459 - protein, 193 aa, Streptomyces coelicolor A3(2)
MQPLIDNARMFGQRPEEFTGHAEGQSPEVLFITCSDSRVVPALITGARPGQLFELRTAGNIVPPHGTGHPSGEAATVEYAVQVLGVADIVVCGHSHCGAVGALVRGDDLTAVPAVRDWLAHAADEPKPCDPADPTVAGAVQHHVLAQLLRLRSYPCVERRLADGRLRLHGWYYEVHTGLVRAHRADTDAFETL

SEQ ID NO: 4460 - protein, 304 aa, Synechococcus sp. CC9605
MSSCGVLVVAGTHGNEVNAPWLLQQWQANPDLIDAAGLAVQKVIGNPEALRRRCRYVDRDLNRCFLPEQLEQGASGLEFQRAGELLRLHGPSGEQPCAVAIDLHSTTAAMGNSLVVYGRRPADLALAALVQGALGLPIYLHEADAQQTGFLVESWPCGLVIEVGPVPQGLLNAGVVEQTRLGLESCLRALYQVRQELARLPDALVVHRHLGSRDLPKAENGEPQALVHPELQGRDWQNIASTQAMFRAADGTDRCEAWVGGEIPVFVNEAAYAEKSIAFSLTRREVWPVEPNWLLALKQLLAAA

SEQ ID NO: 4461 - protein, 554 aa, Zea mays
  misc_feature (335)..(335): Xaa can be any naturally occurring amino acid
MDRLGANPANSCPLTPLGFLERSATVFGDCHSVVYHDTVFTWSQTHRRCLRLASALVSLGINRGDIVSVLLPNVPAMYEMQFGVPMSGAVLNNINMRLDARTVAVLLRHSGSKLVFVDPASLTLIRDALKQLPQGHPAPRVIPVEDPHEKGLPAAPPGSLTYEGLLEKGDPEFAWVRPASEWDPMVLNYTSGTTSEPKGVVHCHRGIFLITLDSLIEWAVPPQPTYLWTLPMFHANGWSFPWGMAVVGGTNVCLRRVDAAEVYATIAGRGVSHLCGAPVVLNMLANAPEGVRRPLPGKVRILTAGAPPPAAVLHRTESIGFEVIHGYGLTETAGXWICRAWKREWNKLPASERARLKARQGVRTPGMAEVDIVDGETGRSVPRDGSTMGEIRLRGGGVMLGYLDDDKATRAAIRDNGWFYTGDVGVMHPDGYMEIRDRSKDVIISGGENISSVEVESVLYSHPAVNEAAVVARPDDFWGETPCAFVSLKEEGSTAADVIAWCRQRMPHYMVPRTVVFRDELPKTSTGKIQKYVLRNLAKEMGSTHKGASRISKM

SEQ ID NO: 4462 - protein, 359 aa, Oryza sativa (japonica cultivar-group)
MPGQAQMLPAGRMDFYGTRTLANNLLEDQCQIESGPLSFLDSGPYGTFVGVYDGHGGPETACYINDHLFHHLKRFASEQNSISADVLKKAYEATEDGFFSVVTKQWPVKPQIAAVGSCCLVGVICGGILYVANVGDSRVVLGRHVKATGEVLAVQLSAEHNVSIESVRKELQSMHPEDRHIVVLKHNVWRVKGLIQVCRSIGDAYLKRSEFNREPLYAKFRLREPFHKPILSSEPSISVQPLQPHDQFLIFASDGLWEHLTNQEAVDIVHSSPRNGSARRLIKAALQEAAKKREMRYSDLKKIDRGVRRHFHDDITVIVVFLDSSLVSRASTYRGPSVSLRGGGVNLRSNTLAPYASQM

SEQ ID NO: 4463 - protein, 256 aa, Mycobacterium sp. MCS
MSDRFSMEGRVAVITGGGTGIGRASALVLAERGADVVLAGRREEPLKATAADVEALGRRAIAVPTDVTKADQCQALVDAALGEFGRLDVLLNNAGGGETKSLMKWTDEEWHEVLELNLSSAWYLSRAAAKPMIAQGKGAIVNISSGASLLAMPQAPVYAAAKAGLNNLTGSMAAAWTRKGVRVNCIACGAIRTPGLEADAKRQGFDIDMIGQTNGSGRIAEADEIGYGVLFFASDASSYCSGQTLYMHGGPGPAGV

SEQ ID NO: 4464 - protein, 627 aa, Pseudomonas aeruginosa PAO1
MSATQKNNITRLEQLDRQSTQPFPNSRKVYLTGSRPDIRVPVREISLADTPTAFGGEKNPPVFVYDTSGPYTDPEVRIDLRKGLPDVRSRWIDERGDTEILPGLTSEFGQARLADASLDALRFAHVRTPRRAKPGANVSQMHYAKKGIITPEMEYIAIRENMKLQEARAAGLLDQQHPGHSFGANIPKEITPEFVREEVARGRAIIPANINHTELEPMIIGRNFLVKINGNIGNSALGSSIEEEVEKLTWGIRWGADTVMDLSTGKHIHETREWILRNSPVPIGTVPIYQALEKVNGVAEDLTWEIFRDTLIEQAEQGVDYFTIHAGVLLRYVPLTAKRVTGIVSRGGSIMAKWCLAHHQENFLYTHFEEICEIMKAYDVSFSLGDGLRPGSVADANDAAQFGELETLGELTKIAWKHDVQVMIEGPGHVPMQLIKENMDKQLECCDEAPFYTLGPLTTDIAPGYDHITSGIGAAMIGWFGCAMLCYVTPKEHLGLPNKDDVKTGIITYKIAAHAADLAKGHPGAQIRDNALSKARFEFRWEDQFNLGLDPDTARAFHDETLPKDSAKVAHFCSMCGPKFCSMKITQEVRDYAKENGLSDESKAIEAGFQEQAARFKDEGSVIYRQV

SEQ ID NO: 4465 - protein, 393 aa, Pseudomonas aeruginosa PAO1
MRYSDFTQRIAGDGAAAWDIHYRALARVEQGEEILLLSVGDPDFDTPAPIVQAAIDSLLAGNTHYADVRGKRALRQRIAERHRRRSGQAVDAEQVVVLAGAQCALYAVVQCLLNPGDEVIVAEPMYVTYEAVFGACGARVVPVPVRSENGFRVQAEEVAALITPRTRAMALNSPHNPSGASLPRATWEALAELCMAHDLWMISDEVYSELLFDGEHVSPASLPGMADRTATLNSLSKSHAMTGWRVGWVVGPAALCAHLENLALCMLYGSPEFIQDAACTALEAPLPELEAMREAYRRRRDLVIECLADSPGLRPLRPDGGMFVMVDIRPTGLSAQAFADRLLDRHGVSVLAGEAFGPSAAGHIRLGLVLGAEPLREACRRIALCAAELLGQA

SEQ ID NO: 4466 - protein, 370 aa, Streptococcus suis 89/1591
MKPSIYAFSQANLVDWILENGEKKFRATQIWEWLYRSRVQSFAEMTNLPKSLIEKLEEHFVVNPLKQRIVQESKDGTIKYLFELPDGMLIETVLMHQHYGLSVCVTTQVGCNIGCTFCASGLIPKQRDLTSGEIVAQIMLVQKYLDERNQNERVSHIVVMGIGEPLDNYDNVMTFLRVVNDDKGLAIGARHITVSTSGLAPKIREFACEGVQVNLAVSLHAPNNDLRSSIMRINRKFPIEVLFEAIEDYIKVTNRRVTFEYIMLNEVNDGVEQAQELADLTKNIRKLSYINLIPYNPVSEHDQYSRSTKERTLAFFDVLKKNGVNCVVRQEHGTDIDAACGQLRSNTLKKDREKARARIAAAKAKAGIRA

SEQ ID NO: 4467 - protein, 473 aa, Prochlorococcus marinus str. MIT 9515
MAKSPQDVLSQIKDEGIELIDLKFTDIHGKWQHLTLTSDMIEEESFTEGLAFDGSSIRGWKAINASDMSMVPDSSTAWIDPFYKHKTLSMICSIQEPRSGAPYDRCPRSLAQKALSYLDSTGIADTAFFGPEPEFFLFDDVRYDSKEGGCFYSVDTNEAPWNTGRTEEGGNLGYKIQYKEGYFPVAPNDTAQDIRSEMLLLMGELGIPTEKHHHEVAGAGQHELGMKFDSLINAADNVMTYKYVVRNVAKKYGKTATFMPKPVFNDNGTGMHVHQSLWKSGQPLFFGEGSYANLSQTARWYIGGILKHAPSFLAFTNPTTNSYKRLVPGFEAPVNLVYSEGNRSAAVRIPLTGPSPKAKRLEFRSGDALANPYLAFSVMMLAGIDGIKNQIDPGDGVDVDLFELPAEELAKIDTVPSSLNDSLNALKTDKDYLLAGGVFTEDFIDNFIDIKYEEVQQLRQRPHPHEFFMYYDA

SEQ ID NO: 4468 - protein, 215 aa, Phaseolus vulgaris
RLSYGYSSFKGKRSSMEDFFDTTISEVDGQMVAFFGVFDGHGGSRTAEYLKNNLFKNLSSHPDFIKDTKTAIVEAFKQTDIDYLNEEKGHQRDAGSTASTAMLLGDRIVVANVGDSRVVASRSGSAIPLSIDHKPDRSDERQRIEKAGGFIIWAGTWRVGGVLAVSRAFGDKLLKPYVVADPEIQEEEIDGVDFIIIASDGLWNVISNKEAVSLV

SEQ ID NO: 4469 - protein, 364 aa, Vibrio vulnificus YJ016
MNIQALPMHRFLDDEGNVQSPLPSWASEERLVQFYRDMLITRAYDNKAVALQRTGKLGTYPSHLGSEAFGVGIGHALKPSDVFIPYYRDMPAMWVRGIGMEKNLQYWGGDERGSDFCPEESHLRCSDLPFCVPIATQCTHAVGVASALKIQGNHDAALVTCGDGATSKGDFLESINCAGVWHLPLVFVVNNNQWAISVPRQLQCAADLLSEKAKGAGIPGITVDGNDVVAVYDAVNNALDRARKGKGATLIEAISYRLSDHTTADDASRYRSADELKQAWQYEPIKRLQAYLTAQGLWNEELEQQWLAHCKQQVEQAVAHYLSLPPQAPESAFDYLYASLPVELHAQRDMLINKAMRMQGGKHG

SEQ ID NO: 4470 - protein, 327 aa, Vibrio vulnificus YJ016
MAELTLVEAVNLALHHEMERDANVVVLGEDVGDNGGVFRATVGLKQKFGLKRVMDSPLAEALIGGVAVGMATQGLRPVAEFQFQGFVFPAMEHLICHAARMRNRTRGRLTCPAVFRAPFGGGIHAPEHHSESIEALFAHIPGFKVVIPSSPQRAYGLLLAAIRSDDPVMFFEPKRIYRTVKSEVVDNGEALPLDSCFTLRKGRDVTLVTWGACVVESLQAAQTLSSQGIEAEVIDLASIKPLDMATIFQSLEKTGRLLVVHEASRSGGVGGEIIARVAEQAMCLLKAPPKRVTGMDTVMPYYRNEDYFMIQEQDIVLAARELMEGWK

SEQ ID NO: 4471 - protein, 483 aa, Xylella fastidiosa Temecula1
MLKKHLFIVKPIEPTNHTGTGKGGTQLKRSLTAGQLVMLGIGAVIGAGIFVLSGHAAAEYAGPAVVLSYILAGIACALAGLCYAEFAAMLPVSGSAYSYAYATLGEFTAWFIGWNLILEYMFSASTVAVGWSGYLNSFLSSFGYGLPASLSSAPLDVVDGRLIYSGGLINLPAVAIVAAISGLCYVGITQSAFVNSITVAIKVSVIVLFIAFAARYVNPDNWVPFVPDNVAPGKYGIEGVIRGAAVVFFSYIGFDAVSTTAGEAKNPQRDMPIGILGSLAICTVIYIAFSGVLTGLMHYSQLDTPKPVATALETYPTLSWLKHVVEIGAIAGLSSTMLMMLMAQPRIFYAMSQDGLLPKLLSKVHPKFQTPHVGTLIVGACACALAGLFPISLLGDLVSMGTLLAFATVCIGIVVLRRTRPDLPRPFRVPVYWVIAPTGAAACLYLFWQPFTEHWPLMVGWTVLGLVMYGLYGYQHSKLRHGG

SEQ ID NO: 4472 - protein, 477 aa, Xylella fastidiosa Temecula1
MFKQLWATKLSQPSQDSAEGLSMQRVLGVWGLTALGIGAVIGGGIFVITGQAAANHAGPAIMLSFALAAICCTFCALAYAEFAAMVPVSGSAYTYTYATFGELAAWFIGWMLVLEYGVSAAAVAVSWSGYFLSLLQHLGIHLPAALVNAPLDGTLHATGAIANLPAATIVLLLTWLCYFGIRKSSKINIAMVALKSGLILLIIGVGWKYVNPDYWQPFIPTNQGPGKYGWNGVLHGASMVFFAYIGFEAVSVAAQESHRPQRDLPISMMSALAICTVLYIMMAAVMTGLVPYTQLGTDEPVVTAVAAHPQLGWLRVVVEIGALVGLSSVVLVMLIGQPRIFMIMAGDGLLPPIFSTIHSKHRTPHINTVITGLGIALLAAVFPLDVLGELTSMGTLIAFTAVCAGVLILRCTRPDLPRPFRMPAAWLFCSAGVLSCITLLSAMTRHNWMLMSVWTVLGFSLYFSYGYRHSKLHQEST

SEQ ID NO: 4473 - protein, 142 aa, Oryza sativa (japonica cultivar-group)
MFNDITPLLLRPGVFKDAVDIFVERYRGMAIAAVAGIEARGFIFGPAIALAIGAKFIPLRKPKKLPGEVISETYVLEYGTDCLQMHVGAIEPGERVLIVDDLVATGGTLCAAIRLLEVFSPFAHSQHAILLACNSEALDCAL

SEQ ID NO: 4474 - protein, 403 aa, Vibrio sp. Ex25
MTTEIKVERGLFDEVMVPCYNPMEMIPVKGEGSRVWDQEGNEYIDFAGGIAVSCLGHCHPVMVNALTEQANKLWHLSNVMTNEPALRLAKKLTEVSFAERVFFANSGAEANEAALKLARRYAADVHGAEKSEIIAFKQGFHGRTFFTVTVGGQAAYSDGFGPKPGDVTHLPYNDIEALQAHMSDRTCAVMMEPLQGEGGIVPPTPEFAQAVRELCDKHNALLIFDEVQTGNGRTGNFYAYQGLGITPDILSTAKSLGGGFPIGAMLTTAKLAEHMKVGTHGSTYGGNPLACAVAEAVVNEVTKPEVLAGVLEREAMFREGLEKINAKYNIFSEVRGQGLLLGAALNEEWQGRARDVLVAAGKQGLMVLVAGANVVRFTPSLVITQQEIEEGLAKLDKAIATLV

SEQ ID NO: 4475 - protein, 206 aa, Xylella fastidiosa Temecula1
MCNEPATSDVALPDLDWAKGDGLLPVIVQDADTLRVLMLGYMNSQALEVTQRSRLVTFYSRSKQRLWTKGERSGHVLHLVAIDADCDADTLLVQARPRGPTCHLGRTSCFPAAPGQFLGALDALVAERERERPQDSYTTALFEQGVRRIAQKVGEEGVETALAGVVQADDALLDESADLLYHLIVLLRARGLSLADAVTVLEARHR

SEQ ID NO: 4476 - protein, 243 aa, Brassica napus
MSEEVEYRCFIGGLAWATSDRGLRDAFEKYGHLTEAKVVLDKFSGRSRGFGFITFDEKKAMDEAIAAMNGMDLDGRTITVDKAQPQGGSGRDHDGDRSRDRDRDRGYDRDRSRPSGGGRGGSGGGDCFKCGKPGHFARECPDESGKGGGGGGRYSSRDDRYSSKDDRYGGKDDRYSSKDDRYSAKDDRYGAKEDRYGGRDRYGPDRSGERSGGRSRDDGSRGGSGGERHGRAPYDRPRDGGFH

SEQ ID NO: 4477 - protein, 461 aa, Agrobacterium tumefaciens str. C58
MFFMRMICNCINSISMKAQKMDKPVFGWRRNGDDLSLSDVHSSIRIKPDASTFRRAMAFFGPGYLVAVGYMDPGNWATSLAGGSKFGYTLLAVALVSNIMAIVLQSLCARLAIASGRDLAQACRDAYPKPVAMVLWLLAEIAIIATDIAEVIGTAIGLNLIFGIPLELGVLITALDVFLILYLQKLGFRWVEALVITLLGVIAVCFAIQLALADPDWGQVILGFAPTTEIVTNPDMLYLALGILGATVMPHNLYLHSGIVQTREIGPTIAEKREALKFATLDSTIALMFALLINASILILAAATFNKTGQTNVAELGEAHSLLAPLLGLAIAPTLFGVALLCCGINSTVTATLAGQIVMEGFLKMRLAPWLRRLITRAIAIVPAAGVTIFYGDSGTGQLLILTQVVLSLQLSFAVFPLVMFTSDKAKMGELRSPLWLSAIAWLIAVVIAALNVKLLMDFMG

SEQ ID NO: 4478 - protein, 573 aa, Aspergillus oryzae
MCGIFACYNHPDVQKFKPTALRMAKAVRHRGPDWSGNYIADKTILAHERLCIVGVDSGAQPLVNDDGSLALAVNGEIYNHRIIRKNLKNQYDFKTHSDCEVVIPLYMEHGLDAPKHLDGMFSWVLYDRKQDRVVAARDPIGVTSFYIGWSSETPGAIYFASELKSLHPVCDKIEAFPPGHIFDSKTGSMTRYFEPKWWDPTNVPTTPVDLKVLRHTLEKSVRKRLMAEVPYGVLLSGGLDSSLVASIAQRETLRMQEAAKVAIQNQTGSSDLVGIDDSNELSTVTTFQQLHSFSIGLPGAPDTEAALEVAKYLGTKHHAFTFTVEDGINALSDVIYHLETYDVTTIRASTPMYLLSRKIKAMGVKMVLSGEGSDEIFGGYLYFHAAPNKEEFHNETVRRVKALHLADCLRANKSTSAWGLEARVPFLDKNFLETAMGVDPQDKMITKERIEKYILRKAFDTTDEPDVEPYLPEKILWRQKEQFSDGVGYSWIDGLKDHAELHVTDEMMKNPKPEWGNDIPDTKEAYWYRMMFDEHFPPSCASTVERWVPTWSKQTDPSGRAIATHNAKYDHVE

SEQ ID NO: 4479 - protein, 264 aa, Synechococcus sp. CC9605
MQTPRRINDPANSLAVVVAIVLSALLLLGQALFIVPAGKVAVVTTLGKVSGGSRLPGLNLKVPFVQSVYPFDVRTQVKPEEFATLTKDLQVIEATATVKYAVRLNEAGRIYRTIAGNDREIYPRIIQPSLLKALKSVFSQYELVTIATEWNDISALVERTVAEELDKFDYVEVRGLDLTGLQIAEEYRAAIEQKQIAEQQLLRAQTEVKIAEQEALRYDTLNRSLDDQVLYKLFLDKWDGQTEVVPALPGSNGSTPPVIVGRRS

SEQ ID NO: 4480 - protein, 247 aa, Chlorobium tepidum TLS
MKKLVLLRHGESQWNRENRFTGWVDVDLSEKGREEARTAGQLLKDEGFVFDLAYTSVLKRAIRTLWTVLDEMNLMWIPVTKNWRLNERHYGALQGLNKAETAQRHGDEQVLIWRRSYDTPPPALTESDEFWPGKDPRYASLSSQELPATECLKDTVARFLPYWHETIAPQIRDGKNVIITAHGNSLRALVKYLDNISDEDIVGLNIPTGIPLVYELDDDLKPLKSYYLGDQEELKKKVEVVVKQGKA

SEQ ID NO: 4481 - protein, 1646 aa, Anabaena variabilis ATCC 29413
MVNMKTVENQEPLDGVAIVGMVGRFPGAKNVQEFWGNLCAGKESTTFFQDEELDPSIDPHLVQDPSYVKARGIIPGGETFDAAFFGINPREAEVMDPQSRVFLELVYEALENAGYDAEAYSGLIGLYAGCGQNTYFANHICGRQEIIDRVGEFQTMLANEKDFLTTRAAHKLNLKGPAVSISTACSTSLVAVIQACQSLSNYQCDMALAGGVSMTTPQNSGYIAQEGTMLSGDGHCRPFDAKSQGTMFNNGAGLVVLKRVEDAIQDGDRIYAVIRGFGINNDGADKVSFTAPSVDGQAEAIAMAQAYANFHPETISYIEAHGTATSLGDPIEIEALTQAFRIHTNSKQFCAIGSLKSNVGHLVAAAGVAGLIKTALALYHQQIPPSLNFEAPNPNIDFANSPFYVNTQLTPWPQGETPRRAGVSSFGVGGTNAHIVLEEAPAILPSNLSRPSQLLLLSAKTSTALETATVNLQEHLRNNASINLADVAHTLQRGRKAFNYRRFVVCQNTKEAITTLQSLEPKRVFTRHTQVRDPEIAFMFPGQGSQYVNMGFNLYSREIVFRQVVDQCAEILKPILGRDLREIIYPVATDIETASTALQQTCFTQPALFVVEYALAQLWQSWGVKPQAMIGHSIGEFVAACLAGVFSLEDALMLVANRGRLMWELPRGAMLSVRLSAPEVEKRLAGELAIAAINSPSLCVVSGTTEAIAAWQTQLETAEIVCRLLHTSHAFHSPMMEAIVAPFAELVGKVKLSPPQIPFVSSVTGDWITPEEATNPMYWAQHLRQTVRFADGVKTLWQQPERLLLEVGPRTTTTTLARQQAKDIKQQITIASLSDNADNEAEWTALLQAMGQLWLAGVTINWNNFYQEERRQRIPLPNYPFERQRFWIDPLPHPNRNTNHKPAHYQLEKTQTMSAQTTLISLLKEIIEETSGLEIASVDASTTFLEMGLDSLSLTQVGLALKKKFKVKVSLRHLLEVYPNLATLADFLQQNLSAEALSALVPSETTSPSATLSLQEVSTNGSNGKNGKNGSTPSPMLLVPPTSTNGNGSKNGSLPQVSLPNVASSALEGVINQQLQIMAQQLALLGNNSQPVTVPAVNGQNNGVKSEKPVTQSNQKPEPQDSTENLPKKVFGAGARIETTQTKTLTPQQRTYLDSIIQRYTQRTQKSKEYTQTNRPHLADPRSVSGFNPTMKEMVYPIVVSRSSGSKLWDIDGNEYVDLSNGFGLNLFGWSPAFVTEAIEAQLKLGMEIGPQTPLVGEVAKLMCEITNFDRAAFCNTGSEAVLGAMRLARTITGRNLIAIFSGGYHGILDEVIVRGTKKLRSIPAAPGIPQEKVDNILVIDYDAPDALDILKSRADELAGVMVESVQSRRPEYQPREFLQQLRQFTEQEDIALIFDEIVTGFRIHPGGAQAHFGIKADIATYGKIVGGGLPIGVIAGKSKYMDALDGGFWQYGDDSVPEVGVTYFAGTFVRHPLALAAAKAVLQHLLKNGPSLQQQLNAKTDQFVVELTDYFQQMQAPYTVHNFGSLFMVKSAPEFLYGDLLFYLMRDKGVHIWDHRPCFLTTAHSDADLSLAMAAFKESIAEMQSAGFFSAPTPTTKGSPESSKNLRNRPPQPGAKLGRDPEGNPSWYVPDPQRPGKYLQVSSVS

SEQ ID NO: 4482 - protein, 470 aa, Pseudomonas aeruginosa PAO1
MADGKERLQLTRALASRHIFMLSLGGVIGTGLFMGSGVTINQGGPAGAVLAYLVAGVLMYLVMVCLGELSVQMPVSGSFQAHATRFIGPATGFMIGWVYWMSWASTVGLEFTAAGMLMTRWFPEVPVWLWSGFFVVVLFSLNALATRAFGEAEYWFAGIKVAAILVFIVVGGLVIFGGIELKSGAPAPMFSNLVGERLFPNGLSAVFAVMMTVVYAFQGCEIMGVAAGETERPEKSIPRAVRNVVFRVLIFYVLAIVVLSAIIPWQQAGLMESPFVQVFDMVGIPYAADLMNFVILTAILSVGNSGLYASTRILWAMSRSGMAPRGLSKLSARGVPLYALLITLCFALLSLLTSVVAADTLFMVLMAVSGMSGTVTWIVIAYAQYRFRREHMASGGTVAELKYAAPLFPLVPLACIAVCCSLFVFLALDPTQRPSLYWGFGFIAACYLAYYVVRRRQPQGLGDPALGRAG

SEQ ID NO: 4483 - protein, 336 aa, Frankia sp. EAN1pec
MTVDSPLSTPRQDGTAGPPPPFDAEMRPTMVIMRQALVGMRTLDAVLAARAHTGRARDQDARLARDGAFELTEVSVPGPPGGPEVSLLVCRPTATTAPRAVLYFAHGGGMIIGDNRLGLDDPLDWAQELGLVVVSVDYRLAPEYPHPAPVEDCYAGLVWTASHAADLGVDPSRIIISGQSAGGGLAAATALLARDRGGPALDGQLLMCPMLDDRNDTPSARQMAGVGVWDRSMNEMGWSALLGEARGGPDVSSYAAPARATDLSALPPTFVDVGSAETFRDEDVAYASRIWQAGGEAELHVWPGGFHGFDLVAPQAALSRAAKAARLQWLRRLLRD

SEQ ID NO: 4484 - protein, 359 aa, Glycine max
MGGFMICIIICCFRYKLLIQPIKLCSTTKSDQDIEAFLKNKGAVAQKRYKFSEVKKMTNSFKVKLGQGGFGAVYKGQLPTGCPVAVKLLNSSKGNGEEFTNEVASISRTSHVNIVTLLGFCLKGRKKALIYEFMANGSLDKFIYNRGPETIASLRWQNLYQISIGIARGLEYLHRGCNTRILHFDIKPHNILLDENFCPKISDFGLAKLCPRKESIISMSDTRGTLGYVAPEMWNRHFGGVSHKSDVYSYGMMLLEMVGGRKNIDAEASRTSEIYFPHLAYKRLELDNDLRPDEVMTTEENEIAKRMTIVGLWCIQTFPNDRPIMSRVIEMLEGSMNSLEMPPKPMLSSPTRSATESSS

SEQ ID NO: 4485 - protein, 949 aa, Mesembryanthemum crystallinum
MASAFKGILIRSPPDVCAETVAKVSQCNRAQLVKNSSTGFKNIFKLSEARKFHAPVASHLRSQAVMAPASDPTSTAIKRVFTFGKGRSEGNKGMKSLLGGKGANLAEMASIGLSVPPGLTISTEACQEYQEHGKQLSAGLWEEILEGLRVIEKDMGSYLGDPSKPLLLSVRSGAAISMPGMMDTVLNLGLNDDVVAGLAAKSGERFAYDSYRRFLDMFGNVVMGISHSSFEEKLEKLKQVKGVKLDTELTASDLKEVVEQYKNVYLEVKGEKFPADPERQLQLAIQAVFDSWDSPRAIKYRNINQITGLKGTAVNIQCMVFGNMGNTSGTGVLFTRNPSTGEKKLYGEFLINAQGEDVVAGIRTPEDLDTMRSCMPEAYKELVENCEILERHYKDMMDIEFTVQENRLWMLQCRSGKRTGKGAVKIAVDLVKEGIVDTYTAIKMVEPQHLDQLLHPQFEDPSAYKDRVIATGLPASPGAAVGQIIFSADEAESWQAQGKSVILVRNETSPEDVGGMHAAIGILTARGGMTSHAAVVAGGWGKCCVSGCSEIRVNDTDKVLLVGDKVISEGDWLSLNGSTGESYLRESTTSPPALSGDLETFMSWADDIRVLKVMANADTPEDALAARNNGAEGIGLCRTEHMFFASDDRIKTVRKMIMAVTSEQRKVALDQLLPYQRSDFEGIFRAMDGLPVTIRLLDPPLHEFLPEGDVEQIVSELTLETGMAEDEIFSRIEKLSEVNPMLGFRGCRLGISYPELTEMQARAIFQAAVSMSNQGVKVFPEIMVPLVGTPQELGHQVSLIRNVAEKVFSETGSSLSYKVGTMIEIPRAALVADEIAMEAEFFSFGTNDLTQMTFGYSRDDVGKFLPVYLSKGILQSDPFEVLDQKGVGQLIKLATEKGRSARPSLKVGICGEHGGEPSSVAFFAEAGLDYVSCSPFRVPIARLAAAQVV

SEQ ID NO: 4486 - protein, 214 aa, Brassica napus
EALPESARSCDDGLYRAIDSYLKAHPTLSEHERKRLCRVMDCQKLSMDACMHAAQNERLPLRVVVQVLFSEQVKISNALANTSLKESTTLGEAMGTTYQPMIPNRKTLIEATPQSFQEGWAAAKKDINTLKFELETVKTKYVELQNEMEVMQRQFEKTGKVKNISSSAWTSGWKKLSKLTKMSGHETQDMVGGEQAGVDHQPTRKPRRWRNSIS

SEQ ID NO: 4487 - protein, 327 aa, Prochlorococcus marinus str. MIT 9515
MASTLLFNALKEAIDEEMANDVNVCVMGEDVGQYGGSYKVTKDLYEKYGELRVLDTPIAENSFTGMAVGAAMTGLRPIVEGMNMGFLLLAFNQISNNMGMLRYTSGGNYKIPAVVRGPGGVGRQLGAEHSQRLEAYFHAVPGIKIVACSTPTNAKGLMKAAIRDNNPVLFFEHVLLYNLSEELPEGDYICSLDQADIVKEGKDITILTYSRMRHHCLKAIEELDKKNIDVELIDLISLKPFDMKTISKSIKKTNNVIIVEECMKTGGIGAELIALITEECFDDLDHRPIRLSSQDIPTPYNGNLENLTIIQPHQIVEKVEEIINGSI

SEQ ID NO: 4488 - protein, 428 aa, Gibberella zeae PH-1
MAPVATGETAPAHLPVGSPKPLSISASVLHGPRDLRMETRIIEAPAAGELQIAVKATGICGSDVSYYKKFANGDLCACHPLSLGHESSGEVVAIGPQVNGFKLGDRVALEVGVACGNCGTCRKGRYNLCKKLRFRSSAKTYPHYQGTLQERINHPAVWCHKLPDNVSYEAAALLEPLSVAIHAVNRARPEPGSTAIVIGAGTVGLLTAAMARQSGCTSVTITDIDAGRVNYAVSQGFATHGFVTPISRLNSSNYSSGISTPATGALTPASTFSTASRFDGAKSLAADILASSNSPGSFILEEDEDGVDVTFECTGKEVCMHTSLYTTKAGGKVIMVGMGTPIQTLPLSVAHLREIDILGVFRYSNTYPTGIRLLCSQAANPSGCGLPSLDGMVTHRFKGLDKAQAAFELATRTSDDEGNLVLKIVIEA

SEQ ID NO: 4489 - protein, 375 aa, Xylella fastidiosa Temecula1
MTPIVFIDRDGTLIEEPPDFQIDAYEKLRLVNGVIPALLKLRDAGYHFVIVTNQDGLGSPTYPQASFDGPNALMLQIFSSQGIVFRDVLIDRSWPADNAPTRKPGIGLMVAYLQDRDIDWARSAMVGDRPTDLQFAENLNIRGFQLRTPQFGGDWDWDGIAHTLADAPRRAVVQRHTKETNIRVEIDLDGAPQARITTGLPFFDHMLEQIAKHAGISLHISAVGDLHIDEHHTIEDTGLALGQAVRQALGDKRGIGRYGFDPPQLPWQVSGAAAHGGFTLPMDETQASAVLDFSGRPYFVFEGTFVRERVGDMPTELVPHFFRSLCDASGMNLHLSVHGDNDHHKVEACFKALARALRQALQRHGHVLPSTKGAL

SEQ ID NO: 4490 - protein, 492 aa, Arabidopsis thaliana
MLLRTMAATSPRPPPSTSLTSQQPPSPPSQLPLRTMPGSYGWPLVGPLSDRLDYFWFQGPDKFFRTRAEKYKSTVFRTNIPPTFPFFGNVNPNIVAVLDVKSFSHLFDMDLVDKRDVLIGDFRPSLGFYGGVRVGVYLDTTEPKHAKIKGFAMETLKRSSKVWLQELRSNLNIFWGTIESEISKNGAASYIFPLQRCIFSFLCASLAGVDASVSPDIAENGWKTINTWLALQVIPTAKLGVVPQPLEEILLHTWPYPSLLIAGNYKKLYNFIDENAGDCLRLGQEEFGLTRDEAIQNLLFVLGFNAYGGFSVFLPSLIGRITGDNSGLQERIRTEVRRVCGSGSDLNFKTVNEMELVKSVVYETLRFSPPVPLQFARARKDFQISSHDAVFEVKKGELLCGYQPLVMRDANVFDEPEEFKPDRYVGETGSELLNYLYWSNGPQTGTPSASNKQCAAKDIVTLTASLLVADLFLRYDTITGDSGSIKAVVKAK

SEQ ID NO: 4491 - protein, 439 aa, Arabidopsis thaliana
MSCSSSSGSEGEEEGFDAYRKGGYHAVRIGDPFSGGRYIAQRKLGWGQFSTVWLAYDTLTSNVLLCMFLCLFAQQFAQAALHEIEFLSAAADGDLDKTKCVVRLIDHFKHSGPNGQHLCMVLEFLGDSLLRLIRYNQYKGLKLNKVREICRCILTGLDYLHRELGMIHSDLKPENILLCSTIDPAKDPVRSGLTPLLEKPEGNANGGASTMNLIEKKLKRRAKRAVAKISERRVSMVTGEEASSKTEKSLDGIDMRCKVVDFGNACWADKQFAEEIQTRQYRAPEVILKSGYSFSVDMWSFGCTAFELVTGDMLFAPKDGNGYGEDEDHLALMMELLGKMPRKIAIGGAKSKDYFDRHGDLKRIRRLKYWPLDRLLIDKYKLPEAEAKEFAEFLTPILEFAPEKRPTAQQCLDHPWMNVTTQNDAENVDDQMNNLHIKG

SEQ ID NO: 4492 - protein, 173 aa, Triticum aestivum
MTKCIYCGFCQEACPVDAIVESPNIESGTPKRFKEDEEKEQLAKELAKDWSAVFERSINTLFLTEMVRGLMLTLKYFFERKVTINYPFEKGPLSPRFRGEHALRRYDTGEERCIACKLCEAICPVDAIVEGPNFEFSTETHEELLYDKEKLLENGDRWETEIAENLKSEALYR

SEQ ID NO: 4493 - protein, 459 aa, Nostoc sp. PCC 7120
MTFDYDLFVIGAGSGGLAASKRAASYGAKVAIAENDLVGGTCVIRGCVPKKLMVYGSHFPALFEDAAGYGWQVGKAELNWEHFITSIDKEVRRLSQLHISFLEKAGVELISGRATLVDNHTVEVGERKFTADKILIAVGGRPIKPELPGMEYGITSNEIFHLKTQPKHIAIIGSGYIGTEFAGIMRGLGSQVTQITRGDKILKGFDEDIRTEIQEGMTNHGIRIIPKNVVTAIEQVPEGLKISLSGEDQEPIIADVFLVATGRVPNVDGLGLENAGVDVVDSSIEGPGYSTMNAIAVNEYSQTSQPNIYAVGDVTDRLNLTPVAIGEGRAFADSEFGNNRREFSHETIATAVFSNPQASTVGLTEAEARAKLGDDAVTIYRTRFRPMYHSFTGKQERIMMKLVVDTKTDKVLGAHMVGENAAEIIQGVAIAVKMGATKKDFDATVGIHPSSAEEFVTMR

SEQ ID NO: 4494 - protein, 197 aa, Brassica napus
  misc_feature (49)..(49): Xaa can be any naturally occurring amino acid
KNGKKKFCRYLFLTLFSVKEKSVKKTLRVDRVDLVFDSRWRRLSVLLLXELAKGINGLDKIVLRQSRFRSAEVYLYGGHVTSWKNENGEELLYLSSKAIFKPPKPIRGGIPLCFPQFSNLGTLESHGFARNRIWEVDASPPPLPTYSSPNAFGDLILRPTEDDLKTWPHNFEFRMRVDLGSEGELTTDIPRIRNTNA

SEQ ID NO: 4495 - protein, 622 aa, Aspergillus oryzae
MRAALRAPLRASDFAPAPVLRYTSSAPWIRPFQRASGPSSVHRSVSNSAQAFSKARQLRPRVPLVALRPHTSYSTKTSNLFGAAEKANGNGRKSSGSEWSRRKVITYTVVGGTIVIGVVAFSDNAQHLYRAAARTGRVVGTLAVCINDYRVTLNRETSSPEERNEELRACHRRCAERTLRVLERNGSIFIKLGQHLSSMGYLLPLEWTTTFIPLQDKCPISSIESIEEMFIADTGCRIDELFSSFDPEPIGAASLAQVHIGILKETGQKVAVKVQHPALAEWVPLDLALTRFTFSTLKRFFPEYDLEWLSKEMDLSLPQELDFRMEADNARRASEYFKEHSDAPLVIPEVMWAQKRILVMEFLSGRRPDDLEFLDSNNIDRDEVSAALAHIFNEMIFGDNAPLHCDPHGGNIAIRKNTNRRGQNFDIILYDHGLYRDIPRDLRRNYAKLWLAVIEADEAHMREYSRKVAGITDEQFPLFASAITGRDYTKLTKKNIATTRTAAEKESMSGALGEGMLQQLVELLGQVPRIILLILKTNDLTRSLDENLHTRQGPVRTFLILARYATRTVFEEQMDLIHETGGLLRPFNFLRFLAAWTAFLRVELKLSVYETLLSLKSRFGLL

SEQ ID NO: 4496 - protein, 175 aa, Triticum aestivum
MGNASSMLTQYDIEEVQEHCSYLFSQQEIVSLYERFCQLDRSAKGFVAEDEFLSIPEYSTNPLSQRLLRMVDGLNFKEFVSFLSTFSARASLQQKIEFIFKVYDIDGKGKVSFKDLVEVLRDLTGSSMSEQQREQVLTKVLEEAGYTRDSTLSLEDFVTIIDHPGLKMEVEVPID

SEQ ID NO: 4497 - protein, 112 aa, Zea mays
  misc_feature (38)..(38): Xaa can be any naturally occurring amino acid
  misc_feature (68)..(68): Xaa can be any naturally occurring amino acid
  misc_feature (80)..(80): Xaa can be any naturally occurring amino acid
  misc_feature (91)..(91): Xaa can be any naturally occurring amino acid
LAINFEGADIWGRVLLNRCSLRGLGQSRIWIHALLEEXAKNGRMHPMNFMDGEKTRGHDRALVNTAQXELFNEYFLRYLXFPNFEHRVSGXLEEEVIHSYTKCLKGLADCEI

SEQ ID NO: 4498 - protein, 1341 aa, Gibberella zeae PH-1
MTESSPRAVRFQGSEDDGRPDKVRGHRLETPIESNGDPHATERHDELGNLIGYGATGHTGSLTSLAPGTVINGVSKAQRGPNTGDDGTAYTPNGSWPQRPLGPARTPSNTYNPATSRKPAHPPATPSFTESIRSSSKTRPRNESRFRAQERAYVQKLRQDYSGGYFTSYSNLNGNDSDSEGETPSSEGPYDDRFDQETIMFYGNDTLQPTDEDLKDPENRERLEWHGMLEAVLTGDVVRQEKKRLIGSADQQAGKSAHKTELWLGIRSKVCGRHIPVQRRMLEESRSTLDRTLDEIINFQIKGESEAGKPPYEQVKDMVAKIQMCENLYPSWAALATEHKAADSATFKESHDAIISWYNTNEMINTELNILKKWVGNEELDFTRTKQRSPAVNGINNDETSFLDRLMKEDGLQSLYNDDNGNLEKGMLAPISTVISKAKDTLIRNSEAFRKRHLPPYLEELLTLISFPSRLIEEITRLRLAYARRVKESAQQNPLMQDQMISQFQLLLKFAIRIKIECTSIANPEPGWDLPPCIDESFDQVVLEALKYYFKMLNWKLSGNKNTFKEAELLFQEWDFANEIGSHLQRGHIEVAEQFSSLTFKALHRLSQTFEKELQAKPKETATEMSKRYKACLDSVRVRQRMLQRFTRMLNDNYEHASDYSISFPPETMQKFYDQLVASGHFQVDTRLLEQDNIYVIASPELRERLEDIQAMMAITSKDQFPDELGEQYLLILRPEDPLNWFGETIEVPLRDLNIDLKRGHIRLCASSPQTLHNARRAFIENVDMHVDLVQEARSNIQKVNSRLTEIRRVAYKLSNNFMDSVEIIRKQARGKDCQELIQTCFVFATEFGQRSLLYMDSNRRQMNNLKLTKLALDWVSFICDDCVASDRKTFRWAVLALELAMGMTRGRHILALGEGEYAKLRSKVAGCMSLLISHFDVMGARSNLAAQAEKERIEALVGQFRKLDKNRMMNDEEASRCVTEQRMSELERVDEYRCEKIAERQGVGRVLEGNNEVDRSLAYLSSSATNVTMRWQQGQFVGGGTFGNVYAAMNLDTGHLMAVKEIRLQDPKLIPQVAEQIREEMGVLEVLDHPNVVSYYGIEVHRDRVYIFMEFCSGGSLANLLEHGRIEDEQVIMVYALQLLEGLVYLHESGIAHRDIKPENILLDHNGIIKYVDFGAAKWIARQGRTLAGDVQPSLPNRSMTGTPMYMSPEVIKGENPGKPGAVDIWSLGCVILEMATGRRPWAQLDNEWAIMYNIAQGNPPQLPPSDQLSPQGLDFLKRCFTRDPRNRSSAVELLQHDWITSIRSQVVEPATPSDTSSSAQSTPTVGSISSKLGGSDGFY

SEQ ID NO: 4499 - protein, 311 aa, Arabidopsis thaliana
MEKYEKLEKVGEGTYGKVYKAMEKTTGKLVALKKTRLEMDEEGIPPTALREISLLQMLSQSIYIVRLLCVEHVIQSKDSTVSHSPKSNLYLVFEYLDTDLKKFIDSHRKGSNPRPLEASLVQRFMFQLFKGVAHCHSHGVLHRDLKPQNLLLDKDKGILKIADLGLSRAFTVPLKAYTHEIVTLWYRAPEVLLGSTHYSTAVDIWSVGCIFAEMIRRQALFPGDSEFQQLLHIFRLLGTPTEQQWPGVMALRDWHVYPKWEPQDLSRAVPSLSPEGIDLLTQMLKYNPAERISAKAALDHPYFDSLDKSQF

SEQ ID NO: 4500 - protein, 352 aa, Catharanthus roseus
MANFSESKSMMAVFFMFFLLLLSSSSSSSSSSPILKKIFIESPSYAPNAFTFDSTDKGFYTSVQDGRVIKYEGPNSGFTDFAYASPFWNKAFCENSTDPEKRPLCGRTYDISYDYKNSQMYIVDGHYHLCVVGKEGGYATQLATSVQGVPFKWLYAVTVDQRTGIVYFTDVSSIHDDSPEGVEEIMNTSDRTGRLMKYDPSTKETTLLLKELHVPGGAEISADGSFVVVAEFLSNRIVKYWLEGPKKGSAEFLVTIPNPGNIKRNSDGHFWVSSSEELDGGQHGRVVSRGIKFDGFGNILQVIPLPPPYEGEHFEQIQEHDGLLYIGSLFHSSVGILVYDDHDNKGNSYVSS

SEQ ID NO: 4501 - protein, 539 aa, delta proteobacterium MLMS-1
MASLAITFGSGAMTNSIADTTVTDLFMMIGSNPDTSHPTIGLRLHQALDRGAKMVVIDPRRTRFAERADLWLPIQPGTDVALLNAMMQVIIEEDLWAKQYVEERTEDFAELRTLVADYTPEKVAEVCRVPAADIRKAARMYAADGRHATYHGMGITHYATGTDRVKSIANLAMLCGKVGFEGGGSNPLRGQNNVQGACDMGALFNTLPGYGGLNDEELFDRYEKIWKVRLPRRPGKPATEVWENILEGNIRALYVFGEDPMLADTNINHVQQALEKTDFLVVQDLFLTETAKLADVVLPAACFAEKDGTFTCTERRVQRVRKAVEPPGEAKPDWQIFCELAKRMGYQMHYDTAEDIFAEIRQLLPQYKGITYQRLEQVGLQWPVPDEEHPGTPVLHVGQFTRGRGLFVPEKFIPPAEPVNGEYPMLFTTIREYARYNFSSMTGKTREIDVIAPEALAEVHPNDAGRMGITDGVMLRLTSRRGSVDIRAKVTDQTQEGTISAPYNFAETPVNRLTLDALDRLSRTPEYKLCAIRVEVLEQ

SEQ ID NO: 4502 - protein, 393 aa, Solibacter usitatus Ellin6076
MSTTAAAFRNRFRSQRISRFTESVIREMSRLAIRHGATNLAQGFPDFPAPEALKRAAAEAIDSDINQYAITWGAKPFRDAIAAKYQRTYGMEFDPEREITVCCGATEGMVASLLAVVDPGDEIVLFEPFYENYGPDSQLCGAVPRYVKLQAPDWNFDPDELRAAFGPRTKAIILNSPNNPTGKVFTRQELEFIAGLCQEFDVLAITDEIYEHILYDGAVHIPIMSLPGMRDRSILVNSMSKTYSVTGWRVGWVLASPDLTDSIRKVHDFLTVGAAAPLQQAGVLALSLPEDYYEHLSTEYSGRRDHIVESLEAVGFKCFVPHGAYYVMTDVSGFGFSDDTSFVRHLITNLGVAAVPGSSFYAHPATGSQQVRFCFCKKYETLELARSKFLKLQ

SEQ ID NO: 4503 - protein, 658 aa, Streptococcus vestibularis
MSNLSVNAIRFLGVDAINQANSGHPGVVMGAAPMGYTLFTKQIHVNPEVPNWINRDRFVLSAGHGSMLLYALLHLSGFKDLSIEELKQFRQWGSKTPGHPEFGHTVGVDATSGPLGQGIATAVGMAQAERFLASRYNKEGFPIFDHYTYVIAGDGCFMEGVSGEASSYAGLQKLDKLIVLYDSNDINLDGETKDSFTEDVRARYEAYGWNTEFVQDGTDVEAINAAIESAKASGKPSLIEVKTVIGHGAPNKQGTNGVHGAPLGPDETAAARENLGWNYAPFEVPKEVYADFKENTVDRGRQAYDAWIALVDEYKQSYPELGAELERILEGKDAVEFQASDFPALENGYSQATRNSSQDALNVIADKVPTFLGGSADLAHSNMTYIKSDGLQDDAHRLNRNIQFGVRESAMGTVLNGMSLHGGLRVYGGTFFVFSDYVKAAVRLSALQGLPVTYVFTHDSIAVGEDGPTHEPIEHLAGLRAIPNLNVYRPADARETQAAWYQAVTSKSTPTALVLTRQNLTVEEGTDFDKVSKGAYVVHETAADFDTILLASGSKVNLAVASAKALESEGYKVRVVSVPSTDVFDAQDQAYKEEVLPNAVRRRVAIEMAASLPWYKYVGLDGAVIGIDTFGASAPAAKIIEEYGFTVENVVETVKGMN

SEQ ID NO: 4504 - protein, 467 aa, Burkholderia pseudomallei K96243
MSLFRKKNVDRMIAGAQAAGLKKALGAVDLTFLGIGAIIGTGIFVLTGTGAVQAGPALMLSFVIAAIACGLAALSYAEFASTIPVAGSIYTYSYATLGELVAWIIGWDLMLEYGLAASAVSVGWSGYLQSLLQGFGVSLPTALTAAPGALPGVVTYFNLPAFVVMLVITTLLSIGIRESTRVNNIMVFIKVAVVLLVIAVGVFHVTPANWKPFMPHGWNGVFGAAAVMFFAFIGFDAVSSAAEEVKNPKRDLPVGIIASLGVCAFLYVAVAAIATGIVPWAQYANVSHPISYALQVAGEKWVAGFIDLGAVIGMLTVILVMSYGQTRIIFAMSRDGLLPAALSRVHPRFATPFLTTWLVGLFFGLIAALIPLNVLAELINIGTLAAFSMVSIAVLVLRRTHPDLPRAFRCPGVPLVPILAVAACLFLMLNLQPVTWIAFLTWLVIGLFVYFAYSRSRSKLAHGAQQH

SEQ ID NO: 4505 - protein, 372 aa, Oryza sativa (japonica cultivar-group)
MDEKVKMESKLSSAAAFVEGGVQDACDDACSICLEAFCDNDPSTVTSCKHEYHLQCILEWCQRSSQCPMCWQPISMKDPMSQELLEAVEQERNIRANRLNTAAVFHHPVLGDFEVPVGADDAELEERIIQHLAAAAAMRRSHRHGRRDGHRSRSGSHSRPQIVVFSRNEAIPGGSLHASSGQDEDHEQSSDLGSAHPFAALAAVDQGHMSGGSQLYVGHSDQGASNPSLHDERAMSRTSENQSAPVNQDTAGPSDLQSFSDTLRSRLQSASMKYKDSITKSTRGWKERWFSRSNTISGLGTEVRREVNAGIAAVSRMMERLETKDDTGPSAVPAASACSPSDANNQRTVSPNHAAVVNETSSTTCASGSGSQ

SEQ ID NO: 4506 - protein, 293 aa, Photobacterium profundum
MFSGSMVALITPLGEAGEVDYASLANLVEYHIAAGTDAIVAVGTSGESATLTVDEHVKVVLKTLEYAKGRIQVLAGTGANATHEAIIFSKLFSGTGVAGCLTVTPYYNKPTQEGLYQHYKAIAEATDLPQLLYNVPGRTAVDLLPETVARLAKFENIVGIKDATGDLSRVKKTRELCGEDFIQLSGDDATGLDFVAQGGHGVISVTANIAAADMATMFKLALSGQFEAAQKINARLMPLHRDLFVESNPIPVKWAAHQLGLIKHGYLRLPLTELSESAHPVVLQALKDANVLL

SEQ ID NO: 4507 - protein, 161 aa, Agrobacterium tumefaciens str. C58
MKPSAFLPGVAMSIPFPSAPADKEALENAGLFSPKFDAHGLVTAVVTDARDGELLMVAHMNAEALSLTLETGIAHYYSRSRDKIWKKGETSGNLQTVKEFRTDCDQDAVWLKVSVAGHDATCHTGRRSCFYRTVELSNGDAVTKITDDTRHFDPATTYSNT

SEQ ID NO: 4508 - protein, 144 aa, Agrobacterium tumefaciens str. C58
MATFVKDLLDRKGRDVVTVGPDVSIGEAAGTLHAHKIGAVVVTDADGVVLGIFTERDLVKAVAGQGAASLQQSVSVAMTKNVVRCQHNSTTDQLMEIMTGGRFRHVPVEENGRLAGIISIGDVVKARIGEIEAEAEHIKAYIAG

SEQ ID NO: 4509 - protein, 670 aa, Anabaena variabilis ATCC 29413
MAVATQSLEELSINAIRFLAVDAIEKAKSGHPGLPMGAAPMAFVLWNRFMRYNPKNPKWFNRDRFVLSAGHGSMLQYALLYLTGYDSVSIEDIKQFRQWESKTPGHPENFMTAGVEVTTGPLGQGIANGVGLALAEAHLAAKFNKPDAKIVDHYTYVILGDGCNMEGVSGEAASLAGHWGLGKLIALYDDNHISIDGSTDVAFTEDVSQRFESYGWHVIHVKDGNTDLEAIHKAIEEAKAVTDKPTLIKVTTIIGYGSPNKSNTAGVHGAALGGDEVALTRQNLGWSHDPFVVPEDVLNYTRKAVERGAGYESDWNKTYADYKAKYPQEAAEFERHLSGKLADGWDKVLPSYTPEDKGLPTRKHSETCLNKLAAVLPELIGGSADLTHSNLTEIKGKGDFQKGQYQNPNIHFGVREHGMGAICNGIALHGSGLIPYGATFLIFSDYMRAPIRLSALSQAGAIWVMTHDSIGQGEDGPTHQPIETLASLRAIPNLTVIRPADGNETSGAYKVAIERAKNNAPTLLAFTRQNVPNLAGTSIDNVAKGGYIVVDTDGTPDLILIGTGSELSLCVTAAEKLKAEGKKVRVVSLAAWDLFDAQDAAYKESVLPKAVTKRLAVEAASSFGWHKYIGSEGDVVTIDRFGASAPGGICLEKFGFTVDNVLAKAKQLLG

SEQ ID NO: 4510 - protein, 335 aa, Polaromonas sp. JS666
MSQRISLTRYLVEQQRREGHIPAQLRLLLEVVARACKGISQSVNKGALGGVLGTAGSENVQGEVQKKLDIIANEVLIEANEWGGHLAAMASEEMDSIYLVPNRYPQGEYLLLFDPLDGSSNIDVNVSIGTIFSVLKKPDDHAGVEEKDFLQPGNKQVAAGYCVYGPQTTLVLTVGDGVAMFTLDREQGSFVLIEENVRIPEDTKEFAINMSNMRHWDAPVKRYIDECLQGTEGPRGKDFNMRWVASMVADVHRILSRGGIFMYPWDKREPEKAGKLRLMYEANPMGWIVEQAGGSATNGKQRILDIQPGKLHERVSVILGSKNEVERVTGYHSGL

SEQ ID NO: 4511 - protein, 780 aa, Candida albicans SC5314
MSSPTSLDDLSNMPETGNTIKTLHELKQESSPDSNNEMNIDGEMSNDNSNHSNSNHKMHTYDGDFVMDNEYNDYEELRKSLVNKRRLSSIKRPHGPFLDHNNQIDKRSLLRLPTEILLQIFHYLERRDWYSLLTTCSEIADLIIEMLWFRPHMQNDSAFKKIKEVMEINKSVTHWDYRQFIKRLNLSFMTKLVDDELLSLFIGCPRLERLTLVNCAKLTRYPITQVLNGCERLQSIDLTGVTDIHDDIINALANNCPRLQGLYAPGCGNVSEEAIIKLLRSCPMLKRVKFNSSTNITDESILVMYENCKSLVEIDLHGCENVTDKYLKSIFLDLTQLREFRISNAPGITDKLFESIPEGHILEKLRIIDITGCNAITDRLVEKLVSCAPRLRNVVLSKCMQITDASLRALSQLGRSLHYIHLGHCGLITDYGVAALVRYCHRIQYIDLACCSQLTDWTLVELANLPKLRRIGLVKCSMITDSGILELVRRRGEQDCLERVHLSYCTNLTIGPIYLLLKNCPKLTHLSLTGISSFLRREITQYCREPPSDFNEHQKSLFCVFSGHGVNQLRNYLNQVVEERTYQIDQGDIHTLFNERRRRFLNGDIDMDEEEMNIWERRRGLGVTADLGHPDMAEINREIFRELNEGNMGPDEMREHFQRLIRNHHQQRLLEHQNRLNQQLVQQRQQQQQQEPQLEQENLQNRGQVETQAPDQLPNEGQLRLQPPLQQQRAQNTIINNPQNAPQIEQPAVFPNGENQTLPLVLNEDEDVDMEPVDLFPRNT

SEQ ID NO: 4512 - protein, 266 aa, Ralstonia metallidurans CH34
MTQTHLGTALVTGASSGIGAIYADRLARRGYDLILVARNRDKLDTLARRITDDTQRVVEVFPADLNDRQSLARVEEKLRQDASITLLVNNAGVGTHTPLLDSDVDAMNRMIDLNVTALTRLTYAAVPGFVARGRGAIINISSIVGIAPEILNGVYGGSKAFVLAFSQSLHHELAAKGLRVQAVLPGATATDFWETGGLPIEHLDKAIVMPAEAMVDAALVGFDRGELVTIPPLHAIEQWNAYEGARQAMAGLLSTNTPAPRYATGR

SEQ ID NO: 4513 - protein, 406 aa, Photobacterium sp. SKA34
MTTEQRVERNLFDKVMVPCYSPMAEIPVRGSGARVWDQHDREYVDFAGGIAVSCLGHCHPIMVNALKDQADKLWHLSNVLTNEPALRLAKKLTELCFADKVFFANSGAEANEAALKLARRYAVDKFSAEKDQIIAFHQGFHGRTFFTVTVGGQEAYSDGFGPKPQAVTHIPYNDLSALAEIMSERTCAVMMEPLQGEGGLVSPSVEFVQGVRELCDKHQALLIFDEVQTGNGRTGDFYAYQGLGVTPDILTTAKSLGGGFPIGAMLTTTELAEHLKVGTHGSTYGGNPLACAVAEAVINEVSKPDVLAGVKEREQWFREGLTAINAKYPIFAEIRGKGLLLGASLTEEWQGRARDILVQAGKEGLMMLVAGTSVVRFTPSLVIEKADVDEGMARLERAIATLYNAE

SEQ ID NO: 4514 - protein, 155 aa, Anabaena variabilis ATCC 29413
MGVSGSGKTTIGQMLAESLHWEFYDADSFHSLENIEKMRRGIPLDDADRIPWLQSLQTAITNWLQNNRNVVLACSALKASYRQFLLLDTDIKLVYLQGTFELIQTRLQKREHHFMNVELLTSQFASLEEPDDVIRVDISQSPQVIIQVIKTMINV

SEQ ID NO: 4515 - protein, 587 aa, delta proteobacterium MLMS-1
MALDPTKHADWEIAEEAESRMKTVYELGEQLGMEKEEVLPQGHYVAKLDYRKILERSKNKPDGKYVDVTAITPTPLGEGKSTCAMGLVQGLGKRNKSVIGAIRQPSGGPTMNIKGSAAGGGLAQCIPLTPFSLGLTGDINAIMNSHNLGMVALTSRMQHEANYTDEQLAKRNLKRLDIHPKKVEFGWIIDFCAQALRNITIGQGGKMDGFNMQSKFSIAVSSEIMAILSVARDLKDMRQRIGKIVVAYDKQDRPITTADLEVDGAMTAWMVEALNPNLMQTLEGQPVVVHAGPFANIAIGQSSVIADRVALKLADYNVTESGFGADIGFEKFWNLKCRFSGLKPHCAVVVATIRALKCHGGAPIPVPGKPMPEEYGKENVGWVEEGCKNLLHHIETVKKAGINPVVCINAFYTDSDNEIKAVRRLCEAAGARVALSRHWEQGGDGALEFADAVVEACEEENDFRFLYELETPLEKRIELIAKEVYGADGVSYTPDAKAKLKRMEADPDMKEMGTCMVKTHLSLSHDPSLKGVPKGWTLPVQDILTYKGAGFVVPVAGTISLMPGTASDPAYRRIDVDTDTGKVKGVF

SEQ ID NO: 4516 - protein, 151 aa, Coccidioides immitis RS
MSTSARRRLMRDFKRMQTDPPAGVSASPVADNVMTWNAVIIGPADTPFEDGTFRLVMHFEEQYPNKPPGVKFVSKMFHPNVYGTGELCLDILQNRWSPTYDVAAILTSIQSLLNDPNTSSPANVEASNLYKDNRKEYAKRVRETVEKSWED

SEQ ID NO: 4517 - protein, 487 aa, Legionella pneumophila str. Lens
MKTNIPTLSKPIKDSGYRRGLKDRHVQLIALGGIIGSGYFLGTGEVINLVGPSVFIAYLLGGLIIYLTMLCMGELAVAIPISGSFVTYTSDFISPTVACGVGWSYWITWVAYIPAECVAGGIIMELFTGVSGYIWVVCFGLVITYINLAKVDTFGEIEFWLALIKIISLLAFVFLAILIFFGLIHGSEPPGIIGFKYLLDDGGLLPNGAMSLLTAMVLLLVNYQGSEIIGLAAGESENPARMIPHAIRNVTFRILFLYIIPVFCLVLIFPWQKAGLSNSVFADALNFYGLKWAGAVTSFVTLSATLSCANSGFYGAVRSLNALARDGMAPHVLAKFNQNSVPQNAVIATLIGVWILLGVGYFFGQTKLYIALLLVSGFTGTLAWLSLCIAQISFRNRLYKAGYSIKDLRYVTPYSPYTGILAVILMVGSLFFLLLNKDPIYKLSFIIGVVSFIIPVIIYKVFDLSKVRKKALHVKSRVKFQDLFPPQ

SEQ ID NO: 4518 - protein, 331 aa, Candida albicans SC5314
MFSNKFNRLGPLVIQNSSHKYPGVRNFSIDHNAIINTMTSSFQTVHEFSGLPWWALIPLTTFTLRSVWTLPLAILQRKRIQKQSQLRPLVSAMNPILKLNLARRVQQAKKKLENNSNTKEDITSIQASSTLINMKYEQILLLSAKEARKRQKELFAKNGVQLWKNFILPAFQVPLWIMMSITMRDLSGWSSWDNTHNKALDPSLYEEGILWFQDLSIADPMHVFPVILGITALCNIEWTLKTLELSRLTKKLKFRPTLTDAFGNLTKMSIVFMMAISLHAPAALTIYWISSQLYSLLQNVMMDLMLPISFTPKKRINYAKIKNDNAVNVIN

SEQ ID NO: 4519 - protein, 661 aa, Streptococcus salivarius
MTFDAIDQMAVSTIRSLSIEAIQAANSGHPGLPMGAAPMAYVLWNHVMNVNPKTSRNWTNRDRFVLSAGHGSALLYSLLHLSGYDVTMDDLKNFRQWGSKTPGHPEVNHTDGVEATSGPLGQGIANAVGMAMAEAHLAAKFNKPGFDIVDHYTYALHGDGCLMEGVSQEAASLAGHLKLGKLVLLYDSNDISLDGPTSMAFTEDVKAKFEAYGWQHILVKDGNDLEAIAKAIEEAKAETDKPSIIEVKTIIGYGAEGQGTSAVHGAPIGQDGIDHAKGVYGYDAPAFTVPDEVARRFEAGIKFRGEAAENAWQTKFAEYESAYPELAAEYKAAFANEPVHVDLNAHELGSAVASRVSSQQAIQQISEQVPSFWGGSADLSASNNTMVKAESDFQADNYAGRNIWFGVREFAMAAAMNGIALHGGTRVYGGTFFVFSNYLLPAVRMAALQNLPVTYVMTHDSVAVGEDGPTHEPIEQLASVRSMPNLNVIRPADGNETNAAWKRALAETERPTMLVLTRQNLPVLDGTAENAETGVNKGAYIISEANGDLDGIIIATGSEVKLALDTQAALEAEGVHVRVVSMPSQNLFDEQDAAYKEEVLPAAVTKRLAIEAGTSFGWGKYVGLAGKILTIDTWGASAPGDRIFKEYGFTVENASQLYKSL

SEQ ID NO: 4520 - protein, 322 aa, Fusobacterium nucleatum subsp. nucleatum
MEKKLAILTSGGDAPGMNAAIRATAKIAEYYGFEVYGIRRGYLGMLNDEIFPMTGRFVSGIIDKGGTVLLTARSEEFKEARFREIAANNLKKKGINYLVVIGGDGSYRGANLLYKEHGIKVVGIPGTIDNDICGTDFTLGFDTCLNTILDAMSKIRDTATSHERTILIQVMGRRAGDLALHACIAGGGDGIMIPEMDNPIEMLALQLKERRKNGKLHDIVLVAEGVGNVLDIEEKLKGHINSEIRSVVLGHIQRGGTPSGFDRVLASRMAAKAVEVLNKGEAGVMVGIEKNEMVTHPLEEACSVDKRKSIEKDYELALLLSK

SEQ ID NO: 4521 - protein, 458 aa, Aspergillus oryzae
MSNLPIEPEFEQAYKELASTLENSTLFQKNPEYRKALAVVSVPERVIQFRVVWEDDNHQVQVNRGFRVQFNSALGPYKGGLRFHPSVNLSILKFLGFEQIFKNALTGLNMGGGKGGSDFDPKGKSDNEIRRFCVAFMTELCKHIGADTDVPAGDIGVTGREVGFLFGQYRKIRNQWEGVLTGKGGSWGGSLIRPEATGYGVVYYVEHMIKHATDGKESFAGKRVAISGSGNVAQYAALKVIELGGSVVSLSDSKGALIVNGEGSFTPEEINTIAQIKVDRKQISEIASTEAFASKFKYIPGARPWTHVGKVDIALPSATQNEVSGEEAQALIDAGCKFIAEGSNMGSTQDAIDIFEAHREANKGASAIWYAPGKAANAGGVAVSGLEMAQNSARINWTSEEVDARLKGIMEDCFKNGLETAIEYATPAEGVLPSLVTGSNIAGFTKVAAAMKDQGDWW

SEQ ID NO: 4522 - protein, 857 aa, Solanum tuberosum
QIVGGLIGGHHDSKKVKGTVVMMKKNALDFTDLAGSLTDKIFEALGQKVSFQLISSVQSDPANGLQGKHSNPAYLENFLFTLTPLAAGETAFGVTFDWNEEFGVPGAFIIKNTHINEFFLKSLTLEDVPNHGKVHFVCNSWVYPSFRYKSDRIFFANQPYLPSETPELLRKYRENELLTLRGDGTGKREAWDRIYDYDVYNDLGNPDQGEQNVRTTLGGSADYPYPRRGRTGRPPTRTDPKSESRIPLILSLDIYVPRDERFGHLKMSDFLTYALKSIVQFILPELHALFDGTPNEFDSFEDVLRLYEGGIKLPQGPLFKALTAAIPLEMMKELLRTDGEGILRFPTPLVIKDSKTAWRTDEEFAREMLAGVNPIIISRLQEFPPKSKLDPEAYGNQNSTITAEHIEDKLDGLTVDEAMNNNKLFILNHHDVLIPYLRRINTTTTKTYASRTLLFLQDNGSLKPLAIELSLPHPDGDQFGVISKVYTPSDQGVESSIWQLAKAYVAVNDSGVHQLISHWLNTHAVIEPFVIATNRQLSVLHPIHKLLYPHFRDTMNINAMARQILINAGGVLESTVFPSKFAMEMSAVVYKDWVFPDQALPADLVKRGVAVEDSSSPHGVRLLIEDYPYAVDGLEIWSAIKSWVTDYCSFYYGSDEEILKDNELQAWWKELREVGHGDKKNEPWWPEMETPQELIDSCTTIIWIASALHAAVNFGQYPYAGYLPNRPTVSRRFMPEPGTPEYEELKKNPDKAFLKTITAQLQTLLGVSLIEILSRHTTDEIYLGQRESPEWTKDKEPLAAFDKFGKKLTDIEKQIIQRNGDNILTNRSGPVNAPYTLLFPTSEGGLTGKGIPNSVSI

SEQ ID NO: 4523 - protein, 287 aa, Picea mariana
YKVTKGMAEKYGDLRVLDTPIAENSFTGMGVGAAMTGLRPVIEGMNMGFLLLAFNQISNNCGMLHYTSGGQFTIPVVIRGPGGVGRQLGAEHSQRLESYFQSVPGLQMVACSTPYNAKGLMKAAIRSENPVILFEHVLLYNLKEKIPDEEYVCCLEEAEMVRPGADVTILTYSRMRYHVMQAAKTLVNKGYDPEIIDIRSLKPFDLHTIGNSIKKTHRVLIVEECMRTGGIGASLRAAIIENFWDYLDAPIMCLSSQDVPTPYAGTLEDWTVVQPPQIVSAVEQICQ

SEQ ID NO: 4524 - protein, 285 aa, Nostoc sp. PCC 7120
MTVKHLAIAPEGKKSLRLSWTNVAFFTTIHALALLAPWFFSWSALGLLLFLHWLFGSIGICLGYHRLLSHKSFQVPKWLEYAIATIGALAMQGGPIFWIGGHRQHHAHTEDVYLDPYSSQRGFWWSHMLWILYPRSEFFDYEIYQKYAPDLARQPFYRWLDRYFLLLQIPFGLMLYAIGGWSFVIYGVVLRAVLLWHSTWFVNSATHMWGYRTFNADDNARNLWWVSIVTYGEGWHNNHHTYPNVAKAGFQWWEVDVTWWSIKLLQTLGLAKKVVLPPSQRMNQG

SEQ ID NO: 4525 - protein, 170 aa, Botryotinia fuckeliana
IMGVSGAGKTTLLDVLASRVTMGVITGGMLVDGQQRDQSFQRSTGYVQQQDLHLLTTTVREALTFSALLRQPGHVSREEKLKYVDEVIDLLDMELYADAVVGVPGEGLNVEQRKRLTIGVELAAKPQLLLFLDEPTSGLDSQTSWIICNLMEKLKNSGQAILCTIHQPSA

SEQ ID NO: 4526 - protein, 152 aa, Nostoc sp. PCC 7120
MRGKVSKVLNQSGVIPYRERNGKIEILLITTRDRQSWVIPKGGIVNGMTPPDSAAKEAWEEAGVIGQVDVNELGTYKYRKRGKVYQVKMYLLPVEMVSNNYPEANKRYRRWLDANQAIKLIKKDSLKRILKGFLQTKSHTCASSLELSQQSI

SEQ ID NO: 4527 - protein, 106 aa, Brassica napus
MGRKKGLPEFEETAPDGFDPENPYKDPVAMVEMREHIVREKWIQIEKAKILREKVKWCYRVEGVNHYQKCRLLVQQYLDSTRGVGWGKDHRPISLHGPKPEAVEAE

SEQ ID NO: 4528 - protein, 139 aa, Triticum aestivum
  misc_feature (73)..(73): Xaa can be any naturally occurring amino acid
  misc_feature (75)..(75): Xaa can be any naturally occurring amino acid
  misc_feature (78)..(78): Xaa can be any naturally occurring amino acid
  misc_feature (82)..(82): Xaa can be any naturally occurring amino acid
  misc_feature (86)..(86): Xaa can be any naturally occurring amino acid
  misc_feature (88)..(88): Xaa can be any naturally occurring amino acid
  misc_feature (91)..(91): Xaa can be any naturally occurring amino acid
  misc_feature (93)..(93): Xaa can be any naturally occurring amino acid
  misc_feature (95)..(95): Xaa can be any naturally occurring amino acid
  misc_feature (100)..(100): Xaa can be any naturally occurring amino acid
  misc_feature (102)..(103): Xaa can be any naturally occurring amino acid
  misc_feature (105)..(107): Xaa can be any naturally occurring amino acid
  misc_feature (109)..(110): Xaa can be any naturally occurring amino acid
  misc_feature (113)..(113): Xaa can be any naturally occurring amino acid
  misc_feature (115)..(116): Xaa can be any naturally occurring amino acid
  misc_feature (118)..(120): Xaa can be any naturally occurring amino acid
  misc_feature (122)..(122): Xaa can be any naturally occurring amino acid
TTLSPEPDAAPIPHPHSPSAAAAAGVQLGTSKPQIATQAEMAEARLPIPYRDQCAHLLIPLNKCRVAEFYLPXKXEPXKRHXYEKXQXRAXHXAXCFQMXKXXEXXXAXXRPXAXXTXXXMXSKIYEPFTLPFPYNPFF

SEQ ID NO: 4529 - protein, 416 aa, Zea mays
MWESPRQTQAHTPFPSWIPYAGTFAAGVGMVAAADSSLPSERGPGPDCAWNQSAPSVGARDGGSGYRGNYFLSLLDSKNVTPEMFEDDVVVLPAASPSRDYLGVGGGAGAAASNMAGPAAAYGLLDPYYSPVVASRAPPVDHETASSPLVYSGDGVVRGTSMPCYDDDHEEKRPTGGRQPQGFGAPAAAFLQEMMIPSRVETKLHSGLGYLGMVSQSRLETSFGVVGSLPDAAGSFSDEYNSNRSSADFMSSNSNRSLEQRVGGSSSGRGAATRRKSDGGLGGNTKKSKQEASPKASSAPKQPQAPRVKIGEKITALQQIVSPFGKTDTSSVLFETIEYIKFLHEQIRMFSEPYMTKSTYKGHIGLRGEEEESGTGHDLRGRGLCLVPVSLTSQAYQEDDTLPDCWAPAYRGCLYR

SEQ ID NO: 4530 - protein, 194 aa, Zea mays
  misc_feature (154)..(154): Xaa can be any naturally occurring amino acid
  misc_feature (174)..(174): Xaa can be any naturally occurring amino acid
DSADVEQRHHVVSFPATTDTSSVVLEGNSSEAIQILYQVWEDPSSSPQALRALEQAITKLCERLTEEKRGEDLRTLLTKLIPFFSLIPKDKSAKIVRGIIDTLIKIPGTTHLPITLCKEMAEWTRAEKSTFLKPSEKARLAALLMENKEYVEAXLTLLTTLVKDVKRLDDHVLXLADIDLLESKLHYRVEKLTL

SEQ ID NO: 4531 - protein, 507 aa, Solanum tuberosum
MASFSLPLPSLHQQFPSKYSTFRPIIVSLSEKPTIVVTQPTKLPTRTIPGDYGLPGIGPWKDRLDYFYNQGKDEFFESREVKYKSTIFRTNMPPGPFISSNPKVIVLLDGKSFPVLFDVSKVEKKDLFTGTYMPSTELTGGYRVLSYLDPSEPNHEKLKKLMFFLLSSRRDHVIPKFHETYTEFFETLDKEMAEKGTAGLNSGNDQAAFNFLARSLFGVNPVETKLGTDGPTLIGKWVLLQLHPVLTLGLPKFLDDLILHTFRLPPFLVKKDYQRLYDFFYTNSASLFAEAEKLGISKEEACHNLLFATCFNSFGGMKIFFPNMLKSIAKAGVEVHTRLANEIRSEVKSAGGKITMSAMEKMPLMKSVVYEALRVDPPVASQYGRAKQDLKIESHDAVFEVKKGEMLFGYQPFATKDPKIFDRPEEFVADRFVGEEGEKLLKYVLWSNGPETESPTVGNKQCAGRDFVVMVSRLFVTEFFLRYDTFNVDVDKSALGASITITSLKKA

SEQ ID NO: 4532 - protein, 370 aa, Gibberella zeae PH-1
MAEFVRAQIFGTTFEITSSPPFIAILTRLARRYSDLQPVGMGAFGLVCSARDQLTNQNVAVKKIMKPFSTPVLAKRTYRELKLLKHLKHENVISLSDIFISPLEDIYFVTELLGTDLHRLLTSRPLEKQFIQYFLYQIMRGLKYVHSAGVVHRDLKPSNILVNENCDLKICDFGLARIQDPQMTGYVSTRYYRAPEIMLTWQKYDVEVDIWSAGCIFAEMLEGKPLFPGKDHVNQFSIITELLGTPPDDVINTIASENTLRFVKSLPKRERQPLRNKFKNADDSAIDLLERMLVFDPKKRITATEALAHDYLSPYHDPTDEPVAEEKFDWSFNDADLPVDTWKIMMYSEILDYHNVEAGVTNMEEQFNGQ

SEQ ID NO: 4533 - protein, 207 aa, Oryza sativa (japonica cultivar-group)
MTSLPGRGVSPSSSDPLCEGNAAPSSSSSSGQDLKQLKNSILSCVFSSPFSIFEAHQDSSANRSLKPHSGSYAWSRFLRRIACTGSMWRFLGASKALTSSDVWFLGKCYKLSSEELSNSSDCESGNAAFLEDFSSRIWITYRKGFDAISDSKYTSDVNWGCMVRSSQMLVAQALIFHHLGRSWRKPSQKPYSPEYIGILHMFGDSEA

SEQ ID NO: 4534 - protein, 313 aa, Prochlorococcus marinus str. MIT 9515
MKDLNIEFPLDNFEKLIFQIGWSSLDEWFDFWKLKKEMLSIDDFWDENVNDDWIWGLALPLLSQAYKLNLESHERKIIGISALPGTGKTTLGKWLETISLKLNFKISVISIDDFYLPSEEMALAIKNNPWNVSRGFPGSHSIDLMKEKILRWKTDGKLNVPVFDKSLRKGLGDRSYWREEKPDLLIIEGWFLGVKPFSEDSHSLEIITPPLSPHESSYRYKIQNNLINYLDIWNMIDQIWHLKPLKFEFMNEWKSNQEKSMFVKKGSSLKENRLNDFIRMLNVSIPHQSFDLISSDVLLLINQERKLINVGLN

SEQ ID NO: 4535 - protein, 454 aa, Medicago truncatula
MDLIELSKAVENVELVDTLDTDVSFVRILWVDNSGQHRCRAIPRKRFYDVVTKNGVGLAFVSMVMTSFLDGSPAGSGLGSVGEARLTPDLSTKRTIPWSKQDEIVLGDLNLQPGQAWEYCPREALRRVSKILKDEFDLAMNAGFENEFFLLKSAIREGKEEWIQFDSTPYCSSSAFDVASPILREVTSALHSMGIPVEQLHAEAGKGQFELVLGHMVCTKSADNLVYTRETVRAIARKHGLLATFVPKYTLDDLGSGCHVHLSLWQNGRNVFMASDESSKYGISTLGKEFMAGVLHHLPSILSFVAPLPISYDRLQPNTWSGAYMFWGNENREAPLRASTPPGTPNGFASNFEFKSFDGCANPYLGLSAIIAAGIDGLRRHLSLPEPVDTNPDPEKLQRLPKSLSESLEALHKADFLEEFIGDKLLTAIKAIRKAEIDHYSKNKDAYKQLIHRY

SEQ ID NO: 4536 - protein, 384 aa, Triticum aestivum
  misc_feature (186)..(186): Xaa can be any naturally occurring amino acid
MLRLRRGVLAQVLSSLSASSVPPLHRLISAAAPAISPNPSFAVEEYLVSTCGLTRPQALKASAKLSHLKSPANPDAVLAFLADLGLSDADVAALVAKDPQILCASVERTLAPVVAGLSGLGLSRSDIARLASLSRSSFRYRSIVSKLQYYMPLFGSFENLLRALKKNFYLHSADLDDVVKPNVAMXRECRLGACDIAKLCISQPWLLTANVKRVQAMVECAENIGVPRASGMFRHALHAVAFLSEDKIAARVKYLKNTFRWTDAEVGMAVSKAPMVLARSKESLQRRSEFLISEVGLEPVYIAQRSEIIGHSLEGRLRPRYYAVKFLKENGLLKRDPNYSTVFKISEKAFRKKFIFPHKEAAPHLTEDYDAACKGDVPTNFRFT

SEQ ID NO: 4537 - protein, 577 aa, Candida albicans SC5314
MRFKIRGPLIQLRYKSTKPFYITTPICYVNAAPHIGHLYSMLIADTRNKWEKLNPSKESFMLTGTDEHGLKIQSTAEKLGLEPKVLVDKVSQNFSKLAEQFDVNYDRFIRTTDNDHIELVRYFWNLMMEKGFIYTDTHSGWYSISDETFFPETQIEEVVKNGKAVKISSETKNEVVYQKETNYFFKLSMFQEQLIQFLKQNPEFIKPKHRYQFILKELEDTKLPDLSISRPSSRLKWSIEVPNDSTQKIYVWFDALLNYLTATKFPHGFEVQDSKFVTPENSIWPATHVIGKDIIRFHCIYWPIFLMAAGIELPKQVIVHSHWLCDGFKMSKSLGNVVDPMEISEYYGVDPVRFFLVENSNIDDDCKFSEELLQRSRDAVLGKYCNLISRIGGKNFSIEEAVKSSASGEFNNIREIIETYTINKDSVEGLLSSSSKLTTDLNDLYNQMDHYFTNFDYIRAIQCWWSVINQANQIFQSAEPWTYVKLINSPETPAELKEKYRILNNYFVYLCAETTRISSILIQPVMPQLSKKILDRLNVSGRTSEFTTFGADLQYGSGANSKSHKVPLEKIAPRDIK

SEQ ID NO: 4538 - protein, 459 aa, Agrobacterium tumefaciens str. C58
MERAGHAVAASGLRHYPQALRFVVLCGGGNNGGDGYVAARALVQSGATVTVHHLGDAGTLRGDARVAFERSGLVPLPLGDYTPLAGDVVIDAVFGAGLSRDVPQELARIIEAVTSARVPVLAVDLPSGLCGRRGVPLGASFRAERTVTFMARKPGHLLMPGRELCGALEVFDIGIPLRILADHAGSVAENHPLVWRDALPASDLETHKFRRGHLTVFSGPAHATGASRMTALAALKAGAGIVTIAAPKEALDLLSVTLTAVMNAPMDNADDLRLWLDDQRHGTFVLGPGFGDLKKARQFVSLLGDKAAVLDADAITAFKDHAAALFERITSGAGKFVLTPHEGEFARLFPDLAADRTLSKIEKAQVASARSGAALVYKGADTVIAAPDGRALVSTNAPASLATAGSGDVLAGIIGALLAQGTPAFEAAAAGVWLHGEAGHRAGDGMTAEDLAHAVRPFG

SEQ ID NO: 4539 - protein, 405 aa, Zea mays
MVAEAEVMHQSPVPVLEVQYHRRATTKGVDDVVGMSAPAPAEVGVGVGVEVEVEVEVAVEVPRMGLEQPDVAPSLSTDMIQQFVPNIRSGSFADIGPRRYMEDEHIRIDDLSAHLGSMLVCPLPSAFYGVFDGHGGPDAAAYMKRHAMRFLFEESEFPQASQVDEVYLESVESCVRRAFLQADLALADDLDISRSSGTTALTALVFGRQLVVANTGDCRAVLCRKGVAMEMSRDHRANHVEERERVAASGGYIEDGYLNGVLSVTRALGDWDMKAPGASASAALIAEPEFRRATLGEDDEFLVMGCDGIWDVMTSQHAVSLVRRGLRQHDDPARCARELVMEAKRLETADNLTVVVVCFAPEMGSPFTPQQQQEEELPARPRSCKKGLSTEALCSLRSWLDTDHR

SEQ ID NO: 4540 - protein, 469 aa, Agrobacterium tumefaciens str. C58
MTTANDILKQIKDNDIKFVDLRFTDPKGKLQHVTMDVVCVDEDMFADGVMFDGSSIAGWKAINESDMVLMPDPATAHIDPFFAQSTLVVLCDILDPVSGEAYNRDPRGTAKKAEAYLKASGIGDTVFVGPEPEFFVFDDVKYKADPYNTGFKLDSSELPSNDDTDYETGNLGHRPRVKGGYFPVPPIDSLQDMRSEMLTVLAEMGVVVEKHHHEVAAAQHELGVKFDTLVSSADKMQIYKYVVHQVANAYGKTATFMPKPIFGDNGSGMHVHQSIWKGGKPTFAGDEYAGLSENCLYYIGGIIKHAKAINAFTNPTTNSYKRLVPGYEAPVLLAYSARNRSASCRIPFGSNPKAKRVEVRFPDPTQNPYLGFAAMLMAGLDGIKNKIHPGKPMDKDLYDLPAKELKKIPTVCGSLREALESLDKDRKFLTAGGVFDDDQIDSFIELKMQEVMRFEMTPHPVEFDMYYSA

SEQ ID NO: 4541 - protein, 926 aa, Arabidopsis thaliana
MAPSSSSSPSKSPVPSLHQSLHFTPILECEEDDLQEERYKNRATPSSDGGSSATPNHQHHRRTNSNNNHQHTLTPLHHNGKPQTRKRHDDNDEDDGGAVSCNKCRPHHSHRDKFSVVPLESHNNPSFISSPNLIIKSIFQSLTRRSPKPSSATAALPPRSSSSSAADASREEQWRLAVAELSHKLIQATKKKEDAVIEASRLKSSMAELEKKLNKLEIYCHNLKSGLDECSNKKQSVPIRKDGFNDRIIQQFLVSVSESRSSIRALSRSLASQLRTVGGKVYERLSLLLQPFDVKINSFAKNPKSLIFYLEAILSRAFFEDFEAPGFQKNGSTRILNPIDRCESNYASFNVLMELTWDEVLSRGTKHFSEEFSRFCDRKMSDVVSMLSWNRAWPEPLLQAFFGASKSVWLVHLLANSVNPGLQIFRVEKDDRFDPIYMEETGGERFKSLVRAMVQPGFYVYGSVVKCKVVCKQCGSDEEELEDHTTLMRGVTETDKLANGIFHLVCLADLEFDYINPYDSASRINSVVLPEFIVQGVLCVFYLLTGHWFMTLLCLPYLYYNFHLYSKRQHLVDVTEIFNLLNWEKKKRLFKLAYIVLNLFLTIFWIEMSSISGLVEDEISSFFESSPPLKNKEEIVANLNQFIELNSSCQGGMRRIVCVTSGGTTVPLEQRCVRYIDNFSSGNRGAASTENFVKAGYAVIFLYRRGTCQPYCRYLPDDPFLECFEFPDAKNIQVHGSHSGAVKMAVMDQQAAVAEGRLLKLPFSTIYEYLQMLRLIATILKDVGPCSMFYLAAAVSDFYVPWLSMARTEHKIESGSGPLDIRLAQVPKMLSILRSNWAPKAFCISFKLETDSKILLEKATKALQKYKVHAVVANELLTRKEEVVVVSSSGNVVVRRDSNKPESIVEDNLIRLLVDRHSTYIKESLT

SEQ ID NO: 4542 - protein, 607 aa, Mesorhizobium sp. BNC1
MKIRNIAIIAHVDHGKTTLVDELLKQSGSFRENQRVAERVMDSNDLEKERGITILAKATSVEWKGVRINIVDTPGHADFGGEVERILSMVDGAIVLVDASEGPMPQTKFVVGKALKVGLRPIVAINKIDRPDGRHQEVINEVFDLFANLDATDEQLDFPILYGSGRDGWMNFNPEGPKDQGLAPLLDLVLSHVPEPTVEEGPFRMIGTILEANPFLGRIITGRIASGSVKPNQAVKVLGQDGRLIEQGRISKILAFRGIERQPIEEAHAGDIVAIAGLSKGTVADTFCDPVVTEAMKAQPIDPPTVTMSFIVNDSPLAGTEGDKVTSRVIRDRLFKEAEGNVALKIEEAEGKDSFYVSGRGELQLAVLIETMRREGFELAVSRPRVVMHKDENGTLLEPIEEVVIDVDEEYSGVVVQKMSERKAEMVELRPSGGNRLRLRFYAPTRGLIGYQSELLTDTRGTAVMNRLFHDYQPYKGAIGGRINGVLLSNAAGEAVAYAMFNLEDRGPMIIEPGEKVYQGMIIGIHSRDNDLEVNVLKGKQLTNIRAAGKDEAVKLTPPIRMTLDRALSWIQDDELVEVTPKSIRLRKMYLDPNERKRFEKQKLAVA

SEQ ID NO: 4543 - protein, 530 aa, Oryza sativa (japonica cultivar-group)
MASGSTDPLLPRAGAARRRPATGGWRSALFIIWVEVAERFAYYGVSSNLISYLTGPFGETTAAAAAAVNAWSGAASMLPLLGAAVADSWLGRYRTIVASSVLYITGLGLLALSSTFSSPQSQQCSSSGDGRQVCRSSSVQRAFFYVSLYLVAIAQSGHKPCVQAFGADQFDATDPGESSSRSTFFNWWYLGLCASATVTAAVMSYVQDNVGWGLGFGVPGMVMLLGLLVFLLGTRTYRFYDGGGSGAFSGVGEAVRAWRKSRRRGEGGGGGGATVEAEHGELAEEVRGMARLFPIWATCLLYGVLFAQPPTLFTKQAATLDRRIGPSSSFQVPPAALQSFLGVSIIPCVLLYEHVLVPAARRATGVATGITMLQRIGAGIAMCAVTLLVAALVEMRRLSAARDADPGAAVPMSLWWMVPQYVLFGAADVFAMVGMQEFFYDQVPGALKSLGLALYLSVLGVGSFISSFLISAIDVVTRRDGGTSWFDDDLNRGHLDYFYLLLAALTVLDLLAYVYFSMSYIYRRKVVDVQ

SEQ ID NO: 4544 - protein, 411 aa, Ustilago maydis 521
MSSFSRNLLRTAGKAKSLPAYSRNAIPSSSRFVQLTAEASRPQQELPESKTEKFTVDLNADSFKGYKLEVPKLEWETSKDELVHLYSEMVKMRRMEMAADQLYKQKLIRGFCHLAIGQEAVAVGMEAGMKPSDKLITAYRCHPFTVQKGGSIKSVIAELFGRQDGISKGKGGSMHMFTPTFFGGNGIVGAQVPVGAGIAFAQQYMNTNDATFAMYGDGASNQGQVFEAYNMAKLWNLPCVFVCENNKYGMGTSAERSSMNTQYYTRGDVIPGIQVNAMDVLAVAAATKHASGYTLGGNGPLLMELVTYRYGGHSLSDPGTTYRTRDEIQTMRSSSDPIQGLKARMLDWGVVEEAELKRIDKAAKEEVDQAVEEAKQSPQPSEHSLWTDIYYPGTEPDWMRGRDRTEIHRYR

SEQ ID NO: 4545 - protein, 137 aa, Zea mays
  misc_feature (61)..(61): Xaa can be any naturally occurring amino acid
  misc_feature (74)..(74): Xaa can be any naturally occurring amino acid
  misc_feature (99)..(99): Xaa can be any naturally occurring amino acid
MVALLGRRIGVAAAAAAFIALVAFGSASSSPKSFVKSTVSAHDVVIFSKSYCPYCKRAKAXFKELELKKEPYVXVELDQREDGSEIQDALLEIVGRRTXVPQVFVHGKHLGGSDDTVDSYESGKLARLLNIGVKDDL

SEQ ID NO: 4546 - protein, 284 aa, Photobacterium sp. SKA34
MKPVLKMSVLAATIFLAVGCQDDNKADTNKPAEPAKVEQVAAKTPAADAKVEFKTEDQKAAYAIGASLAQYLSANLEQQKELGLDLNRQDVLQGVEDVFAGKSRLTQEQTQQALQELDQRVAKIVEEKAKTEAEKNVKAGEEFRTKFSKETGVVTTKTGLMYKIEKEGTGPKPTATDTVEVHYKGMLTDGTVFDSSYKRNQPATFPLNQVIPGWTEGVQLMPVGSKFEFVIPPQLAYGAQANPSIPANSTLVFQVELLSIKGNETAKPAAAPAEKSAATETKTQ

SEQ ID NO: 4547 - protein, 229 aa, Solanum tuberosum
MAAILARKSLSALRSRQLVLAGQAWQGTNTPNGTLLGTRSFATKHSFSTDKDDEEREQLAKELSKDWNSVFERSINTLFLTEMVRGLMLTLKYFFEKKVTINYPFEKGPLSPRFRGEHALHRYATGEERCIACKLCEAICPAQAITIEAEEREDGSRRTTRYDIDMTKCIYCGFCQEACPVDAIVEGPNFEFATETHEELLYDKEKLLENGDRWEIEIAENLRSESLYR

SEQ ID NO: 4548 - protein, 425 aa, Arabidopsis thaliana
MEGENNMEKGLLLAKKEDSANTTPLLIFSTFIIVSASFTFGAAIGYTADTMSSIMSDLDLSLAQFSLFGSLSTFGGMIGAIFSAKAASAFGHKMTLWVADLFCITGWLAISLAKDIIWLDMGRFLVGIGVGLISYVVPVYIAEITPKHVRGAFTFSNQLLQNCGVAVVYYFGNFLSWRTLAIIGSIPCWIQVIGLFFIPESPRWLAKKGRDKECEEVLQKLRGRKYDIVPEACEIKISVEASKKNSNINIRSLFEKRYAHQLTIGIGLMLLQQLCGTAGISSYGSTLFKLAGFPARIGMMVLSLIVVPKSLMGLILVDRWGRRPLLMTSALGLCLSCITLAVAFGVKDVPGIGKITPIFCFIGILSFTMMFAIGMGALPWIIMSEIFPMDIKVLAGSLVTIANWFTGWIANYAFNFMLVWSPSGE

SEQ ID NO: 4549 - protein, 447 aa, Paenibacillus polymyxa
TIFQFPQDFMWGTATAAYQIEGAYQEDGRGLSIWDTFAHTPGKVFNGDNGNVACDSYHRYEEDIRLMKELGIRTYRFSVSWPRIFPNGDGEVNQEGLDYYHRVVDLLNDNGIEPFCTLYHWDLPQALQDAGGWGNRRTIQAFVQFAETMFREFHGKIQHWLTFNEPWCIAFLSNMLGVHAPGLTNLQTAIDVGHHLLVAHGLSVRRFRELGTSGQIGIAPNVSWAVPYSTSEEDKAACARTISLHSDWFLQPIYQGSYPQFLVDWFAEQGATVPIQDGDMDIIGEPIDMIGINYYSMSVNRFNPEAGFLQSEEINMGLPVTDIGWPVESRGLYEVLHYLQKYGNIDIYITENGACINDEVVNGKVQDDRRISYMQQHLVQVHRTIHDGLHVKGYMAWSLLDNFEWAEGYNMRFGMIHVDFRTQVRTPKESYYWYRNVVSNNWLETRR

SEQ ID NO: 4550 - protein, 487 aa, Glycine max
MVEKDGVGSKYLQQTLNVSIDMHQHGISKCFDDDGRPKRTGTVWTSSAHIITAVIGSGVLSLAWAIAQLGWIAGPIVMVIFSAITYYTSTLLADCYRTGDPVTGKRNYTYMDAIQSNFGGNGFKVKLCGLVQYVNLFGVAIGYTIAASTSMMAIERSNCFHKSGGKDPCHINSNMYMISFGIVEILFSQIPGFDQLWWLSIVAAVMSFTYSTIGLGLGIGKVIENGGVGGSLTGITIGTVTQTDKVWRTMQALGDIAFAYSYSLILIEIQDTVKSPPSESKTMKKASFISVAVTSIFYMLCGCFGYAAFGDASPGNLLTGFGFYNPYWLLDIANAAIVIHLVGSYQVYCQPLFAFVEKHAAQMFPDSDFLNKEIEIPIPGFHPYRLNLFRLVWRTIYVMLSTVISMLLPFFNDIGGLLGAFGFWPLTVYFPVEMYIIQKRIPKWSTKWICLQILSMTCLLMTIGAAAGSIAGIAIDLRTYKPFKTNY

SEQ ID NO: 4551 - protein, 288 aa, Xylella fastidiosa Temecula1
MFDIPGLSTGDFHGFPSLLIQTPFSHAAISLFGGQLLSFVPSGGEEVMWLSPLVQPPPTAIRGGIPVCWPYFGRQGQRDTMPAHGFVRTVPWQQVESCQENDGSLFLVMAPPPLKHLGLHLRMTLRIGRTLEQELATENISHAPISFTQALHNYFRVSNALQVTVQGLDGVEYLDKFEGYTQRHRQQGHWTLQDPHDPGRADRIYVDTSGHYVLVDPLFSRRIVLTTEGSHSLVVWNPGHAGASNMIDVADGWRDYLCLEPANAGPDEIELLPGARHVLRQSIAIAPL

SEQ ID NO: 4552 - protein, 466 aa, Lactococcus lactis subsp. cremoris
MLYGKENRDEAEFLEPIFGSESEQVDLPKYKLAQQSIEPRVAYQLVQDEMLDEGNARLNLATFCQTYMEPEAVKLMSQTLEKNAIDKSEYPRTTEIENRCVNMIADLWNASEKGKIYGTSTIGSSEACMLGGMAMKFSWRKRAEKLGLDINAKKPNLVISSGYQVCWEKFCVYWDIEMREVPMDREHMSINLEKVMDYVDEYTIGVVGIMGITYTGRYDDIKALDNLIEEYNKQTDYKVYIHVDAASGGLYAPFVEPELEWDFRLKNVISINTSGHKYGLVYPGVGWVLWRDKKYLPEELIFKVSYLGGELPTMAINFSHSASQLIGQYYNFVRYGFDGYKAIHERTHKVAMYLAEEIEKTGMFEIMNDGAQLPIVCYKLKENSNRGWNLYDLADRLLMKGWQVPAYPLPKNLENEIIQRLVIRADFGMNMAFNYVQDMQEAIDALNKAHILFHQEPENKTYGFTH

SEQ ID NO: 4553 - protein, 431 aa, Oryza sativa (japonica cultivar-group)
MEDDDAGGGGGGGEASPPHAGSAAAMAGAGRDIAASPTSSRSVTQTVNGSHRFVIQGYSLAKGMGVGKHIASETFTVGGYQWAIYFYPDGKNPEDNSAYVSVFIALASEGTDVRALFELTLLDQSGKAKHKVHSHFDRSLESGPYTLKYRGSMWGYKRFFRRTALETSDFLKDDCLKINCTVGVVVSTMDYSKPHSIHVPESDIGYHFGTLLDNQEGVDVICNVAGEKFHAHQLVLAARSSFFRSELFEHESDEEKNEVDTSNEIKEIVIDDMEPKVFKAVLHFMYRDNLVGDDELSASSSDCSIFDTLAGKLLAAADRYELPRLRLLCESYLCKHISVNSVATTLALADRHHAMELKSVCLKFAAENLSAVIRTDGFDYLKDNCPALQSEILRTVAGCEEECSSGGKSQSVWGQLSDGGDTSGRRVRPRV

SEQ ID NO: 4554 - protein, 413 aa, Acinetobacter sp. ADP1
MSNYDVIIVGTGHAGGQAAVALRQQGFTGSILMIGEELHLPYERPPLSKEYFSGEKTFERILLRPEQFWKDKNIDLKLGQRVIQIDAQSHRILTQQNHEYHYGKLIWATGGKPRRLSCEGADLDGIHYIRNREDVDRINQELDRVQKCVVIGGGYIGLEAASALRKINRDVTLVEAQSRVLARVAGPIISDFYQQYHQQKGIEFYLGQGVDHLEGDQGRVHTVILANGTRIATDMVIVGIGLNPEINALIEAGAISSNGIETDRRCRTSLPDIFAIGDCANHENIFADGQRIRLESVQNANDQAMIVAKEILDKGEDYAAIPWFWSNQYDLKLQTIGLSIGYDQEVLRSEPDSGSFTVIYLRQGTIIALDCVNRPADFIQGKAIIQQSISIPTEQLSDHTLPFKELIQRYKNS

SEQ ID NO: 4555 - protein, 450 aa, Vibrio sp. Ex25
MSHIHDTIVALQHSSPAQKEFYQAVEEVLTSLAPVIESNNKYKEQAIIQRIVEPERQIMFRVPWVDDAGNVQVNKGYRVEFNSALGPYKGGLRFHHSVNASIIKFLGFEQIFKNALTGLPIGGGKGGSNFDPKGKSDGEIMRFCQSFMNELYRHIGPVTDVPAGDIGVGAREIGYMFGQYKRLTGRYEGVLTGKSLLWGGSLVRKEATGYGTVYFAECMLNDRNDSLKGKTCLVSGAGNVAIYAIEKLYHMGATPVTCSDSRGTIYHEHGIDLQLLKQLKEVKRASLEEYLDTYPEAEYTPLGDYPNEGHAVWRYQADAAFPCATQNELTSNDALALIDNGCVLISEGANMPTTRDAANIIVDSEMAYGPAKAANAGGVATSQLEMAQNASMQNWTFEQVDSQLQTIMKNIFVNANETSREFGQPGNLVLGANIAGFRRVADAMIEQGIV

SEQ ID NO: 4556 - protein, 120 aa, Neorickettsia sennetsu str. Miyayama
MGILAKFNEAQRKALSEGRNYPEFRAGYTMSVEFYVQGTSGRTQVFKGLCIGKSNKGVHSSFTLRKLSVHDVYVERTFRLYWPSIKSISVEREGKVRRAKLYYIRALTGKATRIRKEYRS

SEQ ID NO: 4557 - protein, 498 aa, Mesorhizobium loti MAFF303099
MTLSFDPRAKATTLYHGEFRPMFIGGKWVAAQSGQEMQALNPATGEVLTTVPRGGAADVDAAVAAARAAFEGPWSKFSPYERQCVLLRIADLFETHWEELSVSDTLDMGLPITRTLANRRRVIGMLRFYGGMATALHGEAIDNSIPGEIVSFTRREPVGVVGAIIPWNAPTAASIWKIAPALATGCTIVLKPSEEASLTPLLIARLMQEAGVPDGVVNIVTGTGAEAGARLAEHPDVNKIVFTGSTLTGQAIARAGVTNLKRVSLELGGKSPIIVCRDADIDKAVPVAAMAVFVHSGQICIAGSRLFVAREIHDEFVRRVAEFAGRLRIGHGIEAETEIGPLINARQAGKVEGYIKAGSDEGAKLVAGGSRLTGALYDGGNFIAPTVFGSVSDKMTIAREEIFGPVISAMPFDTLDEVVARANATPYGLAAGIFTTHLGTAHKLARRIRAGSVWVNMYHAIDPAVPFGGMKMSGYGREGGIEHLHEYLETKSVWIQTD

SEQ ID NO: 4558 - protein, 204 aa, Zea mays
SLVFCVQPVGVDNTSRRKFDKEEYLERARQREQREKDEARKGKERGPPVQRQPLKHRDYEVDLDSRLGKTQVVTPIAPLNQQAGYYCSVCECVVKDSANYLDHINGKKHQRALGMSMRVERASLEQVQKRFEALKKRKDPSAFTEEDLDERIMKQQQEEEERKRQRKEKKKEKKREQATQHEPEDVDPDIAAMMGFGGFGSSKK

SEQ ID NO: 4559 - protein, 377 aa, Phalaenopsis hybrid cultivar
MAEGEEIQPLVCDNGTGMVKAGFAGDDAPRAVFPSIVGRPRHTGVMVGMGQKDAYVGDEAQSKRGILTLKYPIEHGIVSNWDDMEKIWHHTFYNELRVAPEEHPILLTEAPLNPKANREKMTQIMFETFNAPAMYVAIQAVLSLYASGRTTGIVLDSGDGVSHTVPIYEGYALPHAILRLDLAGRDLTDALMKILTERGYSFTTTAEREIVRDMKEKLAYIALDYEQELETAKTTSSVEKSYELPDGQVITIGAERFRCPEVLFQPSMIGMEAAGIHETTYNSIMKCDVDIRKDLYGNIVLSGGSTMFPGIAERMNKEITALAPSSMKIKVVAPPERKYSVWIGGSILASLSTFQQMWIAKAEYDESGPSIVHRKCF

SEQ ID NO: 4560 - protein, 537 aa, Medicago truncatula
MVSTCVNFKANNHVANLRKDSIFHQDNGFLGERIKVGVNYSPWIGNQFGISLRTKERVKKAKPGVVSAVLTSNDATETKTFQVPSFIRRKADPKNVASIVLGGGPGVQLFPLTKRAATPAVPVGGCYRLIDIPMSNCINSGINKIFVLTQFNSASLNRHIARTYFGNGINFGDGYVEVLAATQTPGEAGKNWFQGTADAVRQFTWVFEDAKNTNIENVIILAGDHLYRMDYMDLVQSHIDRNADITVSCAAVGDSRASDYGLVKVDSGGRIIQFSEKPKGADLKSMSCVSDASLQQADTSLFGLSNQDALRSPYIASMGVYVFKTDVLLKLLKWRYPTSNDFGSEIIPASVKEYNVQAFFFGDYWEDIGTIKSFYDANMALTEESPMFKFYDPKTPIFTSPGFLPPTKIDKCRIVDAIISHGCFLRECSVQHSIVGERSRLDYGVELQDTVMMGADYYQTESEIASELAEGKVPIGIGSNSKVRKCIIDKNARIGKDVIIMNKDGVQEADRPEDGFYIRSGITIVMEKATIEDGTVI

SEQ ID NO: 4561 - protein, 292 aa, Cucumis sativus
MEGKEEDVRLGANKFNERQPIGTAAQSQDDAKDYKEPPPAPLFEPEELTSWSFYRAGIAEFFATFLFLYITVLTVMGVTRSKEADGNTCNTVGIQGIAWAFGGMIFALVYCTAGISGGHINPAVTFGLFLARKLSLTRAIFYIVMQCLGAICGAGVVKGFQPKPYERLGGGANVVSDGYTKGDGLGAEIVGTFILVYTVFSATDAKRSARDSHVPILAPLPIGFAVFLVHLATIPITGTGINPARSLGAAIIFNKDKAWDDHWIFWVGPFIGAALAALYHQVVIRAIPFKSK

SEQ ID NO: 4562 - protein, 452 aa, Brucella suis 1330
MNPADEKPYAVISAGSAADIDLAVAAARRAFPAWSETPAEERIAYIRRIAEIYESRLDEMAKTISMEMGAPIKLARESQAAAGLSHTKAFIAACENFEVEEVLSPKYPNQTAVHEPIGVCGLITPWNWPMNQITLKVIPAIAVGCTVVLKPSEIAPMSAMLFAEFVDQAGLPKGVFNLVNGEGPVVGEALSQHPEVDMMSFTGSTRAGTAVSRAAAATVKRVSLELGGKSPNIVFADSDLEKAISRSLAHCFENTSQSCNAPTRMLVERSVYDKAVELAKKAAESTKVGDPAQEGDHIGPLSSSIQFEKVQALIQKGIDEGARLVAGGTGRPEGFTEGDYVKPTVFADVNNNMTIAREEIFGPVLAMIPFDTEEEAIAIANDTPYGLAAYIQTGSPERAKRVARKLRAGMIQINGTSRAPGSPFGGYKQSGNGREGGKWGLEDFMEVKLISG

SEQ ID NO: 4563 - protein, 338 aa, Bordetella holmesii
MAKRDYYEVLGVAKNASDEDLKKAYRKLAMKYHPDRNPDSKEAEEKFKEAKEAYEVLGDEQKRAAYDRYGHAGVDPNAAGMGGGMGGGMGGGMGGGFADAFGDIFGEIFGAGRRGGGGPQVYRGADLKYALEITLEQAASGFDTEIRVPSWENCDTCHGSGAKAGTSPKTCRTCGGSGAVRMQQGFFSVQQTCPTCHGTGKEITDPCPSCDGVGRTRRNKTLQVKIPAGIDDGMRIRSSGNGEPGINGGPPGDLYVEIHIKQHKIFQRDGDDLHCELTIPFTTAALGGELQVPTLGGKAEISIPEGTQSGKTFRLRAKGIHGVRGSYPGDLYCHVVVE

SEQ ID NO: 4564 - protein, 488 aa, Mycobacterium bovis AF2122/97
MRAEIGPDFRPHYTFGDAYPASERAHVNWELSAPVWHTAQMGSTTHREVAKLDRVPLPVEAARVAATGWQVTRTAVRFIGRLPRKGPWQQKVIKELPQTFADLGPTYVKFGQIIASSPGAFGESLSREFRGLLDRVPPAKTDEVHKLFVEELGDEPARLFASFEEEPFASASIAQVHYATLRSGEEVVVKIQRPGIRRRVAADLQILKRFAQTVELAKLGRRLSAQDVVADFADNLAEELDFRLEAQSMEAWVSHLHASPLGKNIRVPQVHWDFTTERVLTMERVHGIRIDNTAAIRKAGFDGVELVKALLFSVFEGGLRHGLFHGDLHAGNLYVDEAGRIVFFDFGIMGRIDPRTRWLLRELVYALLVKKDHAAAGKIVVLMGAVGTMKPETQAAKDLERFATPLTMQSLGDMSYADIGRQLSALADAYDVKLPRELVLIGKQFLYVERYMKLLAPRWQMMSDPQLTGYFANFMVEVSREHQSDIEV

SEQ ID NO: 4565 - protein, 388 aa, Arabidopsis thaliana
MTTISDLSDDLVGDILSRVPFTSLISVRSTCKKWNALSKNQIFGRKTAARNQFLEFMILDSRVCSLRLDLQGIRNEDKEDFVDPSMKLISIPSNDDQVEISQVYHCDGLLLCIAKENSNVFVWNPYLGQTKWIRPRNTFHRYDRFALGYDNNRNHKILRFLYDEESNESSRRTHIDVYDFSSDSWRVLDVNPDCDIPFYQTGVSLKGNTYFFGQEVTQATKVTEIETCLLCFDFTTERFGPCLPLLFYPPCPSFETVTLSWVRDEKLAVLYNHYVTAEIIEIRISTKIEPNAVSWSSFLTVDMSLVNGLPDHFSMYFEAKSFFIDEEKKVVVLFDSKEIKTCRYQMAYIVGDDGYFKSVNIGVSPNSQRKPGRLVCSSYVPSLVQLQD

SEQ ID NO: 4566 - protein, 138 aa, Arabidopsis thaliana
  misc_feature (2)..(2): Xaa can be any naturally occurring amino acid
  misc_feature (11)..(11): Xaa can be any naturally occurring amino acid
  misc_feature (17)..(17): Xaa can be any naturally occurring amino acid
  misc_feature (26)..(26): Xaa can be any naturally occurring amino acid
  misc_feature (32)..(32): Xaa can be any naturally occurring amino acid
  misc_feature (35)..(35): Xaa can be any naturally occurring amino acid
  misc_feature (52)..(53): Xaa can be any naturally occurring amino acid
  misc_feature (57)..(59): Xaa can be any naturally occurring amino acid
  misc_feature (64)..(64): Xaa can be any naturally occurring amino acid
  misc_feature (68)..(69): Xaa can be any naturally occurring amino acid
  misc_feature (79)..(79): Xaa can be any naturally occurring amino acid
  misc_feature (85)..(85): Xaa can be any naturally occurring amino acid
  misc_feature (88)..(88): Xaa can be any naturally occurring amino acid
  misc_feature (91)..(91): Xaa can be any naturally occurring amino acid
  misc_feature (96)..(96): Xaa can be any naturally occurring amino acid
  misc_feature (100)..(100): Xaa can be any naturally occurring amino acid
  misc_feature (105)..(105): Xaa can be any naturally occurring amino acid
  misc_feature (109)..(109): Xaa can be any naturally occurring amino acid
  misc_feature (111)..(111): Xaa can be any naturally occurring amino acid
  misc_feature (117)..(119): Xaa can be any naturally occurring amino acid
  misc_feature (121)..(122): Xaa can be any naturally occurring amino acid
  misc_feature (124)..(125): Xaa can be any naturally occurring amino acid
  misc_feature (128)..(129): Xaa can be any naturally occurring amino acid
  misc_feature (131)..(131): Xaa can be any naturally occurring amino acid
  misc_feature (133)..(136): Xaa can be any naturally occurring amino acid
MXSSMLSSAAXGTSPAXATMVAPFTXLKSSAXFPXTRKNNKDITSIASNGGXXNCMXXXPPIGXKKFXXLSYLPDLRDXKLGKEXDYXLRXKGIPXGEFXLKNGXFVYXEXGKTPGXXXGXXWXXGKXXLXGXXXXLK

SEQ ID NO: 4567 - protein, 288 aa, Arabidopsis thaliana
MKTSLLCIAEDNSGLVVWNPYLCQTKWIRLRNTFHRYDVFALGHDNNRNHKILRFLYDAKKYRTGRGRDNDVYDFSSDSWRRVFDVNPHRGELFYYSGVSLKGNSYFFGQEVTIEEEEEEVISQPRDYLLCFDFTTERFGPRLSLPFNPPSPNFDYLTLSWARDEKLAVLYNHYNTREIIEIWISTKIEPNTVSWSTFLTVDTSLINGLPDRFSTFYGPRSFFIDEEKKVAVFFDNKGTETGCYQVAYIIGDNGYFKSVKIGVISNSQWQQGILVCSSYVPSLVQLQD

SEQ ID NO: 4568 - protein, 400 aa, Arabidopsis thaliana
MSAMMKKRKRKVSKENVALTISSSVGEYGENSGTLPTDLMVEILSRVPAKSAARFRCVSNDWNSLLRSPYLTNLFLKRSSARPHLLITFQAEGKWSFFSSPEYLISDQNSNLVVVDNHMDVPKDYSFGVCVPVCGLMCTSNEWVLSRKRDARMMICNPSTGQFKSLPKVRSCRGNVITYIGYNPIEKQYKVLCMTIREKPFKFKAEEHQVLTLGTGKLKWRMLECSVDHYPYYHGSICINGVLFYLAMKSESKEYMTVSFHMKDENFMFIPNQDLLSTLINYKGRLGGIRHKSFGFMDGGDVGFELWILDVVNQEWIRSIHVLPPMWKDVVGETRVYFVGIIGSCEVVFSPFVKSNPFYIFHLDMKSNSITRVEIKGTGPLEGQAVYTFVNHIENVNLIM

SEQ ID NO: 4569 - protein, 324 aa, Oryza sativa (japonica cultivar-group)
MAAAAPALPAFASLLLPSSSSPPRRIPWPRPLPSRRGALRPVKLLPAISAVEKGKGAAAEAKEVELEGMPPEYYDEEWQARQREKTKEWNAYRKKEEAEEERLTNEYREIGMRLKAYPQEEVRKARILVSSFIRAGEDIEEEIEKAAERGELTELVLMVIWNRLDVARRDDERDAIRSLDLLYRRVETEILRSEATPAMRLLNDLLNLHDGSDDDKWLKKCKKHMLEVFPREDPFTMVFPAGFNMEEHQGQIKLPPQDDDVLLRVDFIREVDELLKEVQAAHENNKVPTGNDPEAVATKLKYQEKLRTIRQVESLLELASSLKW

SEQ ID NO: 4570 - protein, 222 aa, Stellaria longipes
MAKARIGHFVEAQILESIGVDYVDESEVLTPADEDHHINKHNFQIPFVCGLSIPRGAPPPAYRRGYAGHDTGPRVRKPSTGNVVEAVRHIRSVMGEIRLLRNMDDDEVFAYAKKISAAYDLVMQTKQLGRLPVVNFAAGGVATPADAALMMQLGCDGVFVGSGVFKSGDPAKRARAIVQAVTHYSDPDLLGRGEFGLGEAMVGIIVRMRRLRGTPIVLNEVI

SEQ ID NO: 4571 - protein, 380 aa, Solanum tuberosum
MSTTVGQVIRCKAAVAWEAGKPLVMEEVDVAPPQKMEVRLKILYTSLCHTDVYFWEAKGQNPVFPRILGHEAAGIVESVGEGVTELAPGDHVLPVFTGECKDCAHCKSEESNMCSLLRINTDRGVMINDGQSRFSINGKPIYHFVGTSTFSEYTVVHVGCVAKINPLAPLDKVCVLSCGISTGLGATLNVAKPTKGSSVAIFGLGAVGLAAAEGARIAGASRIIGVDLNASRFEQAKKFGVTEFVNPKDYSKPVQEVIAEMTDGGVDRSVECTGHIDAMISAFECVHDGWGVAVLVGVPHKEAVFKTHPMNLLNERTLKGTFFGNYKPRSDIPSVVEKYMNKELELEKFITHTLPFAEINKAFDLMLKGEGLRCIITMED

SEQ ID NO: 4572 - protein, 226 aa, Mycobacterium sp. S65
MADTDAGRLDAAVAELAESGAAVCGVVGDVCRRDVADGVAERALTEFGQLDALFNVVGGSLARNVEEISEEQWRTQLDMNLGSVFQMSKPAIPLLRQGGGGSIVNVASTAGLLAENRCSAYSASKGGVVLLTKNMALDFARDNIRVNAIAPGGTRTPRIERFLTEHPEHSSMMVDLCAMQRFGWPDEIAAPAVFLASPEASYITGAVLPVDGGMTAGVTFRAFEAG

SEQ ID NO: 4573 - protein, 336 aa, Beta vulgaris subsp. vulgaris
MRLISTTSAVATLLFLVVILPSIQLTEAQIGVCNGRLGNNLPSEEDVVSLYKSRGITRMRIYDPNQRTLQAVRGSNIGLIVDVPKRDLRSLGSDAGAASRWVQNNVVPYASNIRYIAVGNEIMPNDAEAGSIVPAMQNVQNALRSANLAGRIKVSTAIKSDLVANFPPSKGVFTSSSYMNPIVNFLKNNNSPLLANIYPYFSFIGTPSMRLDYALFTSPNAQVNDNGLQYQNVFDALVDTVYAALAKAGAPNVPIVVSESGWPSAGGNAASFSNAGTYYKGLIGHVKQGTPLKKGQAIEAYLFAMFDENQKGGGIENNFGLFTPNKQPKYQLNFNN

SEQ ID NO: 4574 - protein, 341 aa, Mycobacterium sp. S65
MDAIVLKGTNDVGLTSVPDPAPQPGEVIIEVAATGLCGTDLHEYVAGPTFSQPPVVLGHEVSGRIVEVGAGIDRCRIGEGAAVIPMDFCGSCHYCHRSLYHLCQRPGWIGLTRNGGLASHVAVPSRLAVRVPDAVDLQEAALTEPTAVAFHAVRRAELLLGETVLVLGAGALGLTVIQCARAAGAARIYVTEPSRVRGNLARDLGATLVLDPHEPGTTARILEETRGVGVDVVFHVAGSVEAFTQGLDCLRKQGRFMEMSSWAGPASLDVNRHLLKETQLRMVFGYDMFDDFPAVLALMADGKIALTPQITTRIPLDSAVEEGLNGLLEAREGLIKVLVRP

SEQ ID NO: 4575 - protein, 279 aa, Vibrio vulnificus CMCP6
MKLETVDYLADDAAEQFVTSLRETGFGVLKNHPIPKELVESIYKNWYEFFSTEQKHDFHFNVETQDGYFPPSVSEVAKGHSVKDIKEYFHVYPWGQMPEQLKAEIMEYYERANAFASELLGWVEAHAPKEVQEKFSVALSEMINGSDKTLLRVLHYPPMTGDEEPGAIRAAAHEDINLLTVLPAANEPGLQVKAKDGSWIDVPCDFGNLIINIGDMLQEASGGYFPSTTHRVINPTGERQTQSRISLPLFLHPKPDVVLSERYTAHSYLMERLRELGVI

SEQ ID NO: 4576 - protein, 137 aa, Chlorobium tepidum TLS
MGENQETQKSFLETVKFDSNGLVPAIVQDHETGKVLMMAWMNLESLKMTLEKKKACYWSRSRNKLWLKGESSGNMQEVHDILIDCDGDTLLLKVSQKGGACHVGYHSCFYRRTVDGESMEICDTLMFDPEEVYGKQS

SEQ ID NO: 4577 - protein, 159 aa, Oryza sativa
YVTPKEHLGLPNRDDVKTGVISYKISAHAADLAKGHPYAQAWDDTLSKARFEFRWLDQFALSLDPVTAMSFHDETLPSEGAKVAHFCSMCGPKFCSMKITEDIRKYADEHGYGTVEEAVIQGMNAMSAEFSAARKTISGEQHGEAGGEIYVPESYTARK

SEQ ID NO: 4578 - protein, 341 aa, Photorhabdus luminescens subsp. laumondii TTO1
MKALSKLKAEEGIWMIDVPEPELGHNDVMIKIRKTAICGTDVHIYNWDDWSQKTIPVPMVVGHEYVGEVVAIGQEVKGFKIGDRVSGEGHITCGYCRNCRGGRTHLCRNTIGVGVNRAGCFAQYLVIPAFNAFKIPDNISDELAAIFDPFGNAVHTALSFDLVGEDVLVSGAGPIGIMAAAVCKHVGARHVVITDVNEYRLELARKMGVTRAVNVSQENLTDVMAELGMTEGFDVGLEMSGAPAAFRTLLNTMNHGGRVALLGIPPSDMAIDWNQVIFKGLFIKGIYGREMFETWYKMATLIQSGLDLTPIITHRFSIDDFQKGFDIMRSGQSGKVILNWD

SEQ ID NO: 4579 - protein, 356 aa, Triticum aestivum
  misc_feature (145)..(145): Xaa can be any naturally occurring amino acid
  misc_feature (210)..(210): Xaa can be any naturally occurring amino acid
MFADAGFSFSAYSSSPPGPAYSYSYSYSSSPTVLSHPHPDHSSFSSPPSSAAPAQPPPPPLPLPLPLLHQQHQHQHQHQAAAAVATASNDDDDDAMYHHLGDMGQPSLISEYDLGAEGDLFKAPEPIIEEPLLALDPGRRRHLDXCPAGTTPWTTASRSPTWGLSEVLYECEKELMEKSAIEETISELLDVKIPMLQVEDVPGELRASSXIDSCRRHPASAPLQKSVSSGCLSSGDWMNGSAVRPNFLDFQGLDFEAAFGLRRAYSEGDIQKLGANTPRPGIAANVQASGERLVTISDLKSEERKQKLNRYRKKKIQRNFGRKIKYACRKALADSQPRVRGRFAKMDDGDMLKPRK

SEQ ID NO: 4580 - protein, 403 aa, Medicago truncatula
MAAELPPEILTEIFSRLPVISLLRFRSTSKSLKFLIDSYKFINLHLRNSPNRSLILRFKFDIYQLEINDDFSNPGVLVLLIPHNHPFTANSEHNNTLTLIGSCNGLLAMSHGVMAFTHPNAPNEIAIWNPYTGKYRIIPFLPLPIPNILQSDNPNRGCLCVHGFGFDSLSGDYKLLRISYLLDLQNPFYDPHVRLFSLKTNSWKIIPNFPYALYYTRTMGVFVENSSSLHWVASRKIQPFQSDLILAFNLSLETFNEVPLPDEIGEQVNSKSFKIRVADLGGCLCMTVDYKDTKIDVWVMKEYGCRDSWCKLFTVVKSCFDDLPVESLRLLGYSIDGKKVLLRVDVVNLFWYDLESNQVSHFQEDLDLDDAMICVGSLVPPPCEDPTSEKRDDFLSREFKLRL

SEQ ID NO: 4581 - protein, 197 aa, Triticum aestivum
  misc_feature (21)..(21): Xaa can be any naturally occurring amino acid
  misc_feature (108)..(108): Xaa can be any naturally occurring amino acid
  misc_feature (130)..(130): Xaa can be any naturally occurring amino acid
  misc_feature (155)..(155): Xaa can be any naturally occurring amino acid
  misc_feature (179)..(179): Xaa can be any naturally occurring amino acid
LRVRRKWGRDLFTLKLGRGLXNLAGPIVSLAYPLYASVRAIETKSPIDDQQWLTYWVLYSFITLFELTFAAVIEWLPFWSYGKLFFNCWLVLPYFNGAAHVYGPFVRXPMIVNPPVVNIWYLPKKGGSDXPDDVISAAPEYIEPNGSKAFGALVXNKFRTTKREALQFLEEVEVERRAXAERELEARDVNPFFHPNY

SEQ ID NO: 4582 - protein, 405 aa, Chromobacterium violaceum ATCC 12472
MTKPRAVYLQSGGPTAVLNASAQGAIETARRLGLSLYAAYDGLAGLLDGRLCDTDGVSDTAIAQLAFMPGGSFGVSRRMIGTFEEAPEDWLRLRDVLAKHDIHYLLINGGNGSLGCAERLVDFEKHTGYKLGVIGIPKTIDNDLVGTDNSPGYGSSAKFLASAMREVGLDMTSMGWGRVFIMETMGRHTGWLAAACAAASRNPHEAPHLLLLPEVPFDQARFLAALDASLAKYGQCAIAVAEGITGQDGRFVAEAKKSETYGHEQLGGAGHWLAQLILRERGISAHVAQVDYLQRAGGHLASATDVRQAYVMGERAVEWLLAGKTGLMAGIRRLNDHPYCWDVAEVPLSAVGDKEKRLPPEFIGADGFSVTQAFLDYVKPLIEGERIPPFKDGLPDYRPIAWPRV

SEQ ID NO: 4583 - protein, 987 aa, Candida albicans SC5314
MPSSSDAINRISYISLVTSDNDKFNQTFQFYSQLGFRLTKSFSKVSSYGSGLGANHPEFQLGVSHDSLKEVWLESYPLQNVDSNGNLRPWQEMEVYDGDNCERLNESTVIKVRLLGETPLKSISQKQFVFFTTQLNKIEKILTDANVKYGKVVDNVILAEDPLSNIISFSNTQNELCKTRFQSPEEYVEKTTAEILAKRKKSQLGSKFGSFEEISPSEVGGGNGLRKKKIGVMTSGGDAPGMNPAVRAVVRAGIYYGCDVYAVYEGYEGLVKGGDLLKKMEWSDVRSYMSLGGTSIGTARCKEFRERAGRLQGAYNMIKNGIDALVVCGGDGSLTGADLFRSEWPSLVKELVDTGKLTKEEVSPYEHLTIVGLVGSIDNDMSGTDVTIGAFSALERITEMVDYIGATAASHSRAFVVEVMGRHCGWLALLSGLATGADFVFIPERPPKAGLWKEQLKEVCLRHREYGRRKTTVIVAEGAIDDELNPITSEEVKQVLADLGLDTRNTILGHVQRGGTAVAFDRRLATLQGVEAVKAVLEMTPDTPSPMIGILKHKIVRIPLVDAVKQTKAVAEAISNKDFDKAMSLRDNSFYDDYRYFRDISIYDDGSKQLSEDKRLNIAIVHVGAASAGLNAATRAVALYSLSRGHKLYAVQDGFAGLVKGDLKNLTWMDVEGWHSLGGSEIGTNRSLPSQNIGKVAYNLQKFNIQGLLIVGGFEAFTSLHELSEQKANYPIFEIPMVVVPATVSNNVPGTEYSLGADTCLNQLVSYCDAVQQSASSTRRRVFVVEVQGGHSGYVASYCGLITGALATYTPESNINLRELQGDIDLLQKVFATDRGEDHNGTLIVRNEQASAVYSTQLIADILKENANKRFETRTAIPGHVQQGFTPSANDRVMAVKFSLKAMEFIETRNGCYGKHDRKFSDEEISEHSQVVIGIHGDVVKFTCIKHLYDNEANVALRKGKTVHWTDMIDVANILNGKSLLKKQERY

SEQ ID NO: 4584 - protein, 481 aa, Helicobacter pylori
MIVRTQNSESKIKEFFEFCKENEVEFVDFRFSDIKGTWNHIAYSFGALTHGMFKEGIPFDASCFKGWQGIEHSDMILTPDLVRYFIDPFSADVSVVVFCDVYDVYKNQPYEKCPRSIAKKALQHLKDSGLGDVAYFGAESEFFIFDSIKIKDASNSQYYEVDSEEGEWNRDRSFENGVNFGHRPGKQGGYMPVPPTDTMMDIRTEIVKVLNQVGLETFVAHHEVAQAQGEVGVKFGDLVEAADNVQKLKYVVKMVAHLNGKTATFMPKPLYGDNGSGMHTHVSVWKNNENLFSGETYKGLSGLALHFLGGVLRHARGLAAFTNASTNSYKRLIPGYEAPSILTYSANNRSASVRIPYGISKNSARFEFRFPDSSSNPYLAFGAILMAGIDGIKNKMDPGEAMDINLFKLTLDEIIEQGIIQMPHTLRRSLEEMLADKQYLKQGQVFSEQFIHAYQSLKFHSEVFPWESKPHPFEFITTYSC

SEQ ID NO: 4585 - protein, 305 aa, Vibrio sp. Ex25
MNKLVVLGSVNADHVLQVPSFPRPGETLHGRNYQVIPGGKGANQAVAAARLKADIGFIACVGDDSFGINIRENFNMDGIDITGVKMQPNCPTGIAMIQVSDSGENSICISAEANAKLTAEAIEPDLDRIRQADYLLMQLETPMCGIEKAARVAKDAKTNVILNPAPARELSDELLACIDVITPNETEAEVLTGVTVTDNDSAQEAANVLHSKGIEIVMITLGAKGVWLSQNGRGELIPGFRVDATDTTAAGDTFNGAFVTGLLEDLPLESAIKFAHAAAAISVTRFGAQTSIPTREEVDAFLAAQ

SEQ ID NO: 4586 - protein, 668 aa, Xanthobacter flavus
MSSRTSDSVTSHDRLANAIRFLAIDAVEAANSGHPGLPMGAADIATVLFTKVLKYDPSRPFWPDRDRFVLSAGHGSMLLYSVLHLAGYEKVTIDEIKRFRQLGSLTPGHPENFVTEGIETTTGPLGQGIATAVGMAMAERLLAARFGSDVVDHYTYALASDGDLMEGISQEAADLAGHLKLSKLIVMWDDNKISIDGPTSISGSTNQLARFAASGWATAAVDGHDPEAILAALEAAKASDRPTLIACRTTIGFGSPKKAGSEKVHGSPLGAEEIVATRAALGWEAPAFVVPEDALNGWRAAGAAGRAAREAWEARFAARPAEERAEFERRVAGTLPAALEGAIVAVKEKAVKDGGAVATRKSSEMVLDFITPAVPEMVGGSADLTGSNNTKAKGAKSVTPDDFSGSFIHYGVREHGMAAAMNGMALHKGLIPFSGGFMVFSDYCRPAIRLAALMGERVIHVLTHDSIGLGEDGPTHQPVEHLAALRAIPNLLVMRPCDTVETAECWQIALQSTDRPSALILSRQNLPLLRTDATAVNRSAEGAYEILAASGPAQASLFATGSEVSLAVEAAKLLEAQGVPTRVVSISSFELFLERPAAERAKVIGDAPAKVAVEAAIRMGWDAIVGSNAAFVGMTSFGASAPAKELYAHFGITAQQVAARALDQLRQA

SEQ ID NO: 4587 - protein, 323 aa, Photobacterium sp. SKA34
MSRSFDFCSHGKKVLNIEIQALQNISRYIDDSFNKACQLVLDCEGKVIVMGMGKSGHIGRKLAATLASTGTPAFFVHPGEASHGDLGMIKHEDVVIAISNSGEASEILALLPVIKRLGIPMISMTGKPTSSMAKMAIINLQITVEKEACPLNLAPTSSTTATLVMGDALAISVMEARGFTADDFALSHPGGALGRKLLMRIADVMHTGKMLPIIEETASIKDALLEISQKGLGMTAIVNNKQQLSGIFTDGDLRRLLDNHVDIHNTNIGNVMSCNPQTISPQLLAAEGLKIMEDRKINGLLVTENSQLVGALNMHDLLKAGVM

SEQ ID NO: 4588 - protein, 559 aa, Oryza sativa
  misc_feature (461)..(461): Xaa can be any naturally occurring amino acid
MDKLGANPANSCALTPLGFLERAATVFGDCPSVVYHDTVFTWSQTHRRCLRLASALVSSLGISRGDVVSVLLPNVPAMYEMHFAVPMSGAVLNSINTRLDARTVSVLLRHSGSKLIFVDPALLPVLRDALRLLPAGHTAPRVVLVEDPHEKEFPPAPAAALTYERLVEKGDPEFAWVRPASEWDPMILNYTSGTTSAPKGVVHCHRGIFLITVDSLVDWAVPPRPTYLWTLPMFHANGWSFPWGMAVVGGTNVCLRRVDAAEVFDTIARRGVNHLCGAPVVLNMLANAPEGVRKPLPGKVRILTAGAPPPAAVLYRTEAIGFEVSHGYGLTETAGLVLSCAWKGEWDKLPASERARLKARQGVRTPGMAEVDVVDGETGRSVPRDGSTMGEIVLRGGCITLGYLNDEAATKAAIRDNGWFYTGDVGVMHPDGYVEIRDRSKDVIISGGENISSVEVESVLXYGHPAVNEAAVVARPDEFWGETPCAFVSLKQGGGAVTAADVVAWSRERMPRYMVPKTVIFRDELPKTSTGKIQKYVLRNIAKEMGPTTGTNTNRNSKM

SEQ ID NO: 4589 - protein, 296 aa, Neisseria gonorrhoeae FA 1090
MFPVFHLSGESRRRMLQTALRFPHVFKARAEDSHKGTFGTLAVVGGSAGMSGAPVLAASAAMYLGCGKVRAGFNQDTLPFAVIAGFPEIMLDTADGLTKRQGINAWTAGCGLGTDAAAVETVAAVLARNRDEAVVLDADALNILSTDAETRNLARGCKNLILTPHPAEAARLLGTTVAQVQADRTAAVRKIGAILGATVVLKGHKTLVAASDTEIYVNESGNAGLATAGSGDVLGGIIGSLLAQGVPVFEAACAGAWLHGAAADVIKESAGIAAGLSAGEIAPAARWLRNWITESM

SEQ ID NO: 4590 - protein, 514 aa, Clostridium perfringens str. 13
MKVIIGNAWPYANGSLHIGRVSSWMAGDILARYHRAKGDEVIFVSGSDCHGSPILNKAKEINKSPEELINKYHREFVRCFNKLGFSFNIFTRTDSEYHEKQVKNIIKSLYNKGFIYEKETEEFYCPKCCDTLDEFGIKEGLCNECNSKVEVRSSNNLFFKLSYFQDYIQNILDEEESWRENAIKITKRYLEGGLRDKILTREINWGIEVPIEGFEDKRVYVWIDALLAYVTASKKVIEEKGQSLEEYWNNEDSRIYLVHGKENIPFHTTMFPAILSGIGLEKSEIRIFSSQYLTLEGKTFSTNRNWAIWVPYIMERYNIDSIRYYLISRGAEEKNSDFTWRDFINANNNELVGEIGNFTNRVLTFIKKNFSGEIKGEELPLQWKNLIRRTYASVGNKFENGEFKSGVKEMFNLIKQGNDFFDKNKPWILINNNKKKCEEVLYICSQILVALTDLMNPIIPFTCEKIKMFLGIKDTKWSFKERKNIRVNRVEFLFDKIDKKVAIEELNRLKNKKI

SEQ ID NO: 4591 - protein, 515 aa, Escherichia coli O157:H7 EDL933
  misc_feature (158)..(158): Xaa can be any naturally occurring amino acid
MTDHTMKKNPVSIPHTVWHADDIRRGEREAADALGLTLYELMLRAGEAAFQVCRSAYPDARHWLVLCGHGNNGGDGYVVARLAKAVGIEVTLLAQESDKPLPEEAALAREAWLNAGGEIHASNIVWPESVALIVDALLGTGLQQAPRESISQLIDHAXSHPAPIVAVDIPSGLLAETGATPGAVINADHTITFIALKPGLLTGKARDVTGQLHFDSLGLDSWLAGQETKIQRFSAEQLSHWLKPRRPTSHKGDHGRLVIIGGDHGTAGAIRMTGEAALRAGAGLVRVLTRSENIAPLLTARPELMVHELTMDSLTESLEWADVVVIGPGLGQQEWGKKALQKVENFRKPMLWDADALNLLAINPDKRHNRVITPHPGEAARLLGCSVAEIESDRLHCAKRLVQRYGGVAVLKGAGTVVAAHPDALGIIDAGNAGMASGGMGDVLSGIIGALLGQKLSPYDAACAGCVAHGAAADVLAARFGTRGMLATDLFSTLQRIVNPEVTDKNHDESSNSAP

SEQ ID NO: 4592 - protein, 645 aa, Clostridium perfringens str. 13
MCKKPYYITTPIYYPSTNLHIGNTYTTVAADAIARFKRLTGHEVMFLTGTDEHGQKIERIANEKGITPKEHVDEIVAGIKDLWKMMNISYDKFIRTTDDYHVKAVQEIFKKLYDQGDIYKDSYEGLYCTPCESFWTETQLVNGNCPDCGRPVEKAKEEAYFFKMSKYADRLIQYIEEHPDFIQPESRKNEMLNNFLRPGLQDLCVSRTSFTWGIPVSFDEKHVIYVWIDALSNYITALGYGQENQELYKKFWPADVHLIGKDILRFHTIYWPIMLMALGLELPKQVFGHGWLLVDGGKMSKSKGNVVDPVVLVNMFGADAVRYYLLREIPFGSDGLFNNEIFIKKVNTDLANDLGNLLSRTIAMVYKYFGGVIQAPTCKEPIDDELINLALSTPGKVEASIDALKIPEALESIWTLISRANKYIDETTPWILAKDEEKKERLGTVLYNLLETLRFVSVMISPFLTETSVKINAQLNTKVTTWESLKEFNGTVAGDKVVKGDVIFPRIDVEEKLAELEALKPAPVKPANEELVENPIKEEITIDDFDKIDLRVVKVLECEPVKKAKKLLKLKVDLGGEERQVISGIAQYYKPEELVGKYVVLVANLKPVKLRGELSQGMILAAAPSDDSELLLVNPGEMLTGSQVR

SEQ ID NO: 4593 - protein, 607 aa, Nicotiana sylvestris
MAVVTASSAGPSYAPEDPTLPKPWKGLVDGTTGFIYFWNPETNDTQYERPVPSSHAVSAPAHKSSVFVSSSVEKPSQGQRYDADGGHNRGSNNKIARSSSDRFHDGTSVHEGYGSLGVGSDISQESYCRRNEISVTGGDVPAPLTSFEATGFPSEIVREMHQAGFSAPTPIQAQSWPIALQGRDIVAIAKTGSGKTLGYLMPAFIHLQQRRKNPQLGPTILVLSPTRELATQIQAEAVKFGKSSRISCTCLYGGAPKGPQLRELSRGVDIVVATPGRLNDILEMRRVSLGQVSYLVLDEADRMLDMGFEPQIRKIVKEVPVQRQTLMYTATWPKGVRKIAADLLVNSVQVNIGNVDELVANKSITQHIEVVLPMEKQRRVEQILRSKEPGSKIIIFCSTKKMCDQLSRNLTRNFGAAAIHGDKSQGERDYVLSQFRAGRSPVLVATDVAARGLDIKDIRVVINYDFPTGIEDYVHRIGRTGRAGASGLAYTFFSDQDSKHALDLVKVLEGANQCVPTELRDMASRGGGMGRARNHWGSGPGGRGGRGGPYNSSYVGRNGGHGYDRGSRDSDRYGHGTYNADAPRKRSRSRSPNIGSGWSGKKSRFTD

SEQ ID NO: 4594 - protein, 323 aa, Erwinia carotovora subsp. atroseptica SCRI1043
MNLEQITTLTTQDMAAVNKVILEQLNSDVVLINQLGHYIISGGGKRIRPMIAVLAARALAYNGDKHVTVAALIEFIHTATLLHDDVVDESDMRRGKATANAAFGNAASVLVGDFIYTRAFQMMTSLESLRVLALMSEAVNVIAEGEVLQLMNCNDPDITEESYMRVIYSKTARLFEAAAQSSSILAGATPEQEKALQDYGRYLGTAFQLIDDLLDYSADGKTLGKNTGDDLNEGKPTLPLLHAMRQGNAEQSSLIRQAIEEGNGRHLLEPILAAMQQCGSLDYTRQRAEEEADKAINALQLLPKTPYRMALEGLAHLAVQRDF

SEQ ID NO: 4595 - protein, 1097 aa, Ustilago maydis 521
MANKDQVGTNADPPNPSLSISTRPINLDRGTYTEQSEGHHGYRSAPSTARPRLAGRRTMSAKSEVRRLSSLFVPPHTYSGDHQEPSTTSSRISGFLREPLSPIRSFYGSFAAQAAPGSRKRRKQNLRSYDDAKFEDEMNLPGSAGNGIRVWYESYTTIDWIHDAIKESSRLRRIRNLKGIRGLAVNSWDRLQGWIIVTITGIVTALIAGCIVKSEAVLFDLKDGYCTKDWRLAKRFCCPYGEAPDWDHPTVSASFWSYRTAFMSNAAVASTSPAEIAHSVLSGLGKGNRILSGWAAPVAGSPVWSRFVASANTSSTTSLAMLSPIDSGIQACPGWVTWNHKFGSVINSNNQLAGYSMYFVIAVLWASIASILTIYLTSSELYLKDQDASSSATTILTQKRAAQHQQTDDVVHEPTETTALLAQQLPNQHSSHPASTAAPTNDANCVSSRNYARLANEQRAQNAILPRKVLYFATGSGISEVKCILSGFVIHGYLGFWTLFTKSVGLTLSVASGLSLGKEGPFVHIASCVGNIVCRIFPKYENNEGKRREMLSCACAAGVAVAFGAPVGGVLFSLEEVSYYFPNKVMFRSFFCAMVAAASLRAIDPFGTGKIVLFQVTYDKDWHFYEMLFFVLIGIFGGLYGAYFTKLNMFWAKNVRAKTWMARHPILEVVVITVVSAAFSFFNGYTRMGGVELIADLFSECHEHESLEGLCVSQPSQIGPLIMAILFAMVLKGLLTIITFGIKLPAGIFIPTLAVGACFGRIVGLLVQYVQWTHPDAAFFDWCPASDSVCIVPGVYAMVGAAAALSGVTRTTVSLAVIMFELTGTLTYSVPVMLSILVAKTIADALEHKGIYDLVIDFSGLPYLDSKTEYIWNGVNVTDAMETEVEVISLDAFNTVQSLSDKLDRLASGSGYTDGGFPIVSRVVSPLSPANPPISPGLSTSVGSLMPDHSPQMPAHEDEADSASAASHQMVGYIAASELEHALARAVSSDPDLNLQTARCSFKNLPFVRAEHEGEAGVRDSVLFIASDPLDLSRYVDKAPITVQIHSPLELVHQYFTRLGVRYLIVVDERGLYRGTIFKKSYLKFLADIERQGKDGH

SEQ ID NO: 4596 - protein, 784 aa, Bacillus cereus G9241
MKGVILAGGKGRRLRPLTCNTPKPMLPLLEKPVLEYNIELLRQHGIREIAITVQYMSTAIKQYFGDGSKWGVNLYYFEDSPPLGTAGSIKQAEKFLDETFVVISGDALTDFQLSEGITFHEQQKRMVTMFVKEVENPLSFGLVVMNKEQEVTRYIEKPSWNEVVSNIVNTGIYIMEPEIFSYIPPREFFDFSQDVFPLLANKNALFAYLSEGYWLDIGTFDQYRQAQFDLLMKKLQVPIPYTEVLPMVWMGEGVTIGKGTKIHGPSFIGEGAKIGAGAVIEPYSIIGKNSIVSSYSHLQKSIVFANAHIGQYCELLETTIGEHTMVEDDVTLFQKSIVADHCHIGKSTVIKQKGKLWPYKAIDSYSVVGSAGVQESEKSAGWLQKSRIVGRGNVEITPQFIVKVAMAYGSLLAKGESILIGSQEHIETTSYKNLFLHAIHGIGIHTMECKEMNESLFQYSIQDLQCAGGVFIQLENEKEVVIKLYGKDGVQLTYKQQKVIEQVYMSESFYYVCEKEMGRNKLVHVSLHDYIEAVLERIDIEKIQKQKFHLLINKRNDMLQHLLMLFLQRLGCTVTWIYAGEQKDHVKALMKSSKANMALMFSEQGNYFELYDNHSNIYQGTDFEEVDIPDLLLESTGNIYPMSLKLGECYLLFYTQDEKKSFQARWKRDILYRIGKLFELIALQGKTFLSIVEQSPPLYLLCDEVVCSWNEKGKVMRKLLADMERKEEGIFEGVQFKYTEKEWSYIVSDTKQPKFLVYSHARNPVIARENMKNLIEKIRQYQKV

SEQ ID NO: 4597 - protein, 414 aa, Glycine max
  misc_feature (396)..(396): Xaa can be any naturally occurring amino acid
MVAANERVVAVIMVGGPTKGTRFRPLSFNVPKPLFPLAGQPMVHHPISACKRIPNLAQIYLLGFYEEREFALYVSSISNELKVPVRYLKEDRPHGSAGGLYHFRDLIMEEDPSHIFLLNCDVCCSFPLPEMLDAHKRYGGMGTILVVKVSAESASEFGELVADPTTNELLHYTEKPETFVSDRINCGVYVFTPDIFTAIEGVSTQRKDRANLRRVSSFEAMQPDTRSLPVNYVRLDQDILSPLAGKKQLYIYETNDFWEQIKTPGMSIKCSGLYLAQFRYTSPHLLANGDGIKKASITGDVYIHPSAKVHPSAKIGPSVSISANARIGAGTRLKHCIILDDVEIKENALVGHAIVGWKSSIGRWACVEASGDYNAKLGVTILGESVTVEDEVVVLXIVLPHKTLNLGVQDEILL

SEQ ID NO: 4598 - protein, 175 aa, Triticum aestivum
GQVYHSSFTDDDGITKACGCPLLPLKTHIKGPAPASDSDKADIVDEAITFFRANVFFKNFHVKSPADKLLIYLTSYINIALKRLESCRTLAVGTKAIINLGLETVPVPGEPGFPFPGLFTLPESQEEAELLRNYLKQIREETSGRLLNCAYRANGTPNKWWLAFAKRKFMNLVIL

SEQ ID NO: 4599 - protein, 332 aa, Oryza sativa (japonica cultivar-group)
MVSEKFSVSYVLAAYQFEGSYQAKLLEAVERERNVRTNQTRNTTIFHHPALGDFEVQHLPVVGNDAELEERILQHLAAAAAMGRSHHLGRREGHRGRSGSHGRPQFLVFSSHPNMPSAGSVSSSSVQGEVDNESSPVHTTGELSLHANTHEEAGNQSPGMLTYDADQDAVVSSGNSTPVSSPRFFNRRHSTGQSTPVNNDRAGPSDLQSFSDSLKSRLNAVSMKYKESITKSTRGWKERLFSRHSSVADLGSEVRREVNAGIASVSRMMERLETRGSNGRTSDGPAISTSEVIPSTESSNERVTENNPTTAATSSGNTSASSAPCVTTTGSN

SEQ ID NO: 4600 - protein, 626 aa, Pseudomonas putida KT2440
MTKQEKAINLSESAQVDQQSVQPFPRSRKVYVEGSRPDIRVPMREISLDDTPTDFGGESNAPVLVYDTSGPYTDPDVIIDVRKGLPDVRSAWIEARGDTERLEGLSSDFGQQRLNDAELAKLRFAHVRNPRRAKAGANVSQMHYARQGIITAEMEYVAIRENMKLQEARAAGLLNEQHAGHSFGANIPKEITPEFVRQEIARGRAIIPANINHPEVEPMIIGRNFLVKINGNIGNSALGSSIEEEVAKLTWGIRWGSDTVMDLSTGKHIHETREWIIRNSPVPIGTVPIYQALEKVNGVAEDLTWELFRDTLIEQAEQGVDYFTIHAGVLLRYVPLTAKRVTGIVSRGGSIMAKWCLAHHKENFLYTHFDEICEIMKAYDVSFSLGDGLRPGSIADANDAAQFGELETLGELTKIAWKHDVQCMIEGPGHVPMQLIKENMDKQLECCDEAPFYTLGPLTTDIAPGYDHITSGIGAAMIGWFGCAMLCYVTPKEHLGLPNKDDVKTGIITYKIAAHAADLAKGHPGAQIRDNALSKARFEFRWEDQFNLGLDPDTARAFHDETLPKESAKVAHFCSMCGPKFCSMKITQEVREYAAKIEAVDVTVEQGMREQAERFRQEGSQLYHKV

SEQ ID NO: 4601 - protein, 364 aa, Rhodopirellula baltica SH 1
MMPHLRLTDFELGAVLGVGTVGTVYDGKILDDVEVHPAAEAIRGQDLAVKKLHPAVSQDDLIQARFRREMVILERLQHPNIIGYFGGGSEDGQLFYVMERVDGGTIKDLLETNGALAWPVVVDVARQVCSALQCAHNHGVIHRDLKPGNLFLTRDAHVKLGDFGIARDQHSSDLTSQGLTVGTHAYMAPEQITGDEAISGKADLYALGCVLFEMLANRKVFAGENFAQLFEQHLRTKAPTIASIVPDVPPELSQVIADCLEKSPDDRPFNARSVQGVMIEIGEKYNLSAPPDSPVGPNHSETGNAPKDVSADSVTEKGRRLLEEQIHYRLGGTSREPVSAGKVSLIVVAIIVLIVLAVSLSGGS

SEQ ID NO: 4602 - protein, 201 aa, Desulfitobacterium hafniense Y51
MITIRKAEFVTSAVNIKGYPELTGPEIALAGRSNVGKSSLINKFINRRNLARTGNTPGKTQMLNFYRINDQWSFVDLPGYGYAKVSKEIKANWGKMMEEYFSRRENLRAVIQVVDIRHVPSVEDQEMHAFLRNRGIPVLVVATKADKISKGQWGKHLSQIAKALHIPDWHIIITYSAETGLGVPELHEAVEEILSMDNEDS

SEQ ID NO: 4603 - protein, 500 aa, Petunia x hybrida
MVLSKTVSQSDVSIHSTFASRYVRTSLPRFKMPDNSIPKEAAYQIINDELMLDGNPRLNLASFVTTWMEPECDKLMMDSINKNYVDMDEYPVTTELQNRCVNMIAHLFNAPLEDGETAVGVGTVGSSEAIMLAGLAFKRKWQNKMKAQGKPCDKPNIVTGANVQVCWEKFARYFEVELKEVKLSEGYYVMDPEKAVEMVDENTICVAAILGSTLNGEFEDVKRLNDLLVEKNKETGWDTPIHVDAASGGFIAPFIYPELEWDFRLPLVKSINVSGHKYGLVYAGIGWVVWRNKDDLPDELIFHINYLGADQPTFTLNFSKGSSQVIAQYYQLIRLGYEGYKNVMENCQENASVLREGLEKTGRFNIISKEIGVPLVAFSLKDNRQHNEFEISETLRRFGWIVPAYTMPPNAQHITVLRVVIREDFSRTLAERLVRDIEKVLHELDTLPARVNAKLAVAEEQAAANGSEVHKKTDSEVQLEMITAWKKFVEEKKKKTNRVC

SEQ ID NO: 4604 - protein, 526 aa, Zea mays
MGARRRLQADAPPGHRHRQGAPAPDWSAGYLNGWLSQPTPVFGLRLWVLIGIAVGAAIVLVLLLIFVCLSRRRRRRRLAANPYYPADTKLLKKHLQQQATPTPTPTKDIQEIVRRQQEPAVQLAKAVPQPQPQPQTPPPPPPPQHRPPARKTPGSGVSATTSGGSERDGATPRSTGSGAGLPEVSHLGWGHWFTLRELEEATGGLAEENVIGEGGYGIVYKGTLHDSTLVAVKNLLNNRGQAEKEFKVEVEAIGRVRHKNLVRLLGYCVEGAYRMLVYEYVDNGNLDQWLHGDVGEVSPLTWDIRMNIMLATAKGLAYLHEGLEPKVVHRDIKASNILLDQQWNAKVSDFGLAKLLCSERSYVTTRVMGTFGYVAPEYASTGMLNERSDVYSFGVLIMEIITGRCPVDYTRAAGEVQLVEWLKNMVAERKAEEVVDSKMAERPPPKTLKRALLVALRCVDPDANKRPKMGHVIHMLEMDDLQFRDDKRPGAGRDGRRPQGPDRYSSKLGGGREPQQARAPASVQMR

SEQ ID NO: 4605 - protein, 405 aa, Solibacter usitatus Ellin6076
MASFKHLILGGGMVAGHCAKQYVENGGKAGELAIVSGDDALPYERPPLSKGFLAGKDSEESVRINAAEFYAEHGIDVRLNTRVNSIDARGGRLSTSSGEEFGFEKLILATGAEVRRLDVPGAASSNVLYLRSLNDSKRLRDASIKAKHAVVAGGGFIAMEVASVLASRGIETTILARQNRFGAAFFTPEMSAFFEKYYVDRGVRILKQTEVMGIEKGSRALLKDGRAVDFDLFLAGIGVQPVTVLAEKAGLPVDNGILVNEYLETRDANLYAAGDVANYPDSLFGMKRRRVEHWDNAVSQGQYLAGALLGKREPFVHVPYFFSDVFDLSYEFWGDPSPSDRVVHRGDLQTSSFSIWWLSQNRLVAAFAMNRPDEERELAPELIRSRKLLSAERLREAGSVRDAAA

SEQ ID NO: 4606 - protein, 697 aa, Solibacter usitatus Ellin6076
MATKTSIPQNQNTVDVLTPDQLIRAFRIMHTARRLDDREIALKRQNRIFFQISGAGHEAVQVAAAMSLRPGRDWVYPYYRDRALCLALGVTPLEMLQQAVGAAADPASGGRQMPSHWGNAAYNIVSSSSPTGTQYNQAAGCAEAGRYRDPKSDEITLVCSGEGATSEGEFWESLNIAALKRLPLLYLIEDNGYAISVPIEQQTAGGSISALTAAIPGLFRQEIDGTDFFASWQAMQAAVRYCREGSGPALVHAHCIRPYSHSLSDDERLYKTPAERAAEAERDPVLRFPKLLIDEGVLDRRMLQDITHEIDEEIQQATQTALHDEPPSPASALVHLYSDLDPCAPAFHAEPRFQGAPMTMVDLINATLREEMRRNPDILVFGEDVADASREQNLTEVKGKGGVFKVTHGLQSEFGARRAFNAPIAEAAIVGRAIGMAARGLKPVAEIQFFDYIWPAMMQLRDELATMRWRSNGAFSAPAIIRVPIGGYLNGGAIYHSQCGESIFTHIPGLRVVFPSNAADACGLLRTALRSDDPVLFLEHKRLYREPYNRSPHPGADYTVPFGSAKVVKPGQNLTVITYGALVQKSLLAATQIERRDAAISIEILDLRTLAPYDWDAIRASVEKTSRVLVVHEDTLSWGYGAEIAARIADELFDKLDAPVRRVGALDTWIGYHPQLEAAILPQTDTLVTAIDHLLAY

SEQ ID NO: 4607 - protein, 214 aa, Brassica napus
  misc_feature (139)..(139): Xaa can be any naturally occurring amino acid
  misc_feature (182)..(182): Xaa can be any naturally occurring amino acid
  misc_feature (186)..(186): Xaa can be any naturally occurring amino acid
  misc_feature (189)..(189): Xaa can be any naturally occurring amino acid
  misc_feature (193)..(193): Xaa can be any naturally occurring amino acid
  misc_feature (204)..(204): Xaa can be any naturally occurring amino acid
  misc_feature (206)..(206): Xaa can be any naturally occurring amino acid
  misc_feature (212)..(212): Xaa can be any naturally occurring amino acid
METSSNSTNSSLFQWLGLIEDYDHPSTSTLPPVITLLASVLTKMIQKNEKPFHTRRNKFRDEEITMFHGSRAPSMNIQRYTERVHRYARCSPACFVAAFVYIIRYLEIPVATSTTRRLTSLNVHRLLITSLLVAAKFLXRKCYNNAYYAKIGGVSTEEMNRLERTFLFDLDFRLNITAEMFXKHCXMLXRQTXPCGSRRLRTAXEXMTCGCXAI

SEQ ID NO: 4608 - protein, 595 aa, Candida albicans SC5314
MLRSTTRNTLRLATRYTKVSSSIIRHTLPTMFGSSTGGSGIRFASQLAHVKTPPNLQNEPVKNFSFKDTKDWDLLRASITKFTDEGALKVPLVVGGKKIYRDEIKTQVNPAKHSQVLADVSQATPEDIIAAIDAAKAAKAKWATTSWTDRAAIFLKAADLISTKYRYDMLAATMLGQGKNVYQAEIDCVAELIDFFKFNVKYAEEMYQQQPIQTSPGVWNRAEYRPLEGFVYAVTPFNFTAIAANLVGAPALMGNTVVWKPSATAALSNYLLLTILEEAGLPAGVINFIPGDPVEVTDIVLNDKEFSALHFTGSTDVFKSLYSKISNNVAADKYRDFPRIVGETGGKNFHLIHPSASINHSVLSTLRGAFEYQGQKCSATSRLYVPESIWPEFKDQLVGAMSQITIGNSSEPENLNTFMGPVIHEQSFKKLSDAIEQAKSDPELEIVTGGSYDNTKGFYVQPTLIKTTNPNHEFLTKEFFGPILTTYVYPDGEFENIIKSIDSITKYGLTGSIFARDRDAVRTAEENLRYAAGNFYINDKSTGAVVGQQWFGGARASGTNDKAGSGNILSRFVSIRNIKENFYELTDFKYPSNYQ

SEQ ID NO: 4609 - protein, 141 aa, Candidatus Protochlamydia amoebophila UWE25
MASEQTLSIIKPDAVQNNYIGEIISRFEQAGLKIAAIKMTTLTKDQASKFYAIHKDRPFYNDLVNFMSSGPVVVMVLEGNQAIAKNRELMGATDPKKAEKGTLRADFAESMSRNAVHGSDSSETAEEEVLFFFKPDEITHR

SEQ ID NO: 4610 - protein, 178 aa, Arabidopsis thaliana
MPLSLRLSPSPTALSPTTGGFGPSRKQCRIPYSGVPTTKIGFCSLDSRKRGDSSVVRCSLETVNVSVGQVTEVDKDTFWPIVKAAGEKLVVLDMYTQWCGPCKVIAPKYKALSEKYDDVVFLKLDCNPDNRPLPKELGIRVVPTFKILKDNKVVKEVTGAKYDDLVAAIETARSAASG

SEQ ID NO: 4611 - protein, 285 aa, Rhizobium leguminosarum bv. viciae 3841
MGDSRETFGPKAFVTGFPIKHSRSPLIHGYWLKTLGLLGSYRAHEVTPEAFADFIHSLKDGSSGFTGGNVTIPHKELAFRLADKPDALSQELGASNTLWREDGALHATNTDGRGFIANLDERHPGWDRHGTAVVFGAGGASRAIIQAVRDRGFKEIHVVNRTVERARELADRFGPRVQAHPAGALVEVMKGAGLFINTTSLGMDGEPAPQLDFSPLAADAVVTDIVYVPLKTPILAQAEEQGFPIVDGLGMLLHQAVPGFEKWFGQRPIVDAPLRALIIADMEAH

SEQ ID NO: 4612 - protein, 142 aa, Salmonella enterica
MPKPMFGDNGSGMHCHMSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGIKNKIHPGEAMDKNLY

SEQ ID NO: 4613 - protein, 323 aa, Acinetobacter sp. ADP1
MPKFFLRWIDSWSNLNHTQVSTQVYSSQPQRIQWLRIIPFIVLHIACLAVFWIGFSWFAIFFMLGFYVIRMFAITAFFHRYLSHKTFQTSRPVQFLFILIGTMSAQRGPLWWAAHHRYHHRFTDTDQDPHSSTKGFWYSHVGWFLNEENFAIRKSIIKDWLKYPELIWLDRFSLPVVLATAFAIYALGEVLAIYAPQLKTNGLQLLVWGFVVSTVLLTHATLCINSLAHRYGSKDFETDDQSRNNFFLSIITLGEGWHNNHHFYAGSTRQGFFWWQIDVTYYLLKIMSWCGLVWAIKPVPERIYTSSKKSNSLKDKKINITNI

SEQ ID NO: 4614 - protein, 189 aa, Triticum aestivum
MRPPRGGGGFRGRGGDRGGRLAGGGRFAGGGRGGGGRGRFGGGGGGFRDEGPPAEVVEVSTFVHACEGDAVTKLTNEKVPYFNAPIYLQNKTQIGKVDEIFGPINESYFSVKMFEGVIATSYNEGDKFFIDPMKLLPLSRFLPQPKGSTPRGGGRGGRGGRGGFRGRGAPRGRGPPRGGGRGFRGRGRF

SEQ ID NO: 4615 - protein, 153 aa, Arabidopsis thaliana
SMEDVEETYIMVKPDGIQRGLVGEIISRFEKKGFKLIGLKMFQCPKELAEEHYKDLSAKSFFPNLIEYITSGPVVCMAWEGVGVVASARKLIGKTDPLQAEPGTIRGDLAVQTGRNIVHGSDSPENGKREIGLWFKEGELCKWDSALATWLRE

SEQ ID NO: 4616 - protein, 646 aa, Xanthomonas axonopodis pv. citri str. 306
MFNINRLLRSRPRTDTADQAPAEDRPSHQPSAAEGLLSPLLARPRRRESAAAPRNAGQRSPFRSPLRASGQPAALAGASSAPPRSIEHDIDDWLAQSLPMAERVRTGYNLHDGQRDTSREVLQSVADAIRRAATRHSTELVLDYGLPATTLPDAIGRLDALQKLTLLHTGLQSLPDSLGQLHQLRHLQIAGALGLKTLPPSLTRLSNLRTLQLTMIPLDELPVGIGRMQGLRSLTLGGGHYARLPASIVELSGLTELRMPHSSHFRELPENIGLMQGLRSLEVASNSELEQLPGSLTQLHRLEKLTLSSNRRLAHLPEDIGQLRGLTELSLKNCAALRQLPDSVGDLAQLQLLDLRGTGLQTLPQSLARLPAQCDIKVPDHLAGQLLQIRDPERAAREPQRAAQRLAERRRRAPVPAAQQAGASWNRMPEFARVLRTVDADLGERFDKWTQGLAQTARISGASITPADMPLLDQVVTEAIRSPEFRSSFGQFLSDHTLKTLNMDGMTQVGGFGPAVRGDVKTAFAEMLKHKLMHTQDHQTALGLLQDALQNPDLGLSREMLLRSRNELTGRVEMWPPLKAYISMHDVEGQAAQDAAITWTMAQFEEAQQGGIGDAEAKQESERAQANANRFIEQRARVLLREWDIR

SEQ ID NO: 4617 - protein, 372 aa, Desulfitobacterium hafniense Y51
MGELRVLVFSATFGAGHLRAAEALIEAVRKKSPEAEITHLDFGAFISKTLNTIVKNTYIELIKHTPRLYGMFYYRTSKIRPQSLIQRFINILGRKEFLDYIKGLNPDVIICTYPVIAGVLGELRFKGVIHAPVVSVVTDYGVHSQYIQRGVDLYIAGCQDVYKDLIAGGIARERIRITGIPVDPKFEEELDRAEIAEKLNLKLIRPTILVMVGAYGVLGGSKHICRFLLDSSSPLQVLVVCGRDEKLYRSLEGLEGRNPMVCYGYINNVEELMSVSDLVITKAGGLTVSESLTKKLPMIIYKPIPGQEEENACFLERIGAAKLAKTEEELEATIQYLLSHPEEIESMRRAAAKALPGHAAERAVEEILALVQ

SEQ ID NO: 4618 - protein, 795 aa, Idiomarina loihiensis L2TR
MKFSEQWLREWVNPDISSHELSEQLSMAGLEVDAVEPVADEFHTVVVGEVIECGPHPDADKLQVTKVNVGEDEPVDIVCGASNCRLGIKVAVAKVGAVLPGDFKIKKAKLRGQPSNGMLCSFKELGLIDEHDGIIELPADAPVGEDYRKYLQLDDNSIDIDLTPNRGDCLSIRGIAREVGVLNRLDVTVPESNEVTASIEDTLSISLSAAEQCPRYLGRVIKGVDLTRPTPVWMTEKLRRSGIRSIDPVVDVTNYVLLELGHPMHAFDLDSLEGNIDVRLAKPKEQLTLLDEQLVELDEDTLVIADEKKALAMAGVYGGKNSGVTESSKNIFLESAFFAPDAILGKARRYGLHTDASHRYERGVDPQLQRTAMERATELLLAICGGEAGPVTEAVAEAFLPKRDGITLRACRLAKVLGVSIANDNVTEILERLGFDVSFDGEQWQVGIPSYRFDLSIEEDLIEEVARVYGYNSIQAAPPAAQLRMTERKESQLSTHQLVDAMVSRGYQEAITYSFVDPKHQALMFDETAALTLPHPISVDMSSMRVSLWPGLVGAVAHNQKRQQSVLAFVETGLRFIPDESAENGVRQEAVISGIRSGKAHSEHWSEGDRPVDFYDVKGDVEALLAQTGNAAAFRFVASQNPALHPGQSAAIYRGSEKVGDIGALHPKFDKALGLNQRTFVFELALSVVTERPLPQAKPVSRYPSIRRDLAVVVDKDLAAGELIAAMENVGVKQLVDLNLFDVYIGDGVAEGKQSLALSVTLQDSDKTLEEAEVTELMTKFIETLKSEFNATLRD

SEQ ID NO: 4619 - protein, 625 aa, Oryza sativa
MEASTSLLVLVLAAAAFAAGTVTEAAGDGCSAGCDLALASFYVTPNQNVTNMADLFGIGAANYRSLAPYNPNIPNLDFINVGGRVNVYFTCGCRSLPGSPGATYLAGAFPFQMSRGQIYTSVAANYNNLTTAEWLQATNSYPANNIPDTAVINATVNCSCGDASISPDYGLFLTYPLRAEDTLASVAATYGLSSQLDVVRRYNPGMESATGSGIVYIPVKDPNGSYLPLKSPGKGASAGAIAGGVVAGVVVLAAIFLYIIFYRRRKAKQATLLQSSEDSTQLAGTISMDKVTPSTIVGPSPVAGITVDKSVEFSYEELSNATQGFSIGNKIGQGGFGAVYYAELRGEKAAIKKMDMQATHEFLAELKVLTHVHHLNLVRLIGYCIESSLFLVYEFIENGNLSQHLRGMGYEPLSWAARIQIALDSARGLEYIHEHTVPVYIHRDIKSANILIDKNYRAKVADFGLTKLTEVGGTSMPTGTRVVGTFGYMPPEYARYGDVSPKVDVYAFGVVLYELISAKEAIVRSTESSSDSKGLVYLFEEALNSPDPKEGLRTLIDPKLGEDYPIDSILKLTQLAKVCTQEDPKLRPSMRSVVVALMTLSSTSEFWDMNNLYENQGLVNLMSGR

SEQ ID NO: 4620 - protein, 377 aa, Brucella melitensis 16M
MATQRIIDFLNTRRPEGPCLVVDTDVVRENYQGFEKALPYSRIFYAVKANPAPEILRLLASLGSSFDTASVAEIEMALEAGATPDRISYGNTIKKERDIARAFDLGIRLYAVDCVEEVEKIARVAPGSRVFCRVLTDGEGAKWPLSRKFGCVPAMAKDVLRRAKALGLDAYGVSFHVGSQQTDLTAWDRALADAAAVFRTLADEGIILRMVNMGGGFPTRYLKDVPTAQAYGMAIFDALSRHFGNRIPETIIEPGRGMVGNAGVIKTEVVLVSRKADNDNVRWVYLDIGKFGGLAETMDEAIRYQIVTPHDGSETEPCVLAGPTCDSADVLYEKTPYPLPVSLTIGDEILIEGTGAYTTTYSAVAFNGFEPLRSYVI

SEQ ID NO: 4621 - protein, 178 aa, Triticum aestivum
  misc_feature (140)..(140): Xaa can be any naturally occurring amino acid
MGPNVMGSLDTSVALFQGLKSTDGLPVRRRSNGASLGSVSNGGRIRCMQVWPIEGIKKCDTLSYLPPLRTEALVKHVDYLIRSKWVPCLEFRKVGFIFREQNASPGYYNGRYWTMWKLPMFGCTDATQVINKVEEVKNEXPDAYVRMIGFYNMLQVQCVRFIGFKQPGLQGLRQRLNR

SEQ ID NO: 4622 - protein, 392 aa, Francisella tularensis subsp. tularensis SCHU S4
MSFLTLKDVDLKDKKVLVRVDFNVPVKDGKVTSKVRIEAAIPTIQYILDQGGAVILMSHLGRPTEGEYDSQFSLEPVAKALSEIINKPVKFAKDWLDGVDVKAGEIVMCENVRFNSGEKKSTDDLSKKIASLGDVFVMDAFATAHRAQASTYGVAKYIPVACAGILLTNEIQALEKALKSPKKPMAAIVGGSKVSTKLSVLNNLLDKVEILIVGGGIANTFIKAEGFDVGNSLYEQDLVAEATEILAKAKALGVNIPVPVDVRVAKEFSENAQAIIKKVSDVVADEMILDIGPESQKIIAELLKSANTILWNGPVGVFEFDNFAEGTKALSLAIAQSHAFSVAGGGDTIAAIEKFGIKDQVSYISTAGGAFLEFLEGKKLPAIEILKEKAIR

SEQ ID NO: 4623 - protein, 466 aa, Bacillus thuringiensis serovar konkukian str. 97-27
MKTVVVIGGGITGLSTMFYLEKLKKDYNIDLNLILVEKEEYLGGKIHSVEEKDFIMESGADSIVARNEHVMPLVKDLNLEGEMVYNETGISYIYSDNTLHPIPSDTIFGIPMSARSLFSSTLVSTKGKIVALKDFITKNKEFTKDTSLSLFLESFLGKELVERQIAPVLSGVYSGKLNELTMASTLPYLLDYKNKYGSIIKGFEENKKQFQSAGNKKFVSFKGGLSTIIDRLEEMLTETVVKKGAVTTAVSKQGDCYEISFANHDSIHADYVVLAAPHDIAETLLQSNELNEQFHTFKNSSLISIYLGFDILDEQLPADGTGFIVTENSDLHCDACTWTSRKWKHTSGKQKLLVRMFYKSTNPVYETIKNYSEEELVRVALYDIEKSLGIKGEPEVVEVTNWKDLMPKYHLEHNQAVQTLQEKMMNLYPNIYLAGASYYGVGIGACIGNGKNIANEIIATLNEPSN

SEQ ID NO: 4624 - protein, 663 aa, Francisella tularensis subsp. tularensis SCHU S4
MSLSIPREFSNAIRFLSIDATLKAKSGHPGMPMGMADIATVLWTKFLKHNPNNPHWINRDRFVLSNGHGSMLLYSLLHLTGYDLSIEDIKNFRQLHSKTPGHPEYGYTPGVETTTGPLGQGVANAVGMALGEKLLSDRYNTPDLKVIDHHTYVFLGDGCLMEGVSHEACSLAGTLGLNKLVAFWDDNNISIDGDTKGWFSDNTPERFRAYGWHVIENVDGHDFVAIEKAINEAHSQQQKPTLICCKTVIGFGSPEKAGTASVHGSPLSDQERASAAKELNWDYQAFEIPQDVYKYWDAREKGQALEANWQGQWNLFKDSPKFDEFERVLSKELPVGLESAINDYIASQLSNPVKVATRKASQMVLEVLCKNMPEMFGGSADLTGSNNTNWSGSVWLNNTQEGANYLSYGVREFGMAAIMNGLSLYGGIKPYGGTFLVFSDYSRNAIRMSALMKQPVVHVMSHDSIGLGEDGPTHQPIEHVPSLRLIPNLSVWRPADTIETMIAWKEAVKSKDTPSVMVLTRQNLMPVVQTQHQVANIARGGYLVKDNPDAKLTIVATGSEVELAVKVANEFEKKGIKLNVASIPCVEVFATQAHEYKKTVIKDDIPAVFVEMAQPDMWYKYMPKAGGEVKGIYSFGESAPAEDLFKRFGFTVENISNIVAKYV

SEQ ID NO: 4625 - protein, 474 aa, Oryza sativa
MAIAVSGRWTRLRTLGRGASGAVVSLAEDGASGELFAVKTAAAAEAAMLRRERGMMSGLSSPHVVPCIGGGDGPDGSYNLFLEFAPGGSLANEVARDGGRLEERAIRVYAADVLRGLTYLHGMSLVHGDVKADNIVIGVDGLAKLADFGCAKTMDSERPVSGTPAFMAPEVARGEEQGPAADVWALGCTVIEMATGRAPWSDMDDVLAAVHRIGYTDAVPEVPVWLSAEAKDFLAMCFARNAGDRSTAAQLLEHPFVAFACHEVKAAQPKPRWVSPKSTLDAAFWESETDDEEEVDEITESLCDRIKSLACPVSALPDWDSDEGWIDLLGEQCEACDSEAARESIDVARSAPSKVSSAATVPAAEVVLVGGGCCPSNEADAFDQSIGGDIQAADRSIERRNKVCAGSDNDVLPFRLRLALLGPSRPSTAHIRKPPPNPRGRSALTASASISSPRRACVDVKRGVCVAPRPHRLT

SEQ ID NO: 4626 - protein, 79 aa, Brassica napus
GSFKVCRYLFVRCDNEPAPWTSDEHGDRPRPLPNIPELKMATELFERKESPSWNFDVSFVSLLSSHSLVPIRLDQIPNY

SEQ ID NO: 4627 - protein, 70 aa, Brassica napus
MAFLVTSVIFAVVGIIASIFTRICFNQGPSTNLLHFTLVITATVCCWMMWAIVYIAQMKPLIVPILSEVE

SEQ ID NO: 4628 - protein, 868 aa, Oryza sativa (japonica cultivar-group)
MQQPQASSMTAAARRRQLQGSVLAGKMVLVRKALDTNLNSGDVVCQLVSSTVGDPDNGNRGMLGQEACVHINSELHPTPYEASTFSFEFIWDMKKQGVPGAVIVKNYCDEEFFVNTITLDIVPGYGTIVFTAESWVYPDEIYDHLPRVFFSNQPYLPNQMPAPLVPYREEELRNLRGDDNPGPYKDHDRVYRYDVYNDLGEPDSGNPRPVLGGSDEHPYPRRCRTGRRRTNTDPDSESRNVGFPLTNHFYVPRDEVFNDRKKAYFDTNNLKLYIMQKYATFLLHADQQTPFEFDSFADVLSLYDEGSINLPGWLNTFLQPLLGIIPFKLLQQVLTPDSEFILKFPMPAVIREDKTAWQTDEEFAREMLAGTNPVVIRRLGETEFPPKSKLDTSKYHNQNSRITAAHVEKCLEVEGLTVEQVLADGRLFILDHHDHFMPYLLDANHQPDTFVYATRTLLFHRNDGTLQPAAIELSLPRFEAGSTLISSVGEVYTPASDGVEGHIWQLAKAYVTVNDYSWHQLVSHWLNTHAVMEPFAIATHRQLSVAHPIHKLLHPHYRDNLFINALGRQSLINAGGSSENTVFLGKYGLSMTSEVYRNWNFTEQALPEDFIKRGVAKRRSNGELELLIKDYPYAVDGLAIWSAIETWVRDYCAIYYADDAAVQGDAELQSWWKDVREEGHGDLKDHKWWPEMKTVAELVQSCATIIWIASALHAAVNFGQYMYAGYVPNRPSVSRRPMPKPGTDLYRELELHPEKEFLLTITKQDLSIAGIALVELLSSHSDDEVYLGQRDSPNWTSDLDAMNAFDRFRERLLEVEKNIVAKNDKGSGFKNRTGPVNIPYNLLFPYASGDAEANTGVTGKGIPNSASI

SEQ ID NO: 4629 - protein, 444 aa, Oryza sativa (japonica cultivar-group)
MRMGKYEMGRALGEGHFGKVKLARHADTGAAFAIKILDRQRILAMKIDEQIKREIATLKLLKHPNVVRLHEVSASKTKIYMVLEYVNGGELFDKIALKGKLSEKEGRKLFQQLMDAVSYCHEKGVYHRDLKPENVLVDAKGNIKVSDFGLSALPQNQRKDGLLHTTCGSPNYIAPEVLLNRGYDGSLSDIWSCGVILYVMLTGNLPFDDQNTVVLYQKILKGDARIPKWLSPGAQDILRKILDPNPITRLDITGIRAHEWFRQDYTPAMPFDDDDDNNISDGNLHMTENQDIETSPAISQINAFQLIGMSSCLDLSGFFEKEDVSERKIRFVSNYSPTSLFEKIESTVTEKGFQVQKNSGKLKVIQVCKEPANPRGHGNLLISAEVFEINESLYVVELKRSSGDCSLYRQLCASLSEDLGICKRQQLLKKDSMRQDLCRYNSSF

SEQ ID NO: 4630 - protein, 1317 aa, Pseudomonas putida KT2440
MATTTLGVKLDDPTRERLKAAAQSIDRTPHWLIKQAIFNYLEKLEGGATLTELNGHASNPADDAGEVQADHSHQCFLEFAESILPQSVLRSAITAAYRRPEQEVVPMLLEQARLSAPLADATNKLAASIAEKLRNQKSVGGRAGIVQGLLQEFSLSSQEGVALMCLAEALLRIPDKGTRDALIRDKISTGNWQPHLGNSPSLFVNAATWGLLLTGKLVSTHNETGLTSSLTRIIGKSGEPMIRKGVDMAMRLMGEQFVTGETIAEALANASRFEAKGFRYSYDMLGEAALTEHDAQKYLASYEQAIHSIGKASHGRGIYEGPGISIKLSALHPRYSRAQYERVMEELYPRLLSLTLLAKQYDIGLNIDAEEADRLELSLDLLERLCFEPSLAGWNGIGFVIQAYQKRCPYVIDYVIDLAKRSRHRLMIRLVKGAYWDSEIKRAQVEGLEGYPVYTRKVYTDVSYVACARKLLAVPEAIYPQFATHNAHTLSAIYHIAGQNYYPGQYEFQCLHGMGEPLYEQVVGKIADGKLNRPCRVYAPVGTHETLLAYLVRRLLENGANTSFVNRIADHSISIQELVADPVASIERMGTQEGSIGLPHPRIPLPRDLYGTERANSAGIDMANEHRLASLSCAMLATAHNDWKAAPLLACAASESAAAPVLNPADHRDVVGHVQEATVADVDNAIQCALNAAPIWQATPPAERAAILERTADLMEAEIQPLMGLLIREAGKTFANAIAEVREAVDFLRYYAVQARNDFSNDAHRPLGPVVCISPWNFPLAIFTGQVAAALAAGNPVLAKPAEQTPLIAAQAVRLLLEAGIPEGVLQLLPGRGETVGAGLVGDERVKGVMFTGSTEVARLLQRNVAGRLDNQGRPIPLIAETGGQNAMIVDSSALTEQVVIDVVSSAFDSAGQRCSALRVLCLQEDSADRVIEMLKGAMAESRLGCPDRLAVDIGPVIDAEAKAGIEKHIQGMREKGRPVYQVAIADAAEIKRGTFVMPTLIELDSFDELKREIFGPVLHVVRYNRRNLDQLIEQINNSGYGLTLGVHTRIDETIAKVVETANAGNMYVNRNIVGAVVGVQPFGGEGLSGTGPKAGGPLYLYRLLSTRPADAIGRHFQQQDGEGTPDRTLHEQLVKPLHGLKAWAENNQLADLAALCSQFASQSQSGIARLLPGPTGERNSYTILPREHVLCLADNETDLLAQFAAVLAVGSSAVWVDGEPGKALRARLPRELQAKVKLVADWNKDEVAFDAVIHHGDSDQLRGVCQQVAKRAGAIVGVHGLSSGDHQIALERLVIERAVSVNTAAAGGNASLMTIG

SEQ ID NO: 4631 - protein, 482 aa, Idiomarina loihiensis L2TR
MNNEQVLQPDNVELIKNSRVGTSTKSSIAVDDPATGHVIGHVPDLTPRQILRAIESAETAFYKWRDVPLRERCEKLFRWYQLMHEKEEELAGILTSEQGKPLSESRGEIRYAASYIQWYAQPSLQDQGSVLPYSSIDESMIVITEPVGVCAAITPWNFPAAMITRKVAPALAAGCTMLVKPALETPLTAIAIAELAIQAGIPEGVLSIVTGDGEAIGKIFSESAVVRKLSFTGSTRVGRLLMASSASTIKRLSLELGGNAPFIVCETADVERAVQGAIQSKFRNAGQTCVCANAFYIHTKVYDEFTEKFIACVNQLMLGNGKNESVDIGPLINENALEKVEQIVADAVKKGAVIACGGERWVNSERWYYPTVLLNADSSMRCVNEEIFGPVAPIVRYNDETALLEELRQQQTGLAAYFYSQNLGQVNRLSRALEVGMIGVNSGVISDAAVPFGGVKSSGIGREGGRHGIEEYLETKYIKLSY

SEQ ID NO: 4632 - protein, 409 aa, Brucella suis 1330
MDDRCIIIGAGHAGSQAAVSLRQEGYAGEIILINDETDIPYHKPPLSKSYLKAPEKGSLVLRPESAYRDNNIEMLFGAHVDAVSIAERTVTLGDGRVLPWSELVFATGARARIPDVPGVALEGVVTLRRMEDARRIAAMMPDVRNVVIIGGGFIGLEMAHSAIALGKKTVLIEAAPRVLGRSVAAPVSAHVEARSRAADITLLTGLGIASIEGENGRAIGVTAGDGTFFPADLVVIGTGAVPNVELAAKAGLSIDNGIRVDEHMRTSAPHVYAIGDCASYAHFHAGRHVRLESVQNATDQAKHVARTIVGRETPYREVAWFWSDQGDMKLQTAGLSFDADRHVLSGEPEENAFSVFHFKGDRLVAVDSINRPADHMIARRLLAAGISPSEADIMAGMPRLKELLAVVAR

SEQ ID NO: 4633 - protein, 509 aa, Myxococcus xanthus DK 1622
MALPDLKALSLLNHVPPRLLSAAERYLKAVPGVKGLLNRETGSLLSELESGLKPYRGKMQSFDHLPPTGRSREDVLRELQALESQEEYRWREGRVSGGVYNGDAEHIAFLNRVYALHSQSNPLHADLWPSATKFEAEVVAMTASMLGADVANAGQPEEARICGAMSSGGTESIMLAMKTYRDWARETKGITRPEMVAPASAHPAFDKAAHYFGIKMVRVPVGPDYRADVAAMRKAINRNTIVLIGSAPGFPHGVIDPIEALSEIARKKRIGFHTDACLGGFVLPFAMKLGYDVPPFDFRLPGVTSMSVDTHKFGYAAKGSSVVLYRGTELRSHQYFTATDWPGGIYFSPTFSGSRPGALIASAWAALVSTGEQGYLDATRSILETAAAIKKGIRDIPELHVLGDPLFVIAFGSESVDIFQVMERMSEHGWNLNGLHKPSAVHLCVTLRHTQPGVAEQFLVDLRDAVDYVKSHPSAKGTMAPVYGMAASVPFRGLVSDLLKKYMDLLYKV

SEQ ID NO: 4634 - protein, 374 aa, Wolbachia endosymbiont strain TRS of Brugia malayi
MSKKDYYKLLGVDRNASTDEIKKAYKKLALKYHPDRNPGNKEAEEKFKEITAAYEVLSDSEKRAGYDRYGHEGASGGFDFSQGFGSAGDFSDIFNDFFGGEFGSSSRSKAKRSTTGVPGADLRYDLEITLEDAFKGIQAPIHYVTNVKCDMCQGRGSEGATKPVQCHTCQGSGRIRTQQGFFTIERTCTTCYGEGEIIQNKCKKCNGSGRRRDEVNISVSIPKGIEEGAKVRVSGKGEAGAKGGKSGDLYVYVKITPHKIFTRNKADLHCKVPIRMTLAVLGGEIDVQSIDGAKIKVKVPEGTQTSTKLRCKEKGMPYMNSYARGDLYVQIIVETLNPNNLTKKQIELLKALEEEENASIQQQSEGFFSKVKKK

SEQ ID NO: 4635 - protein, 308 aa, Xanthomonas campestris pv. campestris str. ATCC 33913
MSLDPALRSRIDTLLQSNRVVLFMKGQPGMPQCGFSAKAIGVLDGLGIDYAHVNVLADQEIREGIKAYGDWPTIPQLYVDGELIGGSDIIVQMADSGELSSMLGLQAPDRSPPKITITPAAVEMLKGALADAPDASLTLAIDANFQPNFQLAPTNPNAIAAESNGLRVQFDLASARRADGITIDWVDDIRGRGLAIDNPNAPKPVQELAVRDADDRLKAGTLTVVDVRPADERALATVAAPFRTLDAHERLEIEQLPKDTPLAFLCHRGGRSLQAAEHFRGLGFTNVYNVTGGIDAWSDAVDNGVPKY

SEQ ID NO: 4636 - protein, 357 aa, Blumeria graminis
MAEFVRAQIFGTTFEITSRYSDLQPVGMGAFGLVCSAKDNLTGQNVAVKKIMKPFSTPVLSKRTYRELKLLKHLRHENVISLSDIFISPLEDIYFVTELLGTDLHRLLTSRPLEKQFIQYFLYQILRGLKYVHSAGVVHRDLKPSNILVNENCDLKICDFGLARIQDPQMTGYVSTRYYRAPEIMLTWQKYDVEVDIWSAGCIFAEMLEGKPLFPGKDHVNQFSIITELLGTPPDDVIHTIASENTLRFVQSLPKRVRQPLKDKFTNADPLAIGLLEEMLVFDPRRRIKATDALAHEYLAPYHDPTDEPIALEKFDWSFNDADLPVDTWKIMMYSEILDYHNVDSENQAMEDPLECP

SEQ ID NO: 4637 - protein, 136 aa, Brassica napus
LGMNSLSTLPAEIGDLSRLGTLDLRSNQLKEYPVGGCKLKLSYLDLSNNSLTGLHPELGNMTTLKKLVLVGNPLRTLRSTLVNGPTAALLKYLRSRLSNGEETSASTPTKENVIASAARMSISSKELSLEGLNLSA

SEQ ID NO: 4638 - protein, 288 aa, Xanthomonas campestris pv. campestris str. ATCC 33913
MTNTSIPADLGDWIIAQAIAGHPPEHTLQPLLEAGWSEQDAIDAVEALVRAHVQAHAQAHGLPVPVPVRVPAPLQADASSLLDLGDRQVQVLVSLMLPRVVVLGGLLADDECDALIALARPQLARSRTVDNRDGSEIVHAARTSHSMALQPGQDALCQRIEARIAQLLEWPVEHGEGLQVLRYATGAQYAPHYDYFEPDAPGTPVLLQHGGQRVASLVMYLNTPERGGATRVPDVHLDVAAVKGNAVFFSYDRPHPMTRTLHAGAPVLAGEKWVATKWLRERPLHAPT

SEQ ID NO: 4639 - protein, 135 aa, Salmonella enterica
GDNGSGMHCHMSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGIKNKIHPGEAMDKNL

SEQ ID NO: 4640 - protein, 715 aa, Oryza sativa
MDVSVPPTNYPKSLSSIIKCHRRRAAINNCHSVVSHPPLSHSNHHHRSLRVRSSAAVAPPLPPPLVVPMTTPKPSPTIRRLDVASPVPADIDIANAVSPLPIADIAAELGLRPEHFDLYGKYKAKVLLSVLDELKGQQDGYYVVVGGITPTPLGEGKSTTTVGLCQALGAFLDKKIKFVIGVEVVTCLRQPSQGPTFGIKGGAAGGGYSQVIPMDEFNLHLTGDIHAITAANNLLAAAIDTRIFHEASQSDKALFNRLCPPNKEGKRRFADVMLRRLIKLGISKTDPNELTPDEVRRFARLDIDPESITWRRVMDVNDRFLRKITIGQGPDEKGMVRETGFDIAVASEIMAVLALTTSLADMRERLGRMVIGNSKAGEPITADDLGVGGALTVLMKDAIHPTLMQTLEGTPVLVHAGPFANIAHGNSSIVADKIALKLVGKGGYVVTEAGFGSDIGTEKFMDIKCRYSGLMPQCAIIVATIRALKMHGGGPDVVAGKPLDHAYVSENVALVEAGCVNLAKHIANTKSYGVNVVVAINKFASDTEAEMDVVRNASLAAGAFDAVVCTHHAHGGKGAVDLGLAVQRACESQADPLKFLYPLESGIKEKIESIAKFYGASGVEYSEQAEKQIEMYTKQGFSNLPICMAKTQYSFSHVPSMKGAPSGFVLPIRDVRASIGAGFIYPLVGTMSTMPGLPTRPCFYEIDVDTATGKVMGLS

SEQ ID NO: 4641 - protein, 416 aa, Myxococcus xanthus DK 1622
MAIFEFKLPDLGEGVMEGELVKWHVKAGDSVKEDQVLAEVMTDKATVTVPAPKAGRVVKTHGNEGDMAKVHQLLVTLEVEGAAPAQAGGHSEASAPAAAPVAGGHVGGAPASASKVLATPVTRRMAREHGLDLASIAGTGPQGRVTKADVVAALEGGEKNVVAAPAEQKARPAAPAVSSGAADERVPLRGLRKKIAEKMVRSKFTAPHFAFVEEVDATELVALRARLNAQLAAAGENIKLNYLPFIIKATVAALKKFPHLNANFDEASQELVVRGEFNIGMAAATPDGLTVAVVKSADRLTLAELARETARLGAAARDRKLKMEELTGGTFTISSLGQSGGLFATPIINHPEVGILGVHRLKKRPAVVGDQVVVRDMMNLSLSCDHRVIDGSVAADFTYEIIKYLEKPDLLFLAMA

SEQ ID NO: 4642 - protein, 183 aa, Arabidopsis thaliana
MATEDVQDPRIAKIASSIRVIPDFPKPGIMFQDITTLLLDTEAFKDTIALFVDRYKDKGISVVAGVEARGFIFGPPIALAIGAKFVPMRKPKKLPGKVISEEYSLEYGTDTIEMHVGAVEPGERAIIIDDLIATGGTLAAAIRLLERVGVKIVECACVIELPELKGKEKLGETSLFVLVKSAA

SEQ ID NO: 4643 - protein, 104 aa, Triticum aestivum
  misc_feature (37)..(37): Xaa can be any naturally occurring amino acid
ETDMALILDVVRFKYTLNWHTLTLMWDAMNTTDEATXLLMRIMLGSRRRSSTSLLYTTCCGHTRWKSMATYCVEDVPNLLTDENGDTVTTTLCRLVESLPGNAG

SEQ ID NO: 4644 - protein, 133 aa, Salmonella enterica
MPKPMFGDNGSGMHCHMSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGIKNKIHP

SEQ ID NO: 4645 - protein, 567 aa, Streptococcus pneumoniae TIGR4
MALEVIMPKAGVDMTEGQIVQWNKKVGEFVKEGEILLEIMTDKVSMELEAEEDGYLIAILKGDGETVPVTEVIGYLGEERENIPTAGAASPEASPVPVASTSNDDGKSDDAFDIVVIGGGPAGYVAAIKAAQFGGKVALVEKSELGGTCLNRGCIPTKTYLHNAEIIENIGHAANRGIVIENPNFTVDMEKLLETKSKVVNTLVGGVAGLLRSYGVTVHKGIGTITKDKNVLVNGSELLETKKIILAGGSKVNKINVPGMESPLVMTSDDILEMNEVPESLVIIGGGVVGIELGQAFMTFGSKVTVIEMMDRIVPAMDVEVSKNLRLILERKGMTILTGTKLQEIIEENGQLRIKVEGKDDIIASKALLSIGRMPDLEGIGEVEFELDRGCIKVNEYMETSVPGIYAPGDINGTKMLAHAAFRMGEVSAENALKGNHAVAKLNLTPAAIYTLPEVAAVGLTEEQAREKYDVAIGKFNFAANGRAIASDAAQGFVKVIADKKYGEILGVHIIGPAAAELINEASSIIEMEITVEEMLKTIHGHPTYSEVMYEAFADVLGMAIHSPKKK

SEQ ID NO: 4646 - protein, 347 aa, Streptococcus pneumoniae TIGR4
MADDKLRATPAARKLADDLGINLYDVSGSGANGRVHKEDVETYKDTNVVRISPLAKRIALEHNIAWQEIQGTGHRGKIMKKDVLALLPENIENDSIKSPAQIEKVEEVPDNVTPYGKIERIPMTPMRKVIAQRMVESYLTAPTFTLNYEVDMTEMLALRKKVLEPIMEATGKKTTVTDLLSLAVVKTLMKHPYINASLTEDGKTIITHNYVNLAMAVGMDNGLMTPVVYNAEKMSLSELVVAFKDVIGRTLDGKLAPSELQNSTFTISNLGMFGVQSFGPIINQPNSAILGVSSTIEKPVVVNGEIVIRPIMSLGLTIDHRVVDGMAGAKFMKDLKELIETPISMLI

SEQ ID NO: 4647 - protein, 154 aa, Salmonella enterica
MPKPMFGDNGSGMHCHMSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGIKNKIHPGEAMDKNLYDLAAKNLYDLPP

SEQ ID NO: 4648 - protein, 655 aa, Oryza sativa (japonica cultivar-group)
MDIVVGVLLILGLMPMPFEVIMAAADDGGGVFCDNLKFVSATLPNKTSSSPHHYATAAAGQAPDVVYVLALCRGDLNDTACGESVAYTFARLINESCVANYTAGAYYGDCTGVYSFQNFLDPSDATEDEEPFERWNVNNITGDGENVRFIAGLIQQLLSETVERAAGAAGRFATGVVDTGRTFPLVYSLAQCTPDLSAGDCLACLRRLTGMINSTMAVRMGAQIHVTRCYFRYEAYVFYDSKPMLHLTGAPAPAIPKRHKSKLWVIPIVIIPVVAFFCFIVYCGWRRGHRKGIMGLQARRTDNLQGEEELVWDLEGKNPEFSVFEFDQVLEATSNFSEVNKLGEGGFGAVYKGHFPDGIEIAVKRLASHSGQGFIEFKNEVQLIAKLQHRNLVRLLGCCSHEEEKILVYEFLPNKSLDLFIFDENKRALLDWYKRLEIIEGIAHGLLYLHKHSRLSVIHRDLKPSNILLDSEMNPKISDFGLARIFSSNNTEGNTTRRVVGTYGYMAPEYASVGLFSIKSDVFSFGVLFLEIISGKKNSGSHHSGDFINLLGFAWSLWGEGRWLELIDESLVSKYPPAENEIMRCINIALLCVQENAADRPTMSDVVAMLSSKTMVLAEPKHPGYFNVRVANEEQSVLTEPCSVNDMTISAISAR

SEQ ID NO: 4649 - protein, 521 aa, Zea mays; identical to SEQ ID NO: 1457

SEQ ID NO: 4650 - protein, 330 aa, Streptococcus pneumoniae TIGR4
METKTMSFRDTIILAMSEEMRRDENVFLMGEDVGVFGGDFGTSVGMLEEFGPERVRDCPISEAAISGAAAGAAMTGLRPIVDMTFMDFSVIAMDNIVNQAAKTRYMFGGKGQVPMTVRCAAGNGVGSAAQHSQSLESWFTHIPGLKVVAPGTPADMKGLLKSSIRDNNPVIILEYKSEFNQKGEVPVDPDYTIPLGVGEIKRQGTDVTVVTYGKMLRRVVQAAEELAEEGISVEIVDPRTLVPLDKDIIINSVKKTGKVVLVNDAHKTSGYIGEISAIISESEAFDYLDAPIRRCAGEDVPMPYAQNLENAMIPTVESIKDAIRKTYNKE

SEQ ID NO: 4651 - protein, 489 aa, Rhodopirellula baltica SH 1
MSTTLPEIAPPKVRHTQLFIDGQWRDSASGKTFATINPATEEEIVQVAEGDKEDIDAAVKAARKAFESGPWRTMDARDRGRLMMKLADAIENEIDELAQLETLDNGKPLRESRHADLPLVIDALRYYAGYADKIQGETVPIRGNYLCYTRKEPVGVVGQIIPWNFPMLMVAWKWGPALATGCTIVMKPAEQTPLTCLRMAQLAKEVGFPDGVINVVPGFGPTAGGALVDHPGVDKIAFTGEHRTAQLIMKNSAQSLKRLTFELGGKSPNVIFSDADLDAAVQGSFVGLYLNQGQCCCAGSRVFVEESIHEAFVEKLTDLTNKRVVGNPFEHTTEQGPQIDQAQFDKIMSYIDKGNQQGASCVSGGKRSGDRGYFIEPTVFTDVQDDMAIARDEIFGPVMSVLSFKDSDDILKRANDTMFGLAAAVWTQDIKKAHHFAANVRAGTVWVNCYDVFDAAAPFGGFKMSGQGRELGTEGLKAYLESKTVTVAL

SEQ ID NO: 4652 - protein, 549 aa, Prochlorococcus marinus str. NATL1A
MFSTEFTQLTVQLNSPFTDQKPGTSGLRKSTLQFEETHYLESFIESILCSLPGVRGGVLVVGGDGRYGNKRAIDIIIRMAAAHGIQKVITTVDGILSTPAASNLIRINKAIGGIILSASHNPGGLEGDFGVKLNGSNGGPASESLTDEIYNYSKNLKEYKIIKCQSNNSFSLGKYKLASMIVEIIDGIDDYLDLMKKIFDFDLISSYINNDFPIVFDALNAVTGPYAKRLFVDHLGATAETVRNGIPLEDFGGLHPDPNLTYAKDLADLLLKGNLFSFGAACDGDGDRNMILGRGCFVNPSDSLAILAANYDCVPGYAKGLSGVARSMPTSSAVDVVAKHLGINCFETPTGWKFFGNLLDANQITLCGEESFGTGSDHVREKDGLWAVLFWLQILASKKKSVSEIMKNHWLFFGRHYYSRHDYESIPSEVANSLYSRLSNMLPTLIGESFARRTIENADDFSYTDPVDGSITLNQGLRILLDDGSRVLVRLSGTGTQGATLRVYFESFVPRDGDITQDPQLALDPLIKSIDSLAEISKRTGMSAPTVIT

SEQ ID NO: 4653 - protein, 322 aa, Streptococcus pneumoniae TIGR4
MSTLDKNLLLEMFRKMEEIRRMDLKIAQLVKKGKVPGMTHFSVGEEAANVGAMLALNPDDLITSNHRGHGQAIAKGIDLNGMMAEILGKYTGTCKGKGGSMHIADLDAGNLGANGIVGGGMGIAVGAALSQQMQNTGKIVVCFFGDGATNEGVFHEAVNMASIWNLPVIFYCINNGYGISADIKKMTNIEHIHQRSAAYGIPGMFIEDGNNVIDVYEGFQKAVDHVRSGNGPVLIESVTYRWLGHSSSDPGKYRTREEVELWKQKDPIENLRNYLIENNIASAEELEEIQAQVKEAVEASVKFAEESPFPPLESAFEDIYAD

SEQ ID NO: 4654 - protein, 404 aa, Mesembryanthemum crystallinum
MESRVLSRATAIAALPRLSRPRREAASLGIAAVKPVGAVKDGGNLIWGRQLRPVLLLEPVQTGPVSRKESTAVQPCRAAAEGSDSAGEAKVGFLQKYPALVTGFFFFMWYFLNVIFNILNKKIYNYFPYPYFVSVIHLLVGVIYCLVSWAVGLPKRAPIDGNLLKLLIPVALCHALGHVTSNVSFAAVAVSFTHTIKALEPFFNASASQFILGQPIPITLWLSLAPVVLGVAMASLTELSFNWTGFISAMISNISFTYRSIYSKKAMTDMDSTNVYAYITIIALFVCIPPALIIEGPQLIKYGFNDAIAKVGLTKFITDLFWVGMFYHLYNQLATNTLERVAPLTHAVGNVLKRVFVIGFSIIIFGNKISTQTAIGTSIAIAGVAIYSFIKGKMEEEKRQKKAA

SEQ ID NO: 4655 - protein, 160 aa, Oryza sativa
  misc_feature (31)..(31): Xaa can be any naturally occurring amino acid
  misc_feature (74)..(74): Xaa can be any naturally occurring amino acid
  misc_feature (133)..(133): Xaa can be any naturally occurring amino acid
ARGLVPNSARGVAGDNSVDILTNDIGVVVVXDSAREPVGFNIYVGGGMGRTHRLDTTFHRLADALGYAASEDLXVWYKSKRRHTEGRRTDRVTRLCITMKDLTDDRGIDKPASAIYKDYGKMVEHTRPLPGWXGNRLLRWLEQGDGKLFYGVHVDNGRVA

SEQ ID NO: 4656 - protein, 459 aa, Ralstonia eutropha JMP134
MSANSEHLQRGLGERHIRLMALGSAIGVGLFLGSANAIRMAGPAIMLAYLIGGAMIFLIMRALGEMAVHNPVAGSFCRYAQDHMGPLAGYLTGWNYWFLWLVTCVAEITAVAIYMGVWFPDVPRWIWALAALATMGSVNLLTVKAYGEFEFWFAMIKIVTIVLMLFGGGAMIVFGLGNGGIATGISNLWAHGGFMPNGASGVLMSLQMVMFAYLGVEMIGLTAGEAKNPRKSIPDAINSVFWRILIFYVGALFVILSLYPWNEIGAQGSPFVMTFERLGIKTAAGIINFVVLTAALSSCNGGIFSTGRMLYNLAQQGQAPAAFARVDRNGVPRRALLVSIGALLCGVLLNYLVPEKVFVWVTSISTFGAIWTWAIILVTQMQFRKNLSPAERDKLAFRMPFWPYGSWIALAFLALVIALMAYFPDTRIALYVGPAWLVLLTVLYYRLGMQARGPVTYQA

SEQ ID NO: 4657 - protein, 395 aa, Mesembryanthemum crystallinum
MITTLKQPTISFSNPDVLRKKFQVPTSQFASFAPLIRRKSDLLIQKPLHVSSVKGLGFGLGDGLLRERKPLIKCEAYEADGSEPIKPEPVPVPIPGEAARKVKIGIYFAVWWALNVVFNIYNKKVLNAFPYPWLTSTLSLAMGSLIMVVSWATRIAEAPNTDSDFWKALLPVAVAHTIGHVAATVSMSKVAVSFTHIIKSAEPAFSVLVSRFFLGESFAAGVYWSLVPIIGGCALAAVTELNFNMIGFMGAMISNLAFVFRNIFSKKGMKGKSVSGMNYYACLSILSLVLLTPFALYVEGPKMWAAGWDKAVSDIGSNFIWWLTAQSVFYHLYNQVSYMSLDEISPLTFSIGNTMKRISVIVSSIIIFRTPVQPVNALGAAIAVFGTFLYSQAKQ

SEQ ID NO: 4658 - protein, 343 aa, Zea mays
QEVFRCVTPARVRRHLRMTTDPNGNGNGNDKPMLVSIRTKGQRDSTLPSIAEPEPLPPRHNYRHHRRRPKAHSMCVCTMLRNQARFLREWIIYHSRIGVERWFIYDNNSDDGIEQVLGTMDPSTHNVTRHLWPWTKSQEAGFAHCALRARESCEWVGFIDVDEFLHFPGNQTTLPDILRSYSNRPRVGELRTACHSFGPSGRTRIPKQGVTTGYTCRLAAPERHKSIVRPDALNPSLVNVVHHFHLREGARYVNVGQGAMLVNHYKYQVWEVFKDKFSGRVATYVADWRDEENVGSRDRAPGLGTRPVEPEDWPRRFCEVYDTGLKDFVQKAFADPATGSLPW

SEQ ID NO: 4659 - protein, 443 aa, Arabidopsis thaliana
  misc_feature (312)..(312): Xaa can be any naturally occurring amino acid
MDRISSLPDEILEHILSFLSTKEAALTSSLSTRWKNVFVFVPSLHLDYARQHENPREFIDFVDFVNTLFNRKGNSPIKKLALKIHLKDNQSLQNQTHVQSWIHRVLSRGGVTDLDLFITFKGKFQLVPLLIFKSNTLVKLKLGRGFTIKLCHENVYLPMLKTLCLDTVDFDGDHNVFETLLPRCPLLEELVLEDQRWKQWCGPVSSPSLKRLRIRFFHIPIISLDVPGLVYLELSCIFGSKYANVNLDSLVEARLNHWVEEQELRKLRDGSSHLVPADMMDLITGIRKVKVLHLTSDALELFYFSGQELPMXDNLVYLSIASDKKQGWQILPLLIKNSPNLETLVFKGLEHYTTKQCGDACVCSGILGKSSSCLSSSRVKVLEIWSYQGTSKELKQMGHFLMKLQFLELVKIRAVSNLQVPIDIQYLLKLPRASSNCKIQAIF

SEQ ID NO: 4660 - protein, 364 aa, Shewanella sp. MR-7
MSYQIAVLAGDGIGPEVMAEARKVLKAVEARFGLNIEYTEYDVGGIAIDNHGCPLPEATLKGCEAADAILFGSVGGPKWEKLPPNEQPERGALLPLRGHFELFCNLRPAKLHDGLEHMSPLRSDISARGFDVLCVRELTGGIYFGKPKGRQGEGESEEAFDTMRYSRREIARIARIAFEAARGRRKKVTSVDKANVLACSVLWRQVVEEVAVDFPDVELEHIYIDNATMQLLRRPDEFDVMLCSNLFGDILSDEIAMLTGSMGLLSSASMNSTGFGLFEPAGGSAPDIAGKGIANPIAQILSAALMLRHSLKQEEAASAIERAVSKALNSGYLTGELLSSDQRHKAKSTVEMGDFIADAVKAGV

SEQ ID NO: 4661 - protein, 414 aa, Galdieria sulphuraria
MAFLSTSCVNLVGSHRCYKDKTSQAICQRSFLKRRSFLCGSDSTGYSLFTSSFVSYHNRDLDLSSKTNANQRWVMQAKVRVAINGFGRIGRNFLRCWATRPSSHLDVVAINDTTGAKTAAHLLKYDSILGTFEKDVRAGEDCITVDGKEIKVVSNRDPLQLPWKDLNIDLVVEATGVFVDSKGAGKHLQAGAKKVLITAPGKGEDVGTFVIGVNEHSYDHQVHHIVSNASCTTNCLAPFIKVLHEEFGIVKGTMTTTHSYTGDQRLLDAAHRDLRRARSAALNIVPTTTGAAQAVALVIPELKGKLNGLALRVPTPNVSVVDMVCQVGRKTFKEEVNGAFLKASQGSLRGILRYSDEQLVSCDYRKTNESSIIDASLTMVLGDDLVKVVAWYDNEWGYSQRVVDLGELMASKWK

SEQ ID NO: 4662 - protein, 371 aa, Acidovorax sp. JS42
MKSRAAVAFKAGEPLQIVELDVAPPRKGEVLVKITHTGVCHTDAFTLSGDDPEGIFPAVLGHEGAGVVVEVGEGVTSVKPGDHVIPLYTAECGECLFCKSGKTNLCVAVRATQGKGVMPDGTTRFSYNGQPVYHYMGCSTFSEYTVVAEVSLAKVHPDANPEQVCLLGCGVTTGLGAVKNTAKVQPGDSVAVFGLGGIGLAVIQGARLAGAGRIIAIDTNPSKFDLARTFGATDCVNPKDFDKPIQQVIVEMTGWGVDHSFECIGNVNVMRAALECAHRGWGQSVIIGVAGAGQEISTRPFQLVTGRKWLGTAFGGVKGRSELPGMVEDAMAGKIELAPFVTHTMGLTDINQAFDLMHEGKSIRSVVNYAA

SEQ ID NO: 4663 - protein, 450 aa, Oryza sativa
MEAAAKLKRSISRQLSSGAARVWRQLSLEPVYTPRRAGAVGGGGGGGGGGGGGGGGARPTRFGLARQSSLDPTPREGGGAAEDGSGAAAMLAVPENLDATMRLLFAACQGDVAGVEELLRDGVDVDSIDLDGRTAMHIAACEGQGEVVRLLLSWKANMNARDRWGSTPAADAKHYGHFEVYNLLRARGAKTPGHYVARWYGSKVFVKILDKDSFSDANSINEFKHELTLLEKARHPNLVQFVGAVTQNVPMMIVSEYHQKGDLASYLETKGRLQPYKAIRFSLDIARGLNYLHECKPEPIIHGNLSTKSIVRDDEGKLKVAGFGSRSLIKVSEDNPQMDQTTSKFNSVYTAPEMYRNGTFDRSVDVFAFGLILYEMIEGTHAFHPKPPEEAAKMICLEGMRPPFKNKPKYYPDDLRELIQECWDPTPSVRPTFEEIIEGKQIMKYMRNIP

SEQ ID NO: 4664 - protein, 1104 aa, Coprinopsis cinerea okayama7#130
MAIHDTKARPAHPRRTIPKFGPYLLLQTLGEGEFGKVKLGLHCQWGEEVAVKLIRRGNVDSSVRMSKVEREIEVLRTLKHPNIVRLYDVIETDKYIGIILEYASGGELFDHILAHRHLRERDAAKLFSQLISGVWYIHQKKIVHRDLKLENLLLDRHRNVIITDFGFANRFEHRSDDLMQTSCGSPCYAAPELVISEGLYVGSAVDIWSCGVILYAMLAGYLPFDDDPANPDGDNINLLYRYIVNTPLSFPDFVSAEARDLLSLMLVPDPTRRANLDTVMRHPWLSAYHGTPRTDGVPNAFGKSVADLEKAAMEQHQQKRIAYQKQMKANAVLNNTSAPSPRSHSHRPEPTSAAPTSGRSRSVQPEFIYDSSVDQSISAPVPSANANATPKHNGTTPKAFDSPAALGLADDDPFAPPPGTKVNSGVATATSPSKQRPSEDSARTPAAGLSPTDNKTPSKGHRSSTSGGGRDIRHTIQVEYDEPKSAKRSDDKRRDRSGSQGQPSQASAQPNGVLPNVQNGQPATRERRPSHGGATKPLPPQPVAPSAYKPPPTPATPKGSSHQQPSATPVKAASGGDVPTVNVSSPPQTPSFHQLSHPKDKDKDASSQNSASSKRGHKKGKSSIDKIGLGKIFGSGNSAPAPPVPPLNGSEHNLQSPSAPSSRVPSESQGSASSLQAPQEPAPPKDGKKSRRNTLTVMVEPFIGTIRNRKGRPPTTPATAEPVPTAQTSVNATHPPVPSSATVPALPTAPHDADLTHPDIPVEDGPGLSASSNKAKKVMQWFRTKSKGRESVGIGLGGEAEHHDSLSTPITEQKYKKGFSASSSTVNQTSTPASAMSPQVVVTQAQQATTPKTPKVSAPGHPQRAASSATETPSFVARFRNSVTVGGGSHSHSSKHSNQPGGQLRIHQGAVDQTTITTRPPPEVMAKVKAVLEGMGVEIQLESEYKYRCIRHKKKKGATSAAGTAPNGAPANLAAVQVTGSAASNGVDRRGLPLPSPSAFSATGGMLRGLLMRRQSSQVSSSSQPSLAFDDETSVVVSEPLLMSDITYGDPSQDAGDEVRFSVELTRIDRLNDTYSLDIRRLKGNLRSYKYLYDTIRQRADLQR

SEQ ID NO: 4665 - protein, 141 aa, Salmonella enterica
KPMFGDNGSGMHCHMSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGIKNKIHPGEAMDKNLYD

SEQ ID NO: 4666 - protein, 257 aa, Brassica napus
MGMDLRVVPAEEWWERGRDSSLDGECDLGLMVTDFIETGAAAAAGGGGGGDSWCSSDSDSGFPDPSYLSDKIQFLKYSMPQHETEVLSAVRTLMLSIKEKDLHSVKSGTCNASCIRFYLAKLLRLSGYNAAVCSARWQGTGKVPGGDNEYIDIIMSDSPVGQDDRLIIDIDFRSHFEIARAVDSYQRIMESLPVVYVGTVARLNQFLQVMVDAAKYSLKQNSMPLPPWRSLNYLQSKWLSPYKRHLGTINQEGPGMF

SEQ ID NO: 4667 - protein, 373 aa, Glycine max
APPPNDSLVCSGSQDRTACVWRLPDLVSVVVFKGHKRGIWSVEFSPVDQCVVTASGDKTIRIWAISDGSCLKTFEGHTSSVLRALFVTRGTQIVSCGADGLVKLWTVKTNECVATYDHHEDKVWALAVGRKTEKLATGGGDAVVNLWFDSTAADKEEAFRKEEEGVVKGQELENAVSDADYTKAIQIAFELRRPHRLFELFAELCRKREAEDHMDRALKGLDSEELRILFNYVREWNTKPKLCYVSQFVLFRVFCIFPPTDIVQIKGIGEYLEGLIPYSQRHFGRIDRLVRSTFLLDYILSGMSVIEPQAQLTESKTELLLQSEIGIPDPDKENDTNEITASKKRKSNKSKHGSHKKVKNVAYNKVESIQLQA

SEQ ID NO: 4668 - protein, 134 aa, Salmonella enterica
NGSGMHCHMSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGIKNKIHPGEAMDKNLY

SEQ ID NO: 4669 - protein, 324 aa, Neisseria gonorrhoeae FA 1090
MDTLTRFLPEHLQQNQLPEALGGVLLSVVSACTEINAKVRLGALAGVLGMAGTGNIQGEDQKKLDVIANNIMIDTLKANPAVAGLASEEEDTFVSAGENGRYLVLFDPLDGSSNIDVNISVGTIFSILAKPEGALATESFLQTGRQQLAAGYVLYGPQTQLVFTFGHGVYVFTLNAENEFVLTKENPKVPESTKEFAINMSNRRHWLPPVQQYVDELLAGETGTRGKNYNMRWVASMVAEIHRILMRGGVFMYLQDKRDPSKPGKLRLMYEANPMALILEQAGASASNAYQAMLDIQPESLHQRVAVIMGSSEEVDYLNRLHSK

SEQ ID NO: 4670 - protein, 395 aa, Burkholderia xenovorans LB400
MRALCWHGKKDVRIDNVPDPMIEHPRDAIIKVSSCAICGSDLHLFDGFMPTMKSGDVLGHEFMGEVVEVGAENQKLKIGDRVVVPFTIACGECDRCRRGFFSVCERSNRNKEMADKVFGHSTAGLFGYSHLTGGYPGGQAEYVRVPFADFTPVRIPDGLTDEQVLFLGDIFPTGWQAAAQCEIEPTDTVSIWGAGPVGQFAIRSAILLGARQVISIDRVPERLAMARAAGAITINFDTESVLDRLNELTQGKGPEKCIDAVGMESHATRSFDALYDRAKQALMLETDRPHVLREMIYVCRPAGILSIPGVYGGLIDKIPFGAAMNKGLTFRMGQTHVNRWTDDLLRRIQEGQIDPSFVITHTVPLEQGPEMYRVFREKEDGCVKVVLKPSPSMGQ

SEQ ID NO: 4671 - protein, 346 aa, Jatropha curcas
LGSHPSFRDIVASFFELPRLNNPNLHRTLLSLSKTANIKAFVIDFFCNSAVQVSSTLNIPTYYFYTSNANGLCHFLYSPTISENVPDSLEDLDIVIDTPGIPSLSSKVLPPVMLDRSHKVYQYFIDTASQMAKSAGLLVNTFESLESRAIKAVIEGKCTPDIPVPPIYCIGPIVSSRKTKEEHECLAWLDSQPSRSVVFLSFGSMGAFSATQLKEMAIGLEKTGVNFLWVVRNPPENGQTSDGMLLEELNLETLFPEGFLERTKERGFLVKQWAPQVAMLNHDSVGLFVTHCGWNSILESLCAGVPMLAWPLYAEQKMNSVFLVEEMKMALPVNQPEDGFVSDGCL

SEQ ID NO: 4672 - protein, 501 aa, Clarkia modesta
MASPALISETEAWKDLKAHLEDIKMTHLRELMGDTERCQSMMVEFDNIFLDYSRQQASPDTISKLYKLADAAHLKQKIDRMYNGDHINTTENRSVLHVALRAPRNSAICSDGKNVVPDVWNVLDKIKDFSDRVRNGSWIGATGKKLKDVIAVGIGGSFLGPLFVHTALQTDPESSKNARGRELRFLANVDPIDVARNISGLNPETTLVVVVSKTFTTAETMLNARTLREWISSALGPSAVAKHMVAVSTNLPLVEKFGIDPNNAFAFWDWVGGRYSVCSAVGVLPLSLQYGFAVVEKFLQGAHSIDQHFSSAPFEKNVPVLLGLLSVWNVSFLGYPARAILPYSQALEKLAPHIQQVSMESNGKGVSIDGLPLPFESGEIDFGEPGTNGQHSFYQLIHQGRVIPCDFIGVVKSQQPVYLKGEVVNNHDELMSNFFAQPDALAYGKTPEQLKKENVSEHLIPHKTFTGNRPSISILLPTLDAYRIGQLLAIYEHRVAVQGFV

SEQ ID NO: 4673 - protein, 1067 aa, Clostridium perfringens str. 13
MPLNKDIKKVLVIGSGPIIIGQAAEFDYSGTQACQALKEEGIEVVLVNSNPATIMTDKEIADKVYLEPLTVEFVEKVIEKERPDSLLAGMGGQTGLNLAVELYEKGILDKYNVKVIGTSIESIKEGEDRELFRDMMNRINQPVIQSEIITDLDAGIAFARKIGYPVIVRPAYTLGGTGGGIANNEEELIETLTSGLQLSTIGQVLLEKSVKGWKEIEYEVMRDSFGNCITVCNMENIDPVGIHTGDSIVVAPSQTLSDKEYQMLRSASIDIINAVGIEGGCNVQFALNPHSFEYAVIEINPRVSRSSALASKATGYPIAKVAAKIALGYGLDEIKNAVTGMTYACFEPSLDYVVVKIPKWPFDKFQGADRVLGTKMMATGEIMAIGSNFEAAFLKGIRSLEIGKYSLEHKKFKDLSMYELRERVVSPDDERIFALAEMLRRGYRIDMVSKITGIDIFFLEKFRWLVEEEQKLKQSTIDDLNREWLLKLKRRGFSDKAIADMLKVSPDEIYRLRDIWHIKPSYKMVDTCGGEFEALSPYYYSTYEQYDEVVVSDNKKVVVIGSGPIRIGQGIEFDYASVHCVMALRKQGIETIVINNNPETVSTDFSISDKLYFEPLTEEDVLNIIDKEKPDGVILQFGGQTAIKLAKFLKEKNIPTLGTTSDQIDLAEDREQFDDLLERLNIARPKGKGVWSLEEGLEEARRLGFPILVRPSFVLGGQGMEITHDEEELTYYLTNAFEKDSKNPILIDKYLMGREIEVDAISDGEDVLVPGIMEHLERAGVHSGDSITMYPAQNISDKIKEDVLDYTKKLALSIGIKGMINIQFIEFEGKLYVIEVNPRASRTVPYISKVSGVPIVDIATRIMLGEKLKDLGYGTGVYKEPELVSVKVPVFSTQKLPNVEVSLGPEMRSTGEVLGVGRNVFEALYKGFVGASMYTGDKGKTILATIKKHDKKEFMELAKDLDKLGYNFIATTGTAKELREAGIDAKEVRRIGEESPNIMDLIKNKEIDLVVNTPTKANDSKRDGFHIRRAAIERNIGVMTSLDTLKALVELQKEGAHNRELEVFNLI

SEQ ID NO: 4674 - protein, 303 aa, Oryza sativa (japonica cultivar-group)
MAPEVFEGVPVACDYLKGMDSDGMAASAVAAYSLDNNGQHASVSSIEHGIASSPLLAYQLGKNSAVVQRSIQQQEVGSPMAAFLQQLIPTSVLDQSGIGFGGVCLDGSALEASFCMRTSPDVSSFSGHRSATAEELMSTDTREQEITRLARSCSSSGSDRNKKKLSEVRGGGKAKKFKSETSHSTSSPKHQSPKVKLGEKITALQQIVSPFGKTDTASVLLETITYIKFLHEQIQLFSQPYMTNSTNKGHIHWGGEGKRKAGLEHDLRGRGLCLVPVSWTSQEYCDSILPECWAPAYRNYFYR

SEQ ID NO: 4675 - protein, 569 aa, Clarkia modesta
MATPSLISETEAWKDLKAHLEGIKRTHLRELMGDTERCQSMMVEFDNIFLDYSRQQASPDTINKLYKLADAAHLKQKIDRMYNGDNINSTENRSVLHVALRAPRNSAICSDGKNVVPDVWNVLDKIKDFAERVRNGSWVGATGKELKNVIAIGIGGSFLGPLFVHTALQTDPEASKNARGRELRFLANVDPIDAARNISGLNPETTLVVVVSKTFTTAETMLNARTLREWISSALGVSAVAKHMVAVSTNLPLVEKFGIDPNNAFAFWDWVGGRYSVCSAVGVLPLSLQYGFAVVEKFLQGANSIDQYFSSAPFEKNIPVLLGLLSVWNVSFLGYPARAILPYSQALEKLAPHIQQVSMESNGKGVSIDGLPLPFESGEIDFGEPGTNGQHSFYQLIHQGRVIPCDFIGVVKSQQPVYLKGEVVNNHDELMSNFFAQPDALAYGKTPEQLKKENVSEHLIPHKTFTGNRPSLSILLPTLDAYRIGQLLAIYEHRVAVQGFVWGINSFDQWGVELGKSLATQVRKQLHASRVKGEPVEEGFNFSTKTLLTRYLEATSDVPADPSTLLPKI

SEQ ID NO: 4676 - protein, 387 aa, Pseudomonas putida KT2440
MTVLKMTDLDLQGKRVLIREDLNVPVKDGVVASDARILAALPTIKLALEKGAAVMVCSHLGRPTEGEFSAENSLKPVADYLSKALGRDVPLVADYLDGVAVQAGELVLFENVRFNKGEKKNADELAQKYAALCDVFVMDAFGTAHRAEGSTHGVAKFAKVAAAGPLLAAELDALGKALKAPAKPMAAIVAGSKVSTKLDVLNSLSSVCDQLIVGGGIANTFLAAAGHPVGKSLYEPDLVDTAKAIAAKVSVPLPVDVVVAKEFAESAEATVKAIADVAADDMILDIGPQTAANFAELLKSSKTILWNGPVGVFEFDQFGNGTKVLAKAIADSAAFSIAGGGDTLAAIDKYGVSKEISYISTGGGAFLEFVEGKVLPAVAILEERAKA

SEQ ID NO: 4677 - protein, 494 aa, Geobacillus stearothermophilus
SSIAAPKLKEKVEKFLSGKKKMYINGSFVESASGKTFDTPNPATGERLATVYEGDAEDIDRAVKAAREAFDRGPWSRMSAAERSRLMYKLADLMEENKEELAQLETLDNGKPIRETINADVPLAIEHMRYYAGWSTKIVGQTIPVNGPYFNYTRHEPVGVVGQIIPWNFPLLMAMWKLGAALATGCTVVLKPAEQTPLSALYLAELIEEAGFPAGVVNIVPGFGETAGDALVKHPQVDKIAFTGSTEVGKLIMANASKSLKRVTLELGGKSPNIILPDADFSKAIPGALNGVMFNQGQVCCAGSRVFIQKKQYDNVVADMVSHAKSIKQGFGLKADTEMGPLVSSEQQNRVLGYIEKGLEEGAELLTGGQKPSEQGYFVEPTIFANVEDSMTISKEEIFGPVIAALPYEDIDELIERANDTNYGLAAGVWTRDVTKAHYIANKLRAGTVWVNCYNVFDAASPFGGYKESGIGREMGSYALDNYTEVKSVWIAQN

SEQ ID NO: 4678 - protein, 665 aa, Pseudomonas putida KT2440
MPSRRERANAIRALSMDAVQKANSGHPGAPMGMADIAEVLWRDYLKHNPSNPSFADRDRFVLSNGHGSMLIYSLLHLTGYDVTIDDIKGFRQLHSRTPGHPEYGYTPGVETTTGPLGQGIANAVGFALAEKVLAAQFNRDGHNIVDHNTYVFLGDGCMMEGISHEVASLAGTLGLNKLIAFYDDNGISIDGEVHGWFTDNTPARFEAYNWQVIRNVDGHDAEEIKMAIETARKSDRPTLICCKTTIGFGSPNKQGKEDCHGAPLGNDEIALTRQALNWNHGPFEIPADIYAEWDAKAAGAKVEAEWNQRFDAYAKAYPELAAEFKRRASGELPADFSEKAQAYINEVAAKGETIASRKASQNALNAFGPLLPEFLGGSADLAGSNLTLWKGCKGVEANDASGNYVFYGVREFGMTAIMNGVALHGGLVPYGATFLMFMEYARNAVRMSALMKQRVIHVYTHDSIGLGEDGPTHQPIEQLTSLRSTPNLDTWRPADAVESAVSWKNALERKDGPSALIFSRQNLQHQDRDAQQIADISRGGYVLKDCAGEPELILIATGSEVGLAVQAFDKLTEQGRKVRVVSMPCTSVFDAQDAAYKQSVLPLEVGARIAIEAAHADFWYKYVGLEGRIIGMTTYGESAPASALFEEFGFTLENILGTAEELLED

SEQ ID NO: 4679 - protein, 298 aa, Haemophilus influenzae R2846
MSAQNPLFSGSIVALVTPMNHYGEVDFSCLEKLVEHHIEAGSNALVSVGTTGESATLSIEENVKVIEKTVEFAKGRIPIIAGAGANATSEAITMTKLLRDSGVAGCLSVVPYYNKPTQEGMYQHFKAIAECTDLPQILYNVPSRTGSDMKPETVARLAEIENIVGIKEATGDVSRIVKIKQLAGKNFIVLSGNDTTGLEAIKLGAEGVISVTNNIAAKDMADMCRYALAGDFDKAEEINARLMRLHHDLFIESNPIPVKWAAYRLGLIKSPHLRLPLTTLSEEIQPKVEDALKIAGLL

SEQ ID NO: 4680 - protein, 244 aa, Desulfitobacterium hafniense Y51
MQDWLPILWVSTIAGLATTLGSLVVLMFGRPKEQVLAMLLAGAGGVMLAVVSLDLLPTAWQIGPLSQVILGFIIGLAFMKLADQKLNASPPSLPLPRRQRLKRIGLLVAAGIALHDLPEGMAIALGQEATEDLGVLIAMAITLHNLPEGMATTAPLKMAGIKSWKILLLNFGIAFFTPLGALIGLLAIDSVQNSLSFFLALAGGAMAFLVFAELWPLSRERHPRYALLGGVLGYLFFAGISFLH

SEQ ID NO: 4681 - protein, 123 aa, Brucella suis 1330
MSRKQVFGASHVPLSPAVRAGDMVYVSGQVPVGPNGQIVEGGIEAQTRQVLENIKAALALAGAAMEDVVKTTVWLEDARDFGRMNAVYGTYFPKEPPARTTVESRLMIDIKIEIEAVAYAPQK

SEQ ID NO: 4682 - protein, 361 aa, Chromobacterium violaceum ATCC 12472
MGTCENYVGTVGVPVGLAGPLAIHGSRAQGEFVVPMATTEGALVASFSRGMSIITESGGCHVLSPGNVLPGETGQPYRVLGDALTKISAVVLRDAAEAGRFDGWLREHLPQIVAAANATSRFARLLEVSPLFHGDLVGLAFTYSTDQAMGLNMATKANEAACRYILAHSGGLAIDYFNTLGGDKRFVPDQAKGRYVSASVRIPAQLLQQRLRTTAHRMRRFLGACNILLAQRGATAPNIHIANALTAMFIACGQDPAFVTVSFKNASTMFEPQSNGDLLASVTLPNLLLGTVGGGVKLPGQQECLRMLGCEDDVIKLAEIIAAVALAGEVSVAGAVTAGEFTHAHTVLGRGLHGDNAERKA

SEQ ID NO: 4683 - protein, 200 aa, Brassica napus
GLDGREMECWKGQRTQKVSDIAMTDDGKWVVSVCKGSVISLFDREATVERLIEEEDMITSFSLSNDNKYLLVNLLNQEIRLWNIEGEPKIVMRYKGHKRSRFLIRSCFGGYKQAFIASGSEDSQVYIWHRSTGKLIIELPGHAGAVNCVSWSPTNLQMMASASDDGTIRIWGLNRINPHKQEKQVQGSSSNGVLHQCNGN

SEQ ID NO: 4684 - protein, 166 aa, Coreopsis petrophiloides
MFPMVTEFMNYGQQTVRAARYIGQGFMITLSHANRLPVTIQYPYEKLITSERFRGRIHFEFDKCIACEVCVRVCPIDLPVVDWQLETDIRKKRLVNYSIDFGICIFCGNCVEYCPTNCLSMTEEYELSTYDRHELNYNQIALGRLPMSIIDDYTIRTILNLPERKT

SEQ ID NO: 4685 - protein, 206 aa, Mycobacterium sp. KMS
MPNSSPVTAWKALKEGNERFVAGRPEHPSQSIDYRASLAEGQRPTTVVFGCGDSRVAAEIIFDQGLGDMFVVRTAGHVIDSAVLGSIEFAVTVLEVPLIVVLGHDSCGAVKATLAALDEGVVPGGYVRDIVERVTPSILLGRRDGLSRVDEFEERHVNETAVQLRDRSSAIASRIEAGKVAIAGVTYHLADGRAQLRAHLGDIGEA

SEQ ID NO: 4686 - protein, 668 aa, Geobacter sulfurreducens PCA
MAAVSLTNEDARLGADTLRMLAVDAVEAAASGHPGLPMGAADYAFLLWHSHLRFDPADPEWPGRDRFILSAGHGSMLLYGLLHLFGFDLPLDELKRFRQWGSRTPGHPEYGHTPGVEVTTGPLGQGFAMGVGMALAARMGSARFADERFDPCAHHIYALVSDGDLMEGVSQEAASLAGHLKLGNLVYLYDDNRITIEGSTDLAFSEDTAGRFAALGWHVQAVDGHDVRQVDEALWRARVERERPSLIIARTHIAQGSPGKHDSAAAHGSPLGAEEAAATRRSLGWPDELFHVPERIRELCEQRREALAEARAAWQDELRRWRRRNSDKGRLWDLMAEKGVPRDLESRLLAAVGAEAGATRSLAGKVLQAAAAVVPSLVGGSADLEPSTNTRIKDSSSVLPGSYGGRNLHFGVREHAMAAIMNGMARHGGFIPYGATFLVFADYCRPAIRLAALMKQQAVYVFTHDSLFVGEDGPTHQPVEQLSSLRLIPNLRVIRPADGPETALAWAAALRRTDGPTALVLTRQKVPAIAREETLDPRTFAKGGYVVRSGGAAPAVVLMASGSEVGLALAAAEIMAGNGVAARVVSIPCMEAFLAQPESYRRRCLPGRVPRVAVEAGHGGLWWRLLGPAGLFIGLETFGASAPEKVLAEQYGFTPELVARRVAEFVER

SEQ ID NO: 4687 - protein, 166 aa, Chamaechaenactis scaposa
MFPMVTEFMNYGQQTVRAARYIGQGFMITLSHANRLPVTIQYPYEKLIISERFRGRIHFEFDKCIACEVCVRVCPIDLPVVDWKLETDIRKKRLLNYSIDFGICIFCGNCVEYCPTNCLSMTEEYELSTYDRHELNYNQIALGRLPMSIIDDYTIRTILNLPEIKT

SEQ ID NO: 4688 - protein, 226 aa, Thiobacillus denitrificans ATCC 25259
MKPEHARLDGIRAVLFDLDGTLVDTAPDLGNALNLQRARHGLAPLAADVIRPQASHGARGLLALGFDLKPDDPRFAAMREEFLQLYADNICQASRPFPGVPELLDALEARGYKWGVVTNKPARFTEPLMSVLDLAERAACIVSGDSCPQPKPHPAPMLVAARRCDALPAQCLYLGDAERDVQAATAAGMPALVAAWGYLGAEDAPHAWGAHAQIHHPLDTLDYLPA

SEQ ID NO: 4689 - protein, 577 aa, Streptococcus pneumoniae TIGR4
MTEMLKGIAASDGVAVAKAYLLVQPDLSFETITVEDTNAEEARLDAALQASQDELSVIREKAVGTLGEEAAQVFDAHLMVLADPEMISQIKETIRAKKVNAEAGLKEVTDMFITIFEGMEDNPYMQERAADIRDVTKRVLANLLGKKLPNPASINEEVIVIAHDLTPSDTAQLDKNFVKAFVTNIGGRTSHSAIMARTLEIAAVLGTNNITEIVKDGDILAVNGITGEVIINPTDEQAAEFKAAGEAYAKQKAEWALLKDAQTVTADGKHFELAANIGTPKDVEGVNNNGAEAVGLYRTEFLYMDSQDFPTEDEQYEAYKAVLEGMNGKPVVVRTMDIGGDKELPYFDMPHEMNPFLGFRALRISISETGDAMFRTQIRALLRASVHGQLRIMFPMVALLKEFRAAKAVFDEEKANLLAEGVAVADNIQVGIMIEIPAAAMLADQFAKEVDFFSIGTNDLIQYTMAADRMNEQVSYLYQPYNPSILRLINNVIKAAHAEGKWAGMCGEMAGDQQAVPLLVGMGLDEFSMSATSVLRTRSLMKKLDTAKMEEYANRALTECSTMEEVLELQKEYVNFD

SEQ ID NO: 4690 - protein, 142 aa, Salmonella enterica
PKPMFGDNGSGMHCHMSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGIKNKIHPGEAMDKNLYD

SEQ ID NO: 4691 - protein, 166 aa, Chaetymenia peduncularis
MFPMVTEFMNYGQQTVRAARYIGQGFMITLSHANRLPVTIQYPYEKLITSERFRGRIHFEFDKCIACEVCVRVCPIDLPVVDWKLETDIRKKRLLNYSIDFGICIFCGNCVEYCPTNCLSMTEEYELSTYDRHELNYNQIALGRLPMSILDDYTIRTILNLPERKT

SEQ ID NO: 4692 - protein, 219 aa, Streptomyces sp. SMA64
RELVRGCSRFARLIGVRHEINANLLFIRFEFPTGDASGHNMATLASDVLLKHLLETVPGISYGSISGNYCTDKKATAVNGILGRGKNVVTELLVPRAVVADVLHTTAARIVELNIRKNLLGTLLAGGIRSANAHYANMLLGFYLATGQDAANIIEGSQGVTMAEDRDGDLYFACTLPNLIVGTVGNGKGLGFVETNLTRLGCREDREPGENARRLAVIA

SEQ ID NO: 4693 - protein, 166 aa, Chaenactis santolinoides
MFPMVTEFMNYGQQTVRATRYIGQGFMITLSHANRLPVTVQYPYEKLITSERFRGRIHFEFDKCIACEVCVRVCPIDLPVVDWKLETDIRKKRLLNYSIDFGICIFCGNCVEYCPTNCLSMTEEYELSTYDRHELNYNQIALGRLPMSIIDDYTIRTILNLPEIKT

SEQ ID NO: 4694 - protein, 258 aa, Streptomyces sp. SMA5
GIVATLVDERMTRSVLVEAVDARTALMAARTIETRTEELRELVRGCSRFARLIGVRHEINANLLFIRFEFATGDASGHNMATLASDVLLKHLLETVPGISYGSISGNYCTDKKATAVNGILGRGKNVVTELLVPRAVVADVLHTTAVGIVELNIRKNLLGTLLAGGIRSANAHYANMLLGFYLATGQDAANIIEGSQGVTMAEDRDGDLYFACTLPNLIVGTVGNGKGLGFVETNLTRLGCREDREPGENARRLAVIA

SEQ ID NO: 4695 - protein, 166 aa, Calea megacephala
MFPMVTEFMNYGQQTVRAARYIGQGFIITLSHANRLPVTIQYPYEKLITSERFRGRIHFEFDKCIACEVCVRVCPIDLPVVDWKLETDIRKKRLLNYSIDFGICIFCGNCVEYCPTNCLSMTEEYELSTYDRHELNYNQIALGRLPMSIIDDYTIRTIFNLPEIKT

SEQ ID NO: 4696 - protein, 131 aa, Salmonella enterica
GDNGSGMHCHMSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGIKNKIHPGEAM

SEQ ID NO: 4697 - protein, 239 aa, Streptomyces griseus
TDAQTAYTAARTIEARIEELRDVVRTCSRFAELLQVRHEIAGNLLFVRFEFSTGDASGHNMATLASDTLLTHLLRTVPGIAYGSISGNYCTDKKATAINGILGRGKNVVTELLVPRAVVERVLHTTAARIVELNIRKNLLGTLLAGGIRSANAHYANMLLGIYLATGQDAANIVEGSQGVTLAEDRDGDFYFSCNLPNLIVGTVGNGKGLEFVETNLTRLGCREDRAPGENARRLAVIA

SEQ ID NO: 4698 - protein, 158 aa, Nocardia sp. SMA88
YGSISGIYCPDKKATAVNGILGRGKNVISELIVPHEVVEQRLHSPAAQVVQLNIRKNLVGTLLAGGIRSANAHYANMLLAFYLATGQDPANIVEGSQGITHAEDRAGDLYFSCTLPNLIVGTVGNGKHASFVDENLEAPRLPRRPAARRERQPASRHR

SEQ ID NO: 4699 - protein, 113 aa, Oryza sativa (indica cultivar-group)
MSQLKSSSLAALLIFLLAVFTTAAAAAGTECQNDVEVLKTTCYKFVEKDGPKLQPSPDCCASIKGVNVPCVCTYLGNPGVRDNISMDKVFYVTKQCGIAIPGNCGDKERIGQT

SEQ ID NO: 4700 - protein, 258 aa, Streptomyces sp. SMA185
GIVATLVDERMTRSVLLEASDAETAYAAALDIHTRTDELRALTRQSSRFAELLAIRHEITGPLLFVRFEFATGDASGHNMVTLAADHLLGHLLTRIPGVTYGSISANYCTDKKATAINGILGRGKNTTAEILIPQTLLAQYLHTTAEKVTRLNVHKNLVGTLLAGGIRSANAHYANMLLAFYLATGQDAANIVEGSQGITYAANREGDLYFSCTLPNLIVGTVGNGKAHTSAGQALTRLGCRDDRPTGENARRLAVIA

SEQ ID NO: 4701 - protein, 602 aa, Coccidioides immitis RS
MDAKPQRPKALRVRGDENAPIANLNGKTLHQRNKSTPALSTLAGADGAKEPLKRAALGNVSNTANILRLAKDDSFTASAKEKLRPTEKLASIARPNQRASQASTTKILNKSTTADAGTATIKTTALDKLPVNARKPPARRNTVVQESVLPALLEPAPSSTQAKHTTSEEALSSNAHCTSHDYNDASSIHAKEPKENSSVLNGTDGLQKLGGIYIEDNGEIKVYKPHNPAIRISGLSTEVKSGPGPAPDIQTSQERPIAGLVAKISEEEAMVPYAHHSTEFDPEETWDEDNGTYVDDGCVTARSQLYSTDNTTVNATTVLFPEISVNIKQELALAKQVVESTRDVQDYEEECSDPTMVAEYGDEIFDYMRKLEIKLMPNPHYMDTQAEIQWSMRSVLMDWILVGATAIFIAAKYEEINCPSVQEIVYMVDNGYTAEEILKAERFMLSLLQFELGWPGPMNFLRRISKADDYDLETRTLAKYFLEITIMDERFVGSPPSFVAAAAHCLARMMLRKGDWGAAHVHYSKYTYSQLYPVMKLMFECCDAPQRHHPAIYEKYSDRRFKRAASFAEHESLSGFQVPQPPQFPSNRLVSVHNHVQAPRRF

SEQ ID NO: 4702 - protein, 623 aa, Zea mays
MPTPPLRGAGLLLRICLFLCLSLRPRLASSEPDADGPGPGWTGVTCSADGARVVALHLPGLGLSGAVPPGTLGRLTALQLLSLRSNDLSGPLPADLLRLPALEGLHLHRNAFSGALPAALAGLTALQVLDLSFNAFDGAVPGALANLTRLVALDLSNNSLSGRVPDLGLPALQFLNLSNNRLDGPVPPSLLRFADAAFAGNDLTRPPAAAPPAAAAPAARTRRVRLSEAAILAVAVGGCVLAFAVAAVLLLAFCNREGRDDDDDDTGGAGGKGGEKKGRESPESKAVIGKAGEGNRMVFFEGPALAFDLEDLLRASAEVLGKGAFGTAYRAVLEERHTAVVKRLSREVSAGRRDFEQQMELVGRIRHRNVVELRSYYYSKDEKLLVYDCYTSGSVSNMLHGKRGEERTPLDWETRWKIALGAARGVAHVHAENNGRFVHGNIKASNVFVNRDGYGCISDLGLAQLANPIAARSRSLGYCAPEVADTRKASQASDVYSLGVLVLELLTGRSPVQVSGGRGSEVVHLVRWVQSVVREEWTAEVFDGALLRVPDIEEEMVEMLQIAMACVSRTPDRRPKVADVVRTVEEVRRSGTGTRPPSPPATAADADQSEMESSSSAAAAAAQ

SEQ ID NO: 4703 - protein, 292 aa, Clostridium perfringens str. 13
MSNEKLFPTTFPVQNQSIHPGVEDEMNPLPIYDLPQYINDGKRLKNKVAIITGGDSGIGRAVSLAYAREGAKVCIIYLSDEEDKDANKTKELIESAGSEALVIKGDISDIDFCNSSVKKVIEKWGKLDILVNNAAVQHDSKTLDDIGPEQIENTFKINVFGTFYMTKAAVKYMECGSSIINTTSITAYRGNEILFDYSCTKGALTTMTRTLATMLVKNGIRVNAVAPGPIWTPLIPSSMNKKKVSEFGVNSPMGRAGQPVELAGAYVFLACNEASYISGITIHVNGGEIING

SEQ ID NO: 4704 - protein, 280 aa, Triticum aestivum
  misc_feature (219)..(219): Xaa can be any naturally occurring amino acid
  misc_feature (234)..(234): Xaa can be any naturally occurring amino acid
  misc_feature (250)..(250): Xaa can be any naturally occurring amino acid
  misc_feature (258)..(258): Xaa can be any naturally occurring amino acid
  misc_feature (274)..(274): Xaa can be any naturally occurring amino acid
MAGRFDLQGRHGKSRVRVSRVWRRPAEAGGHLFVEWSVAVSVVSDCLPSYTSDDNSAIVATDSIKNTVYVKAKECTEVVSMEEFAVILGRHFTSLYSQVSEATVTIVERPWERVAVDGKPHSHGFKLGSEKHTTEVTVKKSGSLLINSGIQGYSLLKTTQSGFEGFVRDRYTLLPETRERIVATEVTAWVGRYPFEHISQLPSKPFCFTQRYQGDVKKXLADTFFGPPELGVYXPSVQNTLYLMAKEFLXVPNIASSXLRMQTSIFPGNLQGKXPRWGSC

SEQ ID NO: 4705 - protein, 319 aa, Candida glabrata CBS 138
MCILFATREHPDYELIMISNRDEFLERKTHSTCWHNDDFILSPYDLARIGAGQSNDTFGTWTGVNRKGRVATVLNLRICDELDMKRMIGERSRGALPFVFLNDRQGNFEDWDTYAKFCKCYPDIKRTGDFNLFYGDFKEGRYALIDSLGNTHPLFSKPGKGYLVISNNIHDKLHLQSQDINSGPEEWGKIKKGKQIMEEFVKTNTNLGKEDVIENCFKLASTNLILDKITEEFDLVKSLGVTKETIYVQPLLTPPHEEIGSPLTAGQYYGTRSQIVLLVDKSKTKATFIERIIYSSDQDISLYSTSNPKEELRYEYDIE

SEQ ID NO: 4706 - protein, 464 aa, Listeria monocytogenes EGD-e
MLYSKENKESYLEPVFGSSAEDRDIPKYTLGKEPLEPRIAYRLVKDELLDEGSARQNLATFCQTYMEDEATKLMSETLEKNAIDKSEYPRTAELENRCVNIIADLWHAPKDQKFMGTSTIGSSEACMLGGMAMKFAWRKRAEKLGLDIYAKKPNLVISSGYQVCWEKFCVYWDIDMRVVPMDKEHMQLNTDQVLDYVDEYTIGVVGILGITYTGRYDDIYALNEKLEEYNSKTDYKVYIHVDAASGGFFTPFVEPDIIWDFRLKNVISINTSGHKYGLVYPGIGWVLWKDESYLPEELIFKVSYLGGEMPTMQINFSRSASHIIGQYYNFLRYGFEGYRTIHQKTSDVAQYLAHAVEQTGYFDIFNDGSHLPIVCYKLKDDANVNWTLYDLADRLQMRGWQVPAYPLPKSLENIIIQRYVCRADLGFNMAEEFIQDFQASIQELNNAHILFHDTQQSGVHGFTH

SEQ ID NO: 4707 - protein, 626 aa, Pseudomonas putida KT2440
MSFASLGLSEALVRAIEAAGYTQPTPVQQRAIPAVLQGRDLMVAAQTGTGKTGGFALPILERLFPAGHPDKSQRHGPRQPRVLVLTPTRELAAQVHDSFKVYARDLPLVSACIFGGVGMNPQIQAIAKGVDVLVACPGRLLDLAGQGKVDLAHVEILVLDEADRMLDMGFIHDVKKVLARLPAKRQNLLFSATFSKDITDLADKLLHNPERIEVTPPNTTVERIEQRVYRLPASHKRALLAHLITLGAWEQVLVFTRTKHGANRLAEYLEKQGLTAAAIHGNKSQNARTKALADFKANSVRVLVATDIAARGLDIDQLPHVVNFELPNVEEDYVHRIGRTGRAGRSGEAISLVAPDEEKLLKSIERVTKQRIADGDLMGFDASQVEAEKPEARERPQNNGRGGRNQQARGEGGKDTNGGRKDKGKDKGKARQQAAAKPDDKEKSGDKQQPRKPRDKKSRPQQASNNSVPKPPADRDPEEFLDDELDNFGNRADYVSPYQGKNQGRNRRPGGAGQGQGQGNGQRSNAGGQGQARNGGQPRSGGGEKRPPRANNGGGARRDGGGGRGRPARDDAARQEPAVRNPRQPEKQPVIIRKESKLDRFPTPEQLDDLPSRPRGERPALLTRKG

SEQ ID NO: 4708 - protein, 907 aa, Dechloromonas aromatica RCB
MRTEVKSTCCYCGVGCGVLIETESGVVTGLRGDSEHPANRGRLCTKGATLNQTVNPTYRLQFPEKRLVRGQGGQRLSWELALDEAAERFATTIREYGPDSVAFYISGQLMTEDYYVFNKLAKGLIGTNNVDTNSRLCMSSAVAGYKQTLGADAPPCSYADILRAKLIFISGANPAVAHPIVFRYIEDAKVAYPDLKIIVADPRRSESAEIADLHLPIKPGSDIALFNGMLHVLINEDLVDRAYVEAHTSGFDALAEIVKNYSPDQVAALCGVPAEAIVQAARWFGASDASLSLYCQGLNQSAHGTHNNAGIIHLHLATGQIGKPGAGPFSLTGQPNAMGGREVGGLSNLLSAHRDLANPAHRAEMARFWGVPFVPATPGKSAVDLFKALKTGEVKAVWIACTNPAQSLPNQAAVREALQAAEYVVLQEAYGNTDTADYADLLLPASGWGEKHGTVTNSERCITRVLPAVKAPGEARHDWEIVVDFARRLGKKLDHAGADKLFPYADAEAIFNEHRESTRGRDLDITGLSYALLEAQGPQQWPYPEGASSGKVRLYEDGHFPTADGKARFVPVEHKPTADALSSELPISLLSGRMRDHWHGMSRTGTVPRLFNLEDEPLLAMHPCDMRHRGLESGDLAKVTNGRGEMVVRVTDRPGLVKGRAWMPMHWGNQFMNTPGANALASDATDPYSKQPELKHAAVQIVKMDLPYPLAVVRRCASQSAALELLQRARTVLGDYPYVTLGLYGRKSPLVVFRAATALPIGEQEVLDLDRLFGLDGADGAIVYIDATRKVAKKAIAQEGRLIGVRLVGETLAQAWLKQAMAEDELDASLIRFALAPTAKPPVSMAPRNIVCKCADVSDVQIRKELENGADLPKLQQNLKCGTFCGSCVPDIKRMLAEQTKKTAAAA

SEQ ID NO: 4709 - protein, 347 aa, Hordeum vulgare subsp. vulgare
MAAAAAEVGNRRVILKRYVTGFPTEDDMEVVPATARLAVPPGSAAVVVKNLYLSCDPYMRSRMSRHDEPSYVPDFVQGEVLTTLGVSKVVESGHQDYKAGDLVWGMTGCEEYTLITNLQTHFKINHPELPLSYYTGVLGMPGLTAYVGFFDVAKPKKGDYVFVSAASGAVGQLVGQLAKISGCYVVGSAGSDEKVNLLKTKFGFDDAFNYKKEQDLNATLKRCFPEGIDIYFENVGGAMLDAVLLNMRLHGRVSVCGMISQYNLEQLDGVRNLFHIVAKRIRMEGFIVMDHYGTYRKFEEEMAGYLKEGKITYVEDVAEGIESFPSALIGLFYVRNVGKQLVAVARE

SEQ ID NO: 4710 - protein, 814 aa, Dechloromonas aromatica RCB
MSKPRLVLIGNGMAGVRTVEELLKIKPDHYDITIFGAEPHPNYNRILLSPVLAGEMTISEIVLNELEWYKENNIKLHTGKQIKTIDRVKRKVIAEDGTEEEYDRLLIATGSTPFMLPIPGNDLPGVIGYRDIKDTDEMIEAAKLHKHAVVIGGGLLGLEAANGLKLRGMDVTVVHLGPWLLERQLDEVAGKMLQKSLEDKGLKFLLQKQTEMLVQGESGRVAAVRFKDGMTIPADLVVMAAGIRPNYALAESSGIYCNRGIVVNDTMQTYDPKVYAVGECVTHRGIAYGLVAPLFEQAKVAANHLAGYGIGRYTGSVTSTKLKVTGIDLFSAGNYMGGEGTEEIVLNDPYGGVYKKLVLKDNKLVGGVMYGDTADGPWYFQLLKDGRDIHDIRDQLIFGQSLVGDVGHAGNSKAADMPDSAEVCGCNGITKGVIVQAIKAKGLFTLDEVKKHTKAASSCGSCAGLVEQILASTIGGAYTPAASDKKPVCGCTEQSHKAVREAILNQHLITKEAVFAALEWKTPNGCDKCRPAVNYYLISTWPHEAKDDPQSRFINERSHANIQKDGTYSVVPRMWGGLTNPKELRAIADAAEKYNVPTVKVTGGQRIDLLGVKKEDLPAMWADLNAAGMVSGHAYGKSIRTVKTCVGMEHCRFGTQLAMSMGVKLEKMLFDMYAPHKVKLAVSGCPRNCAEAGIKDVGIIGVDSGYEIYIAGNGGIKTEVAQFLCKVSSDEDVMEYSGAFLQLYRLEGWYLERTCHYLERVGMDYIKGRILEDEEGRKALYAALLDSLKDAKDPWATSREPEAIKQFIPIMVEA

SEQ ID NO: 4711 - protein, 549 aa, Salmonella enterica subsp. enterica serovar Paratyphi A str.
MKNINPTQTSAWQALQKHYDEMKDVTIAELFANDSDRFAKFSATFDDLMLVDFSKNRITEETLAKLQDLAKETDLAGAIKSMFSGEKINRTEDRAVLHVALRNRSNTPIIVDGKDVMPEVNAVLEKMKTFSQAIISGQWKGYTGKAITDVVNIGIGGSDLGPFMVTEVLRPYKNHLTMHFVSNVDGTHIAEVLKKVNPETTLFLVASKTFTTQETMTNAHSARDWFLKTAGDEKHVAKHFAALSTNAKAVGEFGIDTANMFEFWDWVGGRYSLWSAIGLSIILSVGFDNFVELLSGAHAMDKHFSTTPAEKNLPILLALIGIWYNNFFGAETEAILPYDQYMHRFAAYFQQGNMESNGKYVDRNGNAVDYQTGPIIWGEPGTNGQHAFYQLIHQGTKMVPCDFIAPAITHNPLSDHHQKLLSNFFAQTEALAFGKSREVVEQEYRDQGKDPAQLEHVVPFKVFEGNRPTNSILLREITPFSLGALIALYEHKIFTQGVILNIFTFDQWGVELGKQLANRILPELGDDKAISSHDSSTNGLINRYKAWRA

SEQ ID NO: 4712 - protein, 340 aa, Mycobacterium sp. JLS
MTLRTLPVLPDRVKRALLGFRSVTVDGNTLDTTLQLLLAAQRAAGINGLVASDDVVVARRQLRLTAAMFPADIVADVTELSIPGPAGAIPARLYRPTSTDPDGPLLVFYHGGGFVIGDLDTHDDLCRVICRDGGITVLSVDYRLAPEHKAPAAADDAYAAFRWASEHAAELGVAADRIAVGGDSAGGNLAAVVCQRARNAAAPLPALQLLIYPVVDVGSETRSKTLFADGYFLTARDIAWFMDLYLEGASVDRTDPDVSPLLADDLSGLPPALVLTGGFDPLRDEGNRYAEALRAAGVPVDLREERSLIHAFANFFPLGGDSATATAAMISALRAHLSRG

SEQ ID NO: 4713 - protein, 166 aa, Aphanactis jamesoniana
MFPMVTEFMNYGQQTVRATRYIGQGFMITLSHANRLPVTIQYPYEKLITSERFRGRIHFEFDKCIACEVCVRVCPIDLPVVDWKLETDIRKKRLLNYSIDFGICIFCGNCVEYCPTNCLSMTEEYELSTYDRHELNYNQIALGRLPMSIIDDYTIRTILNLPEIKT

SEQ ID NO: 4714 - protein, 141 aa, Salmonella enterica
MPKPMFGDNGSGMHCHMSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGIKNKIHPGEAMDKNL

SEQ ID NO: 4715 - protein, 483 aa, Acidovorax sp. JS42
MPPLPLLIDGAPRPASGGATFERRNPLDGRIATTAAAATPEDAVAAVQAAARAFPAWAALGPAARRDLLQRAAQALTARADAFAATMAAETGASAAWAGFNVHLAANLLQEAAALTTQIAGEVIPSDMPGSLAMGVRQPAGVVLGMAPWNAPVILGVRAIATPLACGNTVVFKGSETCPATHRLIAEALHDAGLPAGVVNFITHAPGDAADVVEAMVAHPAVRRVNFTGSTKVGRLVAQTCARHLKPVVLELGGKAPLVVLDDADVDAAVNAAVFGAFANSGQICMSTERLVVDEAVADAFVHQLAERARALPLGDPRQGPVVLSPVVDMATVQRCNALIDDALGQGATLVCGGKSDTPLMPATLLDRVTPAMRIYHEETFAPVKAIVRVRGVEQAIATANDTTYGLSAAVFGRDVARAWNVAARIESGICHVNGPTVHDEPQMPFGGVKQSGWGRFGGMAGVREFTELRWITVQTAPRHYPF

SEQ ID NO: 4716 - protein, 166 aa, Ambrosia trifida
MFPMVTEFMNYGQQTVRAARYIGQGFMITLSHANRLPVTIQYPYEKLITSERFRGRIHFEFDKCIACEVCVRVCPIDLPVVDWKLETDIRKKRLLNYSIDFGICIFCGNCVEYCPTNCLSMTEEYELSTYDRHELNYNQIALGRVPMSIIDDYTIRTILNLPEIKT

SEQ ID NO: 4717 - protein, 176 aa, Geobacter sulfurreducens PCA
MPILTDFKAIATGLFVTWKHIFRRPVTVEYPEVKRTPAPRYRARIVLTRDPDGGERCVACYLCSAACPVDCISMEAAEGEEGRRYARWFRINFSRCIFCGLCAEACPTLAIQMTPDYEICERDIMELVYEKEDLLIDGCGKDAGYNFYRHAGIGVAQPRGAGECEEEPVDVRGLMP

SEQ ID NO: 4718 - protein, 376 aa, Francisella tularensis subsp. tularensis SCHU S4
MIQAKSYIDTTPSVYGKFALMANEYKALNFTQGAPDFDTPEWLIERTNFYIQHGKNQYSPIPGAVALRNAIVQKTKRCYDTDITIDNVAITAGDQEGLFCIISAYVGQGDEVIMFDPIFDTYAGVTKFNQGKCVRLKLLPNGKIDINAIANAITNRTKLIILNSPHNPMGTVISKDEFKEIAKIVKDKDILVISDEVYEHIYAGESFISAIQIPELHHKLVVFQSLGKTYNVTGWRQGVTIAPPQVIQNMLAIKQFATFSAVHPMQLALAEGILEHPEYYENLHKLYKKQNQLLREHLKGTRFKILDWQGSPFQILDYSISNQDGDKFASNLIKEHGVGLVPISSLFETPQDGLLRLCFAKKDHDIIKGAKILANI

SEQ ID NO: 4719 - protein, 909 aa, Emericella nidulans
MPRSIPSYFTSAPPAEEHHDPENVSPGPRLNPRTAPPSPSVMRRTYSHLSESHTAYQSLEPPLEAGETTSLLGKAKEGGSGRMEPQRSYTTFSASSGPESGFRYTLLGSSLRRSRHHSRANSVHQRFSRRASMDEVPVESTAASIKDAMTSSFMDDRLWYDQFTSTDWVHDSVADGVRLRELRRRKDIRGRLLALFDGAQGWILVALIGCIVAAIAYFVDITEEYVFGLKNGICTTGWLRSRETCCADEEECPAWRSWSEMMNHHGGGSVSVDFGIYVLWSVILAAISCLLTLLTKTVVPSSVSLTTLDENLGANGSRQATEADGSPASVSGLSPYPPLPLRPDMVYYSAAGSGVAEVKVINSGFVLHGYLGFKTLVIKTLALIFSVASGLSLGKEGPYVHIATCVGNIACRLFSKYNLNDGKRREVLSASAASGVAVAFGAPIGGVLFSLEEVSYYFPPKTLFRTFFCCIAAALSLKFFNPYGTGKIVLFEVRYLGDWEIFELAIFMFLGVLGGAAGALFIKASSIWAKSFRRIPVIKRWPLFEVGLVALVTGLISFWNPYTKLPVTELLFQLASPCEHSTSDGLCPHPEGIGEVIRALTIAFVIKSFLTIVTFGIKVPAGIYVPSMVVGGLMGRIVGHVTQYLALQYPNFFLFGSSCAAGTGMESCVTPGVYAMVAAGATMCGVTRLSVTLAVILFELTGSLDHVLPFSLAVLCAKWTADAIEPHSIYDFLTEMNSYPFLDNKLQTVSDAVLGDIVRPIRRSRLIDITETPLVPARELRSKLQHLLMAGELDSGLPILRDGVLIGLIPAPDLEYALDNLEDEDRTSCLMATDTSSVVSDTDDEDTLQVDFTKYIDPAPLALDIHSPIDLVYQCFVKLGLRYLCVLHDGQYAGLVHKKAFVKFMKEQH

SEQ ID NO: 4720 - protein, 497 aa, Aspergillus niger
MSDLFATITTPNGVKYEQPLGLFIDGEFVKGAEGKTFETINPSNEKPIVAVHEATEKDVDTAVAAARKAFEGSWRQVTPSTRGRMLTKLADLFERDAEILASIEALDNGKSITMAHGDIAGAAGCLRYYGGWADKIHGQTIDTNSETLNYTRHEPIGVCGQIIPWNFPLLMWAWKIGPAIATGNTVVIKTAEQTPLSGLYAANVIKEAGIPAGVVNVISGFGRVAGSAISHHMDIDKVAFTGSTLVGRTILQAAAKSNLKKVTLELGGKSPNIVFNDADIDNAISWANFGIFYNHGQCCCAGSRILVQEGIYDKFIARLKERALQNKVGDPFAKDTFQGPQVSQLQFDRIMEYIQHGKDAGATVAVGGERHGTEGYFIQPTVFTDVTSDMKINQEEIFGPVVTVQKFKDVEDAIKIGNSTSYGLAAGIHTKDVTTAIRVSNALRAGTVWVNSYNLIQYQVPFGGFKESGIGRELGSYALENYTQIKAVHYRLGDALF

SEQ ID NO: 4721 - protein, 488 aa, Geobacillus stearothermophilus
MKVQTEIKTYFNYINGNWVSSVSNNVEPSINPANRHDIVGYVQRSTLEDVNEAVTAANEAQTSWWKRSGVERGEYLYKAAHILEQCLQDIAETMTREMGKTLAEAKAETMRGVHILRYYAGEGARKIGDVIPSSDSEGLLFTTRVPLGVVGVISPWNFPVAIPIWKMAPALVYGNTVVLKPASETAVTAAKVIECFHEAGFPKGVVNMVCGSGSVVGQGIANHPDIDGVTFTGSNTVGKQVGRAAFERGAKYQLEMGGKNPVIVAKDADLDLAVEGTISGGLRSTGQKCTATSRVFIEREVYEPFKAKLLERVKQLKIGNGLDAETWMGPCASESQFHTVLSYIEKGKSEGAKLIYGGNRCLEGELANGFFVEPTIFEDVDLQMTIAREEIFGPVLALIQVDSIEEAIKLANDTEYGLSASIYTKNIGNALEFIKDIEAGLIKVNAETAGVEFQAPFGGMKQSSSHSREQGQAAIEFFTSIKTVFVKA

SEQ ID NO: 4722 - protein, 574 aa, Candida glabrata CBS 138
MCGIFAAYKHQDVHAFKPKALQLSKRIRHRGPDWSGNVVKNSTIMVHERLAIVGLDSGAQPITSEDGDYTLCVNGEIYNHIQLREQFPDYKFKTLSDCEPIIPAYLEHDIDAPKYLDGMFAWCLYDAKQDRIVAARDPVGITTLYMGRCSSSPKTVFFASELKCLTDDCDEITAFPPGHVYDSKTDQITRYFTPDWIDESRIPTTPVNFKDIRESLEKAVRKRLMAEVPYGVLLSGGLDSSLIASIAARETEKANEENDAADNDASASKQLAGIDNQGHLHTAGWSRLHSFAIGLPNAPDLQAARKVAKFIGSIHHEHTFTLQEGLDALDDVIYHLETYDVTTIRASTPMFLLSRKIKAQGVKMVLSGEGSDEIFGGYLYFAQAPSATEFHIESVKRVKNLHLADCLRANKSTMAWGLEARVPFLDKEFLQLCMNIDPKDKMIDQSAGRIEKYILRKAFDTSDEPDVKPYLPEEILWRQKEQFSDGVGYSWIDGLKDTAERVISDTMFSNPKIEWGEDIPTTKEAYWYRLKFDALFPQKTAASTVMRWIPKADWGCAEDPSGRYAKIHEQHVTA

SEQ ID NO: 4723 - protein, 519 aa, Oryza sativa (japonica cultivar-group)
MGVTKAEAVAGDGGKVVDDIEALADLRKEPAWKRFLSHIGPGFMVCLAYLDPGNSVETDLQAGANHKYELLWVILIGLIFALIIQSLSANLGVVTGSHLAELCKTEYPVWVKTCLWLLAELAVIASDIPEVIGTGFAFNLLFHIPVWTGVLIAGSSTLLLLGLQRYGVRKLEVVVALLVFVMAGCFFVEMSIVKPPVNEVLQGLFIPRLSGPGATGDSIALLGALVMPHNLFLHSALVLSRNTPASAKGMKDVCRFFLFESGIALFVALLVNIAIISVSGTVCNATNLSPEDAVKCSDLTLDSSSFLLRNVLGKSSATVYGVALLASGQSSTITGTYAGQYVMQGFLDIKMKQWLRNLMTRSIAIVPSLIVSIIGGSSGAGRLIVIASMILSFELPFALIPLLKFSSSSNKMGENKNSIYIVGFSWVLGFVIIGINIYFLSTKLVGWILHNALPTFANVLIGIVLFPLMLLYVVAVIYLTFRKDTVKFVSRRELQAGDDTEKAQVATCVADEHSKEPPV

SEQ ID NO: 4724 - protein, 108 aa, Glycine max
MGWNLLFWLAICFPSNIALLASTFYQVLILSDLESDYINPFDAASRINYFVLPEFVGQGALCALCLFTGHWFMFLLTVPVTCYHLRLLTLTAVYYLGIEDDEDIGNLW

SEQ ID NO: 4725 - protein, 490 aa, Arabidopsis thaliana
MEIILVTLCLTTLLALLLLKSILKRTTTNNLNLPPSPWRLPVIGNLHQLSLNTHRSLRSLSLRYGPLMLLHFGRTPVLIVSSADVAHDILKTYDVICANRPKTKVIDKILRGGRDVAFAPYGEYWKQMKSICIQNLLSNKMVRSYKKIREDEIKLMIEKVENASSCSPPSPVNLSQLFMTLTNDIICRAALGRKYSSKEDGIDVENIVRAFSALVGEFPIGEYIPSLSWIDKIRGQDHKMEEVDKRFDEFLERVVKEHEDANKDTRSDLVDTLLTIQSDKSALKLIIWDMFLAGTATSLSFLEWAMTELMRNPKVMKKLQEEIRSSSRQGLFVTEKEAEKMDYLQAVIKEALRLRPPAPLMVPRVFSEDVTLKGYNIPAGTQVIINAWAIQRDTTTWGIDAEEFRPERHLDSILDFQGQDFKFIPFGSGKRICPGIGFTSALIGVTLANIVKRFNWRMDVEPQRVQHDLTEATGLVVFRKFPLIAIPSSA

SEQ ID NO: 4726 - protein, 468 aa, Pseudomonas putida KT2440
MGLNDQWMQRDLKVLWHPCTQMKDHEQLPLIPIKRGEGVWLEDFEGKRYLDAVSSWWVNVFGHANPRINQRIKDQVDQLEHVILAGFSHQPVIELSERLVAMTPAGLDRVFYADNGSSCIEVALKMSFHYWQNIGKPDKKRFVTLTNSYHGETIAAMSVGDVPLFTETYKALLLDTLKVPSPDCYLRPEGMSWEEHSRNMFQAMEQTLAEHHASISAVIVEPLIQGAGGMRMYHPVYLKLLREACDRYDVHLIHDEIAVGFGRTGTMFACEQAGIRPDFLCLSKALTGGYLPLAACLTTDKVYQAFYDDYPTLRAFLHSHSYTGNPLACAAALATLDIFEQDNVIEANKALATRMATATAHLADHAHVAEIRQTGMALAIEMVQDKAGKLAYPWQERRGLKVFEHALTRGALLRPLGSVVYFLPPYVITPEQIDFLAEVASEGIDIATRDSVSVAVPANFHPDFRDPG

SEQ ID NO: 4727 - protein, 502 aa, Pseudomonas putida GB-1
MDNKVKAYLQAFGVSEATQRFLSKPQRMFIGGAWLEASDGGTAEVIEPSTEGVLTRIPMGTADDLDRAVCAARAQFDGGAWRQLKPLERERLIHRLADLIETHGDELAQIEAIDMGKSVVQARAVDIQGTVDTLRYFAGWASKIHGRTVEPSLPGNYLAYTRKEAVGVVGAIVPWNFPLQTMAWKLGAALATGCTVVVKPAELTSLSALRFAELVQAAGIPDGVVNIVTGRGSVVGQAMSSHPGIDKLSFTGSTPVGCAVGKTAMDQMKRLTLELGGKSPVIVFADADIEAAAQAVANGVFFNSGQVCDAGTRAYVERSVYPAFLDALARYTATLKIAPGLDPDCFISPMVSQQQQRRVLDYIALGKAEGAQVHYGGELLDGPGFYVQPTIFAHCRNDMRIVSEEIFGPVLVTQPFDSQEEALQLANDSLFGLAAAIYSNDLGKVHGLIPQLRAGTVYVNAHSTLDPAMPFGGYKQSGYGKDLGAEQLEFLLETKAVWITLP

SEQ ID NO: 4728 - protein, 392 aa, Oryza sativa (indica cultivar-group)
METVAAASYTRGAATRSPACCAAMSFSQSYRPKAARPPSTFYGESLRVNTARSLPSGRQSKAASRAALSTRCEIGDSLEEFLTKATPDKNLIRLLICMGEAMRTISFKVRTASCGGTACVNSFGDEQLAVDMLADKLLFEALEYSHVCKYACSEEVPELQDMGGPVDGGFSVAFDPLDGSSIVDTNFTVGTIFGVWPGDKLTGVTGGDQVAAAMGIYGPRTTYIIALKDCPGTHEFLLLDEGKWQHVKDTTTIGEGKMFSPGNLRATFDNPEYDKLINYYVKEKYTLRYTGGMVPDVNQIIVKEKGIFTNVTSPTAKAKLRLLFEVAPLGFLIEKAGGYSSDGKQSVLDKVINNLDERTQVAYGSKNEIIRFEETLYGSSRLTAGATVGAAA

SEQ ID NO: 4729 - protein, 166 aa, Acanthospermum australe
MFPMVTEFMNYGQQTVRAARYIGQGFTITLSHANRLPVTIQYPYEKLITSERFRGRIHFEFDKCIACEVCVRVCPIDLPVVDWKLETDIRKKRLLNYSIDFGICIFCGNCVEYCPTNCLSMTEEYELSTYDRHELNYNQIALGRLPMSIIDDYTIRTILNLPETKT

SEQ ID NO: 4730 - protein, 145 aa, Acidovorax sp. JS42
MTTVAEILRTKADGQVHAVEPSDTVLTALRRMADKGIGALLVMEGDQIAGIFTERDYARKMVLLGRSSGDTPVSEVMTRAVRFVRPAQSAEQCMALMTENRLRHLPVVEGGRVVGLVSIGDLVKSVISEQQFIIEQMELYITGVR

SEQ ID NO: 4731 - protein, 137 aa, Brassica napus
RWDVPTGKESLNLFCGKALNTVDVGGEGSALVAAGGSDPILRVWDPRKPGTSAPVFQFASHASWISACKWHKSSWFHLLSASYDGKIMLWDLRTAWPLSVIDTHKDKVLCADWWKGDSVVSGGADSNLRISSGISIS

SEQ ID NO: 4732 - protein, 792 aa, Geobacter sulfurreducens PCA
MSETEVPQNNIILASLDDLINWGRANSLWPMFFGLSCCFVEMMTSFTSRYDVSRFGAEVLRGTPREADLMVIAGTVFKKMAPSILRLYEQMAEPKWVISMGSCANSGGMYDVYSVVQGVNQIIPVDVHVPGCPPRPEAFLQGLMLLQEKIRREERPARKVLHLAGGSEGTTRPVLVDGVTKSRDTRGPGMEGIAIRGTSVQHPHFPMPRSDEMWRPPAPKHQFPDFGLAGELETAFGHRVVRDDHATDMLTYRCPPELLPDVLRHLKTRSAAPFRRLEDVACVDESCRRERSRFPDFTVNYHLLNFHIPGHLRIKAELRGDTPEIPSATSVFPAADWYEREAFDMYGIQFAGHPNLRRILMPPDWEGHPLRKNHPFRATEMHPYTTDDARRHQALPASDFFDRIDEETLILNLGPQHPGTHGIIRFVLKLDGEEIVDMDTDIGYHHRGAEKIGERQHWNQFIPYTDRIDYLAGVQNNLAYVNSVERLCGITVPDRGIAIRVMLAELFRIANHLVWLGTFAADVGAMTPVFYTFTDREKIFDIVEMVTGGRMHPSWFRIGGVADDLPEGWDGAVKAFLDWMPGRLKEYEDLLKGNPIFRERLKGVGVITGDEALEWGITGPNLRACGVEWDLRKKIPYNGYQHFHFEVPTEEGGDCWARYRVRIEEIRQSLHIVRQCWKEMPAGRWITDDYRYVLPKKRDALHDIESLIHHFINATRGMAPPKGENYSAIEAPKGENGYFVVSDGLNVPYRVRIKTPSFPHIQALPLMSRGWLVADFLAIIGSIDFVLADLDR

SEQ ID NO: 4733 - protein, 143 aa, Salmonella enterica
FMPKPMFGDNGSGMHCHMSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGIKNKIHPGEAMDKNLY

SEQ ID NO: 4734 - protein, 113 aa, Brassica napus
MSSSPSLEILVRDAEGFIVWNGPPFSSNGQPTPKNERVSCSSTKFSLDGSKFMAVKSDGTISIYDSPSLGEVRSFAVANVTATEISPCGTYLQTFQKPTTPQEKNVSLWNTDT

SEQ ID NO: 4735 - protein, 393 aa, Pyrococcus abyssi GE5
MVIFRIKNYVEKDINLPWDQREGEIKMKPLHDPLYITAVFKQVGDAYPTDRGTELKYSREENPTVRKLEDKLAELEGSDNALAFNSGMSAISTLYFSLLEGGDKVVLSMEGYGTTIELAKLLRKFGVDVKLAYPSADSLIETIDEETKLVLVETMTNPTLKVIDVPEVAKRCREVGAILVVDNTFVTPLLYKPLEDGASYVVHSLTKYIAGHNDVLGGAVLWNGEFSRDLWEWRRRLGTIIQPFDAWMIERGMRTLEVRFERQSENAMAIAEFLKDHPKVREVHYPGLKDDPYYKVARRLFKKDLYGGVVAFDLGSGDNALAFLRGLKRIFPSPSLGGVESIATYPVKSAAKTLDEEIREILGITDGLIRLSVGLEPLDELIEDIDNALGVVR

SEQ ID NO: 4736 - protein, 133 aa, Glycine max
MLVFIKFYKQHSISEDGIKKCLPSVLFINLQFSFENPEKYFHCDHSQDLLRKIPMLILRSDQYYVPSMFMNPFFNLEIANMFPERDIIFHHLGRYLFHPSNDAWELISSYYQAHLASASERIGLQIRVFNAAT

SEQ ID NO: 4737 - protein, 291 aa, Streptococcus pneumoniae TIGR4
MKKQEKLALVESALEDFYGDQQFASSLRESVLYSIHAGGKRIRPFLLLEVLEALQVTIKPAHAQVATALEMIHTGSLIHDDLPAMDDDDYRRGRLTNHKKFGEAMAILAGDALFLDSYALIAQADLPSQIKVDLIANLSLASGSLGMVAGQVLDMEGEHQHLSLEELQTIHANKTGKLLAYPFQAAAIIAELSPEMQVKLKTVGELIGLAFQVRDDVLDVTASFEEIGKTPQKDLQAEKSTYPALLGLEESIAFCNQTLDQANEKLEEIAQQLPFETESIVSVVESLRING

SEQ ID NO: 4738 - protein, 296 aa, Clostridium perfringens str. 13
MNPYCDNSINFEKLPKKFPPQHQSVQPGIESIMVPSPIFDNPDYKGSGKLKGKSVLITGGDSGIGRAVSIAFAKEGANIVISYLYENDDAETTKKYVEKYGGKCYLVPGDISNKNFCEKLVRFTVETLGGIDVLINNAGVQFPQNNINCISQEQLELTFKINIFSMFYLTQEALKYMKRGSTIVNTTSVTAYQGKENLIDYSSTKGAVVTFTRSLSQSIVNKGIRVNAVAPGPIWTPLIVSSFSEEEVANFGSDVPMKRAGQPFELAPAYVYLASDDSSYVTGQVLHVNGGTIVDS

SEQ ID NO: 4739 - protein, 383 aa, Oryza sativa
  misc_feature (206)..(206): Xaa can be any naturally occurring amino acid
MAKASVVVPEQVGAAAAAQVGCPCPGTTLFPYPPPRAGIAVRRKCLQAAQQLELGAGLRGGWVESMRASSPTHAKAAAALAAGVDEEHAAWMARHPSALGEFEKVVAASKGKQIVMFLDYDGTLSPIVDDPDAAFMSETMRMAVRSVAKHFPTAIVSGRCRDKVFEFVKLAELYYAGSHGMDIKGPASRHAAAKSPPHNKGVLFQXPASEFLPMIEQVHQRLEQATSSIPGAKVENNKFCVSVHFRCVDEKSWGALAETVRRVVREFPRLRLSQGRMVFEVRPTIKWDKGKALEFLLDSLGFADCSDVLPVYIGDDRTDEDAFKVLRRRGQGVGILVSKHPKETSASFSLQEPAELKKSSVHYPLPAQRSNRLNRILVNWDEQ

SEQ ID NO: 4740 - protein, 648 aa, Oryza sativa
MDASALSNPRLQAMLEEEKRKAMANEFVAKLTDVCWDKCITGSIGSSFSNSEASCLSNCAKRFLELKMLTMQRPQEAPASFSLPLPKSPVPIKATPISAAFPTPQHEDESSDQDYKPFCRQKKPTLPKRAKRPQQAEKSNDANIKRRSIRRSLDNEFNLCSSSSDNPKESVEGILMMFDSLRRRVLQLDEKEDASRRADLKAGTLMMQNNLRINNHKMIGHVPGVEVGDIFFFRIEMCIIGLHAPAMGGIDYISSKNKDETLAVCIISSGGYENDDDDTDILVYTGQGGNSRHKEKHDQKLERGNLALMNSKIKKNQIRVVRSAQDPFCNSGKIYIYDGLYRIEDTWTDTAKNGFNVFKYKLRRDPGQPDGISLWKMTEKWKANPATREKAILLDLSSKVEHLPVCLVNDVDDEKGPSHFNYVAGVKYLRPLRKTKPLQCCKCPSVCLPGDPNCSCAQQNGGDLPYSATGLLAKHTPMVYECSSNCQCSHNCRNRITQKGIKLNFEVFWTGDRGWGLRSWDPIRAGTFICEYAGEVIDETKMDIDVEEDKYTFCASCPGDKALSWNLGAELLEEKSTAVTTKNFKKLPIIIRANNEGNVARFLNHSCSPNLLWQAVQYDHGDDSYPHIMFFAMEHIPPMTELTYDYGY

SEQ ID NO: 4741 - protein, 377 aa, Arabidopsis thaliana
MGLKMSESAKPYFAMVCLQFGYAGMNLVTKVVLDRGMSHYVLVAYRNAFATAAIAPFALLSERKVRPKMTFPIFMQIFVLALLGPLIDQNLYYACLKLTSPTFAGAVTNIVPALTFIISIICRMEKVEMRKVRFQAKVVGTLVIVVGAMLMILFKIPLITFLRSHLTGHALSPAGEDYLKATVFLLIASFSWASFFVLQAATLKRYSSHLSLSTMVCFMGTLQSTALTFVMEPNLSAWNIGFDMNLLASAYAGIMSSSIAYYVQGMMTKQKSVIFVTAFNPLVVIIGSIIGFLILNQTLNLGGVLGMAILVVGVCTVLWGKEGDIDEEENIEEKFVEIVKCCNRCDIKVLSMMPRIDEEVDVEMQSAGTAKVAVGFS

SEQ ID NO: 4742 - protein, 163 aa, Glycine max
  misc_feature (32)..(32): Xaa can be any naturally occurring amino acid
  misc_feature (43)..(43): Xaa can be any naturally occurring amino acid
  misc_feature (79)..(79): Xaa can be any naturally occurring amino acid
TSLKSLSSLSCLKLDNNPLKQIPLDGFEVVPXLQILNLSGNAXSLLNIPTFSNLPYLQKLYLKKMKLSKVPSDIVGLQXLQILNLSQNSLQSIPVKLKDLTSLKELDLSNNNISVLLPKLSLLKPNLQTLRLNKNPLKNIRKTILNRETKTILQYLKNKLPTP

SEQ ID NO: 4743 - protein, 157 aa, Listeria monocytogenes EGD-e
MSIFTNTPLIASIIAIVFAQVVKVPIHILVYRKFNLGLMFSTGGMPSSHSAAVTALMTTLAIEYGLDSPYFAISVVFGIIVMFDATGVRRQAGEQAVVLNKLVTDFQDFVEHAKGLAAPEQEEKTKHLKELLGHKPMEVFFGALTGIAIGFILEMFM

SEQ ID NO: 4744 - protein, 247 aa, Clostridium tetani E88
MDTRKNLKELIKSSSNIVFFGGAGVSTESNIPDFRSEEGLYKTKSNFSYSPEVMLSHSFFKEHTEDFFDFYKEKMIYKYAKPNLAHHALAKLEKVGKLKAIITQNIDGLHQLAGSKNVIELHGGVGRNYCMDCNKFFDLNYILNNKEVVPKCDVCGGIVKPDVVLYEEPLNMDNINNAVRYVENSDVLIVGGTSLVVYPAANLIHYYKGNKLVLINKSSTPYDRKAQIVINDSIGSILGGIVEELGY

SEQ ID NO: 4745 - protein, 403 aa, Listeria monocytogenes EGD-e
MSKPKIVILGAGYGGLKTLRKLQQRNLEAEIVLVNKNDYHHETTWLHEAAAGTIEPEKLMYPLDKVVNDTKTTFIQDTVVKINKDEKTVTLDANGDISYDYLLIALGSEAETFGISGLKEYAFTITSVESVKKIRAHIEAQFAKWKTDPRDELLTIIVGGAGFTGIEFLGELTNRIPELVKQYDVPREKVRIYCMEAAPKVLPQFDAKLVDYGVGVLEDRGVEFHVGKPVKEATADGVKYAESENEVREIKAATIIWAAGVRGNSVIEASGFEAGRGRVKVNNNLTVPGNEEILIVGDCSLIINPANDRPFPPTAQIAMQQADVAAVNLAKLVKGETDLQDFVYHEKGTVCSLGDNDAIGVVFGKNLKGYPASVMKKVIDDRALLLIGGSGVLASKGKFKFYK

SEQ ID NO: 4746 - protein, 821 aa, Acidovorax sp. JS42
MVKQSRLVMVGNGMAGVRALEELLKIAPDLYDITVFGAEPHPNYNRILLSPVLAGEQTLEEIVLNDWSWYADHHITLHAGCTVTHVDRTRRTVHGVAQDGRTVEAPYDRLILATGSNPFMLPIPGRELPGVLAYRDIADTQAMIDAAASYKHAVVIGGGLLGLEAANGLMKRGMQVTVVHAGEWLMERQLDDVAGKLLQQSLAERGMQFLMQAQTQELVAGGDGRVAAVRFKDGSEVPAQLVVMAVGIRPNTALAEQMHLHVNRGIVVSDTLQTVTDPRIYAVGECAAHRGIAYGLVAPLFEQGKVLANHLAEWGIGRYQGSLTSTKLKVTGIDLFSAGDFQGGEGTEEIVLSDPHAEGGGVYKKLVLKDDRLVGACLYGDTVDGSWYFKLLRDGRSVADIRDRLMFGESHLGDAGHQGQNKAAAMADSDEVCGCNGVTKGQICKAIKDKGLFTLDEVRKHTKASASCGSCTGLVEQILMATAGGDYSATPKTKPVCACTDHGHQAVREAIRTHRLLTVDGVFRFLEWKTPNGCATCRPAVNYYLISTWPKEARDDPQSRFINERSHANIQKDGTYSVVPRMWGGETSAAELRRIADVVDKYQIPTVKVTGGQRIDLLGVKKEDLVNVWRDIGMPCGHAYAKALRTVKTCVGSEWCRMGTQDSTQLGKDLEHAFVGMYAPHKVKFAVSGCPRNCAESGIKDVGIIGVDSGWEMYVAGNGGIKTEVAQFFTKLKTAEEVLEYTGAFMQLYRLEGWYLERTVHFVARVGLDYVKRRVLQDAPGRQALWRELQDALAGEPDPWFEFEPAAVDRRQFIPITPIPA

SEQ ID NO: 4747 - protein, 296 aa, Idiomarina loihiensis L2TR
MLKGSIVALVTPFTKYGNVDYSELEFLVNKHCEAGTDAIVAVGTTGESTTLTHEEHIAVVNAMVELSAGRIDIIAGNGSNSTSEAVQLTEKMTQAGVSGFLNVTPYYNKPSLAGLIAHYQACADATDKPQILYNVPGRTSLDMTPDMVEQLAKIDNVIGIKEATGDVSRVQELKERCGDDFILLSGDDPTAREFMFAGGHGVISVTANIVPAKMKELVTAALAGDKESANQIDAELAPLHNMLFVESNPIPVKWSLALMGWVSANYRLPLTPPEESNQQLIESVLQKANLLNIQES

SEQ ID NO: 4748 - protein, 93 aa, Zea mays
MGFIMEFAENLILRLMEDPDKRDQVRREHVYKMKERCERTKAAWNLPLRPYGFWTFERFNSQLSWDPQISQAAGRRDPYDDLITRHSGSPPSS

SEQ ID NO: 4749 - protein, 952 aa, Acidovorax sp. JS42
MQETRSTCPYCGVGCGVIIQSDGDTITGVRGDPHHPANFGRLCTKGSTLHLTASRPITLQTRLLQPQLRPQRGQAAHPIDWDAALDTAAQRFAATIDRHGPDAVGFYLSGQLLTEDYYVFNKLAKGLIGTNNIDTNSRLCMSSAVAGYKATLGADAPPACYDDLGHAQCLFIAGSNTAWAHPIVFRRIEDARAANPAMKIIVADPRRTDTAAMADLFLPLLPGSDVMLFNAMLHVMLREGWVDQGYIARHTSGFADLQAVVQDCTPERAAAVCGLPPQDIATAARWFAGVESMAEGGPRRPTLSLYCQGLNQSTSGTAKNAALIHLHLACGQIGQPGAGPFSLTGQPNAMGGREVGGLANLLPAHRDMANPDHRAEVARLWGLESVPARPGKTAVEMFQAAADGEIKALWIACTNPAQSLPDQTTVRRALQRAEFVVVQEAFATTATAQYADLLLPATTWGEKTGTVTNSERRISRVRAAVAAPGGARHDWQIALALAQRLERHLRPGQPTLFPYTGDTAQACAEAIWNEHRETTRGRDLDITGLTWAALEADGPQQWPYPSGARTGRARLYADGVFPTPDGRARFVPTAWQPLAEPPSARYPFSLTTGRLRDQWHGMSRTGTLGRLFGHASEPALQMHPQDLQRLQLAAGDLAHVTSARGSIIAPVQADDTLAPGQAFMAMHWGGEYLGGRSSTGRPLAGVNALTTPAFCPGSKQPELKHAAVKVLKAELPWTLLAMAWLPEDEALAAREALAALMPELPFAHCVPFSGAAPAAGPARTGVLLRGAAHEAPPPALLARIEHLLHLDGPGTLRYADRRRAQHRAARLQRQADGRTTLDALLLAGNGSAGGWLRTLLQEELPVQTYGRLLLLPTQQPPVAVAARGKRVCVCLNVTDTDITERLGQCQGSPAERLAQLQGALRCGTQCGSCVPELKRMVQAAVAGIGTTAVQAA

SEQ ID NO: 4750 - protein, 276 aa, Zea mays
MEAVARSGDYLWRFVAETEWYNEVVLSAVAPGDWWRGLPHPVQSWMRNCVGGYLLYFISGFLWCFVIYYWKRHAYIPKDAIPTNEAMKKQIVVASKAMPFYCALPTLSEYMIESGWTRCYFNISEIGFSMYLCYMAMYLIFVEFGIYWMHRELHDIKPLYKYLHATHHIYNKENTLSPFAGLAFHPLDGILQAIPHVFALFLFPTHFRTHIALLFLEAVWTTNIHDCIHGKIWPVMGAGYHTIHHTTYRHNYGHYTIWMDWMFGTLNEPEDILKKA

SEQ ID NO: 4751 - protein, 550 aa, Thiobacillus denitrificans ATCC 25259
MKPLKTLPAWKALEQHFKSMRNFDMRAAFREDAARFETLSLRCGNLLLDYSKNRVTQETMRHLAQLARESELEEMRNAMCTGERINFTEKRAVLHVALRAPVRPALMVEGVDVEREIAKVLHRMQRFVESVHNGSWRGHTGKPIRNVVNIGIGGSDLGPAMVCHALDHYAVENVRVHFVSNLDPSHLAGTLAQLDPETTLFIVASKTFTTLETLANANSAKAWLLAALRAPEAVARHFVALSTNAQAVEAFGIDPENMFIFWDWVGGRYSLWSAIGLSIALQIGWGNFQALLAGAHAMDVHFKEAPLEANMPVILGMLGIWYANFWGTDTYGVFPYDQRLRLLVPFLQQLDMESNGKNVNRANKLVNYNTGPIVWGAPGTNGQHAFFELVHQGTRLIPTDFLVAAVNLTPLADQHEWLLANCLAQTEALLKGKSRAVIEAELIAQGMTRDDARALAPHKVFPGNRPSNTLLYQKLDPHTLGMLIALYEHKVFVQGVIWQINSFDQWGVELGKQLAPPIRAALSSVRVIGEHDGSTQGLIADIRRRRGLST

SEQ ID NO: 4752 - protein, 213 aa, Arabidopsis thaliana
MVSGEGETGKVYKAGFHDRHGRTVLILRPGLQNTKSLENQMKHLVYLIENAILNLPEDQEQMSWLIDFTGWSMSTSVPIKSARETINILQNHYPERLAVAFLYNPPRLFEAFWKIVKYFIDAKTFVKVKFVYPKNSESVELMSTFFDEENLPTEFGGKALLQYNYEEFSKQMNQDDVKTANFWGLGHSNNNQLHASNGFSGAEIAPEPIQNHP

SEQ ID NO: 4753 - protein, 237 aa, Schizosaccharomyces pombe 972h-
MLNRSLLFRNLRLARPRPFLPLVGKRFVTEKSQSQEEKDTSKITENAKEEVKRDTSSLAKESLKLLDLNGLNDESYTGDPGKGPEYTSSTMLKREKQARYAFWGFLGLTGGGLLYYGRRYGPDEKELEKQYPAAGYSPSDWWNRVKARTNNFFSYYQEPAFEKLLPDPLPEPYNRPYTLVLSLDDLLIHSEWTRQHGWRTAKRPGLDYFLGYLSMYYEVVIFTRQYLATAKPIIDKI

SEQ ID NO: 4754 - protein, 509 aa, Ralstonia eutropha JMP134
MTAAAPEDTLLDVLIVGAGLSGIGAARQLQQRCPGKRFAILEARDAIGGTWDLFRYPGIRSDSDMYTLGYRFKPWKGAKAIADGPSILSYIRETADEAGITPRIRFGCKVVSAAWNSHDACWTVTAERVADGSRQQWRARFLYVCAGYYSYAAGHRPAFAGEESFRGRIVHPQFWDASLDYAAKRVVVIGSGATAVTMVPAMAGTAAHVTMLQRSPSYVVTRPGEDAIAAKLRRLLPEGLAYAATRWKNVLLGMFVFQLARRRPERVSERMVGMAAAQLGPDIDVGRHFTPRYKPWDQRVCLVPDGDLFREIREGRASVVTDAIERFTEDGIRLASGQTLPADIVVTATGLKLNMLGDIAISVDGQPRVPAEQMAYKGMMLSDVPNLVLAFGYTNASWTLKADLTAEYVCRLLRYMDRRGYRAAVPRRDAAVKPTPFLDFTSGYVQRAASVLPRQGDRKPWRLYQNYLMDMLTIRHGRIADGVLQFDAPHPATAPREVPVSLSGGEVQP

SEQ ID NO: 4755 - protein, 350 aa, Oryza sativa
MADESWRTPAIVQELAAAGVEEPPSRYVLGEKDRSDELVAAELPEPIPVVDLSRLAGADEAAKLRAALQNWGFFLLTNHGVETSLMDDVLNLAREFFNQPIERKRKFSNLIDGKNFQVEGYGTDRVVTQDQILDWSDRLFLRVEPKEERNLAFWPDHPESFRDVLNEYASRTKRIRDDIVQAMSKLLGLDEDYFFDRLNKAPALARFNYYPPCPRPDLVFGVRPHSDGSLFTILLVDKDVSGLQVQRDGKWSNVEATPHTLLINLGDTMEVMCNGIFRSPVHRVVTNAEKERISLAMLYSVNDEKDIEPAAGLLDENRPARYRKVSVEEFRAGIFGKFSRGERYIDSLRI

SEQ ID NO: 4756 - protein, 368 aa, Oryza sativa
  misc_feature (90)..(90): Xaa can be any naturally occurring amino acid
MGVYLSTPKTEKLSEDGENDKLKFGLSSMQGWRATMEDAHSALLDIDNDTSFFGVFDGHGGRVVAKFCAKYLHREVLRSEAYSAGDLGNXPHKAFFRMDEMMRGQRGWRELQALGDKINQISGMIEGLIWSPRGSDSNDQHDDWAFEEGPHSDFAGPTCGSTACVAIVRNNQLVVANAGDSRCVISRNGQAYNLSRDHKPELEAERERILKAGGYIQMGRVNGTINLSRAIGDIEFKQNKFLSPDKQMLTANPDINTVELCDDDDFLVLACDGIWDCMSSQQLVDFIHEHINTESSLSAVCERVLDRCLAPSTLGGEGCDNMTMILVQFKKPISQNKNVSPAEQSAADKQPTGDTHWSEIHVTEESSS

SEQ ID NO: 4757 - protein, 321 aa, Gloeobacter violaceus PCC 7421
MFDVTTVEDKQLPLRLLAGGLLVAGIVAVFLLLFHPFLYVTEPGNATVMFNTFTGIEKGRIERPGATFVVPGVDGPITYNVRTRVFQFTNSTPVPNQAGNAITINTADGQAFSTDVFVALRPNQAVLDQLHANVGTRYMENIVVPTVRSKVRDVAANYTSGDFYNKARRAEMEQKMTALIGRDMPQGVLEGKKVSLLFIEDVYLGTAEFPEALKASLEQKQVASITAQTAAVKAQIQQKETTRKLILADANRKAIELQGQAAARNAKLADLLFYEKLKERIDAAREKGADIPVKVIRVEGAEKSTVFLNIDPQRAAATSAP

SEQ ID NO: 4758 - protein, 266 aa, Gloeobacter violaceus PCC 7421
MPMSAERQAWLSWAPQLVGVLILGFLLISLNPVRFVGNGENLVVFSWFGGIQKEPLQPGGHLILPVVSETIPFDVKTQALTWKDGGDSYGPRIVALTRDGQEIGAEVTMQFVVADPPKVYETLGTEYIDRIAPIVRSVISSQTSGFSAQDLYSTKRPVLQAQIRERVAGDLSQYGINVLDLLLRDVNFSKDFVAAIEAKTISENQLARKAYEIDQATQDAKTLISEAQAEAGRLGAKADALTKNPEYLRVVQSGVLGETLDTLINR

SEQ ID NO: 4759 - protein, 155 aa, Oryza sativa
  misc_feature (20)..(20): Xaa can be any naturally occurring amino acid
  misc_feature (57)..(57): Xaa can be any naturally occurring amino acid
  misc_feature (73)..(73): Xaa can be any naturally occurring amino acid
  misc_feature (84)..(84): Xaa can be any naturally occurring amino acid
  misc_feature (90)..(90): Xaa can be any naturally occurring amino acid
  misc_feature (137)..(137): Xaa can be any naturally occurring amino acid
KHQPEEDIALGPNCWICNHXRKSLSSRVLLPLAGGADSTSDASIIWCMCPLVTEDIXIGHELVKADAMRIAQXRDGHFPIDRIXLSKPLXYTVYMGTDYKCPGTTSRSKMPAQYIGSLHWYDPLDYMIYALAVLCAXLTGKRPPYKDEWGCSTEN

SEQ ID NO: 4760 - protein, 347 aa, Clostridium perfringens SM101
MKNILDFTLEELKEWMKENGENAFRAKQIFDWIYKKEVFNFEEMKNISKALIGKLSENFYIGIPEVIDYLSSSEDGTRKILLGLGDGNIIECVIMKYKYGNSICVSTQIGCRMGCKFCASTLEGMVRNLTAGEILSEVLIGQKLLGERISNIVLMGSGEPLDNYDNVMKFLEIVNADYGLNIGQRHITLSTCGLVPKIREMADKEMQVTLAISLHAVSDEKRKTIMPIANKYSISEILDACNYYIEKTGRRITFEYSLVSGVNDTKEDAKSLGRLLKGMLCHVNLIPVNEIKENEFKKSTKKDIETFLNTLKTYGVEATVRREMGSDINAACGQLRRSYIKSKGLKL

SEQ ID NO: 4761 - protein, 560 aa, Gloeobacter violaceus PCC 7421
MTDTMRRSKVEQIKENSHNLRGRLREELQQPETTHFAEESVQLLKFHGIYQQDDRDERKARKDAGLEPDYAFMVRTKNPGGYAPAAFYLAMDRLADALGSGTLRVTTRQGLQLHGIRKHNLREAIATISTQLGSTLGACGDINRNVMAPPAPFTARPYAVAREAAAAIADMLTPHTGAYFEVWQDEALVYSGEPEVEPIYGETYLPRKFKIAVAVEGDNSVDIYTQDLGVIPVFEDGERLLGYNLTVGGGLGMTHAKPETFPRQADHLGFVSSEDMLEAVKAVVLVQRDHGDRYNRRHARLKYLIHDRGLGWFRAQVETYLGKPLQPWRTVAPWVFHDYLGWQPQGDGRYCLGIWIENGRIKDEGAFRLKSALREIVERFEVDLILTPTQNALLVDVAPEVRAPIDAILQSAGVRPVQAVSNAERYAMACPAWPTCGLALTESERALPGIIAELEAKLTELDLAQEQISIRMTGCPNGCARPYMGEIGFVGSAPGAYNLYLGGNLASTRLNWVFRERVKREDILAVLGPLFSYFKRERAPGESFGDFCLRKGRADLEAHL

SEQ ID NO: 4762 - protein, 292 aa, Dechloromonas aromatica RCB
MITGSIVAIVTPMHEDGSLDLNSFRNLLDFHVQEGTDAIVVVGTTGESPTVNVEEHCELIKIAVDHVAGRIPVIAGTGANSTAEAIELTEFAKKAGANMALSVVPYYNKPTQEGLYRHFKAIAEAVELPVILYNVPGRTVADMSNDTILRLAEVPGIVGVKDATGNIDRACDLIARAPKDFALYTGDDMTAVATISLGFHGDISVTANVAPRLMHEMCVAAASGDIAKAREIHFKVLALHRDLFCEANPIPVKWAVHKLGLMPNGIRLPLTTLSEANQPRVLAALRQAGLVA

SEQ ID NO: 4763 - protein, 545 aa, Idiomarina loihiensis L2TR
MADHERAGQLAQASDLTNIAQLTSAYYVYEPDPRKAAEKVSFGTSGHRGSSLKRSFNEAHILAIAQAICAYREEQGITGPIMVAKDTHALSESAYISALDVFIGNGVEVQVQTEHDYTPTPVLSRAIIEWNRENTAKADGVVITPSHNPPEDGGFKYNPSHGGPADSDVTRTIEKYANALLSSGLVGVNTCESEDVLQHPKLTFVDWRTQYISQLDDCIDMSAIQDAKLRLAVDAMGGSGAKYWTQIAEHYNLSIEVRNAVVDPTFSFMPLDKDGKIRMDCSSPFAMASLLELKDNYDLAFGNDPDYDRHGIVTPTHGLLNPNHYLSVAIDYLCKNRDWDSSIAIGKTLVSSAMIDRVVGANERPLMEVPVGFKWFAKGLFERSIAFAGEESAGATLLDRKGNTWTTDKDGIVMALLAAEILTKTGKNPGQYYDDLCQQHGTAYYRRVDTASSVQKNARFKDIRAYKVKLPELAGDSVSDISTKAAGNDAQFGGIKVTTDNGWFAARPSGTEPVYKIYAESFVSEQHLDDILEQATTWVNDLLSD

SEQ ID NO: 4764 - protein, 498 aa, Myxococcus xanthus DK 1622
MNKTLLYITVIVIATCGLIYELVVGALASYLLGDSITQFSTVIGGYLFAMGIGSYLSRYIERGVAQRFVEVELAVALLGGICAPVLFLTFTLTDLFQVALYGSVIAIGALVGMEIPLLLRILKDQVKFKDLISQVLSLDYVGALAASVAFPLLLVPKLGLVRTSLLFGVLNAAVALWSTWLLAPLLGNPLRLRIKAVGLTVLLLAGFVMGDRLTTFYEDQLYADDVVHASSSPYQRIILTRGKRGFSLFLNGNLQFASLDEYRYHESLVHPAMVRAGKVENVLILGGGDGLAAREVLRYPEVRSVTLVDLDPVITGLATNYGELAKLNRHAMTDPRMRVVNGDAMQFLTEGGAQYDVVVVDFPDPNNFALGKLYTTGFYKLLKKRIAPDGVAVVQSTSPLFARRSFWCVETTLKAAGFWTEPYHALVPSFGEWGYVLIAHEPPARHRPLPEGLLFLDDATMASLTQFPPDMGPLPVEVNRLNNQVLVHYYEAEWQRWN

SEQ ID NO: 4765 - protein, 143 aa, Salmonella enterica
PKPMFGDNGSGMHCHMSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGIKNKIHPGEAMDKNLYDL

SEQ ID NO: 4766 - protein, 301 aa, Ralstonia solanacearum GMI1000
MIEESVMLRQHNLRLRKYDYVLGRLFVALPIGGLVVAVLLLFADWRVGRFELAMCLAMYLFTMMGIEVGFHRCFAHRAFKAGTGLQWVLAVAGSMGGHGPLIWWVTTHRRHHRFVDTDQDPHTPNKDLRGPWRNFKSFLYGYVGWTMDTDVKLQEGWQRYGVDLYKNSILFKVHARFALIALLGLLLPTVAGALFHRTAEGALLGLLWGGLVPICLTQHLFWMINAFGHRIGAKPFSGRIVGDSRNCWWLALPTFGQGWHNNHHADPGCATTRKTWWQLDPGAWLIRLFERLGWASAVKWK

SEQ ID NO: 4767 - protein, 85 aa, Oryza sativa
  misc_feature (20)..(20): Xaa can be any naturally occurring amino acid
  misc_feature (53)..(53): Xaa can be any naturally occurring amino acid
MKRACITYCISYILSCSPSXSPEYKILMIGRVLGGIATSLLFSAFESWLVARXHTQRGFDSQLACRITYLPSAHISYEQIGLGLP

SEQ ID NO: 4768 - protein, 497 aa, Passalora fulva
MSLSVQLETPSAGKYEQPTGLFINNEWVKPVSGKFFDVINPTDESVICQVAEADEKDVDIAVAAARKAFEGPWRQETPENRGKLLVKLAELFEKNLDLFASVKALDNGKAFNMAKVDIGMCAGCLRYYGGWADKIEGKVVDTTPDTFNYIKKEPIGVCGQIIPWNFPLLMWAWKIGPAVATGNTVVIKTAEQTPLGAYVAANLIKEAGFPPGVVNVISGFGKVAGAAIASHMDIDKVAFTGSTVTGRTILKAAAGSNLKKVTLELGGKSPNIVFDDADIDNAISWVNFGIFFNHGQRCCAGSRIYVQEGIYDKFLQRFKERAQKNVVGDPFAADTFQGPQVSQVQFDRIMGYIQAGRDAGATVEIGGNRKGDKGYFIEPTIFANVTEDMKIMQEEIFGPVCSISKFKTKEDAIKVGNATPYGLAAAVHTRNLNTAIEVSNALRAGTVWVNTYNTLHHQLPFGGFKESGIGRELGEDALANYTQTKTVSIRLGDALFG

SEQ ID NO: 4769 - protein, 251 aa, Lotus japonicus
MPIRNIAIGAPQEATHPDTLRSALAEFISTFIFVFAGSGSGIAYNKLTDDGAATPAGLISASIAHAFALFVAVSISANISGGHVNPAVTFGLFVGGNISFLRGVIYIIAQLLGSIVASLLLAFVTGLAVPAFGLSAGVGVGNALVLEIVMTFGLVYTVYATAVDPKKGSLGTIAPIAIGFIVGANILLGGAFDGASMNPAVSFGPAVVSWSWSNHWIYWVGPLVGGGIAGLIYEVVFIGSQTHEQLPTTDY

SEQ ID NO: 4770 - protein, 525 aa, Triticum aestivum
MGCCRSSLRAVTHPHPEKPPGTGAGAAPMARRPSFSASAHRAAPPPAAAAAASGSSSEAGFAEFSLAELRAATGGFAAENIVSESGDKAPNFVYRGRLQQGQGQGPRRAIAVKKFGKMAWPDPKQFAEEARGVGRLRHRRLANLIGYCCDGDERLLVAEFMPNDTLAKHVFHWENQTIEWAMRLRVAYHIAEALDYCSNEGRPLYHDLNAYRVLFDENGDPRLSCFGLMKNSRDGKSYSTNLAYTPPEYLRTGRVTPESVIFSFGTVLLDLLSGKRIPPSHALDMMRGNNIQMLMDSHLEGNYSTEEATALVDLASQCLQYEARDRPNTKKLVNILEPLQTKLEVPSYEMLGIPKHEEEVPPPPTPQPPQHPLSPMAEACSRMDLTAIQQILVSTHYRDDEGSNELSFQEWTQQMRDMLDARKRGDLAFRDKDFKTAIECYTQFVDVGTMVSPTVYARRSLCHLMCDQPDAALRDAMQAQCVYPEWPTAFYMQAVALSKLDMQSDAKDMLSEASQLEEKKQKNSR

SEQ ID NO: 4771 - protein, 628 aa, Francisella tularensis subsp. tularensis SCHU S4
MCGVVGFYSFNKEEGFDSIINQSLLSIKHRGSDDSGYWCDNQVTLGHTRLSIHDITNAGHQPMLSNSGNTAIVFNGEIYNYLSIKNQLLSEYSNLKFKSNSDTEVLVNAIELWGIDKTLEKCIGMFAFGVYSRKTSCLILARDRFGEKPLYFGIQNGILGFASELKALKPLKECGWRFDIDRDALATYMRYAYVPTPYSIYKNISKLNVGSYIKFDAKGNSKEYKYWDSKKVLDSEKYKDSYDQAILDLEIKLKSTLSIQMQSDVPLGAFLSGGIDSTTVVALMQSMSKDKINTFSIGFNQKEYNEAEHARAVAKHIGTNHTDMYVTERDALDVIPKLAGIYDEPFADSSQIPTYLVSKIAKSKVTVALSGDAGDELFGGYNRYFLAPNIAKKIKFAKLLKYAPDAWIKKAEILNFGKFALLADKLLKLKRVLEKAKTNKELYVLLCSQINDTSFVLGAKEYDILRDKNIYDIPQLSFQEWMMFVDSNTYMIDDILVKVDRAAMANSLETRVPFLDHNIYEFAYSLPIDYKIQRGNGKRILKDLLYKYVPESLVNRSKMGFGIPLAKWLREDLREWADNLLDYSKIDKQGYLSPEVVQKYWQEHLSGKRNWQAILWNILIFQEWLDNE

SEQ ID NO: 4772 - protein, 196 aa, Yersinia pestis CO92
MSVSALVCLAPGSEETEAVTTIDILVRAGINVTTASVAGDGALEIICSRGVRLLADTRLVDVADQKFDVIVLPGGIKGAECFRDSPLLVATVRQTHNEGRLVAAICAAPALVLEHHQLFPVGNMTGFPSLKDKIAPNKWMDQRVVYDRRVNLVTSQGPGTSIDFALKIVFLLLGREKAEEIAWQLVLPPGIYNYRE

SEQ ID NO: 4773 - protein, 188 aa, Triticum aestivum
  misc_feature (156)..(156): Xaa can be any naturally occurring amino acid
MCGILAVLGVGDVSLAKRSRIIELSRRLRHRGPDWSGIHSFEDCYLAHQRLAIVDPTSGDQPLYNEDKTVVVTVNGEIYNHEELKAKLKSHQFQTGSDCEVIAHLYEEYGEEFVDMLDGMFSFVLLDTRDKSFIAARNAIGICPLYMGWGLDGSVXFSSEMKALSDDCKRFISFPPGPLYSSKNGGPK

SEQ ID NO: 4774 - protein, 130 aa, Pseudomonas putida KT2440
MKDWLDEIKWNSDGLVPAIAQDHKTGRVLMMAWMNRESLALTAAEQRAIYWSRSRGKLWRKGEESGHVQKLHELRLDCDADVIILMVEQLGHIACHTGRESCFYRVYEDGQWKIVDPVLKDPDAIYSAGH

SEQ ID NO: 4775 - protein, 356 aa, Zea mays
MEMTGSLPVPSVQAMVAAGRHAPVPPRYLRPDLAADVVVADDATTIPIIDFQRLLLVDPEESARLHAACQDWGFFQLINHGVPDDVMEAMKASTQSFFALPAEAKQQYRQQAGQLEGYGQLFVVSEDQKLDWADVLYLNTQPPEHRNLSFWPAGESFRQTLDTYSAAVKHVADRLLGAMYMNLGLLSSMDMDPERGAGIQSVRMNYYPPCAEAADKVLGFSPHSDSDLLTLVLQVNQLQGLQIKRPPDGGGAWAWLPVTPLQGAFVVNVGDVLEIFTNGRYRSVEHRALVNAHTERLSIAAFHSPSIHATIGPLPELLGDQEVPKYKTLDHQSFITLFFSAKLQGKSFLERMKKLS

SEQ ID NO: 4776 - protein, 1252 aa, Streptococcus agalactiae A909
MKRKDLFGDKQTQYTIRKLSVGVASVATGVCIFLHSPQVFAEEVSVSPATTAIAESNINQVDNQQSTNLKDDINSNSETVVTPSDMPDTKQLVSDETDTQKGVTEPDKATSLLEENKGPVSDKNTLDLKVAPSTLQNTPDKTSQAIGAPSPTLKVANQAPRIENGYFRLHLKELPQGHPVESTGLWIWGDVDQPSSNWPNGAIPMTDAKKDDYGYYVDFKLSEKQRKQISFLINNKAGTNLSGDHHIPLLRPEMNQVWIDEKYGIHTYQPLKEGYVRINYLSSSGNYDHLSAWLFKDVANPSTTWPDGSNFVNQGLYGRYIDVPLKTNAKEIGFLILDESKTGDAVKVQPNDYVFRDLANHNQIFVKDKDPKVYNNPYYIDQVQLKDAQQIDLTSIQASFTTLDGVDKTEILKELKVTDKNQNAIQISDITLDTSKSLLIIKGDFNPKQGHFNISYNGNNVTTRQSWEFKDQLYAYSGNLGAVLNQDGSKVEASLWSPSADSVTMIIYDKDNQNRVVATTPLVKNNKGVWQTILDTKLGIKNYTGYYYLYEIKRGKDKVKILDPYAKSLAEWDSNTVNDDIKTAKAAFVNPSQLGPQNLSFAKIANFKGRQDAVIYEAHVRDFTTDRSLDGKLKNQFGTFAAFSEKLDYLQKLGVTHIQLLPVLSYFYVNEMDKSRSTAYTSSDNNYNWGYDPQSYFALSGMYSEKPKDPSARIAELKQLIHDIHKRGMGVILDVVYNHTAKTYLFEDIEPNYYHFMNEDGSPRESFGGGRLGTTHAMSRRVLVDSIKYLTNEFKVDGFRFDMMGDHDAAAIELAYKEAKAINSNMIMIGEGWRTFQGDQGKPVKPADQDWMKSTDTVGVFSDDIRNSLKSGFPNEGTPAFITGGPQSLQGIFKNIKAQPGNFEADSPGDVVQYIAAHDNLTLHDVIAKSINKDPKVAEEEIHRRLRLGNVMILTSQGTAFIHSGQEYGRTKRLLNPDYMTKVSDDKLPNKATLIEAVKEYPYFIHDSYDSSDAINHFDWAAATDNNKHPISTKTQAYTAGLITLRRSTDAFRKLSKAEIDREVSLITEVGQGDIKEKDLVIAYQTIDSKGDIYAVFVNADSKARNVLLGEKYKHLLKGQVIVDADQAGIKPISTPRGVHFEKDSLLIDPLTAIVIKVGKVAPSPKEDLQADYPKTQSFKESKTVEKVNRIANKTSITPVVSKKADSYLTNEANLPKTGDKSSKILSVVGISILASLLALVGLSLKRNRHLK

SEQ ID NO: 4777 - protein, 241 aa, Gloeobacter violaceus PCC 7421
MPKDAIGILIDLARRGEIDPWDIDVVQLTDRFLQSLGSLDVSDLPRSGQALFYASVLVHMKAEILEGSMQSPDPLDVPEDEEEALSHPLGPNGPAVALERLIRRRPAVPAMVDRPLTLNDLIAHLREVEQMEGHQAQKRTAERRPPLKGPMVRTMEQVEHLAHQENLEAIVTGLWAVLTTKGVTAFEKLLEHYRDRVGAFLGLLFLAHRDRVVLAQAEFYRDIEIYAVDESQDPPGGGALP

SEQ ID NO: 4778 - protein, 369 aa, Coprinopsis cinerea okayama7#130
MKALSDLVKHARLQYLQVSKPHVIIHTSDKPSYGPGMYWTDVKKKARRPLNSIILEGNTLEKILADAREFISMERWYNNAGIPHRRGYLLYGPPGTGKSSTIYALAGELGMEIYSLSLASDFVDDNFLQKASSSVPKNSIFLIEDVDCAFPSREDEDEKDKPRRGRRDEYRSFVTLSGLLNTLDGVGSEEGKLFFATTNHLDRLDPALIRPGRIDMKVEYKLATKGQASALFARFYSFKDDILPDSMHSVDEKKEHLTDGEITRLANAFAKAIPEHEFSTAEIQGYLLGFKKDPEQAAACVGEWVVAEQKRREEELQAEKEKKEKVKASKDSGQGVNGINGIVNGFPGPSASFSGRPLSSAGVAVSAAG

SEQ ID NO: 4779 - protein, 294 aa, Zea mays
SARARVFTQKIHDLIGTHTDVPAPDMGTNAQTMAWMLDEYSKFHGHSPAVVTGKPIDLGGSLGRDAATGRGVMYATEALLAEYGKCISGSTFVIQGFGNVGSWAARLIHEKGGKIIAIGDVTGSIRNTAGIDIPALVKHRNEGHAMKDFDGAEVLDSTELLVHDCDVLVPCALGGVLNKDNAPDVKAKFVIEAANHPTDPDADEILAKKGVVVLPDIYANSGGVVVSYFEWVQNIQGFMWDEEKVNDELEKYMSSAFQHLKAMCKSLDCDLRMGAFTLGVNRVARATLLRGWEA

SEQ ID NO: 4780 - protein, 265 aa, Pseudomonas putida GB-1
MTQVFKGTALITGASTGIGSIYAERLARRGYDLVLVARNRERLNALAGRLTSETRQNVEVFPADLANADDLAKVERKLREDASISVLINNAGIGTHTSLLDSDVERMAEMITLNVTALTRLTYAAVPGFVARGQGAVINISSVVSLAPELLNGVYGGSKAYVTAFTQALNKELAGKGVKVQAVLPGATATDFWQIGGLPVENLDPAIVMSAQDLVDGALQDFDNGVLISLPSLHDLQAFDQYEAGRQALFGLLSSNQLAPRYSVE

SEQ ID NO: 4781 - protein, 308 aa, Klebsiella pneumoniae
INGFGRIGRIVFRAAQKRSDIEIVAINDLLDAEYMAYMLKYDSTHGRFDGTVEVKDGHLVVNGKKIRVTAERDPANLKWDEVGVDVVAEATGIFLTDETARKHITAGAKKVVLTGPSKDNTPMFVRGANFDAYAGQDIVSNASCTTNCLAPLAKVINDNFGIVEGLMTTVHATTATQKTVDGPSHKDWRGGRGAAQNIIPSSTGAAKAVGKVLPELNGKLTGMAFRVPTPNVSVVDLTVRLEKAASYEEIKKAIKAASEGAMKGVLGYTEDDVVSTDFNGEVCTSVFDAKAGIALNDNFVKLVSWYDN

SEQ ID NO: 4782 - protein, 364 aa, Acidovorax sp. JS42
MQQQRTHKIAVIAGDGIGKEVMPEGLRAVQAAARRFGLNLELHTFDWAHCDYYARHGQMMPDDWKAQLSGMDAIFFGAVGWPATVPDHISLWGSLLKFRREFDQYINLRPVRLFEGVPCPLAGRKPGDIDYYVVRENTEGEYTSLGGIMYEGTDREIVIQESVYSRHGANRLLKFAFDLAQSRPRKHVTLATKSNGIAISMPWWDQRADDVAKGYPEVTLDKQHIDILTARFVLQPGRFDVVAATNLFGDILSDLGPATTGTIGLAPSANLNPERTFPSLFEPVHGSAPDIYGQNIANPIAMIWSGALMLDFLTHGQGAGRQAHDAIVAAIEEIIKSGPRTPDLGGAASTTQVGEAIAARIAHG

SEQ ID NO: 4783 - protein, 282 aa, Xanthobacter autotrophicus Py2
MTVRVCITGSPVSYSRSPLLHGYWLKAYGIDGDYGREEVPPAQAADFYRSLAARGYAGCNVTAPNKEIAFSVLDEADESAAALGSANTLWLEDGRLCGASTDGYGFIANLDATVPGWDGARKLALVLGAGGASRAIVHAMVERGFERIVLANRTLERAEAIAVAFGKTVVPLAFDKAGEVMADADILVNCTSLGMKGAAALTVDLSRLRPEAVVSDIVYVPLLTPLLTEAAARGLRTVDGLGMLLHQGVPGFERWFGVRPEVTPELRELLIADLRAKGQLAA

SEQ ID NO: 4784 - protein, 149 aa, Dechloromonas aromatica RCB
MQVREILRVKGGTLYTVTPQQPLAVAIDSMADLDVGSLVVMEAGKMVGMLTFREVLLALRQHASSPDGITVGDVMVANPVTAFPDMEANDLRRLMIEKRSRYLPVIDGDTLMGVISFLDVAKAVLEEQSFENKMLKSYIKNWPSETPAA

SEQ ID NO: 4785 - protein, 160 aa, Klebsiella aerogenes
MDQTCTLEGFLTRVQQRDPHQTEFAQAVREVMTTLWPFLEENPRYRQLALLERLVEPERVIQFRVVWVDDRNQVQVNRAWRVQFNSAIGPYKGGMRFHPSVNLSILKFLGFEQTFKNALTTLPMGGGKGGSDFDPKGKSDGEVMRFCQALMTELYRHLGP

SEQ ID NO: 4786 - protein, 490 aa, Rhodococcus sp. RHA1
MADRTSSTGSIGSEPGDGSGTGPAGEPHLSRQLANRHIQLIAIGGAIGTGLFMGSGKTISLAGPSVIFVYMIIGFMLFFVMRAMGELLLSNLHYKSFSDFTADLLGPWAGFFTGWTYWFCWIVTGIADIIAISGYVQYWWPDLQLWIPALVAIAALLLLNLPTVRAFGETEFWFALIKIIAIVSLIVVGLVMVFTHFTSPNGSEAGFDNLWNDGGMFPTGAMGFVAGFQIAVFAFVGIELVGTTAAEAKDPEKNLPKAINSIPIRILLFYVVSLIVIISVTPWREVVPGESPFTAMFTLAGLGIAAGVIQFVVLTSAASSANSGIYSTSRMVYGLAQEGDAPGRLGRLSSRKVPANALMFSCAFLLSAIALLFSGDSVIEAFTTVTTISSVLFMFVWTMILASYIVYRKRRPELHEASKFKMPGGVVMCWVVLAFFVFLIWALTQEADTLEALLVTPVWFVVLGIAWAVIRRRAPHRARYAAFKAELEDR

SEQ ID NO: 4787 - protein, 721 aa, Mycobacterium sp. JLS
MADTSREGVDEHFTTSISQLTAISSRASGPGDRELLALFDVALASRHLDLAARWLRAQGRGYYTIGSSGHEGNAAVAAALRPTDPALLHYRSGGFFLARAQQVDGGLARGIRDVLLGLVAATDEPISGGRHKVFGRADLNIIPQTSTIASHLPRAVGVAFSTARAGKLGVPCRWPEDAVTVCSFGDASVNHSTAVGALNTAMHTAYQGMPMPLLFVCEDNGIGISTRTPRGWVARTYSQREGLQYFAADGTDLAATIETTRAAAEFVRTHRRPAFLHLSTVRLMGHAGSDYEPGYRRPDEIVADFDRDPVLCAAKALVAQGILSPVEVLERYEATRRQVLDMAAEVMDAPQLDSAAAVERPLRETLAEAVAASSAPPPGGSSAASVTVAQAVNRALADALAHHPEALVFGEDVARKGGVYGVTRGLQQKAGPARVFDTLLDEQAILGLALGAGVSGLLPIPEIQYLAYFHNAADQIRGEAATLQFFADRQYRNPMVVRVAGYGYQKGFGGHFHNDNSIAAMRDIPGVVIASPARPDDAAAMMHACVAAAKTAGAVCLYLEPIALYHTKDLYADGDGQWLAPLTGTPAPIGRARIHGDGADLTILTFGNGLWMSLRVARRLERLHIGARIVDLRWLAPLPVEDMLREAQATGRVLIVDETRETGGVGEGILAALLAHGYTGPVERVAGRDSFIPLGDAALAVLLSEDTIEAAAIKLARTAGS

SEQ ID NO: 4788 - protein, 408 aa, Novosphingobium aromaticivorans
MKSIAVVGANLAGGRAVESLRQAGFDGRITLIGEEPWRPYERPPLSKEVLWDPANVPDNFFLHDEAWYAANRIEMRLGTRAEALDLAASAVRLTGGDLVQADRILLTTGGSARKLNMEGADAANVHYLRTRDDATRMATDLRDGARIVIIGMGVIGAEVAASAVKLGCRVTAIEPLAAPMIRALGPQFGQWLGEEHRQRGVDTRFGRGVNAMKVLDGRVTQVELDDGSLVDCDAVVVGVGIVPEISLARDAGIVTNNGIIVDRQCRTSNENVFAAGDVAEQDSFFGGHIRQETYQNAADQAQAAALAMLGQDVDYCKPVWYWSDQFDLNIQFCGHIPVQAEVTLRGDMASNQFTAFFRSGETIEGILTVNRAPDMGIGKRLIERRARAQAAQLADADVSLREILKQAG

SEQ ID NO: 4789 - protein, 556 aa, Streptococcus pneumoniae TIGR4
MKTDIEIAQSIELKPIVDVVEKLGISYDDLELYGKYKAKLSFDKIRAVESNPVGKLILVTAINPTPAGEGKSTLTIGLADALNKIGKKTMIAIREPSLGPVMGIKGGAAGGGYAQVLPMEDINLHFTGDMHAITTANNALSALIDNHLHQGNELGIDQRRILWKRVVDLNDRTLRHVTVGLGGPLNGIPREDGFDITVASEIMAILCLATDIEDLKRRLANIVIGYRYDRTPVSVGDLQVEGALALILKDAIKPNLVQTIYGTPAFVHGGPFANIAHGCNSVLATTTALHLADYTVTEAGFGADLGAEKFLDIKTPNLPTSPDAVVIVATLRALKMNGGVAKDALTEENVEAVRAGFANLKRHVENIRKFGIPAVVAINEFVSDTEAEIAALKELCASIDVPVELASVWADGAEGGVALAETVVKTIAENPANYKRLYDNDLSVQEKIEKIVTEIYRGSKVNFEKKAQTQIAQIVQNGWDKLPICMAKTQYSFSDNPNALGAPENFEITIRELVPKLGAGFIVALTGDVMTMPGLPKRPAALNMDVESDGTVLGLF

SEQ ID NO: 4790 - protein, 157 aa, Brassica napus
  misc_feature (152)..(152): Xaa can be any naturally occurring amino acid
FGGEDGLPSILARHQIPGLDVVVDPCAAILVFIVTGFLCLGIKESTFAQGIVTAVNVCVLLFVIVAGSYLGFKTGWAGYELPTGFFPFGVDGMFAGAATVFFAFIGFDSLASTAEEVKNPQRDLPIGIGLALFLCCSLYMMVSIVIVGLVPXYAMDP

SEQ ID NO: 4791 - protein, 246 aa, Zea mays
  misc_feature (179)..(179): Xaa can be any naturally occurring amino acid
MLQRVETNFLSYAIDDAQKYPYLASMGIYVFKKDALLDLLKSKYTQLHDFGSEILPRAVLDHSVQACIFTGYWEDVGTIKSFFDANLALTEQPSKFDFYDPKTPFFTAPRCLPPTQLDKCKMKYAFISDGCLLRECNIEHSVIGVCSRVSSGCELKDSVMMGADTYETEEEASKLLLAXGKVPVGIGRNTKIRNCIIDMNARIGKNVVITNSKGIQEADHPEEGYYIRSGIVVILKNATINDGSVI

SEQ ID NO: 4792 - protein, 199 aa, Triticum aestivum
AYLGDTIEQVCTKKQAGTGPEFPGYRRPTRPAALAAPEYCNANFTLYFTDAFWRHPAYSSVFANRTRAPCYFNTGVMVIDLDRWRAGGYTAKLEYWMDVQKQEARIYELGSLPPFLLVFAGDVKAVQHRWNQHGLGGDNVAGQCRELHPAPVSLLHWSGKGKPWLRLDAGRPCPLDALWAPYDLLRRRGARDDLLAAVA

SEQ ID NO: 4793 - protein, 434 aa, Bacillus anthracis str. A2012
MFVVRPLGEIDISKNNLRRVDSLSTLREEALHMHKVHQGKLETVSKVKVENAKDLSLAYSPGVAEPCKEIYDDKSKVYEYTMKGNMVAVVTDGTAVLGLGNIGPEASLPVMEGKAVLFKSFAGVDAFPIALNTNDVDKIVETVKLMEPTFGGVNLEDIAAPNCFIIEERLKKETNIPIFHDDQHGTAIVTVAGLVNALKLVGKKMSDIKVVANGAGAAGIAIIKLLYRYGVRDIIMCDRKGAIYEGRPTGMNPVKDEVAKYTNKNRIEGSLADVVQGADVFIGVSAEGALTEEMVRTMNDDAIIFAMANPVPEIMPELAKAAGAAVVGTGRSDFANQVNNVLAFPGIFRGALDVHATQINEEMKMAAVQAIAELVAEDELNADYIIPAPFDARVAPQVAAYVAKAAMETGVARRQVDPNEVAEKTKQLALIGKE

SEQ ID NO: 4794 - protein, 490 aa, Glycine max
  misc_feature (131)..(131): Xaa can be any naturally occurring amino acid
  misc_feature (339)..(339): Xaa can be any naturally occurring amino acid
  misc_feature (355)..(355): Xaa can be any naturally occurring amino acid
MSIFDGAFMNTQLSKHTSIFGLRLWVVIGILIGVFIVFTLFLLSLCLVSRRNRRRSVAVPGYKVTGDADAAKDIHTIVHLPGPHMLRPVAPEIHVEMGKKTEHRVVVQCDGVSSEESKVTVGSGCETTSVXGSGSVGGPGPGLGPEVSHLGWGRWYTLRELEDATGGLSPENVVGEGGYGIVYHGVLNDGTKIAVKNLLNNKGQAEKEFKVEVEAIGRVRHKNLVRLLGYCVEGAYRMLVYEYVDNGNLEQWLHGDVGAVSPLTWNIRMNIILGTARGLAYLHEGLEPKVVHRDVKSSNILIDRQWNSKVSDFGLAKLLCSENSYVTTRVMGTFGYVVXKYAGCGVLLTESGDYXSFGILIMEIITGRSPVDYSRPQGEVNLIEWLKTMVGNRKSEEVVDPKLPEMPSSKALKRALLIALRCVDPDATKRPKMGHVIHMLEADDLLFHTEQRTEGESSRSYQSEQRDSNLDKRRDGGAIDKSEDASTRWR

SEQ ID NO: 4795 - protein, 384 aa, Oryza sativa (japonica cultivar-group)
MAHVVHGLTQANLLPTGPETIGPCSPFHFPSGLSWPIYLCRVLRSSVALMVTSLGEVEAKTCSKMFYAGYGYHGSNFEQTYRCYPASFFDKPHLEGGDKVIMPPSALDRLASLHIEYPMLFELHNDATQRISHCGVLEFVAEEGMIIMPYWMMQNMLLQEGDTVRVKNTTLPKGTYVKLQPHTTDFLDISNPKAILEKTLRNFSCLTTGDSIMVAYNNKQYYIDIVETKPASAVSIIETDCEVDFAPPLDYKEPENPQQPSVPASEATAEDENAKVEDELKFKPFTGSGKRLDGKASKLQATEVPSASRSSPSDSNKRVNQETLAPASSGASNSTRQKSGKLVFGSSANNNKEPQKASVKDDESPKKDEPKFQAFSGKSYSLKR

SEQ ID NO: 4796 - protein, 580 aa, Oryza sativa (indica cultivar-group)
MASLTPSLQDLLVSSLMILLVLLYIAYWRSKYQSLFPVDWPIVGLLPTLVANLHRLHDKITEYLAASGHSFTGNGPAASNMRLFVTCDPDNVRHIFTTNHDNYPKGHEFAEIFDIMAGAFFTMDGELYRRQRAKTHSILSDPRMVASMASSCADKVRDGLLPLLTSMASTRTPFELQDLATRLMFDVTAMPVFGVDPGRLSPDMPSMHVSAAMDTIMEVGLFRHTVPPSCWKAMRRLKIGPERKLAAAHAALHVFVSEMMEKARKQEAAPSSMSMDVLSSYINDPDYVGLLHSILITYMVAGRDTVGTTLPWFFYNLAMNPRVVSGIREELAHNIATSTCNGDGAPVMFSPEDTKSLVYLHAALFETLRLYPPGWIERKTVVADDVMPSGHEVRAGDAVLISIYSMGRMESLWGEDCRVYRPERWLYDSRGGRKMRHVPSHKFLSFNSGPRMCPGKNIAVMQMKIIAAAVVWNFDLEVVEGQAVVPKLSCLLQMKNGVMVKIAQNFQAMTMIMHDEIAQQVNDKAEQALIVPQVGMDFDFIPFTMLLNCTLLLPSGLCSPSPTQPLRPPPKAPDARGQER

SEQ ID NO: 4797 - protein, 323 aa, Gibberella zeae PH-1
MSSALDQLKATGTTVVSDSGDFASIGKYKPQDATTNPSLILAASKKEEYAKLIDVAIDYAKQKGGSVDQQVDDALDRLLVEFGKEILKIIPGKVSTEVDARYSFDTEASVNKALHLIELYGEQGISKDRILIKIAATWEGIKAAEILQRDHGINTNLTLMFSLVQAIGAAEAGAYLISPFVGRILDWFKASTKKEYTKEEDPGVLSVKQIFNYYKKFGYNTIVMGASFRNTGEITELAGCDYLTISPNLLEDLLNSSDSVPKKLDASQASSLDIEKKSYIKDEALFRFDFNEDQMAVEKLREGISKFAADAVTLKGILKEKLS

SEQ ID NO: 4798 - protein, 449 aa, Mycobacterium tuberculosis H37Rv
MASTLTTGLPPGPRLPRYLQSVLYLRFREWFLPAMHRKYGDVFSLRVPPYADNLVVYTRPEHIKEIFAADPRSLHAGEGNHILGFVMGEHSVLMTDEAEHARMRSLLMPAFTRAALRGYRDMIASVAREHITRWRPHATINSLDHMNALTLDIILRVVFGVTDPKVKAELTSRLQQIINIHPAILAGVPYPSLKRMNPWKRFFHNQTKIDEILYREIASRRIDSDLTARTDVLSRLLQTKDTPTKPLTDAELRDQLITLLLAGHETTAAALSWTLWELAHAPEIQSQVVWAAVGGDDGFLEAVLKEGMRRHTVIASTARKVTAPAEIGGWRLPAGTVVNTSILLAHASEVSHPKPTEFRPSRFLDGSVAPNTWLPFGGGVRRCLGFGFALTEGAVILQEIFRRFTITAAGPSKGETPLVRNITTVPKHGAHLRLIPQRRLGGLGDSDPP

SEQ ID NO: 4799 - protein, 544 aa, Zea mays
MGNQCPNGTLGSDYYNRPASRFADGCLEDDRYSDLKKFDKPWPEVNSFKPTAVGILKRGLDPTSITVLERKTADVREHYIIGRRLGQGQFGTTFLCTEISTGCEYACKTIPKRKLITKEDVEDVRREIQIMHHLSGHKNVVSIKDVYEDGQAVYIVMELCAGGELFDRIQEKGHYSEQKAADLIRIIISLVAMCHSLGVMHRDLKPENFLLWDKEDDLSIKAIDFGLSVFFKPGQVFTELVGSPYYVAPEVLHKRYGPEADVWSAGVILYVLLSGVPPFWAETQQGIFDAVLKGHIDFDSDPWPKISESAKNLIRKMLCPCPSERLKAHEVLRHPWICENGVATDQALDPGVLSRLKQFSAMNKLKKLALRVIAERLSEEEIAGLRQMFKAVDVQNRGVITFGELRQGLKRYGSELENREISDIMEVADNDNNVTINYEEFIAATVPLNKIEREEHLMAAFTYFDKDGSGYITVDKLQRACGEHDMDDTFLEEIILEVDQNNDGQIDYAEFVAMMQGSKAGLGWQQMETTLNVTLRDAPQVHCH

SEQ ID NO: 4800 - protein, 516 aa, Oryza sativa (japonica cultivar-group)
MEASQAASAWSSVNSGIVLSLAAVLWTVVWNSLQSLQLHHLVGRHLARHARRLAAVVDPYLTVTVAEHDGGRMKRSDAYREVQAYLHRATCDASAGVRHLRAEPAKNPDAFVLSMADREEVADVFRGGVTVWWLAYSTPPREDDAGGGFYWGGRAARADRRFYRLSFLERDRDVVLGEYLPHVRREGRAAMVRNRQRKLFTNLAGDTWGDDGGWCESVWSHVVFEHPKTFDTLAMDPARKKDIMDDLDAFRNGKEYYARVGRAWKRGYLLHGPPGTGKSTMIAAMANYLDYDIYDIELTSVRTNTDLRKLFIETTSKSIIVIEDIDCSLDLTGKRKNKKKKDAAAAKNDTDGDKKESPPSEEEEKDKEGSKVTLSGVLNFIDGLWSACGGERIIVFTTNHVEKLDPALIRRGRMDKHIEMSYCGFEAFKFLAKVYLGIDAHHLFDAVRALLRDVDMTPADVAENLTPKAAGDNADTCLAELVKELEKAKADKAQAKGKAAATAAAEEEVDGDDDEE

SEQ ID NO: 4801 - protein, 110 aa, Saccharomyces cerevisiae
MVSQETIKHVKDLIAENEIFVASKTYCPYSHAALNTLFEKLKVPRSKVLVLQLNDMKEGADIQAALYEINGQRTVPNIYINGKHIGGNDDLQELRETGELEELLEPILAN

SEQ ID NO: 4802 - protein, 264 aa, Aquilegia formosa
RPKVAYNNFSNDVPVISVAGIDDEEKRSEICKKIVNACEDWGIFQVVDHGVDTSLITEMSRLAKEFFALPPEDKLRFDMSGGKKGGFIVSSHLQGEAVQDWREIVTYFSYPVQNRDYSRWPDKPEGWKTVTQTYSEKLMELACKLLQVLSEAMDLDKDALTKACVDMDQKVVVNFYPKCPQPDLTLGLKRHTDPGTITLLLQDQVGGLQATRDDGKTWITVQPIEGAFVVNLGDHGHYLSNGRFKNADHQAVVNSSYSRLSIAT

SEQ ID NO: 4803 - protein, 119 aa, Glycine max
MEIESVKCECCGLKEDCTQEYIRDVKAKFDSKWLCGLCSEAVRDEVNRAKRPFAMEEAVKAHMSFCGKIKSNPAVRVADGMRQMLRRRSTDLSSSSSKYSGRSNTTSQVTDSFTFPLHP

SEQ ID NO: 4804 - protein, 692 aa, Myxococcus xanthus DK 1622
MELSSLESSFWAIAPGVVGAVGLLFAAVFYFRVKALPEGDATMNRIAGYIRDGAMAFLVREYKVLAAYCAVIAVLIGLALGPLASGSFVLGAFLSLLAGYIGMKAATFANVRTAQAARTGSKPNALLVALDGGAVMGLAVAGLGLIGMGGVYYAFQGHPQLSPVLHSFAVGASSIALFARVGGGIYTKAADVGSDIAGKVIENIPEDDPRNPGVIADNVGDNVGDVAGMGADIYESMVAAIVAAMAIALTASAADLSRLVVDPSAIGSAKVAGVVIPLVLSAVGLVVSLLSIFIARALKHMNPAQVLRSALILPPVILVGLSFVMMQVFGLSQAITVALAAGAFGGAIIGLVTDYYTSSTPVQRIAEASVTGAGTNLIRGLAVGMESVGIPMATIAVVAYIADQALGLYGIALAAVGMLGGTAVVMTVDAYGPISDNAGGISEMSGLGPEVRAITDELDAVGNTTAAIGKGFAIGSATLTVIALFSAFNLEVNHTRIAAGLPEMSLQLTNPNVIVGLLLGSILPFLVGASTMLAVGRAAGAIVEEIGRQFREIPGLMELKADPDPKKIVDIATKSALQEMVFPGIIAVAAPPLVGYLLGPGALAGLLAGSLVVGATMALYMANAGGAWDNAKKFIEKGKLPGHAKGSAVHKAAVVGDMVGDPFKDTSGPGVAILIKVMSVVSLLVASLIALR

SEQ ID NO: 4805 - protein, 501 aa, Novosphingobium aromaticivorans
MATQLRSAENEYGIKSEYGHYIGGEWIAGDSGKTIDLLNPSTGKVLTKIQAGNAKDIERAIAAAKAAFPKWSQSLPGERQEILIEVARRLKARHSHYATLETLNNGKPMRESMYFDMPQTIGQFELFAGAAYGLHGQTLDYPDAIGIVHREPLGVCAQIIPWNVPMLMMACKIAPALASGNTVVLKPAETVCLSVIEFFVEMADLLPPGVINVVTGYGADVGEALVTSPDVAKVAFTGSIATARRIIQYASANIIPQTLELGGKSAHIVCGDADIDAAVESATMSTVLNKGEVCLAGSRLFLHQSIQDEFLAKFKTALEGIRQGDPLDMATQLGAQASKMQFDKVQSYLRLATEEGAEVLTGGSRSDAADLADGNFIKPTVFTNVNNSMRIAQEEIFGPVTSVITWSDEDDMMKQANNTTYGLAGGVWTKDIARAHRIARKLETGTVWINRYYNLKANMPLGGYKQSGFGREFSHEVLNHYTQTKSVVVNLQEGRTGMFDQ

SEQ ID NO: 4806 - protein, 511 aa, Myxococcus xanthus DK 1622
MLRVLTAAQMRQAEQAAEARHGMPSALLMENAGRGLAEVARGLIGSGGRFVVVCGPGNNGGDGLVAARFLREGGACVSVVMVGDAAKLTPEARRNVEAVKGFGVTPRTLEAVEPARRGDVVVDALFGTGLSRAPAGAFADAVSAIRGWRAAGAKVVAADVPSGLQSDTGAPFSPCVEADATVAFGFLKPGQVLEPGASLCGRVHRVDIGMGGESSKEVSGPEFFVVEESDARRTLPVRKADSHKGTFGHVLVVAGSRGKTGAAALVAKAALRSGAGLVTVAARADALDTIQAHSAEIMGIPLEASGPLGMGDLDALVAAAEGKDALVIGPGIPRGPETGALIGELLSRVEAPAVLDADALNAVATDLSVLRRAKGPVVMTPHPGEMARLTGKSTKEVQAHRLDVARQFSVGLKVTLVLKGDRTLTSDADGRVYLNTTGNPGMATGGSGDVLSGICGAFLAQSLPVPSAVWTAVYAHGLAGDLAAAKRGQLGLVAGDIVEQGLCEVWLRWER

SEQ ID NO: 4807 - protein, 541 aa, Candida glabrata CBS 138
MPVARESSRNSLSQMFLREESEELPMIATSSRMQNLIRIGKKYARFIGPGLMVSVSYMDPGNYSTAVAAGSAHKYKLLFSMFVSNLMAGFLQCLCARLGAVTGLDLAQNCKKHLPYGLNITLYILAEIAIIATDLAEVVGTAISLNILLGIPLPIGVVLTVIDVLIVLMAYKPNGDLKLIRYFELFVSFLVICTVICFAIELFYVKLGPASDIFKGFLPSKAVIEGDGLYLSLAILGATAMPHSLYLGSGVVQPRLRDYDIKHGYYSPDELDIDNNHQDYKPSLESVQETLHYTVAELLVSLFTIALFVNCAILIVSGATLFETPQDADIADLFSIYELLSNTLSKSAGTIFALALLFSGQSAGIVCTLSGQIVSEGFLNWTIAPALRRSLTRAVAITPCLILVMVSGRSGLSNSLYASQVVLSVLLPFVSAPLLYFTSNKNIMRIEMIDRKLPATSIFSTPGNVEQNKKKYGKVRLDEDEEEVIPLQDMETETETDQSQHQDQNIEYKDMSNSTFVNILAVTVWLLISGLNLYMLKNLDK

SEQ ID NO: 4808 - protein, 946 aa, Coccidioides immitis RS
MSKISVKTTFEASRAIRPIFTGGSLSLDESGRLLASCVGEDVLITDLETGEQLASIEGDGEPITSISITPSASHLAICSRSLAMRIFSLPRSQDSTFIQPELLRSLKPHTSPVVTTAIDSTGSLLATGSADGSIKVWDIKRGYATHTFHGHGGVVSALCFFESSAINGDNRKDGKKRKNKQKNSNPEFIPLEESTEQSEVTARFRLASGSEDGKIRVWDLFKRKGIASLESHVSVVRGLSFSASTNTLLSGSRDKTIITWDASTWEVKRIIPVLESVEAAGFLHEGFLCYTGGENGRLRIWDPSRGSEVTHDQEAASEQEGIVAVEYYPALPSILTVHVDQTLKFHSLAALSAFTLGTKTDALPVTRTIAGNDDEVIDLACVGPERSLLAMATNSEYIRIVSTKPTEATKEQNYFGADVARLEGHDDIIICIDVDWSGHWLVTGAKDNSAKLWRIDPASHSYTCFATFTGHAESLGAIALSRSPPPEDSAAFRDPLNHPPAFLVTGSQDRTIKRWDTGKLNAESSRPKAVYTRKAHDKDINALDVNHNATLFASASQDRTAKIWSLEDGSVLGILRGHKRGVWSIRFAPKDTPLINTKSAASTSRGLVATGSGDKTIKLWNLSDYSCLLTFEGHSNSVLKVLWLSPPRISSVDEDISSRGAAQVHPLVASAAGDGLVKIWSPYSGEVETTLDNHTDRVWALATPFPPSASPNSPSSNKLEPDFSLISGAADSTVTFWKDTTSTTLSAAVSANSARIEQDQQLQNYIHAGAYREAITLALQLNHPARLLSLFTTAMDTEPTSSQTLTGNPDIDTVIQSLSLDHLYLLLLRIRDWNTNARTSRVSQRLLFALFKSYPPSTFVELASRPNPMPARGKGAKEAELKDILHALSAYTERHYKRVEELVDESYLVEWVLGEMEGMEIDVDIADGDQNGDAFAGGKDVIMVGS

SEQ ID NO: 4809 - protein, 188 aa, Aquilegia formosa
LVNHGIPEDLLTRLREVGKAFFDQPVEEKEKFANDVASGKMAGYGSKLANGASGQLEWEDYFFHLAFPEDKRDMSTWPKTPTEYTEVTAEYATQLRSLVTKVLSLLSLGLGLEEERLEKEVGGMEDLLLQLKINYYPKCPQPELALGVEAHTDVSALTFITHNMVPGLQVYIDEKWVTAKCVPNSIIV

SEQ ID NO: 4810 - protein, 219 aa, Gloeobacter violaceus PCC 7421
MALLVMVRHGQSIWNLENRFTGWTDVPLTEKGRAEARACGELIYCVPFAVAFTSKLTRAQDTLRLILEAADQPDVPVIEDQALNERHYGELQGLNKAETAAKYGEETVRQWRRSLEGRPPGGESLKDTALRSLRYFYEKIVPELEAGKNVLVSAHGNTIRAILMELDHLSPEQVEKVEIEYCVPVAFEHQADGTFSQVLMPRCDIIRPPQPPARSIARL

SEQ ID NO: 4811 - protein, 920 aa, Roseovarius nubinhibens ISM
MSDTITFTLDGEQVTAEKGMTIWEVANGRGLVIPHLCHKPAPGYRPDGNCRACMVEIEGERTLAASCIREPADGMVVKTDTARAETARKMVVEMLVADQPPRDAAHDKSSHLWDMAEMQGVSQSRFPKLEEGRIPLLDDSHVAMSVNLDACIQCGLCVRACREVQVNDVIGMAGRGHDAYPTFDMADPMGASTCVACGECVQACPTGALMPSSVVNEAQVGDSADYDSEVESVCAFCGVGCQISIKVKDNRVKYVEGINGPANEGRLCVKGRFGYDYIHHQHRVTKPLIRRDDAPEKGLNVNPDNWQEFFREASWDEALDLAADGLKGRGREVAGFGSAKCTNEEAYLFQKFIRQGFGHNNVDHCTRLCHASSVFALIENVGSGGVTATFNEIENADVAIVIGANPIENHPVAATYFKQFTKRGGKLIVMDPRGVGLRRFATHMLQFRPGADVAMLNAIMHTIVEEGLYDQQYIDAYTENWEAEKAHLKDFAPEKMEDLCGIPAETLRAVARDFATAKSGMIFWGMGVSQHIHGTDNSRCLISLALMCGHVGRPGTGLHPLRGQNNVQGASDAGLIPMFLPDYQSVTDDGVRSAFTEVWKSEDFSNEKGLTVTEIMDAVHDGDIKAMYILGENPAMSDPDVEHARDALAKLDHLVVQDIFITETANYADVILPASALYEKTGTVSNTNRQVQMVRPAVTPPGEAREDWWIEVELAKRCGLDWRYTHPREVFAEMAINMASLNNITWERLEKTAVTYPSLSPEDPGQAVVFGDGFPRPEGRAKFTPASVIAPDDTPDAEFPMILTTGRQLEHWHTGSMTRRARVLDAVEPEANCSLHPSTLRKLGIEPGGMIRLTTKRGSIVTMARADRAVSPDMVFLPFAYVEAAANILTNAAIDPYGKIPEFKFSAVRVEPVSEQVAAE

SEQ ID NO: 4812 - protein, 522 aa, Arabidopsis thaliana
MPAGGFVVGDGQKAYPGKLTPFVLFTCVVAAMGGLIFGYDIGISGGVTSMPSFLKRFFPSVYRKQQEDASTNQYCQYDSPTLTMFTSSLYLAALISSLVASTVTRKFGRRLSMLFGGILFCAGALINGFAKHVWMLIVGRILLGFGIGFANQAVPLYLSEMAPYKYRGALNIGFQLSITIGILVAEVLNYFFAKIKGGWGWRLSLGGAVVPALIITIGSLVLPDTPNSMIERGQHEEAKTKLRRIRGVDDVSQEFDDLVAASKESQSIEHPWRNLLRRKYRPHLTMAVMIPFFQQLTGINVIMFYAPVLFNTIGFTTDASLMSAVVTGSVNVGATLVSIYGVDRWGRRFLFLEGGTQMLICQAVVAACIGAKFGVDGTPGELPKWYAIVVVTFICIYVAGFAWSWGPLGWLVPSEIFPLEIRSAAQSITVSVNMIFTFIIAQIFLTMLCHLKFGLFLVFAFFVVVMSIFVYIFLPETKGIPIEEMGQVWRSHWYWSRFVEDGEYGNALEMGKNSNQAGTKHV

SEQ ID NO: 4813 - protein, 505 aa, Novosphingobium aromaticivorans
MASGQLRYYAPMTSTSSSPVTETILNFIDGSYRKGSEGKSFPNVNPATGTAIGVVHEASQADVADAVAAAKAALTGPWGKMTTAERVKLIAAVATEIERRADDFLAAEVADTGKPRHVASHIDIPRGAANFRMFADVVSTMPGESFNTSTPDGGQALNYTVRKPKGVVAVVCPWNFPLLLMTWKVGPALACGNTVVVKPSEETPRTAALLGEVMNAVGMPKGVYNVVHGFGPGSAGEFLTSNPDVDAITFTGETGTGQAIMQKAAIGVRDISFELGGKNPAIVFADADLDKAVEGLSRSVFLNTGQVCLGTERVYVERPIFDAFVARMAAAAQGFKPGVTGDRAYLGPLISAEHREKVLGYYRRAVEDGATVVTGGGVPEISGAEAGGFFVEPTLWIDVAHGDTVMREEIFGPCCGIVPFDSEDEVIALANDTVYGLCASIWTENMSRGHRVAAAMDVGVCWVNSWFLRDLRTAFGGSGHSGIGREGGVHSLEFYTEITNICVKL

SEQ ID NO: 4814 - protein, 247 aa, Zea mays
  misc_feature (120)..(120): Xaa can be any naturally occurring amino acid
MMLANKLGGLLKNATSSKSSNMSVYQAIRCMSSSKLFVGGLSYGTDDHSLRDEFAKYGQVIEAKIILDRESGRSRGFGFITYTSSEEASAAITAMDGKTLDGRNIRVNHANERTGGFPQXGGYGGGGYGGGGGGYGGGGYGGGYGGGSGGYGGGGSGDYGGGSGGYGGNYGNRAGGGYRLCRRLPHLLPPTPPPHPPPPAPHAPPLPPPPPPLPSPPPAPLPPLPRPSPAPPPPPPRPPAPPPPPPP

SEQ ID NO: 4815 - protein, 715 aa, Salmonella enterica subsp. enterica serovar Paratyphi A str.
  misc_feature (140)..(140): Xaa can be any naturally occurring amino acid
MKKVVTVCPYCASGCKINLVVDNGKIVRAEAAQGKTNQGTLCLKGYYGWDFINDTQILTPRLKTPMIRRQRGGKLESVSWDEALNYVAERLSAIKAKYGPDAIQTTGSSRGTGNETNYVMQKFARAVIGTNNVDCCARVXHGPSVAGLHQSVGNGAMSNAINEIDNTDLVFVFGYNPADSHPIVANHVINAKRNGAKIIVCDPRKIETARIADMHIALKNGSNIALLNAMGHVIIEENLYDKAFVASRTEGFEEYSKIVEGYTPESVEEITGVSAQEIRQAARMYASAKSAAILWGMGVTQFYQGVETVRSLTSLAMLTGNLGKPSAGVNPVRGQNNVQGACDMGALPDTYPGYQYVKFPENREKFAKAWGVESLPAHTGYRISELPHRAAHGEVRAAYIMGEDPLQTDAELSAVRKAFEDLELVIVQDIFMTKTASAADVILPSTSWGEHEGVFSAADRGFQRFFKAVEPKWDLKTDWQIISEIATRMGYPMHYNNTQEIWDELRHLCPDFYGATYEKMGELGYIQWPCRDTSDADQGTSYLFKEKFDTPNGLAQFFTCDWVAPIDKLTEEYPMVLSTVREVGHYSCRSMTGNCAALAALADEPGYAQINTADAARLGIEDEALVWVHSRKGKIITRAQVSDRPNKGAIYMTYQWWIGACNELVTENLSPITKTPEYKYCAVRVEPIADQRAAEQYVIDEYNKLKTRLRESAMG

SEQ ID NO: 4816 - protein, 112 aa, Zea mays
MVRVSVLNDALKSMYNAEKIGKRQRHGYIGEFEYVDDHRSGKIVVELNGRLNKCGVISPRFDIGVKDIEGWTARLLPSRQFGYIVLTTSAGIMDHEEARRKSVGGKVLGFFY

SEQ ID NO: 4817 - protein, 195 aa, Oryza sativa
MVDRYCTLLRSKHSSLCSACENITSEAVNFLSEKQIQDKIRTILHDTCSQTFSFEQKCLETMDSYATLVFAKMAEIKPDEFCKQYGLCRDMALLSAMKSESTCVFCHHIIDEIMSKLKDPDAEFEIIQLLLKECNKIEGHQQQCKRMVLQYVPLVLVNGEKFLEKNDVCAMIQACDAGKRKAFNLFSARKLVRDA

SEQ ID NO: 4818 - protein, 413 aa, Pyrococcus abyssi GE5
MKAVILAGGFGTRLRPISSTRPKPMVPVLGKPNLQYILEALEKVKEIDEVILSVHYMRGEIREFIQEKMRDYPKDIRFVNDPMPLETGGALKNVEEYVSDDFLVIYGDVFTNFDYSELIEAHKKNDGLVTVALTKVYDPERFGVVITDEEGKIVEFEEKPRKPKTNLVDAGIYMVNKDVLKEIPKNKEVYFEREILPKFVSQGLVYGYKMPKHYYWVDLGTPEDFFYAHQIALDEMARENGYMILGENVEIPEDVEVQGPVYIDDNAKIGHGVKIKAYTYIGPNTMIEDKAYIKRAILLGNDIIKERAELKDTILGEGVVVGKNVIIKENAVIGDYAKIYDNLVIYGAKVLPWKKVEEYEAYIRIKLDPAKVRPELTPDRCPLGLPECIYKKFKAIAGEKPPCDECIENQWLF

SEQ ID NO: 4819 - protein, 463 aa, Yersinia pestis CO92
MELPVKNKLKRGLTTRHIRFIALGSAIGTGLFYGSADAIRMAGPSVLLAYLIGGVVAFVIMRALGEMSVNNPQASSFSRYAQDCLGPMAGYITGWTYCFEILIVAIADVTAFGIYMGLWFPDVAHWVWVLSVVLIIGAVNMMSVKVFGELEFWFSFFKVATIIIMILAGIGIIVWGIGNGGQPTGIHNLWTNGGFFSNGFVGMLLSLQLVMFAYGGIEIIGITAGEAEDPKKSIPKAINSVPWRILVFYVGTLFVIMSIYPWNQVGTNGSPFVLTFQHMGITIAAGILNFVVITASVSAINSDVFGVGRMLNGMAEQGHAPKAFTAISKRGVPWVTVLVMMCAMLIAVYLNYIMPENVFLVIASLATFATVWVWIMILFSQIAFRRSLSKDQVKALDFPLRGGTFTSVLAIIFLVFIIGLIGWFPTTRISLYVGLVWIVLLLVGYYFKVKYQKKQATLIKNAD

SEQ ID NO: 4820 - protein, 564 aa, Synechococcus sp. WH 5701
MPSPSVASTGEAARSITPQRITDDLDRLLEVLPERVGEALASPLSRDQLLEVVLDLGRSPEARYPGRAQLLDQRPIDRADLAAVVQRLGSFGGDNRAGIERTLHRISAIRNRGGEVVGLTCRVGRAVFGTVAMVRDLLDSGQSLLLMGRPGVGKTTALREIARVLADDLERRVVVIDTSNEIAGDGDIPHPAIGRARRMQVARPEQQHQVMIEAVENHMPEVIVIDEIGTELEAQAARTIAERGVMLVATAHGNELANLIKNPTLADLIGGIQSVTLGDEEARRRGSQKTVLERCADPTFPLAVEMHSRSRWLVHRDVARTVDQQLRGQPVRPQVRELGSDGRLRLNDPEPGPPSPRMPRRGLVAAGDSPAPSPALAPVPLPDPELLPPHRRSAPPAPAAPPLRLYCCGVSPQLLEQVVRSRQLPVQRASQVEEADAVLSLRQQLGREPQVRSQALEQHVPILVIKADTLPQIQRGVERLLRRRGGDGSGVSTGPASAPDDAHGAMEECRLAVEQVVLRQGRPVELLPRSPSVRRIQADQVNGYGLRSAEFGSGDLQRLRVFPP

SEQ ID NO: 4821 - protein, 125 aa, Oryza sativa
MAAANLLSRALLPALNPNPSSHSNRVSPSADGRAPKRCFRRGADGHLYCEGVRVEDAMGAAERTPFYLYSKPQVVRNFTAYRDALEGLRSIVGYAVKANNNLRVLQLLRELGCGAVLVSGNELRL

SEQ ID NO: 4822 - protein, 249 aa, Synechococcus sp. WH 5701
MTPSPLLVFDFDGVLVDGMAEYWWAARQAALRLRPDLNLPEQAPAAFVRLRPLIHKGWEMVLVAAELALSSSDLTAPGAAYGPALAPALSHWGWSPEILQTSLEAVRRDAIAADRPHWLALHRPYPEVPQRLRSLAAEGADWAVLTTKGGAFARELLAAQGLAPLHTFGHEDGSKPEVLLRLRELQRPLWFIEDRRPTLEAVRATAGLEAVRCFLVSWGYLGPHDLIDLPEGLALLDPATFAAPLATWP

SEQ ID NO: 4823 - protein, 633 aa, Bradyrhizobium sp. BTAi1
MNIRSNPDTTLPAVTTGPLPSSRKIYAAPDSAPDLRVPLREIILSEAAGEPNLPVYDTSGPYTDPSVTIDVNAGLPRNRTAWVLERGGVEEYEGRDIKPEDNGNVGADKAAKAFIAHHKPLRGLDGHKITQLEFARAGIITKEMIYVAERENLGRKQQLERAEAALADGESFGAEVPAFITPEFVRSEIARGRAIIPCNINHAELEPMIIGRNFLTKINANIGNSAVTSSVEEEVDKMVWAIRWGADTVMDLSTGRNIHTTREWILRNSPVPIGTVPIYQALEKCNGDPVKLTWELYKDTLIEQCEQGVDYFTIHAGVRLQYIHLTASRVTGIVSRGGSIMAKWCLAHHKESFLYTHFDEICDIMRKYDVSFSLGDGLRPGSIADANDRAQFAELETLGELTKIAWDKGCQVMIEGPGHVPMHKIKINMDKQLKECGEAPFYTLGPLTTDIAPGYDHITSGIGAAMIGWFGCAMLCYVTPKEHLGLPDRNDVKTGVITYKIAAHAADLAKGHPAAQLRDDALSRARFEFRWTDQFNLGLDPDTAKSFHDETLPKEAHKVAHFCSMCGPKFCSMKITQDVRDYAATLNDPTTVGVTISGTIEDGMAQMSAKFKEMGGSVYLDADKVKESNKALS

SEQ ID NO: 4824 - protein, 903 aa, Kineococcus radiotolerans SRS30216
MGELGGARDGLHGADLVVGPHQGDQRDVVGVAQGGLERVGVQAPGPVHGQPGDQCALVGLQPPHAVQDGVVLGGGEQDPPARGVGGPAGAQQPLEGEVVALGAPGGPDDLPGARAEGRGEGLAALLHRDAGPAAGGVQRGRVAGAAGGSGHEGLQRFRTQGRRRGVVQVRAHTGQSKDWHTAPVPVPTHRESPTGSRTSRAHPLGVTLRGDGADVAVLAAHADAVEVCVFDDAGRETRTRLPDVELGVWHGHVPGLVAGSRYGLRVHGRWDPERGLRHNPAKLLLDPYAQGVEGEVALTPEIFGHVVDEDLEGDLAVADPRDSAPHVPRGVVLAPLPADLRVGEDERPRTPWADTVVYEAHVRGLTRRFPGVPEAERGTYAALAHPAVLEHLTSLGITALELLPVHTSTSEIALRRRGLSNYWGYNTLAFNAPHPGYATAAARAAGAEAVRAEFRRAVAALHGAGIEVVLDVVYNHTCEEGPDGPHLSLRGLDDATYYLRDAGGRPLDVTGCGNSLDFTDRRVVRFALDSLRHWVTEYGVDGFRFDLMTTLARGHDGYSPDHPFLVALGADPVLAGTKLIAEPWDVGPFGWRTGQFPPPLHEWNDRFRDGARRFWLSDAREIACGRSAPVAPGRGLPELATRFAGSADTFDVQRGRLTSVNFVTAHDGFTLADLTAYDRKHNEANGEGNRDGSDSDTSWNHGVEGGTTDPGVLAARRRSVRNLFATLVLSTGVPMITAGDEFGRSQGGNNNAYCQDNEVGWIDWDLQDWQRELLDDVRELLALRRRYPVLREAGVRRGSPVREQRSDLLWFSEDGEPMSVERWHEADRRVLQLLVDGRDRGETSVLVVLNGGPRRLDVVLPAVEGLAAFSPRWASTPGRAAGSCAAGAALPVDPWSVRVLATD

SEQ ID NO: 4825 - protein, 479 aa, Oryza sativa
HQEMIHAAAAPAMYGGGAAAGGATTTTGSHGGGGGDWWSAAVSSCSAPAPETMQGFGGWSAAVVAVDGGGNTSRSAAGNTASSESPGSLATGSSITFQEPAGGVADPAAIAVHAQTVAGGGGGGWNQQPFLDGSGFHGYMSSSRNDHHTNHHHHQINTPSLMSNSSSNNGVMLQEHQHDQNYQFLSNLGFELLSSPTSPYGGGGGFRSSLLRSLTEPAAAAKPNDSPGFQQYHHHQPAMNLQPPAAAAGREPLQFTNSTAAPFWNPSSRFTVAAEGTALGGAGASPAQPTPASLAAKRALEGVGDSSSIITKKAKADSTPLKKSRTGTPSPLPTTFKACVYIYIIFNLSQMVIDFLPIKFHVRKEKLGDRVTALQQLVSPFGKTDTASVLHETIEYIKFLHDQVGALSAPYLKNRQQVPHLKNSTGVDNDGGGGGGEATAASKRDLTGRGLCLVPISSTFAVASETPVDFWTPFGAAFR

SEQ ID NO: 4826 - protein, 467 aa, Listeria monocytogenes EGD-e
MLYSEDDKRKQESYRIPLFGSEEESTSIPKYVLKKEPMEPRIAYQLVKDQLMDEGNARQNLATFCQTYMEKEAEILMAETLEKNAIDKSEYPQTAELENRCVNILADLWNAPKDMSYLGTSTVGSSEACMLGGLAMKFRWRNNAEKRGLDIQAKRPNLIISSGYQVCWEKFCVYWDVDMRVVPMDKNHLSLDVDKVFDLVDEYTIGVVGILGITYTGKFDDIQLLDEKVEAYNETNEHQLVIHIDGASGAMFTPFVNPELPWDFRLKNVVSINTSGHKYGLVYPGVGWILWKDKEYLPKELIFEVSYLGGSMPTMAINFSRSASQIIGQYYNFLRYGFEGYREIHEKTKKTAIYLAKTVEKSGYFEIINDGANLPIVCYKMKEGLDVEWTLYDLADQLLMKGWQVPAYPLPADLSDTIIQRFVCRADLGYNVAEEFAADFADAIHNLEHARVLYHDKERNDSYGFTH

SEQ ID NO: 4827 - protein, 259 aa, Helianthus annuus
ANYGGDKQYGRETRHTGDYENPIHSTGGQYEREVLQTDEYGNPVRRTGQTDEYGNPVRRTDEYGNPVHSTTGGTMGDYGSTGLGQGTGTGGIGTGGYGTTGHHGLGTGVGHTTGGTGTDYTSGGRSTGQTGYQGLGTESEFGGKTGTFQNQPSATPVGGVGLSSGAGAGVGGTGTGTGILHRSGSSSSSSSEDDGQGGRRKKKGVMQKIKEKLPGGHRQEEQYQSQTTTTTTGGGAGYGETHEKKGMMEKIKEKLPGHH

SEQ ID NO: 4828 - protein, 376 aa, Pythium splendens
MADEDVQALVVDNGSGMCKAGFAGDDAPRAVFPSIVGRPKHLGIMVGMDQKDAYVGDEAQSKRGVLTLKYPIEHGIVTNWDDMEKIWHHTFYNELRVAPEEHPVLLTEAPLNPKANRERMTQIMFETFNVPAMYVNIQAVLSLYASGRTTGCVLDSGDGVSHTVPIYEGYALPHAIVRLDLAGRDLTDYMMKILTERGYSFTTTAEREIVRDIKEKLTYIALDFDQEMKTAAESSGLEKSYELPDGNVIVIGNERFRTPEVLFQPSLIGKEASGIHDCTFQTIMKCDVDIRKDLYCNIVLSGGTTMYPGIGERMTKELTALAPSTMKIKVVAPPERKYSVWIGGSILSSLSTFQQMWISKAEYDESGPSIVHRKCF

SEQ ID NO: 4829 - protein, 257 aa, Helianthus annuus
ANYGGDKQYGRETRHTGDYGNPIHSTGGQYEQEVLQTDEYGNPVRRTGQTDEYGNPVRRTDEYGNPVHSTTGGTMGDYGSTGLGQGTGGIGIGGYGTTGHHGFGTGVGHTTGGTGTDYTSGGRSTGQTGYQGLGTESEFGGKTGTFQNQPSATPVGGVGLSSGTGAGVGGTGTGTAILHRSGSSSSSSSEDDGQGGRRKKKGVMQKIKEKLPGGHRQEEQYQSQTTTTTTGGGAGYGETHEKKGMMEKIKEKLPGHH

SEQ ID NO: 4830 - protein, 261 aa, Candidatus Desulfococcus oleovorans Hxd3
MCLILIANRYRADYPFILAANRDEFYDRPTAVLDFWEDAPRVLAGRDKKAGGTWLGVTTTGRFAAVTNFRDPRLANPAAPSRGALVSDFLSGTTAPDQYLLDLQQENRPYSGFNLVAGTLDDGLFYYSNREQQVRRISPGLHGLSNHLLDTPWPKVETGRNRLKGLLSKGKAFSPDDLLEILHDTTMPPDNRLPDTGVGIAWERVLSPMFIRSPDYGTRSSSVILIDGEGRGLFVERTFEPGAGDRLKTQDKRISFQVGHA

SEQ ID NO: 4831 - protein, 257 aa, Helianthus annuus
ANYGGDKQYGRETRHTGDYENPIHSTGGQYEQEVLQTDEYGNPVRRTGQTDEYGNPVRRTDEYGNPVHSTTGGTMGDYGSTGLGQGTGGIGTGGYGTTGHHGLGTGIGHTTGGTGTDYTSGGRSTGQTGYQGLGTESEFGGKTGTFQNQPSATPVGGVGLSSGAGAGVGGTGTGTGILHRSGSSSSSSSEDDGQGGRRKKKGVMQKIKEKLPGGHRQEEQYQSQTTTTTTGGGAGYGETHEKKGMMEKIKEKLPGHH

SEQ ID NO: 4832 - protein, 253 aa, Helianthus annuus
ANYGGDKQYGRETRHTGDYENPIHSTGGQYEQEVLQTDEYGNPVRRTGQTDEYGNPVRRTDEYGNPVHSTTGGTMGDYGSTGLGQGTGGIGIGGYGTIGHHGLGTGVGHTTGGTGTDYTSGGRSTGQTGYQGLGTESGFGGKTGTFQNQPSATPVGGVGLSSGTGAGVGGTGTGTGILHRSGSSSSSSSEDDGQGGRRKKKGVMQKIKEKLPGGHRQEEQYQSQTTTTTTAGGAAHEKKGMMEKIKEKLPGHH

SEQ ID NO: 4833 - protein, 317 aa, Oryza sativa
  misc_feature (75)..(75): Xaa can be any naturally occurring amino acid
MPPLNPPHLHFGKLRKRARAVAAGGGRQPAAAMAKKGLVGSLYKLRDVHHRAPPTPTSPSSSSSPHCHGRHQLCXQGQADDDAAAAAGSVYRTVNTVYDTSSLEHFNPRRSSLDEASSCIADRSFFAVESEVEVEEEKEKEKELQLRETAVVRGVRSERLFFEPAGAEFLPKQEMARGKNDDEATAMDVVARKNDDVDEATPMTTPQTGKNEAEAAEAAALKGGAVVLTVESEDPYGDFRSSMADMVAAHGLRDWEGLEELLAWYLKLNAKGVHGVIVGAFIDMLVSLASSPIPSQSPSSSCITFEDYSSATMEEES

SEQ ID NO: 4834 - protein, 490 aa, Novosphingobium aromaticivorans
MGVTIPPLERSDFLTGQPLVDGTEICAGSTYAVTNPATGKTLANVVKLGAAQTRRAIESNSRALIDWRKRPAQERARLLHDWLALVRLHRHDLGLLMTAEQGKPLAEALGEVDYAASFIQWFAEEARRVYGEVIPASADRRIVVIRQPVGVAGAITPWNFPAAMITRKVAPALAAGCTVTLKPSELTPMTAFALAKLAREAGVPPGVFNVVCGDAPEIGSVLTSHPDVTKFTFTGSTAIGKLLTAQCAATLKRVSMELGGNAPLLVFDDADLDQAVEGAIASKFRNTGQTCVCANRILVQSGIHDRFVEALAARVSAFRVGNGLEGATDQGPLITASALAKVQGHVADAVAQGAQLVTGGKRHEAGELFFQPTVLTGARPAMRLADEETFGPVAPVFRFETEAEALALANATHSGLAAYAFTRDIDRAWRVSEGLETGMVGLNSGIVSTETAPFGGIKESGLGREGSRHGIEEFLEMKTISVGVRPESPV

SEQ ID NO: 4835 - protein, 193 aa, Brassica napus
MVLWEITLGTAYFLGLRRTYRLALKIQRRIVSPKHPKIRQFLHRRTRKIFDVAVSVHKNIQHRDIEVGRNLGNWILRWLDRMKPAAQIRTRPEPNSNVDKAKSLSESSRPKSNTTQSPQKRESDRHLFSSLKHFQHSPTVSTMIQPPRPNGITTQFRHYSAGAAASLIPPSYVRGSGFDGVIRKDILQWMLQR

SEQ ID NO: 4836 - protein, 165 aa, Glycine max
  misc_feature (42)..(42): Xaa can be any naturally occurring amino acid
  misc_feature (54)..(54): Xaa can be any naturally occurring amino acid
  misc_feature (84)..(84): Xaa can be any naturally occurring amino acid
  misc_feature (126)..(126): Xaa can be any naturally occurring amino acid
  misc_feature (148)..(148): Xaa can be any naturally occurring amino acid
  misc_feature (153)..(154): Xaa can be any naturally occurring amino acid
GLHGSIFSQTIRHSIEISLYLLPQGKNSTVLADKGFSKAGAXSSSYLPATTESXALANEAKDPSEAISILYRVLDDPSSSPDAXRMKEQAITNLTKLLTDENRGEDLCSLLTQLRPFFSLIPKAKXAKMVRGIMDSVAKIPGTSDLQXALCKXXMVLWTRAEKRT

SEQ ID NO: 4837 - protein, 1255 aa, Coccidioides immitis RS
MASSPSSDAICQALLRFITDGKFPDSEDLVSTEFPLEIIPTELQEITTAKKEIENEISTLSRETATNIDDWIVQAKKLHQDIERSRLTAREIVTLHEKGRALRDRVSDAQSAVDQLHEDIVSNEAILETLGQARLIDNKLANAQLALDRGEWIRSIDLLDDIGDSLASSKLPQSSNIVGLLSTKVTQLHAGISNALRAEWSTLIKIDATSDQPTITIHSSDHFPDILAGLTRLQVLDDVVSSFQKDLINYILRPVIFPVKTGQWRIFSVDGNCLRLVLAPSRPLLSDLLNSILSAFSYLKENLPSNILECLFTTLAGTIVSPLTTKWLSPSVPSEVSSLEPFQGTLDRIHRFVSDLEKQGWQGLEGLGAWVGQVPRLWLSQRRSKALNDVRLAMSHSTGKIRKVERIEKQHVSGDNGMLVEGNGEDDWNAEWSDNEDEDTLKSTTIKTTSEETENQADPGNEDDADESWDWDDDNEEPPAAAQPEASSELNSQAKGHGGDHKDSQRELILKEYYAVTDLPDRILTIISNQVADAEDLTNLGSSQLKLASSRPALLALPTLIVAMFKATAPVLYSHRFDAGQMHLYNDCMYLAEKLRSFSEAQNLPKLSSDVESIEKFGKAAYGKELQSQRTILSDLLDGCQGFSTCSEEPFLGECKNAMAAAVDRVRDVYKEWQPILSRSALLQSMGRLISAAINKLILDIEDLSDISDAESRRLAEFCTSLSNLEDLFLPDPSTDPNAANQPEAIPMTAMYVPNWLKFQYLINILESSLADIKYMWTEGELKLEFDVDEMAEESSLEVQSQTAQTQARLRFSTRDEDLALPESTGPILVPTGLRRYALSTLVNNLLATEKPVPLEFLINGTYLRTSVDEFLTANGISAETTLDVEYVRALIPPLHVASFLHDDWVSSVDVLSDSQNEERIISASYDGLLRVWNMSSEIIHTSASAKDGGHQSAIKCVRFLSASQIVSSGIDRTVRLWKYTDQEKGITPQIEYYGHKGSVDSIAVHGNRILSASADHTVGFWSTKKSESPAVPQNLLPSSSARSSKRRKLNSSASTSQRGPLALLKGHTAPVSAAIFDAKDSTVGYSTSWDHSLRTWDLVTAALVDTRTTSHSLLCAQHLPEHTLLAAGSAARHVTLIDPRASATTVSAMTLRGHTNAVVCLARDPDSTYGLISGSHDGTSRIWDIRSTKTDTDGVVSESIYTIARKSAGEGKRVGGDGVKVFDVCWDKKVGIVSVGEDKVIQINRGEGVVPKTA

SEQ ID NO: 4838 - protein, 1402 aa, Candidatus Desulfococcus oleovorans Hxd3
MTLKSKALEVNLASYHVDVSIEDRYMVLRDVMADFQGLAERLDTFLKELSHPYRNWRFIVSEARTFSLDYFYQLRNHAKGPQAADLYVKIFAGAISAAQQMQVKVDAADNLLLFLQKAAKEGGADMAPVLQAGIDTIARLEGESFSFFINSYYQLTDVAAAMLKGGAADLLDAARLGRLLEKYLVAVCRCWQQEKDSLAWLKKEIGWTAPATPAQEEVVALVSGVSHNAISQMLVRIRQLETKTPDSRERCRQLAQLPGYEFFVSAYRNLPDALYAAGVDTGNGHQWKLLALFLVLNMSSLSGLHEEALREINTTLTYLISSSDIKKSREWIKRTFQVLQDQTARFPATALNCVRNVGESVYKTGDAELVSYFIDGVIGLGFHAPMVEGVDNDWKIKANKAHIQNIRAWLALIRENPQRSSRLLSALIVHLTLEGVFIRDTDLFPRDITELLNSDIGPVYNMVKQFARLLPVFFNDIGAEGALRDISTELDEICHRKDVLVHFLRKQGHVEGSNRLIPFMEAAIAFWLTKDKTGLRAFLPPDMYEQVRESGPYVDQMHALFSHLADSGVDLPRGLLALDAEAVAALCEKVPAAPDRERRRVVLVTEFYKLLDQKYTINPSDVEGYVARLNTVDFPDLKELKRAFAESKAKNKATRLITYLEQLKALILSDERFEIEQNIYEKRHIAVDIPSMYGSYRETKFDALGLTFRLEALLNVLFEEIVNDIDLGLITKTTFFQIYNCLRLFVRALAVDGFSTKEIELQLDLLSQGINTRGFSFTQFLDIFKRFATAVKHIIADHFHNRHAKNLRTILSGQPSGVVLPKYLPGDGSRSADMDHDKLTHRVSEIFFREKIALSLGLPQLDLLLTRVLNVLFHQANTLPAERLERLLNYDPARTIAAIDVRETKKYGIIHLGNKGFNIIKLSGYGYPVPPGFIITTEVFRCRDIMDAYAPAEEIFRQQMAHHLKHLEKSAGRKFGDPANPLLLAVRSGAAISQPGMMDTALNVGMNEEITQGLAQQTRNAWFAWDSYRRFLQYYGMAFGLKRDDFDAIIREHKARRSIPLKRYFSGDQMRQVALDYKKMLEDCKIKVAENPFDQLYVTVKNVFASWYSQKAENYRKIVGISDDWGTAVTVQSMVFGNLSRQSGSGVFFTHSPRMPGDTPRLWGDFTIGNQGEDVVSGLVNTLPISVMQKEAEQRRTDITLETHFPEIYAALKQWVDELIYEHGWNPQEMEFTFEGPTKSQLYFLQTRDMTIRESKNITIFDPDDVLESDRFLGQGIGVSGGAMSGRIVFSLEEIDKWAMVEPDTHLILIRGDTVPDDIREISGTDGLLTARGGLSSHAAVLAHSLGKTCVVGCGALVCDEVKKTCRFHDVVLNAGDYISLDGAEGSVYSGFLKTRKVEAYL

SEQ ID NO: 4839 - protein, 479 aa, Arabidopsis lyrata subsp. lyrata
KGEEFTCEENEPFTCDQTKLFNSGSFEKDFIFGVSSSAYQVEGGRGRGLNVWDGFTHRFPEKGGPDLGNGDTTCDSYTNWHKDIDVIDELNATGYRFSFAWSRILPKGKRSRGVNEGGIDYYNRLIDNMIARNITPFVTLFHWDLPQTLQDEYNGFLNRTIIDDFKDYADLCFEKFGDRVKNWITINQLYTVPTRGYAIGTDAPGRCSPKIDKRCPGGNSSTEPYLVAHNQLLAHAAAVDVYKTKYKDQGGKIGPVMITRWFLPFDDTPESKAATERAKEFFHGWFMGPLTEGKYPDIMRKLVGKRLPEFTETETALVKGSYDFLGLNYYVTQYAQNNDAIVPPDVHTAMMDSRATLTSRNATGHAPGPPFAKDSYYYPKGIYYVMEYYKNKYGDPLIYITENGISTPGDESFDEALADYKRIDYLCSHLCFLSKVIKEKAVNVKGYFAWALGDNYEFGNGFTVRFGLSYIDFANVTGD

SEQ ID NO: 4840 - protein, 1170 aa, Vibrio fischeri ES114
MMKITIDKQTFTIDEEITLLAAAKECNVEIPSLCGNNINGEKVPCDLCVVEIEGQGIQRACETQAVDGMQVITSSEALVKRRQSALNKILSDHYADCEAPCQTACPAGVDIQSYLYHISQDNHQKAIEVIKRTLPMPLSIGRVCPAFCEAECRRGLVDEPLAIRQLKRHAADVDLHAQESYVPPKKADKGKSIAVIGSGPGGLTCGYYLTNEGYSVTVFESMPKAGGWLRYGIPEYRLPKSILDKEIELMCRNGMEIQTSVKLGEDFSLTQLSDEYDAVCLAVGASKAVEMHYQGSELGGCYLGVDYLKDYVTESKLTTGKKVAVIGGGNTAIDCARTAVRDGADTTLIYRRTREEMPAEDYEVVEAEHEGVKFHFLTNPVENIADENGRVAQVRLEKMALGEPDASGRRSPQATGEFFIEEFDTVISAVSQKPDLSFLENDTIDLPLTRWNTADANSLTMHSGVKNIFSIGDFRRGPATAIEAVADGRIAAEAIDRFFNGDMEKIPTKPFNSQKEKKTKQVDPKHFEHIQKAMRVIMPELTAEQREQSFDEVETGFDNLDAIREAERCLECACQANTNCGLRDYATEYKADETDLSNESKQKFAIDTSSEFIVFDANRCISCGQCVEACNEKGVHGVLSFMKNEDGTNASRPECRAGFEHGYQMGNSNCVQCGACVQACPVGALVDSRDKSQGRIEVLKPVDTICTYCGVGCKLTMMVDESTNKIKYVQGAKSSPVNEGMLCVKGRFGFDFVSSDERLKTPLIRKNGELVPASWEEAITLVADKFSTIKSQHGGNALAGFSSAKTTNEDNYAFQKLVRREFETNNLDHCARLCHSTTVTGLEASIGSGAMTNDIPSIKHSDLIFIIGSDTTSAHPIIASHIKQATRHHGARLIVADPKQVDISDHAELYVAQRPGTDVMLLNGIMQQIIKNNWHDQAYIAERVEGFDELKAEVMSEAYSPEKIELITGVKAQDVIEMARYIGTAKRTAIYYSMGITQHTTGHDNVRSIANLQMLCGNIGIEGGGINPLRGQSNVQGACDMGALPTDFPGYQKVENPAVYEKFVKAWNKPTLPSKKGLTLTEIIDAACHEQVKGLFVMGENPVLSDPDQAHVIHGLEKLDFLVVQDIFMTETAAYADVILPSCSFAEKAGHFTNTERRVQRISPAVNPPG

SEQ ID NO: 4841 - protein, 489 aa, Pseudomonas putida GB-1
MSHQSLFIAGQWREPHSGRYREILNPANESLLALAPEAGAQDVDAAIDAARHAFDHGPWPQLPPSERSAWLLRIAAAIEADAAQLARLETLNTGKTLCESEADMACVVATFRYYAGLLEARTDRAHPHAPDHVISVTRHEPVGVCALIVPWNYPLLQTAWKLAPALAAGNTVILKPSELTPLSALHLTALLAALALPAGVFNLVCGDGTVGHHMALSDRVDMVSFTGGAQAGAKVMQAASGNFKRLALELGGKNPNIVFADADLDVALDQALNAVFFNAGQVCSAGSRLLLQASVHDRFVARLVERIDAIVLGDGFDSRTRMGPLISAAQRNRVLSLIQAAQGEGARLRAGGQRPTDAHLEKGFWLRPTLLSDVQADMRIAREEIFGPVITVERFTDEAHAVRLANDTPYGLAAGVWTGDLGCANRMARRLRVGTLWVNDYNLAFPQAPWGGFKASGIGRELSATGLEEFSELKHVLLNCEPRALNWFT

SEQ ID NO: 4842 - protein, 156 aa, Zea mays
  misc_feature (146)..(146): Xaa can be any naturally occurring amino acid
MAEEKKVAPTGVWTAVKPFVNGGASGMLATCVIQPIDMIKVRIQLGQGSAVSVTKNMLKNDGIGAFYKGLSAGLLRQATYTTARLGSFKMLTAKAIEANDGKPLPLYQKALCGLTAGAIGACVGSPADLALIRMQADNTLPLAQRXNYTNAFHALY

SEQ ID NO: 4843 - protein, 385 aa, Arabidopsis thaliana
SGETTTSSNMKKKKKKVSSTTNPSLPDDLVLVIIARVSILYYPILSLVSKSFRSLLASPELYKVRSLLGRRESRLYVCINMYSYKNGPSWFTLCRKPDRTTTSSNKEEDRSSGYVLARIPIPHSPLTQRYSLAAVGSNIYNIGVTRYHHLTSSSVWVLDCRSHTWRQAPSLPVELFRVSVSVLDQKIYVAGLHQEDGSDSLKNSVTVLDTETQVSDRVAIPCSVSQGKEIFISTSVGGKVNLVTGRKVVDYNPVEGSWEEVGDTMCEFMFSKCFCVVGNVLYSCAIDRVFRWYDTEVRTWRNLECLIGGRLPKLSPRAFVSLADYGGKLAVFWNQGVGDWQMLWCAVIALERRNTCEILGNVEWSDHVLHVPKIRSYYNALSATL

SEQ ID NO: 4844 - protein, 478 aa, Burkholderia sp. 383
MKIYDQFYIDGAWRKPAGTGTIDVIDSGTEAVIGRIPEGVASDAQDAIRAARAAFDAWAATPPATRAGYLRKIVEHLLARSEELAQSITGEVGMPIKLSRAIQVGGPIYNWKAYAKLAESFEFEAQVGNSLVVREPVGVVAAITPWNYPLNQVTLKVAPALAAGCTVVLKPSEVAPLNAFMLAEAIHEAGLPAGVFNLVCGYGPVVGEVLATDPDVDMVSFTGSTRAGKRVAELAAAGVKRVALELGGKSASVILDDADFATAVKGTVNACYLNAGQTCSAHTRMLVPEARYDEARAIAKAAAETYVAGDPRQDATRLGALASAVQQQRVQDYIQRGIDEGAELVTGGTGLPEGLDKGFFVKPTVFGRVDPKSTIAQEEIFGPVLSIITYRDEDEAVRIANDSPYGLGGAVWAGSDERAMGIARRIRTGQVDINGGAWNMAAPFGGYKQSGHGRENGVYGLEEYLEYKSMQLKPAKPA

SEQ ID NO: 4845 - protein, 159 aa, Oceanobacillus iheyensis HTE831
MTLFSNFPLWAALCAIVFAQVIKIPIKLIFTKEFQPGLAFSTGGMPSSHSAAVTALTTAIGITEGVTSSVFALACIFSVITMFDASGVRRQAGEQAVVINQLIRDFQLITTSAKDWNKKGETEKLQELKELLGHQPIEVFFGALTGIILAFSIAPLFSY

SEQ ID NO: 4846 - protein, 403 aa, Oceanobacillus iheyensis HTE831
MNKPHIVILGAGYGGMMAAARMQKLIHSNEAKITLVNKNDYHYQTTWLHENAAGTLHHDRSKIDIKEVIDRNRIKLILDEVVSIKREEKKVKLKNQELYYDILIVSLGFEPAIYGIPGLSEFAYSIKDINSARLIRERIEYNFALYTNENKPTDGRLNIVIGGGGLTGVEFAGELINRIPTICEEYDIEKNLVKVYLLEGRDCVLYGYDDSAVQYAMNSLQSRGVEIINDATVKACAEDSIIYEKGGSEHKISTKSVIWTAGTKANSIVERLNLSMEHGRVKVRNDLRSIEDDSIYLIGDCSLNYDENGNVLPSTAQIAMQQGEFIARNINAKIKGKEMAAFLPDVPGRITSLGSDDGIADMFSRNLFGWKAALLKRVADNWYLFKLGGIQLLMKKGKFNMFH

SEQ ID NO: 4847 - protein, 112 aa, Gloeobacter violaceus PCC 7421
MRWVWTVGAVSISVLGAGVILAEAQPDLAAGEKIFKANCAACHAGGNNIVEPEKTLKKEALAHFGMGSPAAIIQQVTGGKNAMPAFGGELSTEEIRQVASYVLEMADKDWQK

SEQ ID NO: 4848 - protein, 510 aa, Listeria monocytogenes EGD-e
MSKSPVAIIILDGFGKRAETVGNAVAQANKPNFDRYWADFPHGELKAAGLDVGLPEGQMGNSEVGHTNIGAGRIVYQSLTRIDKAIEEGEFQENKALNNAFTHTKENNSDLHLFGLLSDGGVHSHINHLVALLETAKDKGVKNVYIHAFLDGRDVAPQSSLEYLETLQKAISDLNYGAIATVSGRFYAMDRDKRWERVEKAYKAIVSAEGEKFEDPIELVKASYANDKNDEFVVPAIITKDGKPVATVKDNDAVIFFNFRPDRAIQLSNAFTDKEWDHFDRGADHPKNIKFVTMTLYNPSIDAEVAFEPIEMKNVIGEVLSNEGLSQLRIAETEKYPHVTFFMNGGRNEEFPGENRILINSPKVETYDLQPEMSAYEVTDALVEDIKNDKHDAIILNFANPDMVGHSGMLEPTIKAIEAVDENLGRVVDLILEKGGSAIIFADHGNSETMSTPEGKPHTAHTTVPVPVIVTKKGVTLREGGRLADVAPTMLDLLGVKKPAEMTGESLIQK

SEQ ID NO: 4849 - protein, 251 aa, Listeria monocytogenes EGD-e
MRKPIIAGNWKMNKTAAKAGQFAEDVKNNVPSSDAVESVVAAPALFLQELVRLTEGTDLRVSAQNCYFEDEGAFTGEISPFALADLGVSYVIIGHSERREYFHETDEDINKKAHAIFKHGMTPIICCGETLDQREAGQTDTWVRGQIRAALAGLTEEQVIKSVIAYEPIWAIGTGKSSTSADANETCAVIRAEVADAVSQKAADAVRIQYGGSVKPENIADYLAESDIDGALVGGASLEPASFLALLEAVK

SEQ ID NO: 4850 - protein, 396 aa, Listeria monocytogenes EGD-e
MAKKVVTDLDLKDKKVLVRVDFNVPMKDGKITNDNRIVAALPTIEYILEQNGKAILFSHLGKVKTEEDKEGKSLRPVAVRLSELLGKEVKFVPTTRGPELEKAIDELKDGEVLLFENTRFEDIDGKKESKNDPELGKYWASLGDVFVNDAFGTAHRAHASNVGIASNLESAAGFLMEKEIKFIGGVVDNPARPLVAILGGAKVSDKIGVIENLLTKADKVLVGGGMTFTFMAAQGQEIGKSLLEADKVELAKGLLEKAGDKLVLPVDAVVSKEFSNDAPFHTVSADSIPADEMGLDIGQATIDLFTKELQGAKTVVWNGPMGVFELSNFAKGTIGVCEAIANLTDATTIIGGGDSAAAAMDLGFADKFTHISTGGGASLEYLEGKELPGVASISDK

SEQ ID NO: 4851 - protein, 614 aa, Zea mays
MEDLAPGALALFAAVADFIDDSAPAAAGAGMPPPEPESAPGSPCSDCSSVATADFEGFADLASTLVLDDLVSPASASASASSLPASGPRAARSVFALDCVPRWGLHSVCGRRPEMEDAARVLPTFFHVPLWMLAGDAPVDGLDRASFRLPAHFFAVYDGHGGLQVANYCRDRMHEVLAEGLTRAEQAVSDADLSGLDPSTHEHWEKVFVDCFSRVDAEVGGDAATGTKPVAPDTVGSTAVVALVCSSHVIVANCGDSRAVLCRGKQPLPLSVDHKPNREDEYARIEAQGGKVINWNGYRVLGVLAMSRSIVARIGPCLLIQMQIGLAVLIPDVLRFYLQAQIMLGMVTPQMMHMAKSQQPSGSLSQSSSHLNEPYPQTDAMIPLVSRPSSLPTNIPPNPTVLQEQTATLHSIPQHQHASQPLVKMFPHGHQSGIAAQSPMLHQPLDGSSSVPTQSLVTSVGLTSQVQLPLVPQHPGPSVMPTSVQQLPLTHPHLAQVAVAPETLPNEISTLAEFTHPSKLRKLEDGTSVPGMVNSSHAVYTVPLQAVGPSGPSGSYSAGSVNLQQPGNEEQLTPDVESALLQQVLQLTPEQLSSLPPEQQQQVIELQKMLSVSK

SEQ ID NO: 4852 - protein, 336 aa, Listeria monocytogenes EGD-e
MTVKVGINGFGRIGRLAFRRIQNVEGIEVVAINDLTDAKMLAHLLKYDTTQGRFDGEVEVHDGFFKVNGKEVKVLANRNPEELPWGDLGVDIVLECTGFFTAQDKAELHIKAGAKKVVISAPATGDMKTIVYNVNHETLDGTETVISGASCTTNCLAPMAKVLEDKFGVVEGLMTTIHAYTGDQNTLDAPHPKGDFRRARAAAENIIPNTTGAAKAIGEVLPTLKGKLDGAAQRVPVPTGSLTELVTVLDKKVTVDEVNAAMEAASDPETFGYTSDQVVSSDIKGMTFGSLFDETQTKVLTVGDQQLVKTVAWYDNEMSYTAQLVRTLEYFAKIAK

SEQ ID NO: 4853 - protein, 535 aa, Oryza sativa (japonica cultivar-group)
MERALDSLTYKGSIPDAILQSRRDNKLFVVYISGEDETSSSLEQSTLVNESVAEVIGNCCVFLHLKQGNVDASQFSAIYPQKAIPSISVIGQNGVMLWCHEGYISSKDLKENIEKAWATLHLQGTAAAFLTASLASRMTEPVNTTPTTLPTQGGSSAAENPSTSSNQSTGTSGASGFANPTDSVAQPPRSTSRDETPSISEKESSNLDSSPGNRTVQERPDSDSAQVKGSLPDHPRSSNIEGCANPVQSGNTASLKQKNKVDDGFTKVSSESVPTRVASRGKSSKVAVDQDKATTTSTPIEPAPVRSNDIQLVVRIPDGPSLQIKLTKDDNLRKVKNFVDENRANGAGSYDLAMLYPRKVFTEQDMEATLHELGIETRQALTIVPHHKTIRAAKRQSSSSPHEGDNNMDADSSGGSGYFGYLRTALSFVNPLSYLRANAAPSNPDQLANQGSPQYRPSTGPWNRPGEDTASESRIPDSARQQAARDTSSGSTLRRRPRQFGGNVHSLRSDDQGPSDDRNVYWNGNSTEFGGEDKK

SEQ ID NO: 4854 - protein, 374 aa, Zea mays
MPLILLSTAAPVVAVSLLTLPTHLLPPPHRHPRGRHEHNRHPGCHLTPPQALKASKSLAHLKSASNADAVLAFLADLGLSPKEVAAVVASNPRVLCARIDRSLAPISTELRALGLSPSQIARLAQIAGRYFLCRSFVSKVRFWLPLFGSPERLLQASDWNYWLLSSDLEKVVEPNVAFLRKCGLSAVDIAKLLVAAPRLVTMPPEYVQDAVRRATQLGVAPGSQMFRHALSTAGCIGQEKVDSKVAVLKETLGWSQEEVSLAISKAPRILVASEERLRRNAEFLLNEVGLPPQYIARRSVLLMYSLERRIVPRHLVLMVLKEKGLVEQDRCFFNVVAPTEEKFLEKFVAPYEESIPGLADAYESACMGKVTRGL

SEQ ID NO: 4855 - protein, 638 aa, Zea mays
MEPRHFCRALLLLLVVLLLGFRRAGAQDSTNYTVPARFACNVSSPCDTYVVYRTQSPGYLDLGSISDLFGTSQARIASANGLSSEDGVLQPGQPLLVPVRCGCTGAWSFANATYPIRQGDTFYNLARLSYENLTEYHLIHDLNPRSEPTSLQIGQEVTVPLLCRCPPARAVQSFITYVWQPGDTLSQVSKLMNATADEIAEANNVTSSSVSSASAAGLPMLIPVQQRPRLPPLLYAASAGEGRSSRSRRRALIIIGASVSGSLVALAALLVAIMAQRRYRRKKPSMRLGSPFAVNTKLSWSVNQYGHGSSNSFAHVMKGGKLLTGVSQFIDKPIIFVEEEIVEATMNLDERCKIGSTYYRAKLDGEVFAVKPAKGDVSAELRMMQMVNHANLIKLAGISIGADGDYAFLVYEFAEKASLDKWLYHNHQKPPSALLPSSSCTVPTTLSWGQRLSIALDVANGLLYMHEHTQPSMVHGDIRARNILLTADFRAKISSFSLAKPATADAAATSSDVFAFGLLLLELMSGRRAMEARIGSEIGMLWREIRAVLEAGDKREAKLRKWMDPALGSEYQMDAALSLAGMARACTDEDAARRPNMTEVVFSLSMLAQPLSVADGFEKLWQPSSEDNIRIAGSVAAR

SEQ ID NO: 4856 - protein, 378 aa, Aspergillus fumigatus
MAEFVRAEVLGTKFEYTTRYVNPQPIGMGSFGLVCSAFDQITQQPVALKKIMKPFDSSSLAKRTYREIRLLKYLRHENLICMRDIFISPLEDIYIATELLGTDLGRLLSIKPLDSKFSQYFIYQILRGLKYIHSANVIHRDLKPTNILINENCDLKICDFGLARLQEPQMTGYVATRYYRAQEIMLTWQRYGVQVDVWSAGCILAEMLRRKPLFPGKDHVHQFHLITNILGNPPDAVIEKITSKNTVNFVKSLPSREPRDLSTVVPKDTDFDAIDLLKKMLVIDPDTRISAQDALRYPYLAPYHDPTDEPVASGPFDWSFDSADFPKETWKIMIYSEVLDYLNVDNPADPAPFDPSTPFDPSALEREFSEFLSDSGQI

SEQ ID NO: 4857 - protein, 394 aa, Arabidopsis thaliana
MTTRKRQIKNFTSNFGPQHPAAHGVSRLVLEMNGEVVERAEPHIGSLHRGTEKLIEYKTYLQALPYSDRSDYVSMMAQEHAHSSAVEKLLNCEVPLRAQYIRVLFREITRISNHSLALTTHAMDVGALTPFLWAFEEREKLLEFYERVSGARMHASFIRPGGVAQDLPLGLCRDIDSFTQQFASRIDELEEMSTGNRIWKQRLVDIGTVTAQQAKDWGFSGVMLRGPGVCWDSRRAAPYDVHDQSDLDVPVGTRGDRYDRYCIRIEEMRQSLRIIVQCLNQMPSGMIKADDRKLCPPSRCRMKLSMESSIHHFELYTEGFSVPASSTYTAVEAPKGEFGVFLVSNGSNRPYRRKIRAPGSAHSQGLDSMSKHHMPADVVTIIGTQDIVFGEVDR

SEQ ID NO: 4858 - protein, 310 aa, Zea mays
MAAAVAAVAAATTAEDEARLLRLEEQAEHGGGGAWDYLCLARRLRARRPAHVLRVGLALLNNASARSGLASEQWTLYEQVATAAMDCQRLDVAKDCIGVLSKQFPGSTRVARLEALLFEAKSEWAEAERAYTQILEINPFDQIVHKRKIAIAKAQGNMSLAIGYLNKYLELFMADHDAWRELAETYVSLQMYKQAAFCYEELILSQPTIPLYHIAYAEVLYTMGGLENLQTAKKYYASTIQLTGGKNTRALFGVCLCTSAINQLTKGRNKEEEGSELQRLAAEVLLNNYKQQAPSKAPLISSLLKNMKLS

SEQ ID NO: 4859 - protein, 126 aa, Triticum aestivum
  misc_feature (55)..(55): Xaa can be any naturally occurring amino acid
  misc_feature (72)..(72): Xaa can be any naturally occurring amino acid
  misc_feature (114)..(114): Xaa can be any naturally occurring amino acid
  misc_feature (116)..(116): Xaa can be any naturally occurring amino acid
  misc_feature (119)..(119): Xaa can be any naturally occurring amino acid
MAGTGRSMLLSLLLFAVTLSLLEMYRGWFAASELKTIAGGFVSSLLFLLLLTFIXGNYQEASGVRTGWGAVXVVAQLVAPIVAGTVQRVCIKTCFLFSAGFFTSRQLSGMILAXSXSKXRRTDQTF

SEQ ID NO: 4860 - protein, 437 aa, Corynebacterium glutamicum
MTHMTSSNTARSAEWFEKAQKLTPGGVNSPVRAFGSVGGQARFIEKAHGSTLIDVDGNEYVDLVCSWGPMLMGHAHPAVVEAVQKAVVDGLSFGAPTIGEVELAQDIVKRTSVEEVRLVNSGTEATMSAVRLARGYTQRSKILKFEGCYHGHVDALLASAGSGVATFALPDSPGITGAQTSDTIVVPYNDIEAVRNAFAEYPGEIACIIAEAAGGNMGTVAPKDNFNDKLLAIAHADGALLILDEVMTGFRTSYRGWFGIDKVAADLVTFGKVVSGGLPAAAFGGKAEIMNMLAPQGPVYQAGTLSGNPVAVAAGRASLKLADESLYTTINANADRLHGLISDALTHEGVAHHIQRASNMLSIRFAEGEGHNFSDMKAADTFRFAPFFHTLLDNGVYAPPSVFETWFVSSALTDDDFSKIEQALKPAARAAAEAKAS

SEQ ID NO: 4861 - protein, 302 aa, Zea mays
  misc_feature (14)..(14): Xaa can be any naturally occurring amino acid
HASDELQLSDAEKXARIYHFYIPVFLWCEDEVMVHRARYNDGDDIPPLVIGVSAPQGSGKTTLVFALDYLFRVAGRNSATLSIDDFYLTAKEQNELRDRNPANALLEFRGNAGSHDLQLSVETLESLIKLTKEGMKMKVPRYDKSAFGGRGDRADPSVWPEVEGPLEVVLFEGWMLGFKPLPNEVVKEVDPQLEVVNKNLEAYSDAWDRFIQSWIVIKIREPGSVYQWRLQAEVAMRADGKPGMSDEEVMDFVSRYLPAYHAYLPTLYKEGPNGSNPDHLLVIDIDENRNPICGGSWDISCL

SEQ ID NO: 4862 - protein, 448 aa, Corynebacterium glutamicum
MRFAIIGAGLAGLTAAYEIHKADPTAQIDVLEAGERIGGKLFTVPFASGPTDIGAEAFLAARSDAVEFFTELGLADSLVSPSAAKSQYFAGGALHAFPAGGVMGIPSNPPAGAQDTAFDWTPGHDISVGALVRRQYGDEIVDTVVSSLLGGVYSSTADDLGVRASVPALAAALDQLAEAGEPVTLSAAVKAVEAQREAAKTTSETRPVFQTFKGGYAELYEALAEQCGADIHLDSFVSAITKDGEGFAIKGGGEGTYDKVILAVPAPTAAVLLRDLAPTAAPHLRAIKLASSAVVGMRFDSSEGLPDNSGVLVAVNEPGITAKAFTFSSKKWPHLEARGGALVRASFGRLGDEASARMDEDLLVDAALDDLLTITGFDGRAAGLGEIFVQRWFGGLPAYGVDHIAAVSAARAEIAAVPGVEAIGAWAGGVGVPAVIADAQAAVHRLLG

SEQ ID NO: 4863 - protein, 415 aa, Emericella nidulans
MAEFIRSDILGTTFETTSRYANLQPVGLGTAGVVCSAYDLISEQVVAIKKMMKPFHSTSVAKRTYREVKLLRHLRHDNLINMSDIFISPLEDVYLVTELLGTDLHRLLNGKPLESKFAQYFTYQILRGLKYIHSAGVIHRDLKPGNLLINENCDLKICDFGLARVQEPQMTGYVSTRYYRAPEIMLTWQRYGSKVDLWSVGCILAEMLLGRPLFPGTDHINQFWLITDLLGNPPDEVIDRITTNNTRRVVKSMAKRNPRPLKEILPAAEDAALNLLDNLLVFDPDRRISAEQGLMHPWMAPYHDPTDEPVATEQFDWSFNDADLPLDTWKIMIYSEVLDFFQLTTNAEPSGEQSQNQSQSQSQAFTSSQDLQLASMLNLGEGELLPDFAATIDPNKFGSVDYLMDGQSLDPNSFS

SEQ ID NO: 4864 - protein, 329 aa, Shewanella sp. MR-4
MQVSPRGTASAKLTDFLELANQNIALAKQQNIQYSPQLLRENLNKLAALMSAKPEVSYIADKAWQVKDAQHGDREIGCRVYSPAPSKALPVVLHFHGGGHMCGSVELYDPICRHLASIAQCVVISVEYRLAPEHPYPAGLDDCEYALRHYQSVLTEVQYQQGVSIMGDSAGGALCTSLSQRSLSDSTLNIAKQILVYPSVDYTMTSPSYLSNGAGFLLETPRVQWYFEQYFQEVAKDAERVKQASPLHGEFNAKLPSTLIFTAGCDPLRDEGIAYANALTAAGVQVQHHQFEDMIHAYMLLQDLVSQECLATYRMIAAFLAEPVTAATR

SEQ ID NO: 4865 - protein, 375 aa, Vibrio fischeri ES114
MNQGTKPSIIWLNVFIFTSSFLLAFVATPIYAYYNPLGSEHWIWLLLTFSFCNLSITAGYHRLWSHKAYNAHPALRFIFALGGAFALQNSALHWSSDHRIHHRHVDDNDKDPYSAKRGFWFSHIGWMLRHYKPATYNDYGNCRDLQKDNILMWQHKHYIVLALIMNIGVPLLLGVIYGDIIGMLLMVGAVRLTLSHHTTFFINSLAHIWGSQPYTEKNTARDNGFLAIFTFGEGYHNYHHIFENDYRNGIYWWQYDPTKWFIKTCSLLGLAHKLRVSPQAKIEKAKALMLRKKAESKIATLHNYHAIKEHLEAEYDALIERMAEYYDSKKQLIENKKDTLSKKYELALLNVQHKQIKMQFEHQKRVWNRLVLQYV

SEQ ID NO: 4866 - protein, 509 aa, Glycine max
MPSNDSDSPMKIVHGDAGYILEDVPHFTDYIPNLPTYPNPLRSNPAYSVVKQYFVHMDDTVPQKVVVHKDSPRGIHFRRAGPRQKVYFKSDEVHACIVTCGGLCPGLNTVIREIVCGLSYMYGVNKVLGIDGGYRGFYSKNTITLTPKVVNDIHKRGGTILGTSRGGHDTGKIVDSIQDRGINQVYIIGGDGTQRGATVIYEEVRRRGLKVAIAGIPKTIDNDIPVIDKSFGFDTAVEEAQRAINAAHVEAESIENGIGVVKLMGRYSGFIAMYATLASRDVDCCLIPESPFYLEGKGGLFEFIQKRLKENGHMVIVIAEGAGQDLLTESMQAMDQKDASGNKLLQDVGLWISHKIKDHFARKDKIPINLKYIDPTYMIRAIPSNASDNVYCTLLAQSAVHGAMAGYTGFTVGLVNGRQTYIPFIRINERQNKVVITDRMWARLLSSTNQPSFLSPKDLEEAKKAEQPPTQLLEENNCNDVGDAEKEEQPPKDEQESGNHTDNGIKTQN

SEQ ID NO: 4867 - protein, 381 aa, Glycine max
MSPAMVGSGEKGESDTPGNQYQKGVKQLVENGLHTIPKKYILPPSDRPATNSENSNAAKLSYVRPPPDFSELIGPRRPQVLQSLANACERYGFFQLVNHGISDDVISSMRDVSGRFFDLPFEERAKHMTTDMHAPVRYGTSFSQTKDSVFCWRDFLKLLCHPLPDFLPHWPAPPLDFRKVVATYSEETKYLFLMLMEAIQESLGIKVEVKKQEEETEGNDNNILKDLEDGSQMMVVNFYPPCPEPDLTLGMPPHSDYGFLTLLLQDQVEGLQIQFQGQWLTVKPINNAFVVNVGDHLEIYSNGKYKSVLHRVIVNAMKKRTSVASLHSLPFNCTVRPSPKLIDEANPKRYADTNFDTFLAYVSTREPKRKEFLDSRKLSST

SEQ ID NO: 4868 - protein, 641 aa, Pichia jadinii
MTISNTQAADGRRYSTTVGASGASTTRDTTIGSVNEYPDECISKEPIGEAARAAINVAKATRLSAVGPIECSLNGFQLLNSPLFNKGSAFTLEERAAFGLEGLLPAQVNDLNAQVERAYKQLCYLKTPLAKNDFCSSMRVQNKVLFYELVRRHIRELVPIIYTPTEGDAIAAYSHRFRKPEGCFLDITDPDSIDRRLANFGEDKDVDYIVVSDGEGILGIGDQGVGGVRIAISKLALMTLCGGIHPGRVIPVCLDVGTNNKKLITDDLYMGNRFPRVRGKEYDDFVDKFIQVLKRRFPSATLHFEDFGVTTGRPLLQRYRNELACFNDDIQGTGAVVMASLSAALKHTNRNLLDSQIVIYGAGSAGLGIADQIVNHMVTHGATVEEAKSKIHALDIRGLILKSMKETSTPDQHSYADEDADWEGIDTKSLYEVVKKIKPTCLIGCSTQAGAFTQQIVQEMHKHNPRPIIFPLSNPTRLHEAVPEDLMAWTNNDAMVATGSPFKPVDGWVISENNNCFAFPGIGLGSVLSRAKIISDKMISAAVDQLASLSPLSKDPKAGLLPPLEVINDTSAKVAAAVILQALDEGLARIEDEVQPGKDEYVTVPGDFDACVEWVKQQMWKPEYRPMVKVEHRHDIHTHQF

SEQ ID NO: 4869 - protein, 68 aa, Triticum aestivum
  misc_feature (2)..(4): Xaa can be any naturally occurring amino acid
  misc_feature (6)..(7): Xaa can be any naturally occurring amino acid
  misc_feature (9)..(10): Xaa can be any naturally occurring amino acid
  misc_feature (12)..(15): Xaa can be any naturally occurring amino acid
  misc_feature (17)..(18): Xaa can be any naturally occurring amino acid
  misc_feature (21)..(21): Xaa can be any naturally occurring amino acid
  misc_feature (23)..(23): Xaa can be any naturally occurring amino acid
  misc_feature (27)..(28): Xaa can be any naturally occurring amino acid
  misc_feature (36)..(36): Xaa can be any naturally occurring amino acid
  misc_feature (43)..(43): Xaa can be any naturally occurring amino acid
  misc_feature (45)..(45): Xaa can be any naturally occurring amino acid
  misc_feature (52)..(52): Xaa can be any naturally occurring amino acid
SXXXIXXNXXQXXXXKXXKEXIXQIFXXPKDHRKAXPFHDHVXVXSIVDDHXWFRNYQISVPHNEIDN

SEQ ID NO: 4870 - protein, 338 aa, Leavenworthia uniflora
  misc_feature (170)..(170): Xaa can be any naturally occurring amino acid
TGQIIRSKAAVAWEAGKPLVMEEVEVAPPQKHEVRIKILFTSLSHTDVYFWEAKGQTPLFPRIFGHEAGGIVESVGEEVTDLQPGDHVLPIFTGECGDCPHCHSEESNMCDLLRINTERVGMIHDGESRFSINGKPIHHFLGTSTFSEYTVVHSGQVAKINPEAPLDKVXIVSCGLSTGLGATLNVAKPKKGQSVAVFGLGPVGLGAAEGARIAGASRIIGVDLNSNRFEQAKKFGVTEFVNPKEHDKPVQQVIAEMTNGGVDRSVECTGSVQAMIQAFECVHDGWGVAVLVGVPSKDDAFKTHPMNFLNERTLKGTFFGNYKPKTDIPGVVEKYMNK

SEQ ID NO: 4871 - protein, 253 aa, Borrelia garinii PBi
MRKTFLAGNWKMHYTSTEASIVAKKIATEVKTLKDDFVIMITPPFTALSKVSECIKGSNILLGAQNMSYMESGARTSEISPSMLLEFGVEYVILGHSECRLYLGETDEIINKKILTGLKHPFKYLILCVGETLNERDSEKTLDVVLNQVKKGLDGVSESDIKRIILAYEPIWAIGTGKTATKEEAEEVHKAIRLEIMKLYSKSVSDNVIIQYGGSVNSSNVKELMNEPDIDGALIGGASLKAESFLSIINNVL

SEQ ID NO: 4872 - protein, 393 aa, Borrelia garinii PBi
MSIKTVKDFNSFAGKRALVRCDFNVPLKEGNISDDTRIKAALPTIEYLKEKGARIVLISHLGRPEGKKNLKYSLKPVANKLSELLGQDVKMLSDCIGREIVNNTLQMKDGDVVLLENVRFYAEEEKNDKNFAKKLSENGDVFVNDAFGAAHRAHASTVGVSDYLPSVGGFLMEKEDKFLGEVLKNPERPFVSIIGGSKVSSKIAVLESLLSKSNVVVIGGGMAYTFLHSKGYSIGKSLLESEYIDIASSFLKKAKELDVKVILPLDHIVADDFNKNSTPEYIDSFDIPENKIGMDVGGKTLKEIEKVIKTAKTIIWNGPLGVFEFDSFSKGTAMVAEMVASCAGLTIVGGGDSVAAVNKFNLSDKITHVSTGGGASLEYLEGKILPGIKVLEK

SEQ ID NO: 4873 - protein, 379 aa, Leavenworthia stylosa
  misc_feature (11)..(11): Xaa can be any naturally occurring amino acid
MTTTGRIIRSXAGVAWEAGKPLVIEEVEVAPPQKHEVRIKILFTSLWHTDVYFWEAKGQTPLFPRIFGHEAGGIVESVGEGVTDLKPGDHVLPIFTGECGDCPHCHSEESNMCDLLRINTERRGMIHDGESRFSINGKPIHHFLGTSTFSEYTVVHSGQVAKINPKAPLDKVWIVSWGLSTGLGAILNVAKPKKGQSVAVFGLGAVGLAAAEGARIAGASRIIGVDLNSKRFEEAKKFGVTEFVNPKDYDKPVQQVIAEMTNGGVDRSVECTGSVQAMIQAFECVHDGWGVAVLVGVPSKDDAFKTHPMNFLNEKTLKGTFFGNYKPKTDIPGVVEKYMNKELELEKFITHTVPFSEINKAFDYMLKGESIRCIITMGA

SEQ ID NO: 4874 - protein, 335 aa, Borrelia garinii PBi
MKLAINGFGRIGRNVFKIAFERGIDVVAINDLTDPKTLAHLLKYDSTFGVYNKKVESRDGAIVVDGREIKIIAERDPKNLPWAKLGIDVVIESTGVFSSATSDKGGYLDHVNHAGAKKVILTVPAKDEIKTIVLGVNDQDINSDLKAVSNASCTTNCLAPLAKVLHESFGIEHGLMTTVHAYTNDQRILDLPHSDLRRARAAALSIIPTSTGAAKAVGLVLPELKGKLNGTSMRVPVPTGSIVDLTVQLKKKDVTKEEINFALKKASETPELKGILGYTEDPIVSSDIKGNSHSSIVDGLETMVLENGFAKVLSWYDNEFGYSTRVVDLAQKLVK

SEQ ID NO: 4875 - protein, 264 aa, Saccharomyces cerevisiae
MAAGVPKIDALESLGNPLEDAKRAAAYRAVDENLKFDDHKIIGIGSGSTVVYVAERIGQYLHDPKFYEVASKFICIPTGFQSRNLILDNKLQLGSIEQYPRIDIAFDGADEVDENLQLIKGGGACLFQEKLVSTSAKTFIVVADSRKKSPKHLGKNWRQGVPIEIVPSSYVRVKNDLLEQLHAEKVDIRQGGSAKAGPVVTDNNNFIIDADFGEISDPRKLHREIKLLVGVVETGLFIDNASKAYFGNSDGSVEVTEKHHHHHH

SEQ ID NO: 4876 - protein, 380 aa, Leavenworthia stylosa
MTTTTGQIIRCKAAVAWEAGKPLVMEEVEVAPPQKHEVRIKILFTSLCHTDVYFWEAKGQTPLFPRIFGHEAGGIVESVGEGVTDLQPGDHVLPIFTGECGHCPHCHSEESNMCELLRINTERGGMILDGESRFSINGKPIHHFLGTSTFSEYTVVHSGQVVKINPKAPLDKICIVSCGLTTGLGATLNVAKPKKGQSVAVFGLGAVGLGAAEGARIAGASRIIGVDLNSKRFEEAKKFGVTEFVNPKEHNKPVQQVIAEMTNGGVDRSVECTGSVQAMIQAFECVHDGWGVAVLVGVPSKDDAFKTHPINFLNERTLKGTFFGNYKPKSDIPGVVEMYMNKELELEKFITHKVPFSEINKGFDYMLKGEGIRCIITMGA

SEQ ID NO: 4877 - protein, 181 aa, Saccharomyces cerevisiae
MSISESYAKEIKTAFRQFTDFPIEGEQFEDFLPIIGNPTLFQKLVHTFKTHLEEKFAKEKIDFIAGIEARGLLFGPSLALALGVGFVPIRRVGKLPGECASITFTKLDHEEIFEMQVEAIPFDSNVVVVDDVLATGGTAYAAGDLIRQVGAHILEYDFVLVLDSLHGEEKLSAPIFSILHS

SEQ ID NO: 4878 - protein, 550 aa, Zea mays
MASSASLQRFLLPSPHAAATAASPSSRLRRTGRARAAVSVPPPAAAGEQVPTERLEPRVEERAGGYWVLKDKYRAGLNPQEKVKLEKEPMALFMEGGIQDLARVPMEQIDAAKLTKDDVDVRLKWLGLFHRRKHQYGRFMMRLKLPNGVTTSEQTRYLASVIEAYGADGCADVTTRQNWQIRGVTLPDVPAILDGLRAVGLTSLQSGMDNVRNPVGNPLAGVDPHEIVDTRPYTNLLSSYVTNNSQGNPTITNLPRKWNVCVIGSHDLYEHPHINDLAYMPAVKDGEFGFNLLVGGFISPKRWAEALPLDAWVAGDDVVPVCKAILEAYRDLGSRGNRQKTRMMWLIDELGMEVFRSEVEKRMPNGVLERAAPEDLVDKRWERRDYLGVHPQKQEGLSYVGLHVPVGRLQAADMFELARLADEYGTGELRLTVEQNIVLPNVSNERLDALLAEPLLQEQRLSPRPSMLLRGLVACTGNQFCGQAIIETKARALQVAREVEKRVAVPRPVRMHWTGCPNSCGQVQVADIGFMGCLTKDSDGKIVEAADIFV

SEQ ID NO: 4879 - protein, 550 aa, Triticum aestivum
  misc_feature (468)..(468): Xaa can be any naturally occurring amino acid
MAAAATRRAASSLASRCLLARPAASPAAVPSALRRADGARGLLPGLLQRFGTAAAAEEPISPSVQVGETQLLINGKFVDAASGKTFPTVDPRTGEVIARVAEGDAEDVDRAVVAARKAFDEGPWPRMTAYERSRILLRFADLIEKHNDDIAALETWDNGKPYEQAAHIEVPMLARLMRYYAGWTDKIHGLIVPADGPHHVQVLHEPIGVVGQIIPWNFPLLMYGWKVGPALACGNTIVLKTAEQTPLSALYVSKLLHEAGLPEGVLNIVSGFGPTAGAALASHMDVDKIAFTGSTDTGKVILELSARSNLKPVTLELGGKSPFIVMDDADIDQAVELAHFALFFNQGQCCCAGSRTFVHERVYDEFVEKSKARALKRVVGDPFRKGVEQGPQIDDEQFKKILRYIKSGVDSGATLVTGGDKLGDKGYYIQPTIFSDVQDGMKIAQEEIFGPVQSIFKFNDLNEVIKRXANASQYGLAAGVFTNNLDTANTLTRALRAGTVWVNCFDIFDAAIPFGGYKMSGIGREKGIDSLKNYLQVKAVVTALKNPAWL

SEQ ID NO: 4880 - protein, 351 aa, Triticum aestivum
MTMLMGRLAGVALELALAALLVLFLPPYYVYRLTASFLGSVFPDSVSGKVVLITGASSGIGEHLAYEYAKRGANLALVARREASLREVADNASALGSPSVLVLPADVSKPDDCRKFIDDTVAYFGRLDHLVNNASIWQVCKFEEVEDVNYFRTLMDINFWGHVYPTRYAIPHLKKTHGRIVGVTSNSSYIFIGRNTFYNASKAAALNFYDTLRMELGGEVRITEIVPGVVESEITKGKMLTKEGEMKVDQDERDAILGPTPAEPVAAFAKTAVKDVCRGQRYVFEPRWYMAVYLFRVCFPEILAWSSRLLTVKTLGRPATTDTVGRQILDMPGVRWLTQTASLRSPEIQAR

SEQ ID NO: 4881 - protein, 370 aa, Arabidopsis thaliana
MHLPEDLVLEILSKVPAVSLARFRSTCRRWNALVVDGSFAKKHYAYGPRQYPIVIMLIEFRVYLVSIDLHGINNNNGAPSAKLTGQFSLKDPLSNSSEEVDIRNAFHCDGLLLCCTKDRRLVVWNPCSGETKWIQPRNSYKESDLYALGYDNRSSSYKILRMHPVGNPFHIESEVYDFASHSWRSVGVTTDFHIQTNESYGMNVKGTTYWFALSKDWWSSDDRRFLLSFDFSRERFQCLPLPADVKNLHLTVVLSVTREEQQLCMFATLGAGNVYKLDVFVATKTEETTGELTWTKFRRFHSKICINVSADHEKKVLVPHHILLPYYNILHIVGEDIYIRQVNKDGDIGCPILLTYVPSLVQIQQATGLI

SEQ ID NO: 4882 - protein, 449 aa, Streptococcus agalactiae A909
MTSGKTYVASVLEKVKKQNEHEEEFLQAVEEVFESLVPVFDKYPQYIEENLLERLVEPERVISFRVPWVDDKGQVQVNRGYRVQFSSAIGPYKGGLRFHPTVTQSIVKFLGFEQIFKNSLTGLPIGGGKGGSNFDPKGKSDNEVMRFTQSFMTELQKYIGPDLDVPAGDIGVGGREIGYLYGQYKRLNGYQNGVLTGKGLTYGGSLARTEATGYGAVYFAKEMLAACGQDLTGKVALVSGSGNVAIYATEKLQELGATVVAVSDSSGYVYDPDGIDLETLKQIKEVERARIVKYTEKHPKANFTPADQGSIWSIKADLAFPCATQNELDEEDAKLLVENGVLAVTEGANMPSTLGAIKVFQKAGVAFGPAKAANAGGVAVSALEMAQNSSRRAWTFEEVDQELQRIMKTIFVNASKAADEFGDSGNLVLGANIAGFLKVAQAMSAQGIV

SEQ ID NO: 4883 - protein, 387 aa, Triticum aestivum
  misc_feature (293)..(293): Xaa can be any naturally occurring amino acid
RFAVVRQLCADHPDLDAAKVSLGVLGVVSQVTLALEPMFKRSVTFVTRNDSDMAEQAVVWGGLHEFGDMAWLPQQRNVIYRKDNRVAITSVGNDLNDYLALRSSPTADLISGRVMHELLEKKNNTVARCKEAPTSASLFEKAAYGFTNNDSLFMGYPVVGFQHRIQASGSCLENPEDALLTTCPWDPRIRGIFFYNNAYSIALSRVPAFIADMKQLRNSNPKAFCGIDASLGILLRYIKASSAYLGKPEDSVDFDITYYRSYTKGEPNPHSDVLDELQQMALHKYGAIPHWGXKNRNFAFEGAIAKYPEAGKFLEVKGRYDPDGIFSSEWSDQVLGINGSPIIVEKGCAIEGLCVCSEDSHCAPEQGYYCRPGKVYREARVCSFQPN

SEQ ID NO: 4884 - protein, 308 aa, Burkholderia sp. 383
MTAAFPEILALGEAMIEFNQSQPGRPEFLQGFGGDTSNFCIAAARQGASTGFVSAIGDDPFGRLLADMWRAEQVDTTYVRVDRSAPTGVYFVTHGADGHQFDYLRAGSAASRYAVGDLPLDALAAAKAVHLSGISLAISTAACDAAFAGIDHARRNGAKVSFDTNLRLKLWPLPRARAVMREALRQTDICLPSWDDVTALTGANDRDAIVDAMLEHGPQVVALKLGKEGAYVATPNERRVVPGFAVEAVDATGAGDCFGGAFVARIVAGDDPFAAARYANAAAALSTTGYGAVAPIPHRDAVERLMQG

SEQ ID NO: 4885 - protein, 184 aa, Zantedeschia hybrid cultivar
MALKAVLISPFFFLFLAGIITLPAASKQLGEGECLYTIYVQTGDIADAATDAVVSLVISDHPGAGGYDYFERGNLDFFSGQASCLSAPPCWMLLAHDNTGNKPGWFVDHVLVTMAPLANAPVGQHLFRVNQWLARDESPNQLATTRNDCDNDSNIRMSSALQAAMGARNAGVSRRMGGSEPKPM

SEQ ID NO: 4886 - protein, 880 aa, Arabidopsis thaliana
MICHVLVIFTILVSAVVDATASYEPTDVFLINCGDTSNNMDYSGRNWTTENPKFMSSNAVDDASFTSSASYQESGIPQVPYLKARIFRYDFTYSFPVSPGWKFLRLYFYPTRYGSDFDAVKSFFSVNVNRFTLLHNFSVKASIPESSSLIKEFIVPVNQTLDLTFTPSPNSLAFVNGIEIISMPDRFYSKGGFDDVVRNVGRDVDFEIDNSTAFETVYRVNVGGKVVGDVGDSGMFRRWLSDEGFLLGINSGAIPNITGVKINYTDKTPAYVAPEDVYTTCRLMGNKDSPELNLNFNLTWLFEVDAGFAYIVRLHFCETQPEVNKTGDRVFSIFFGYQLAMREMDVFRLSGGFRLPMYLDFKVLVDADGTSQRPSLRVDLTPYKEDYPTYYDAILSGVEILKLSNSDGNLAGLNPIPQLSPPPQSITPLKGKGKSSHVLPIIIAVVGSAVALAFFVLVVVLVVMKRKKKSNESSVDTTNKPSTNSSWGPLLHGTGSTNTKSASSLPSDLCRRFSIYEIKSATNDFEEKLIIGVGGFGSVYKGRIDGGATLVAVKRLEITSNQGAKEFDTELEMLSKLRHVHLVSLIGYCDDDNEMVLVYEYMPHGTLKDHLFRRDKASDPPLSWKRRLEICIGAARGLQYLHTGAKYTIIHRDIKTTNILLDENFVAKVSDFGLSRVGPTSASQTHVSTVVKGTFGYLDPEYYRRQILTEKSDVYSFGVVLLEVLCCRPIRMQSVPPEQADLIRWVKSNFNKRTVDQIIDSDLTADITSTSMEKFCEIAIRCVQDRGMERPPMNDVVWALEFALQLHETAKKKNDNVESLDLMPSGEVGTTTDGEDDLFSRTTGHVGKSTTTDDSVLVVGDERSGSSWGVFSEINEPKAR

SEQ ID NO: 4887 - protein, 1024 aa, Ralstonia solanacearum GMI1000
MPRDTPQTVPGHSPFWPLFFFTHNNKREARHDLARLSLTLMPILPRLFHRTSRTSSADTQRDARTPPNASPLHGEPGRTPRSRGELGRNLRLRSNAQTSGTPGTPARPQIRASASRTAPSTPQHPQGTEGTRTVPNSPLHNDARVFRERADHTGLSAWRTEMLTRFIEHSRKHGLANDFEQVRVYDRLSRAVDHLKSVLRMSGDSVQLKSLPVPELPDVTFEIAHLKNLETVDCDLHALPATLENLFLLETLSLKGAKNFKALPDAVWRLPALQELKLSETGLKSLPPVGGGSALQRLTIEDSPLEQLPAGFADLDQLASLSLSNTKLEKLSSGIGQLPALKSLSLQDNPKLERLPKSLGQVEELTLIGGRIHALPSASGMSSLQKLTVDNSSLAKLPADFGALGNLAHVSLSNTKLRDLPASIGNLFTLKTLSLQDNPKLGSLPASFGQLSGLQELTLNGNRIHELPSMGGASSLQTLTVDDTALAGLPADFGALRNLAHLSLSNTQLRELPANTGNLHALKTLSLQGNQQLATLPSSLGYLSGLEELTLKNSSVSELPPMGPGSALKTLTVENSPLTSIPADIGIQCERLTQLSLSNTQLRALPSSIGKLSNLKGLTLKNNARLELLSESGVRKLESVRKIDLSGCVRLTGLPSSIGKLPKLRTLDLSGCTGLSMASLPRSLVLPRDGLNVIFPEHLKTDVGNARIQQNPRARLLEGHLERQNEAMNHAMFGDDESVGSMTSVPDNEAGVVSMAFHAKHAYKRLERLRQEAGSSMAAPMRNNDAESMRRALAYAFRSMSDLPTFKKLDNAARSLSYEVQEQLADLVAAPVGQKLVKAIAEGAYGAGRDARAIEQMLPELATRIANHPEIQQLREQAKRYPSSLPPEKLAAKLTPLIQPLWDGTRAVAPMPGQLRQALQDLLVTAEGRQLASEIDRAAHSHRAGDEGKALRGLLPVLAAKIGSDPRVVRVREFVSRHTFGSPQQRAESLAQTLTPVVQELWAQTQAEVAKQGQTPAASPSRQR

SEQ ID NO: 4888 - protein, 281 aa, Leavenworthia uniflora
MTTTTGQIIRCKAAVAWEAGKPLVMEEVEVAPPQKHEVRIKILFTSLCHTDVYFWEAKGQTPLFPRIFGHEAGGIVESVGEGVTDLQPGDHVLPIFTGECGECPHCHSEESNMCELLRINTERGGMILDGESRFSINGKPIHHFLGTSTFSEYTVVHSGQVVKINPKAPLDKVCIVSCGLTTGLGATLNVAKPKKGQSVAVFGLGAVGLGAAEGARIAGASRIIGVDLNSKRFEEAKKFGVTEFVNPKEHNKPVQQVIAEMTNGGVDRSVECTGSVQAMIQ

SEQ ID NO: 4889 - protein, 702 aa, Streptomyces coelicolor A3(2)
MQVWPGEAYPLGATYDGAGTNFAVFTEAADRVELCLLHDDGSETAVELRESDAFVRHAYVPGVMPGQRYGYRVHGPYAPERGLRCNSAKLLLDPYARAISGEVQWGEEVYGYHFGAPERRNDLDSAPHTMTSVVVNPYFDWGDDRRPRTEYHHTVIYEAHVKGLTMRHPGLPEELRGTYAALAHPALIEHLTGLGVTALELMPVHQFVNDHRLVDMGLNNYWGYNTVGFFAPHNAYASWGDRGQQVLEFKSAVKALHEAGIEVILDVVYNHTAEGNHLGPTLSFKGLDNPSYYRLADDPRYYMDTTGTGNSLLMRSPHVLQMIMDSLRYWVTEMHVDGFRFDLAATLARQFHEVDRLSSFFDLVQQDPVVSQVKLIAEPWDVGEGGYQVGNFPPLWTEWNGKYRDTVRDLWRGEPRTLAEFASRLTGSSDLYQDDGRRPLASINFVTCHDGFTLHDMVAYNDKHNHANGEDNRDGESHNRSWNCGVEGDTDDPAVLELRARQMRNFIATLLLSQGVPMLSHGDEFARTQRGNNNAYCQDNELAWVAWPEDGHDLLEFTRAMVWLRKDHPVLRRRRFFHGRPVQGTHDELSDIAWFTPEGAEMAQRDWNSARASALTVFLNGNAISEPGTRGERIADDSFLLMFNAAPRPLDFVVPVDHGRQWEVVVDTVLTAGVPAGTGPKVQAGDRLTLLDRSLTVLQRPV

SEQ ID NO: 4890 - protein, 453 aa, Sinorhizobium meliloti 1021
MLVQATNRLRQASARSRSKHLFDRAKGVFTDGTTRASVERDPFPIYAQRGEGAYLVDVDGNRLLDLNNNFTTLIHGHGFAHVSEAVVDLLRLGTCFANPTEHEIALAELLTARIPAMERVRFVNSGTEAVMFAIKAARAFTARPAIARIEGAYHGAYDWAEAGQGVSPGKDGWDPIPIPTPTYRGTPSSVADEVHLLRFNDVEGLERRLSAASDRIACVLIDPMPSRAGLLHPEPTFIEALSETAHKYGILIVADEVLNLRQGYAGASPRYGLKPDLVTAGKIIGGGFPIGAIGGREEVMRVFGTENARPLLPQGGTFSANPVSMAAGLAAMEAMTPDAFDRLEAMGERLRAGLRASIASRDARFSVTGAASLFRIHPKRVAPLEYRDAHLSAEEAWIMRTMSRYFLEAGILLPYGAAACLSTPMVHSDIDRILSAFDEFLEAKIGPEKERAK

SEQ ID NO: 4891 - protein, 322 aa, Leavenworthia crassa
GQTPLFPRIFGHEAGGIVESVGEGVTDLQPGDHVLPIFTGECGDCPHCHSEESNMCDLLRINTDRVGMIHDGESRFSIKGKPIHHFLGTSTFSEYTVVHSGQVAKINPEAPLDKVCIVSCGLSTGLGATLNVAKPKKGQSVAVFGLGAVGLGAAEGARIAGASRIIGVDLNSNRFEQAKKFGVTEFVNPKEHDKPVQQVIAEMTNGGVDRSVECTGSVQAMIQAFECVHDGWGVAVLVGVPSKDDAFKTHPMNFLNERTLKGTFFGNYKPKTDIPGVVEKYMNKELELEKFITHTVPFSEINKAFDYMLNGEGIRCIITMGA

SEQ ID NO: 4892 - protein, 322 aa, Leavenworthia stylosa
  misc_feature (253)..(254): Xaa can be any naturally occurring amino acid
  misc_feature (256)..(256): Xaa can be any naturally occurring amino acid
GQTPLFPRIFGHEAGGIVESVGEEVTDLQAGDHVLPIFTGECGDCPHCHSEESNMCDLLRINTERVGMIHDGESRFSIKGKPINHFLGTSTFSEYTVVHSGQVAKINPEAPLDKVRIVSCGLSTGLGATLNVAKPKKGQSVAVFGLGAVGLGAAEGARIAGASRIIGVDLNSNRFEQAKKFGVTEFVNPKEHDKPVQQVIAEMTNGGIDRSVECTGSVQAMIQAFECVHDGWGVAVLVGVPSKDDASRTHPMXXLXERTLKGTFFGNYKPKPDIPGVVEKYMNKELELEKFITHTVPFSEINKAFDYMLNGEGIRCIITMGA

SEQ ID NO: 4893 - protein, 326 aa, Oryza sativa (japonica cultivar-group)
MATASWPPTPRSPRPQAPSVERAKGPSGLDKVVLREARGFSAEVHLYGGQVTSWKNDRGDELLFVSSKATFKPPKAIRGGIPICFPQFGTHGILEKHGFARNRFWAIDDNPPPFPTSTAAKAFVDLILKTSEEDLKIWPHSFEFRLRVALGPGGDLALTSRIRNTNTDGRPFSFTFAYHTYFSVSDIRGHKHDLCAFVPFKSAANYLSEVRIEGLETLDYIDCLRGKERSTEQGDAIVFESEVDKIYLDAPAKIAIIDHEKKRTFVLRKDGLPDAAVEKPITLKPGEEWKGKMDLSAVPSSYCSGQLDPNKEHLMSLILSGADAAS

SEQ ID NO: 4894 - protein, 201 aa, Synechococcus sp. WH 5701
MTSSLTRLVRMLSAGFSNQHQAFENPPIYAHILVRFRPLPQLEPGSLLLEQSYAFAPGQPYRIRVLRAENAPDGSLRIHNHALHDERRFWGAVEDPERMAQIQTEDLRLLEGCTYVVHGQGEGFVGEVEPGCRCLVERKGATAYLVSSFEIDGESMRTIDRGHDPATHDQLWGSLAGPFEFQRTDDFSPEIPLAWLESWTT

SEQ ID NO: 4895 - protein, 126 aa, Clostridium perfringens SM101
MAKEIIKTNKAPGAIGPYSQGIKIGDFVYTSGQIPLNPETGVMAGSIEEQTAQSLENIKAILEAAGTSMDKVIKTTVFLSDMNDFVRMNEVYATYFTENQPARSAVEVAKLPKDAKIEIEVIATLK

SEQ ID NO: 4896 - protein, 377 aa, Frankia sp. EAN1pec
MRAVVYREPFQVAVADVPDPRVEHPQDAIVRVSSTSICGSDLHVYEGRTSVRPGTVLGHENMGTVVDRGSAVSHVQLGDRVSVPCTVSCGTCANCERGRTEFCLRTNPDPHRAGAAYGCPDMGPYLGGQAEYLRVPFADFNLLRLPPGDDQELDFATLSDVFPTGFHGTELADVQAGNTVVVFGAGPVGLLAAYSAALRGATALVVDPVPSRLRLCERIGATGIDSSTEDAAERVREETRGRGVDCGIDAVGYQARTASGEEQAGLVLNQLVDCVRWTGSIGVLGVYPTRDPGAADESGARGRLPFDMGAFFAKGLRMGSGPANVKRYNRFLRDLIITGRAQPSCVMSHQLPLADAPDAYARFDHRDAGWIKITLQP

SEQ ID NO: 4897 - protein, 702 aa, Methanobrevibacter smithii
MLLINLYYLNKLFGDYKMVEIKYVPTICPYCGTGCGLNFVVKDDKIVGVEPYKRHPVNEGKVCPKGNFGYEFINREDRLTTPLIKENGEFREASWDEALDLVANKLKEVSDDDPNKVGFYACARSPNENIYITQKLARVACGTQNVDHCARICHGPTVAGLATTFGSGAMTNGFDSIKEADYIFCIGSNNMEAHPLFGRKLIQAQKNGAKLVVLDPRYTPTAKIADEYVQFKTGTDVALMNGMIKVIIDNDLQDDEFIKNRTKGFDELKETVQKYDLETVSEITHIAPEVIEELAIEYAKADKAAIVYSLGITEHSHGADNVMSTANLAMLTGNIGREGTGVNPLRGQNNVQGACDMGALPSDYVGYRKVADQETTDWFNEYYGTNLPAKPGLTLVEMMNAAHAGDLKVLYIHGEDPVLSDADIKHTKEALANLDMLIVQELFMTDTAQCADVVLPAAGWGEQEGTFTNGERRVQCLHKAQEPPEGAMLDWKIMEEIAVRMGVPREKFHYESAEEIFEEIRECAPIFAGMNRERLDTPEALHWPCPSVDDPCQPLMHKDKFAHPDGLGIFQALEHRGPVEVPDEEYPLLLTTTRVLFHYHAAMTRRCKTLDNEVKTGFIEINTEDAKELGILNNEIVKASSRRGEIEIPARVTDDIKKGIVNIPMHFTECAANMLTNSDSFDPKCKMVELKACAIKVEKIEE

SEQ ID NO: 4898 - protein, 332 aa, Arabidopsis thaliana
MPRTAGRVRMPANNRVHSSAALQTHGIWQSAIGYDPYAPTSKEEPKTTQQKTEDPENSYASFQGLLALARITGSNNDEARGSCKKCGRVGHLTFQCRNFLSTKEDKEKDPGAIEAAVLSGLEKIRRGVGKGEVEEVSSEEEEESESSDSDVDSEMERIIAERFGKKKGGSSVKKTSSVRKKKKRVSDESDSDSDSGDRKRRRRSMKKRSSHKRRSLSESEDEEEGRSKRRKERRGRKRDEDDSDESEDEDDRRVKRKSRKEKRRRRSRRNHSDDSDSESSEDDRRQKRRNKVAASSDSEANVSGDDVSRVGRGSSKRSEKKSRKRHHRKERE

SEQ ID NO: 4899 - protein, 655 aa, Clostridium perfringens SM101
MRRNFNSKEFNDKYYYDGELGAIYNKEKTIFRVWSPEAKSLELLLYRDGNTESLIERDLLHKKSNGLWELVKKGDLNGVYYKYHIVGEDFEHDFVDPYCKALGVNGYRAMVIDLKKTNPKGWENEKKPSLENPLDSILYEMHLRDFSIDESSGVSLENRGKFLGIVEENTKVPGKEVKTTLDHLKELGITHVHLLPSFDFGTVDEERLDEEQYNWGYDPVNYNVPEGSYSKNPYKGEVRIKEFKEMVLKLHKAGIRVVMDVVYNHTYSGENSNLNLSYPGYYHRQDDFGNFSNGSGCGNELASERLMVRKYMVDSLKYWAREYHIDGFRFDLMALHDIETLKGIREELNKIDPSILIYGEGWNGGESPLPKEEACFKCNIEKFDKLQIAAFSDDMRDGIKGHVSHLKDGGFVNGGEDFEESIKFGIVASTYHEGVDYNKVNYSDSPWANEPYQTVNYCSAHDNNTLHDKLKIVCENASEEEIIEMNKLSAAIFLTSQGIPFIHSGEELLRTKINEKGEFIENSYNSNDFVNKIDWTRKVKYMDLFKYYKGLIELRKEYPLFRLESNKEIREKISFIESKLGINEKGIVAYRLKDNNNEFIVIFNSNNNEVKINLPKGLWGVMVNNKFSGKEIRDEARDFYDIIRKSAYVFKKISN

SEQ ID NO: 4900 - protein, 610 aa, Oryza sativa (japonica cultivar-group)
MAQLQETYACSPATERGRGILLAGDPKTETIAYCTGRSVIIRRLDAPLDCWAYPDHAYPTTVARFSPNGEWVASADASGCVRVWGRYGDRALKAEFRPLSGRVDDLRWSPDGLRIVVSGDGKGKSFVRAFVWDSGSTVGEFDGHSKRVLSCDFKPTRPFRIVTCGEDFLANYYEGPPFKFKHSIRDHSNFVNCIRYAPDGSKFISVSSDKKGLIYDGKTGDKIGELSSEGSHTGSIYAVSWSPDSKQVLTVSADKTAKVWDILEDASGKLNRTLACPGTGGVDDMLVGCLWQNDYLVTVSLGGTFNVFSASNPDKEPVTFAGHLKTVSSLAFFPQSNPKTILSTSYDGVIMRWIKGVGYGGRLMRKNNTQIKCFTVAEEELVTSGYDNKVFRIPLNGDQCGDAESVDVGGQPNALNLAIQKPEFALVTTDSGIVLLHKSTVISTTKVNYTITSSAVSPDGTEAIVGAQDGKLRIYSINGDTVTEEALIEKHRGAITCIHYSPDVSMFASADANREAVVWDRATREIKLKNMLFHSARINCLAWSPDNRLVATGSLDTCAIVYEIDKPASSRITVKGAHLGGVHGLTFVDNDSLVTAGEDACIRVWKLVPQ

SEQ ID NO: 4901 - protein, 137 aa, Zea mays
MGVKFLVLLGVVLASLVFQDVAFARELTEANNEDEGKNMKQGGMTELKDEKWGGGYGKPGYGGGYGGGYRPKYGRGYRSGYGYGGGYGGGYGGGYGGGYGGGGGYGEGGGFGGGHGGGRYPGGGGHHGGGGHHGGWN

SEQ ID NO: 4902 - protein, 303 aa, Shewanella sp. MR-4
MSHILVIGSANADHVMNFEYLPAPGQTLMSRSYRLEHGGKGANQAVACARLCQADSRVDFICHLGQDSVGNEMRENWLKDGIEADGITQVANLSTGTAMIFVADNGENSIGIAAGANANLTPPELEKHYALFVNAQYMLIQLETPMETVNHALQTAKRLGITTVLNPAPAVSQELDYLKWVDIITPNETEAEALTGIEVNNEDDAKLAAQLLHQQGVTTVVITLGSKGAFISSAGFTGLIPALEVQAIDTVAAGDTFNGALVVGLSEGMSIAAAVGFANAASAITVTRAGAQRAIPYRHELPR

SEQ ID NO: 4903 - protein, 343 aa, Vibrio vulnificus YJ016
MTQPTNRQIVLASRPVGAPTADNFVLTQSDIPTPAQGEMLLRSVYLSLDPYMRGRMSDAKSYAEPVGIDEVMVGGTVCQVEASNHAEFEVGEWVLAYTGWQDYALSNGEGLIKLGKQPSHPSYALGVMGMPGFTAYMGLLDIGQPKEGDTLVVAAATGAVGSMVGQIGKLKGCRVIGIAGGEEKCQFAKDTLGFDECIDHKAADFAEQLAKACHNGIDIYFENVGGKVFDAVMPLLNTGARIPLCGLISQYNATSLPEGPDRMSMLMAQLLIKRIKMQGFIIFDDYGHRYGEFAADMTQWLAQGKIHYREHLVQGLENAPDAFIGLLEGKNFGKMVVQTNQPR

SEQ ID NO: 4904 - protein, 398 aa, Puccinia triticina
MCGTSSAMDPVFQSINPSLYDPQRVLDSEEFEILTDMNKVKAYSDDNKNIACCYNDKQQLNMVKKPMPEVHPGQVLVRVRATGICGSDIHFWKHSRVGEKMVVKHECGAGHESAGEVIALGEGVTDLEVGDRVAIETGIPCSKPTCEMCRTGQYNACPEIMFWFTSPYHGLMTRYHAHPSCWLHKLPPNVSYEEGSLLEPLAVALAGIERAGVRLGDPVLICGAGPIGLVTLLACHAAGACPIAITDLSEGRLDCAKRLVPSVSTFKISLGESETDVAGQIQAAMGCKPRVAMECTGFESSIATAIFSVKFGGKVFVIGVGKDKQTLPFMHMAENEIDLQFQFRYANQYPKAIRLVSTGLIDVKPLITHRFVLEKAIEAFNTAADPKSGSMKVQVVDY

SEQ ID NO: 4905 - protein, 65 aa, Zea mays
  misc_feature (24)..(24): Xaa can be any naturally occurring amino acid
  misc_feature (43)..(43): Xaa can be any naturally occurring amino acid
MSVGEHFFQYPMSTSGMTLHICQXNSHHIIKAYFIAFGRTLRXAIDYDLRYQGTISDSKGVLSRS

SEQ ID NO: 4906 - protein, 153 aa, Borrelia garinii PBi
MIRALLTNDLFLSCFVSGISAQVIKYGIQTVKTRKLKLTPVHLLKKIFLETGGMPSSHSSTVTALSTSIAITEGIRHNFIIALAFALITIRDSFGVRYMSGVQAEYLNALSEKLKKEIKIGPTEIKVVKGHKKKEVLTGIIIGIVSAYIVCYL

SEQ ID NO: 4907 - protein, 853 aa, Bacillus cereus ATCC 14579
MMQITKRLINKTVLLLTLIVMLSSVFSFQSVKAVSNSKTTEIIIHYKEKLGNTKDWNLWLWGENANGTSYQFTGEDEFGKYAKIKIDGDYNRVGFIVRTNEWEKDGGDRWIENIKDGRAEVWILSGDEKVYNSKPSSDLSIQKATIDSFHEITVTTNVPFHIKEKKIEIEGIKIKNITPYDINSGDITNKVKIITEQKIDLKQTYKVKIENLADTNTEIGKVIRSEEFDNLFYYGGNDLGNTYTPQHTKFRLWAPTASEAKLVTYKKWNDKIGTEINMQQGEKGTWTAELKGNQKGLFYTYKVKIGDKWTEAVDPYVRAASVNGDKGAVVNLEETNPKKWKANKKPKFKNPEDAIIYELHVRDLSIQPESGIKQKGKYLGVTEKGTKGPEGVKTGLDHIKDLGVTHVQFLPIFDYASVNEETLNEPQYNWGYDPKNFNVPEGSYSTNPYEPTVRITELKQMVQTLHDNNLRVVMDVVYNHMYNAAESNFHKLVPGYYYRYNEDGTFANGTGVGNDTASERKMMRKFMIDSVTYWAKEYNLDGFRFDLMGIHDYETMNEIRKAVNQIDPSIILHGEGWDLNTPLAAELKANQKNAEKMKGIAHFNDNIRDGLKGSVFEEKENGFINGKENMEDRIKKGITAGIDYDTNSSTYQDPEQVLTYVEAHDNHTLWDKLELTNPGDSDEVRTQMHKLSSSILLTSQGIPFLHAGQEFMRTKYGDHNSYKSPDSINQMDWLRRATFNNEVDYMKGLIELRKKYSAFRMTSAEQIKTHVSFIDAPKNTVAYIIEGNKHEYFTVAHNANREAVEITLPSKGPWKVLVDGKQARSKPLYVVHDNKIKVPALSSIVLKSEKTIK

SEQ ID NO: 4908 - protein, 415 aa, Pseudomonas fluorescens Pf-5
MSHENISRSISTVHPIRLSHGRNAEVWDIDGKRYIDFVGGIGVLNLGHCHPRIVSAIQQQATRLTHYAFNAAPHGPYIEFMQRLANFIPVSYPVSGMLTNSGAEAAENALKIVRGATGRSAVIAFDGGFHGRTLATLNLNGKVAPYKQKVGVLPGPVYHLPYPSADNDVSCEEALKALRRLFSVEIDVQEVACFILEPVQGEGGFLALDATFARALRSFCDEHGILLIADEIQSGFGRTGQRFAFSRLGIEPDLILLGKSIGGGVPLGAVVGRKALLDVLPKGGLGGTYSGNPIACAAALATLDEMTDEHLQAWGERQERAIVQRYEHWKSSGLCPFLGRLTGVGAMRGIELVNARGEPAPEQLSTLLGSARDAGLLLMPSGKSRHIIRLLAPLTTEPEIFEEGLDILQECLARL

SEQ ID NO: 4909 - protein, 363 aa, Brassica napus
  misc_feature (337)..(337): Xaa can be any naturally occurring amino acid
MAPQEDAMQKQSSNKSDVIFRSKLPDIYIPNHLPLHDYIFQNISEFASKPCLINGPTGHVYTYSEVHVASRRIAAGFQKLGVNQNDVVMILLSNCPEFVLSFLAASFRGATATAANPFFTPAEIAKQAKASNSKLIVTESRYVDKIKDLQNDGVIIVCTDEEPSPIPTRSLRFTELTQSTEIETVEISSDDVVALPYSSGTTGLPKGVMLTHKGLVTSVAQQVDGDNPNLYFHSDDVILCVLPMFHIYALNSIMLCGLRVGASILIMPKFEINLLLELIQRCKVTVAPMVPPIVLAMAKSPETEKYELSSIRVVKSGAAPLVKELEYAFSAKFPNAXLRHGYCMTLAGSVLALSLGFAKEPVS

SEQ ID NO: 4910 - protein, 327 aa, Zea mays
FPFSHEVLLFEALREALMEEMELDPTVCVFGEDVGHYGGSYKVTKGLADTFGDLRVLDTPIAENSFTGMGVGAGMKGLRPLVEGMNMGFLLLAYNQISNNWGMLHYTSGGQFKIPLVIRGPGGVGRQLGAEHSQRLESYFQSIPGLQMVACSTPYNAKGLMKAAIRSENPVVLFEHVLLYNLKEKIPDEEYVLCLEEAEMVRPGEHVTILTYSRMRYHVMQAAKTLVNKGYDPEVIDIRSLNPFDLHTIGNSIKKTHRVLIVEECMRTGGIGATLRSAIVDNFWDYLDAPIMCLSSQDVPTPYAATLEDATVAHPAQIVAAVEQLCA

SEQ ID NO: 4911 - protein, 89 aa, Synechococcus sp. WH 5701
MASDPLSEAVSDRICRHMNKDHGEAVLAYARHYGGAQQASAARMLRVSPEAMELEVDGANLSVPFDHVLSDSEDAHRTLVAMLKALPES

SEQ ID NO: 4912 - protein, 256 aa, Zea mays
MSREENVYMAKLAEQAERYEEMVEYMEKVAKTVDVEELTVEERNLLSVAYKNVIGARRASWRIVSSIEQKEESRKNEEHVNLIKEYRGKIEAELSNICDGILKLLDSHLVPSSTAAESKVFYLKMKGDYHRYLAEFKTGAERKESAESTMVAYKAAQDIALAELAPTHPIRLGLALNFSVFYYEILNSPDKACNLAKQAFDEAISELDSLGEESYKDSTLIMQLLRDNLTLWTSDLTEDGADEGKDAPKGDAGEGQ

SEQ ID NO: 4913 - protein, 618 aa, Arabidopsis thaliana
MGSQTARFCLILLFLFYYLPCALSQDDLWGCGTPFRCGNITAGFPFLGGIRGEVCGHHSLKLNCNKHSNTTSLIFSGHNYTVLYIDNNNNSVTLGLSRQDFSGPFCSASFSSTLLSSGLFQNLPSYKSLTVFYACDPRRHFLGNFTCPVKGLGSIIQNSTYGILCDGSFSVPVPTSFVSEEEVLDLTHLESVLRKGFEVKLNIDEIPCPLECFSSRANCLFLAGSCCKYHDRTTTCGGDTGDLLREIIPNTRSILITIGQVVGFHVFIIVVMIIAFLFWRRKKVNDLRKQNLEALVTSRRYSYRQIKKITKSFTEVVGRGGFGTVYKGNLRDGRKVAVKILKDSNGNCEDFINEVASISQTSHVNIVSLLGFCFEKSKRAIVYEFLENGSLDQSSNLDVSTLYGIALGVARGIEYLHFGCKKRIVHFDIKPQNVLLDENLKPKVADFGLAKLCEKQESILSLLDTRGTIGYIAPELFSRVYGNVSHKSDVYSYGMLVLEMTGARNKERVQNADSNNSSAYFPDWIFKDLENGDYVKLLADGLTREEEDIAKKMILVGLWCIQFRPSDRPSMNKVVGMMEGNLDSLDPPPKPLLHMPMQNNNAESSQPSEEDSSIYSEV

SEQ ID NO: 4914 - protein, 767 aa, Tolypothrix sp. PCC 7601
MVSEFQAQSINVNSLKEAAIHVCSQIQPHGVLLVLGEPELNILQISSNTWSVFGILPEDVLQKKLEDLLDPFQIERIKAGILEGNLDYINPTKIWVRKKGDEYVVFDAVFHRNPEGLLILELEPAISQENIPFLSFYHLARASINQLEKTTNLRDFCQIIVQEVRKVTGFDRVMLYKFDDDGHGSVIAEEKLDSMEPYLGLHYPESDIPKPARKLFASNFIRLIPDAHAEPVQILPINHPQSQQPIDLTNSILRTAANCHLEYLHNMGVGASLTISLIKDGKLWGLIACHHQTPKYVSYEFRKACEFLGRVIFTEISTREETEDYDYRMNLAYIQTVLVEYMSQEENFIDGLVKHQPNLLNLTSAQGAAVCFGDRCTVIGQTPKEEDLNFLLQWLKNNVREEVFYTDSLPRIYPDAEKFKNVASGLLAIPISKRNYVLWFRPEVIQTVNWGGNPNEAFEVSQTEGNLRLVPRKSFELWKENVQLTSLRWKAVEIKAALELRKAIINIVLRQADELAQLAHDLERSNAELKKFAYVASHDLQEPLNQVANYVQLLEMRYENELDEDAKEFINFAVEGVSLMQTLIDDVLAYSKVDMQASAFQLTEVETPLNRSLSNLRGRIHETGAMITHDPLPTVMADSTQLMQLFQNLIANAIKFRSEQPPKIHIGAERLEDEWLFSVQDNGIGLEPRFSDRIFVIFQRLHTREEYPGTGMGLAICKKIIECHRGRIWVESQLGEGATFYFTIPVGGRERERRNGRQTQKDLFGRG

SEQ ID NO: 4915 - protein, 586 aa, Oryza sativa (indica cultivar-group)
MAPPPPSPPCRPRVKPERALLCFSLLLLLTATTANASITDCPTTSSTNSSHVDDGAFGANLRALLSSLSAAAAASSSGFAENATGAAPDTAYGLAQCRGDIVGGGNGTSCRSCLDDSVRDAAKACPGEKSAVIISDYCLVRYSNASFAGAADERTVKLWWNTDNATQPERFKSLLGTLMGNLTDAAARASSPLMFAAGETDLPPFTKIYGMAQCTRDLAAGDCYRCLVGAVNNIPKCCDGKQGGQVITRSCSIRFEVYPFFDAQAAKAAMSPAPAPAPVTTPIGVNGSNHTVSKSVIVPVTVGVAVLLVVILLLIALCLCKRNRKPHKHMMIGSVDLGDENEMRGSESLLYDLSTLRAATANFSEENKLGEGGFGPVYKGTLQNGQEIAVKRLSATSHQGQLEMKNEVVLVAKLQHKNLVRLLGCCIEEREKILVYEFLCNKSLDTILFDTSRQQDLNWEQRFKIIEGIGRGLLYLHEDSRLKIIHRDLKASNILLDVDMNPKISDFGLAKLFNMEASVANTSRIAGTYGYMAPEYALHGIFSAKSDVFSYGVLLLEIVTGRRNTCLHDSEDLLAFVIPAQILSKV

SEQ ID NO: 4916 - protein, 333 aa, Bradyrhizobium japonicum USDA 110
MSGSINRQILLVEKPSGKLGPEHFKMVDGAMPEPKDGEALLRVRYISLDAANRAWMHGATYRSAVEANSVMAGGGIAEVVSSKAPGLAAGDIVFGDTGWQEFAAVPAKHLTKMPKLEPMTHLLSVFGIAGLTAYFGLLEVGKPKEGETVVVSAAAGSVGSIVGQIAKIKGCRVIGIAGGADKCNWLTSELGFDAAVDYKDGAVFKALRAAAPTGIDVYFDNVGGDILEACLPQMNNYGRIACCGAISQYDGAPAAHGPRGVPGLIVVKRLVMQGFIVMDYMKDSQRALAELQGWVKSGKLKVQEDIIDGLENTPKALIGLLAGENRGKRMVKL

SEQ ID NO: 4917 - protein, 470 aa, Oryza sativa (indica cultivar-group)
MALPFPVPRGAHWAVTSTAHVLVGFTGAAVAAGKQKAAATAAAGRPGARNRQALGDIGNVLNAHVVDGKIQLPEGINRPITRSFGAQLLKKAQENAVAANKIVVQNPARKEPAPKPAKKVVPRPENAAKASTGAGVNENKKPSESEGAGSSSGGSALKYSRKKVVNTLTSVLTARSKHACGITEKPKEVVEDIDKLDGDNQLAVVEYIEDIYNFYRTAQICSETDSVVLAQLERRPTDYMSSQVEVNPKMRAILADWIIDVHYKFELMPETLYLTMYVIDRYLSLQPVLRRELQLVGVAAMLIASKYEEMWAPEVQDLIHVCDNAYSRQQILAMEKNILNRLQWNITVPTPYVFLLRFIKAAGGDKELENMVFFFSEMALKEYGMASLCPSLVAASAVYAAQCTLKRSPLWTSTLKHHTGFTESQLRECAKVLVNAHAAAPESKLKTAYRKYASEQLGRVSLRPPAVCLD

SEQ ID NO: 4918 - protein, 882 aa, Pseudomonas aeruginosa PAO1
MQDLDPVETQEWLDALESVLDREGEDRAHYLMTRMGELASRSGTQLPYAITTPYRNTIPVTHEARMPGDLFMERRIRSLVRWNALAMVMRANKHDPDLGGHISTFASSATLYDIGFNYFFQAPTDEHGGDLVFFQGHASPGVYARAFLEGRISEEQLENFRQEVDGNGLSSYPHPWLMPDFWQFPTVSMGLGPIQAIYQARFMKYLESRGFIPAGKQKVWCFMGDGECDEPESLGAISLAGREKLDNLIFVINCNLQRLDGPVRGNAKIIQELEGVFRGAEWNVNKVIWGRFWDPLFAKDTAGLLQQRMDEVIDGEYQNYKAKDGAYVREHFFGARPELLEMVKDLSDEEIWKLNRGGHDPYKVYAAYHQAVNHKGQPTVILAKTIKGYGTGSGEAKNIAHNVKKVDVDSLRAFRDKFDIPVKDADLEKLPFYKPEEGSAEAKYLAERRAALGGFMPVRRQKSMSVPVPPLETLKAMLDGSGDREISTTMAFVRIISQLVKDKELGPRIVPIVPDEARTFGMEGMFRQLGIYSSVGQLYEPVDKDQVMFYREDKKGQILEEGINEAGAMSSWIAAGTSYSTHNQPMLPFYIFYSMFGFQRIGDLAWAAGDSRAHGFLIGGTAGRTTLNGEGLQHEDGHSHLLASTIPNCRTYDPTYAYELAVIIREGSRQMIEEQQDIFYYITVMNENYVQPAMPKGAEEGIIKGMYLLEEDKKEAAHHVQLLGSGTILREVEEAAKLLRNDFGIGADVWSVPSFNELRRDGLAVERWNRLHPGQKPKQSYVEECLGGRRGPVIASTDYMKLYAEQIRQWVPSKEYKVLGTDGFGRSDSRKKLRNFFEVDRHWVVLAALEALADRGDIEPKVVAEAIAKYGIDPEKRNPLDC

SEQ ID NO: 4919 - protein, 108 aa, Oryza sativa (indica cultivar-group)
MAEEAQQPRGVKVGGIHDAPAGRENDLTTVELARFAVAEHNSKANAMLELERVVKVRQQVVGGFMHYLTVEVKEPGGPNKLYEAKVWERAWENFKQLQDFKPLDDATA

SEQ ID NO: 4920 - protein, 547 aa, Pseudomonas aeruginosa PAO1
MSELIRVPDIGNGEGEVIELLVKPGDKVEADQSLLTLESDKASMEIPSPKAGVVKSIKAKVGDTLKEGDEILELEVEGGEQPAEAKAEAAPAQPEAPKAEAPAPAPSESKPAAPAAASVQDIKVPDIGSAGKANVIEVMVKAGDTVEADQSLITLESDKASMEIPSPASGVVESVSIKVGDEVGTGDLILKLKVEGAAPAAEEQPAAAPAQAAAPAAEQKPAAAAPAPAKADTPAPVGAPSRDGAKVHAGPAVRMLAREFGVELSEVKASGPKGRILKEDVQVFVKEQLQRAKSGGAGATGGAGIPPIPEVDFSKFGEVEEVAMTRLMQVGAANLHRSWLNVPHVTQFDQSDITDMEAFRVAQKAAAEKAGVKLTVLPILLKACAHLLKELPDFNSSLAPSGKALIRKKYVHIGFAVDTPDGLLVPVIRDVDRKSLLQLAAEAADLADKARNKKLSADAMQGACFTISSLGHIGGTGFTPIVNAPEVAILGVSKATMQPVWDGKAFQPRLMLPLSLSYDHRVINGAAAARFTKRLGELLADIRTLLL

SEQ ID NO: 4921 - protein, 475 aa, Vibrio vulnificus YJ016
MYDTMTREFTMLKFLEQVRKPTLDLPVEVRRKMWFKPFIQSYLVVFIGYLTMYLIRKNFNVAQNDMISTYGLSMTDLGLIGLGFSITYGIGKTVVSYYADGKNTKQFLPFMLILSGLAMLGFSFSMGGGSASLFLMVAFYALSGFFQSTGGPSSYSTITKWTPRNKRGSYLGLWNMSHNVGGAGAAGVALFGANYLFDGHVIGMFVFPSIIAIIVGFIGMRFGSDSPEAYGLGKVEELFDEAVSEEDTAAEENQMTKKEIFVEYVLKNKVIWLLCFANIFLYIVRIGIDQWSTVYAYQELGLSKEAAISGFTLFEVGALVGTLMWGYLSDLANGRRALVACVSLALIIVSLEFYQHATSEFMYLASLFVLGFLVFGPQLLIGVAAVGFVPKKAISVADGVKGTFAYLIGDSFAKLGLGMIADGTPIFGLTGWKGTFAALDTSAMICIVLLAFVAIAEEKKIRHNKKKLELAASQS

SEQ ID NO: 4922 - protein, 304 aa, Shewanella sp. MR-4
MSQLYLEDGIKQLVSEFIAAGCPSVREQSLEERRQGYIASTVLAGEPEAVFEVKTLSLESIELTLFKPSADNNLPVVIYYHGGCFVSGGIATHNQQLRKIANDSGALVVAVSYRLAPEHVYPAAHDDAFNAANLVQQHCQQWGGDNTNITLMGDSAGGHLALVTCLRLKSKGQWLPKKQVLIYPMLDATAKSQSYIDNGDKYIITRDTLLTGFDMYLDWHPRTDVEASPLRSQELEGLPETHIITAEFDPLLDEGEQLFRNLLDAGVNAHCRRYLGVIHGFFQLAGVSQSARDAMVQVTHIIRA

SEQ ID NO: 4923 - protein, 446 aa, Vibrio vulnificus YJ016
MFGLFQSPSYTQAPLDKSQVDERYRYWRLHIMIGMYIGYAGFYFTRKTFNYAAPAMIVDLGLDKGDLGLIGTLFYITYGLSKFISGTISDRSNPRYFMGVGLIASGIINIVFGFSSSLIALSILWVLNAWFQGWGWPSCSKLLTTWYSRSERGFLWAIWNTAHNVGGALIPLLVGYLTFHFSWREGFIVPGIIGVLLGLIVCWRLRDKPTTQGLPTVGQWRHDPLELAQEKHGQGLSYREILTHYVFNNKYIWLLAFSYVLVYIVRTAINDWGNLYLTEQHHYSLINANAALSMFEIGGFVGSLVAGWGSDKLFGGNRGPMNLLFAAGIFLSVAALWLMPLTNFAFQAAGLFSIGFFVFGPQMLIGMAAAECSHKDSAGAATGFVGLFAYMGAALSGYPLALILEEYSWTGFFVTISICAAVIGLLLLPFLQAQPSRKPLAPKLRL

SEQ ID NO: 4924 - protein, 125 aa, Oryza sativa (japonica cultivar-group)
MEVAKPRWYERTLVLAVQRVFFNAYFLGYLLSPKLAHRVVGYLEEEAIHSYTEYLKDIEAGKIENVPAPPIAIDYWRLPAGATLKDVVVVVRADEAHHRDVNHFASDVHFQRMDLKDTPAPLDYH

SEQ ID NO: 4925 - protein, 1306 aa, Schizosaccharomyces pombe
MSYTNHSPANLTRNSSFNHQHYSTTLRSPPSMRGRGIDVNSSHYPHISRPRTSSDSQKMYTRAPVDYYYIQENPYFNNIDQDSISDKSLPSTNQSLHHSEEDTESDNDFSESIHPEFDIDVFYKVSNILYDESDLQDPEKRERLEWHSMLSSVLKGDVMQTEKRRLRLTEPDGHSGTYISEVWLGLQAWLHGRLNADQAEVIRKSREGVEPVLREVIDFQIQDEETTKPPLEQVTEILEKVEQCKQFYISSREMEENVPLSASKEFNYKLNALISWSNVMESIQVETLVLQKWVGNDEFDLTMRTPQFNYDGVENTSSFVERIFRQSGLQRTFEQRTLTTLNRIIHQAKQTISENAQAFEEMKLPTYEDKLLPLVRFPIKLLEEALRLSPAYAKKIKGPNFLIVDSMLDDFKIALSVAVRIKREYIKIASPSPGWSLPTNVDEDYDNVLLDSLKFYFKLLTLKLSSGNKNLYFKEIDFLENEWAFLNEHIYWINGGDIHMAGQFSYLSNSLLLNVHRYVESHLNGPTERTAASLTNWYSTLLKNTQIRFRKILRFSETLNSRFENASDFVISEGHLPDLVNRLSTTGHFLAYTANLERDGVFVIADHTLSENPEALKALLFSKDISNLETIQQNCSYVLILCPVHPIVWKGRIEKVDVPDFSVDLKTNRVRIIASNKREHLQAAKSVFQSISGDLVTLAVECRSSITRVYKEFIRLSKLCMRISSTVVDCVSAVREACSGVNCHDLIYHVFSFAAEFGQRILRFLSFDSYWQTKLKRKITSLAVEWISFICDECDLMDRKTFRWGVGALEFLMLMIRGNNILLIDDAMFLKIREKVGKSMAFLLTHFDVLGAKSKVAAKLQRESTEVSSSPRLTSFGDVEEEALSIQLLQKETMLRIDELEIERNNTLLERLAIGHVLDDSVFRNRDFIKLASSFSNITIRWQQGHFVRSGMFGDVYTGVNMETGDLLAVKEIKLQDSRTFRSTVDQIHNEMTVLERLNHPNVVTYYGVEVHREKVYIFMEFCQGGSLADLLAHGRIEDENVLKVYVVQLLEGLAYIHSQHILHRDIKPANILLDHRGMIKYSDFGSALYVSPPTDPEVRYEDIQPELQHLAGTPMYMAPEIILGTKKGDFGAMDIWSLGCVILEMMTGSTPWSEMDNEWAIMYHVAAMHTPSIPQNEKISSLARDFIEQCFERDPEQRPRAVDLLTHPWITDFRKKTIITMPPATITKKTSLSHTITEEKTAQLLAGRHDDSKAETDSLAASYKEESALPVASNVGLRQPNELRIDSINLPPAIVTPDTINYSVD

SEQ ID NO: 4926 - protein, 752 aa, Oryza sativa (japonica cultivar-group)
MAPPKISKDRFDAAIRAMADIGILKETAAPVLNNLLNLFDYNWVHIEADNYLALADAIFCDSDPKEGQKRQANETNLDADQSNKKLKTKKRSQNPTSKMHGNDNREFVEAPPQQGRGTLSARTVNGKKVTRAHLELPSSQLLIKEPHTCPSIAKNTTIVENNSAVLCHGQDLQTFEVPVATTCPQVVAPSTRKDARRTSGARHDQKHEGVSGAHERNRAVACSNQEIVSSKDSPSNIEVVLSNYGAGKLSFTYNSSLANRSDFHLPDIKLICKKMEARCLRKYKSLEPNFSFKNLIKDTCQCIVESSGPRHEGIIQTVPALDILSKPSVPQILQSNQANSAFMPPNNVMSLGGTSSSCTVAGVSQNSSNMPVVPHQLHIGANRPPHDVNDITKGEERLRIPIINEYGNGILPPPFHYIPHNITLQEAYVNISLARIGDDNCCSDCFRDCLAQSLPCACAAETGGEFAYTTDGLLKGAFLDSCISMIREPLKHPHFYCKICPNERMKIEVNSDSSNTEMNPGPCKGHLTRKFIKECWRKCGCTRNCGNRVVQRGITRHLQVFLTPEKKGWGLRSTEKLPRGAFVCEYVGEILTNIELYDRTIQKTGKAKHTYPLLLDADWGTEGVLKDEEALCLDATFYGNVARFINHRCFDANIIGIPVEIETPDHHYYHLAFFTTRIIEPFEELTWDYGIDFDDVDHPVKAFKCHCGSEFCRDKTRNEWFYAAALVWFINEIALADKSLYTATGSKSRARV

SEQ ID NO: 4927 - protein, 125 aa, Brassica napus
MAGLQRSNISFRRQGSSGIVWDDRLIAELNKQANEHKAETDEQEGQEDQTARPTSGGGIEPIRTEGRIERSRSNGGGANRHHRNTGRVSPAVDPPSPRLSAFGCCSAFGKKPVKQRKRPPKRRSR

SEQ ID NO: 4928 - protein, 565 aa, Streptomyces coelicolor A3(2)
MAATPPKPAAATPRRKVSRHRGEGQWAAGHFTPLNGNEQTKKDDDGLNVRTRIETIYSKRGFDSIDPGDLRGRMRWWGLYTQRRQGIDGGKTAILEPEELDDRYFMLRVRIDGGALTTAQLRVVGEISQEFARGTADITDRQNVQYHWIRIEDVPEIWNRLEGVGLSTVTACGDTPRVMIASPVAGIAEDEIIDGTPALEEMKRRVLNNPAYSNLPRKFKTAISGSPVQDVVHEINDVAFVGVEHPEHGPGFDLWVGGGLSTNPKLGVRLNAWVPIDDVPDVYEGVISIFRDYGYRRLRNRARLKFLVADWGAEKFRQVLEDEYLKRKLTDGPAPAEPSSRWRDHIGVHRQKDGRYYVGFAPRVGRVDGTILTKVADLAEAHGSGRVRTTVEQKMIVLDVEEGRVDSLVESLEALDLSARPSTFRRGTMACTGIEFCKLAIVETKARGASLIDELERRLPDFDEPLTINLNGCPNACARIQTADIGLKGQLMLDEHGEQVEGYQVHLGGALGLEAGFGRKVRGLKVTAQELPDYVERVLKRFQAEREDGERFAAWAARASEEALS

SEQ ID NO: 4929 - protein, 266 aa, Medicago sativa subsp. x varia
MANQSSELAIEQLKKLLREKEELNEVATTKIEELIVELQGCHPQPIDPAEQRIIDGFTYFKLNNFNKNPELYDRLAKGQSPKFMVFACSDSRVSPSIILNFQPGEAFKVRNIANMVPPFNQLRYSGVGATFEYAITALKVESILVIGHSRCGGISRLMSHPEDGSAPYDFIDDWVKIGLSSKVKVLKGHECNDFKEQCKFCEMDSVNNSLVNLKTYPYVDSEIRNENLALLGGYYDFVNGEFKLWKYKTHVTKSVTIPLNGFDMTK

SEQ ID NO: 4930 - protein, 393 aa, Pseudomonas fluorescens Pf-5
MRYSPFVQRISGESVSAWDIHYAAIEARGRGEDVIVLSVGDPDFATDERISAAASAALEQGDTHYTHVLGRPALREAIAAKQRRLLGIEVSADNVALVAGAQNGLFATSLCLFSSGDEVLVPEPMYLTYEACIHASGAQIACVQQPAANGFRLTAAALEAALTDKTRGIALATPCNPTGNVYSREELEAVAEVARKHDLWVISDEVYGQLTYDREHLSIASLPGMAERTVILNSLSKTHAMTGWRVGWVIAPPALVGHLDNLLLCMLYGLPGFIQEAALKALELDEEVIGSAREVYRRRRDLVVAGLKQVQLLDCREPEAGMFMLVDVRRTGLSSMDFAWQLFRATGVSVLDAQAFGASAEGFVRISFTVADEVLKDACQRIAGFVETLGAQR

SEQ ID NO: 4931 - protein, 353 aa, Gibberella zeae PH-1
MSSNLSFVLNKPGDVSFEERPKPSLASPHDVLVAVNYTGICGSDVHYWVHGSIGKFVVEDPMVLGHESAGTVVEVGDKVKTLKAGDRVALEPGYPCRRCQNCLAGKYNLCPDMVFAATPPYHGTLTGFWSAPADFCFKLPDNVSLQEGALIEPLAVAVHIVKQARVKPGDSVVVMGAGPVGLLCAAVAKAYGASKIVSVDIVQSKLDFAKDFASTHVYASQRIAPEENAKNICDLAGLPDGADVVIDASGAEPSIQASIHVLKNGGSYVQGGMGKADITFPIMAFCIKEATASGSFRYGAGDYPLAVELVATGKVDVKKLITGIVDFKQAEEAFKKVKEGEAIKVLIKGPNEQ

SEQ ID NO: 4932 - protein, 476 aa, Streptococcus bovis
MTKQYKNYVNGEWKLSKEEIKIYAPATGEELGSVPAMSQEEVDYVYASAKAAQKAWRALSYVERAEYLHKAADILMRDAEKIGAVLSKEIAKGYKSAVGEVIRTAEIINYAAEEGVRLEGEVLEGGSFDPASKKKIAIVRREPVGLVLAISPFNYPINLAGSKIAPALISGNVVALKPPTQGSISGLLLAEAFAEAGLPAGVFNTITGRGSVIGDYIVEHEAVNYINFTGSTPVGEHIGHLAGMRPIMLELGGKDSAIILEDADLDLAAKNIVAGAYGYSGQRCTAVKRVLVMDSIADKLVEKVSALVNNLTVGMPEDNADITPLIDTKAADYVEGLIKDAQEKGAKEVISFKREGNLISPVLFDNVTTDMRLAWEEPFGPVLPFIRVNSVEEAIEISNKSEYGLQASVFTNNFPLAFKIAEQLEVGTVHINNKTQRGTDNFPFLGAKKSGAGVQGVKYSIEAMTTVKSTVFDIAK

SEQ ID NO: 4933 - protein, 549 aa, Kineococcus radiotolerans SRS30216
MRAPGGQVRRRRGDRGAPGEGRRRRPPRPRLPRRGPHRRARGRGSRRRGAPGEGPRRRRRRRGVRRGHGRPRRVRGDLLRPRRAGAREHDRVRAQRPVHPRPAARRRGPHRHPPRVAAAAGDGGRRPGPGGTLGDGDPRRAGPADADPGRAVRPRRLRRLRRLRLRRLRLQPGGEPVVTVHKGLAGVVADTTAVSKVDPETNSLLYRGYPVQELATRCSSEQVARLLWDGELPSAAELERFRAREREGRRLDERVRRTIDDLPLTAHPMDVVRTAVSVLGALDPAAGDASPEAELAKAERLFAALPAVVAHAQRRRLGGQAPPPRDDLDHAANFLWMVTGAEPDAVAVRTFETSLVLYAEHSFNASTFAARVVTSTLSDLHSAVTAAVGALKGPLHGGANEAVWEAFEEIGLGEGSPGRARAWLAAALAGHRKVMGFGHRVYRHGDSRVPTMHAALRELATDRGRPDVLELYDALEAEMTRAKQILPNLDYPAGPAYHLLGLDTDLFTPVFVAARVVGWTAHVVEQRGANSLIRPLSEYDGPPLRHLPA

SEQ ID NO: 4934 - protein, 367 aa, Triticum aestivum
  misc_feature (89)..(89): Xaa can be any naturally occurring amino acid
MKLTVKTLKGTHFEIRVQHNDTIMAVKKNIEEIQGKDSYPWGQQLLIHNGKVLKDESTLDENQVSEDGFLVVMLSKSKASASSGASSGXPSSTPVTSQAPPVAQPQAPQPQVPSTTTSQPERPPAETPSSTVDLAASDLLSGSNLDTMINQIMEMGGGSWDRDKVQRALRAAYNNPERAIDYLYSGIPVTAEVAVPVVGQGANTTDAAPGETGLSGIPNTAPLDLFPQGASHAGGAAGGGSLDFLRNNQQFQALREMVHTNPQILQPMLQELSKQNPQLLRLIQENNDEFLQLLNETFEGGDGDFLDQADQDEMPHAISVTPEEQEAIGRLEAMGFERARVIEAFFACDRNEQLAANYLLEHAGDEE

SEQ ID NO: 4935 - protein, 343 aa, Arabidopsis thaliana
MKGLFKSKPRTPADLVRQTRDLLLFSDRSTSLPDLRDSKRDEKMAELSRNIRDMKSILYGNSEAEPVAEACAQLTQEFFKEDTLRLLITCLPKLNLETRKDATQVVANLQRQQVNSRLIASDYLEANIDLMDVLIEGFENTDMALHYGAMFRECIRHQIVAKYVLESDHVKKFFDYIQLPNFDIAADAAATFKELLTRHKSTVAEFLTKNEDWFFADYNSKLLESSNYITRRQAIKLLGDILLDRSNSAVMTKYVSSRDNLRILMNLLRESSKSIQIEAFHVFKLFAANQNKPADIVNILVANRSKLLRLLADLKPDKEDERFEADKSQVLREIAALEPRDLA

SEQ ID NO: 4936 - protein, 393 aa, Streptococcus suis 89/1591
MSKLSRRVLEMEESVTLAAGARAKALKAEGRDILELTLGEPDFVTPKNIQEAAIKSIEDGKASFYTVASGHPELKDAVNTYFENFYGYSIERNQVVLATGAKFVLYAFFAAVINPGDEVIIPTPYWVSYADQIKMNDGVPVFVTAREEHNFKVTVDQLEAARTDKTKVFLLNTPSNPTGMIYSREELEAIGNWAVEHDILILADDIYGRLVYNGNGFTPISSISESIRQQTIVVNGVAKAYAMTGWRVGFAVGNPEIIAAMSKIVGQTTSNLTTAAQYAAIEAFTGPQDTVETMRQAFEERLNTIYPLLAEVPGFEVIKPEGAFYLFPNVKKAMEMKGYTDVTEFTTAILEEVGVAMVTGAGFGAPENIRLSYATDMDTLKEAVARLHTFMKK

SEQ ID NO: 4937 - protein, 676 aa, Pichia pastoris
MTFPLLPAYASVAEFDNSLSLVGKAVFPYAADQLHNLIKFTQSTELQVNVQVESSVTEDQFEELIDNLLKLYNNGINEVILDLDLAERVVQRMIPGARVIYRTLVDKVASLPANASIAVPFSSPLGDLKSFTNGGSRTVYAFSETAKLVDVTSTVASGIIPIIDARQLTTEYELSEDVKKFPVSEILLASLTTDRPDGLFTTLVADSSNYSLGLVYSSKKSIPEAIRTQTGVYQSRRHGLWYKGATSGRTQKLLGIELDCDGDCLKFVVEQTGVGFCHLERTSCFGQSKGLRAMEAPCGIVRAMLQKVLIPNGYLTTKFCLNAKIREEADELAEAKSKEDIAWECADLFYFALVRCAKYGVTLDEVERNLDMKSLKVTRRKGDAKPGYTKEQPKEESKPKEVPSEGRIELCKIDVSKASSQEIEDALRRPIQKTEQIMELVKPIVDNVRQNGDKALLELTAKFDGVALKTPVLEAPFPEELMQLPDNVKRAIDLSIDNVRKFHEAQLTETLQVETCPGVVCSRFARPIEKVGLYIPGGTAILPSTSLMLGVPAKVAGCKEIVFASPPKKDGTLTPEVIYVAHKVGAKCIVLAGGAQAVAAMAYGTETVPKCDKIFGPGNQFVTAAKMMVQNDTSALCSIDMPAGPSEVLVIADKYADPDFVASDLLLKLNMVLIPR

SEQ ID NO: 4938 - protein, 366 aa, Bradyrhizobium sp. BTAi1
MQIKAAVARVQGAPLSIEALDIEDPRDNEILVKVVATGVCHTDLVVRDGMLPTPLPVVLGHEGAGIVTKVGRAISKVDVGDHVVMTFNSCGRCPSCQDHHVSYCHEFFPRNFFAARADGTSALSKQGERINGNFFGQSSFACHAICHEANVVKVDAKFDLELLGPLACGIQTGAGAVMNALKISAGKSFAVFGAGSVGLSALMAARVVGAATIVAVDTNDDRLAMARELGATHTINPTRVDATEEITKITGYGVNFALDTTGIAAVIRGAVMSLAPMGTCGILGASAMGTEITLDEVHFMSGGRRLMGIVEGESVPEVFIPMLAELNAQGRFPFDRLVKFYSLDQINEAIHDSETGRTIKPIVRMS

SEQ ID NO: 4939 - protein, 179 aa, Medicago truncatula
MNSNSNLETRTLLDELSDFNKGGLFDFGHPLVNRIAESFVKAAGIGAVQAVSREAYFTVIEGTGIDNAGGMPPEISGAKKNRFHGLRGETSSKSIEAMVKNTGKESFQWGLAAGLYSGLTYGMKEARGTHDWKNSAVAGAITGAALACTSDNTSHEQIAQCAITGAAISTAANLLTGIF

SEQ ID NO: 4940 - protein, 315 aa, Arabidopsis thaliana
MFYDGYAYHGTTFEQTYRCYPSSFIDKPQIESGDKIIMPPSALDRLASLQIDYPMLFELRNASTDSFSHCGVLEFIAEEGVIYIPYWMMQNLLLQEGDMVRVRNVTLPKGTYVKLQPHTTDFLDIANPKAILETALRNYSCLTVGDSIMVPYNNKKYFIDIVEAKPSNGISIIETDCEVDFAPPLDYKEPERPVAPAPAKGEAKAKEVDVAEAEPKFNPFTGSGRRLDGRPLSYEPQPGAANSNGQSHPVASSSSSGSEKATQQNRGKLVFGSNVERSTKETTKVGAGKDRKQEEEAEKEAKFQAFSGKKYSLRG

SEQ ID NO: 4941 - protein, 141 aa, Burkholderia sp. 383
MAIERTLSIIKPDAVAKNVIGQIYSRFEGAGLKIVASRMAHLSRADAEKFYAVHAARPFFKDLVDFMISGPVMIQVLEGEGAILKNRDLMGATDPKKAEKGTIRADFADSIDANAVHGSDAAETAAVEVAFFFPEMNVYSR

SEQ ID NO: 4942 - protein, 438 aa, Arabidopsis thaliana
MGRDRISELPDGLLNHILMYLHIEESIRTSVLSSRWRKLWLKVPGLDVNVHDFPADGNLFESLMDKFLEVNRGRLQNFKLNYESNLYYLMDRFVPWIATVVDRGIQHLDVTATDCPPWTIDFMPANICKSKTLVSLKLVNVGLDTPKFVVSLPCLKIMHLEDIFYSPLIAENLISGCPVLEDLTIVRNHEDFLNFLRVMSQTLKNFRLTFDWGMGSNDFSVEIDAPGLKYMSFRDSQSDRIVVKNLSSLVKIDLDTEFNLKFGLGSPLEPEDLTKRDIIRDFLTGISSVKHMIISHPTLEVLYRYSKIGQLPKFHNLYHLQAVFSSSLLQLLPAFLEICPNLKNLILDYSISAEPEQIDFTNLPRCLISTLEYVEIKQLTMREESGIKLVKYFLENSAVLKKLTLSFIDSPMTNQESEIYMQLLTSTKRSRGCHVLIL

SEQ ID NO: 4943 - protein, 601 aa, Borrelia garinii PBi
MSISIRKKNFCIIAHIDHGKSTLADRFIQKAKIISDRDFKSQMLDSMEIERERGITIKSQVVTITYKSNDGDCYELNFVDTPGHVDFSYEVSRAISSCEGALLLIDASQGIQAQTVSNFYMAFEHDLEIIPVINKIDLPNANIDFVKKQIKNDLGLNEEIAISISAKNGIGIDDLLEAICKHVPSPRGSIKDPLRALIFDSHYDSYRGVVVHFRIFEGQIKTGDKIRLMHTNSEHLIEEIGVFKISLERKDRLEAGDVGYFIAGIKNISDVKIGDTVTLCDCPALSPLEGFKEVKPVVFSSVYPVDANQYDDLLKAMDRLKLNDASLTFEKDSSSALGHGFKCGFLGLLHLEVIQERIEREFDLNVILTSPSVRYKIIPKKGESYFIESPEQFHGNEAIEGVLEPYIRANIIVPTEFLGNIMSVCLLKRGVQTSLIYLDTKRVELIYKMPLSEILFDFYDKIKSVSRGYASFDYELLDYEYTDLVRLDILVNGDRVDALSQLVFKDSAKTKAIGICKKLKDEIARQQFKIAIQGAIGSNVIARETISPVRKDVTAKCYGGDITRKRKLLEKQKEGKKRMKMVGNVEIPQRAFLAVLKSNDN

SEQ ID NO: 4944 - protein, 183 aa, Prochlorococcus marinus str. MIT 9211
MKWTINDQNKTMMSNYLSQLISQHKDFPKKGIVFKDVLPLLQHPNELEGLIQGMSTGQIFESSDAIVSIDARGFIFGTAISMKLSKPMIVARKPGKLPGELITHSYELEYGQNSLSIQKKAIENYQSFVIVDDLLATGGTAMCVSEMLKEAGKDITGLSVVVELGQLNARAYLPFPVESQIIF

SEQ ID NO: 4945 - protein, 886 aa, Thiomicrospira crunogena XCL-2
MNDKFVDQDPQETQEWIDALEAVVSFEGSDKAQHIIGTLIEKARVHGIDIPYSANTPYINTIAPEEQENYPGDVGIERKMRALLRWNAMAMVSRANKYTSVGGHIASYASSCTLYEVGMNHFFKGPKHKQGADMIFFQGHTAPGMYARSYMEGRLEADQLRNYRQEVDGNGLSSYPHPWLMSDYWQFPTVSMGLGPLMAIYQARFMKYMQARGLAETEGRKVWAFLGDGEMDEPESRGALQLAKRENLDNLIFVINCNLQRLDGPVRGNDKIIQELEGVFRGAGWNVIKVIWGSGWDRLLSKDVTGKLIERMGEVVDGEYQAYKAKDGAFVREHFFGKYPETAELVKDMTDDEIFRLTRGGHSPRKIYNAYKRATETQGQPTVILAKTVKGYGMGQYGEAANTAHQQKKLDIEGMKYFRDRFSVPISNEELEKDIPFHRPDEDSDVLKYMKERREALGGDLPSRQDTAEPLPVPDLSVFKMLTEGTEDREMSTTMAFVRIISILLRDKKIGPRCVPIIPDEARTFGMEGLFRQVGIYDPAGQLYEPMDSDQLMWYKESANGQVFQEGINEAGAMSNWIAAATAYANYGVSMVPFYIYYSMFGYQRIGDLAWAAGDSRARGFLMGGTAGRTTLEGEGLQHQDGHNLIQFDHVPNCLSYDPTFAYEMAVIIRDGIKRMFNEKEDVYYYITCMNENYSHPAMPAGSEEGILKGLYSFKKSEAKHKNKVQLMGSGTIFREVIAAAEMLENEWDVAADIWAAPSFNLLRRDGVETTRWNTMHPTEKPKVSYCEATLSGAKGPFIAATDYIRDYPNRIREYVPGEFYVLGTDGFGRSDTREQLRKFFEVNRYYVVVESLKALADAGSIKPEVVQKAIEKYGIDSEKTYPVHA

SEQ ID NO: 4946 - protein, 311 aa, Prochlorococcus marinus str. MIT 9211
MIWSVDSIPNQEGRIVLVTGANSGLGFDTARFLLNKGAGVILGCRTMQKAELARQKLLEQTPSANIELLEIDLGDLNQVDRAADQIAIKYKKLDLLINNAGVMAPPFTLSKQGLELQFAVNHLSHMALTLKLLPLMSKQDGARVVTVSSGAQYMGKINWNDLQGNNHYDRWASYSQSKLANVMFALELHKRLKKSNCNVASLSSHPGLARTNLQIASVAANGSWQEGFAYKLMGPMFQSSAMGSLPQLLAATDPNAKSGEQYGPRFNFRGYPKLCRVAPLALNMELREKLWELSLKLIRNFIQINSFKEIL

SEQ ID NO: 4947 - protein, 594 aa, Thiomicrospira crunogena XCL-2
MSKIVDILIPDIGDFAEVDVIEVLVSAGEEIIQDDSLLTLESDKATMEIPAPYAGRVVEMNVDVGDKVKEGSVVGKIEIADVETVSSNVEESVTPEPTPEKTDQKTTETPAPKAVSAADLPDADMQCDVLVLGSGPGGYTAAFRAADLGKKVVMIERYESIGGVCLNVGCIPSKALLHMSVVLNETREMGAHGIEFAEPKIDTNKMRAFKDSVIGKLTGGLSGLAKARNVDVVQGYGKFSSANTVTVDLADGGTKTIAFENAIIAAGSRVVKLPFIPHDDPRVMDSTDALELEEVPKRMLVIGGGIIGLEMAQVYDSLGSNITVVELGDTIIPGADKDISKPLLRRIKKKYENIYLKSKVTNVEAKEEGLVVTFEGKDCPETDTFDRILVAVGRAPNGKLIDAEKAGVAVNDWGFIEVDERQKTNVDHIYAIGDIVGQPMLAHKAVHEGKVAAEVINGMPSAFTPMGIPSVAYTDPEVAWAGKTEDELKAEGIEYEKGAFPWAASGRSLSLGRDEGLTKALFCAETHRLLGCGIVGPNAGELVAEAMLAIEMGADMQDIGLTIHPHPTLSETLCFAAEMAEGTITDLMPPKKKK

SEQ ID NO: 4948 - protein, 309 aa, Pseudomonas aeruginosa PAO1
MHPWTRRNIPQLAGRLALVTGANSGLGWQAARTLAGKGATVVMACRNREQAERARRAILDEYPQARLELADLDLADLASIRACAAGFRQRHARLDLLFNNAGVMFLPLRRTRDGFEMQMGTNHLGHFALTGLLLDSLLAAPRPRVVGMTSGFNQFGRLPLDDLNAERGYNRYLAYCHSKQANLLFSLELQRRAGQRGVLLQSLAAHPGYAATNLQYAAPAMSGSRLGRWAMKVANGAFAQSAEMGALPALSALTEQRWYGGAYVGPDRWLETRGYPAAARIPRNARDLGLAARLWALSEELTGVRFWSE

SEQ ID NO: 4949 - protein, 292 aa, Frankia sp. EAN1pec
MKKNPMVNRALEDFSSESLARARGPVGFPVTREMASVSDEDADGVPVRIYQPEAKRTGLVVYFHGGGWCVGSVGLMDNVARELAHATGATVVSVEYRLAPEHPYPAGLDDCELVTRWALKNAKRFGTSPAQVVVAGESAGGNLAAAVTLRLRGSSAVPLAGQILIYPGLDSGVDPLPSRVEFINVMGGASMMTYYWDAYAAGRDLTRDPFVVPLQADSLAGLPPALILRGGCDFLRDEGLRYATRLSEAGVPVEDTCYPGQPHGFVNYMFPAAEKLFRQISQWSKRIFAEAN

SEQ ID NO: 4950 - protein, 514 aa, Clostridium perfringens ATCC 13124
MKVIIGNAWPYANGSLHIGRVSSWMAGDILARYHRAKGDEVIFVSGSDCHGSPILNKAKEINKSPEELINKYHREFVRCFNKLGFSFDIFTRTDSEYHEEQVKYIIKSLYNKGFIYEKETEEFYCPKCCDTLDEFGIKEGLCNECNSKVEVRSSNNLFFKLSYFQDYIQNILDEEESWRENAIKITKRYLEGGLRDKILTREINWGIEVPIEGFEDKRVYVWIDALLAYVTASKKVIEEKGQSLEEYWNNEESRIYLVHGKENIPFHTTMFPAMLSGIGLEKSEIRIFSSQYLTLEGKTFSTNRNWAIWVPYIMERYNIDSIRYYLISRGAEEKNSDFTWRDFINANNNELVGEIGNFTNRVLTFIKKNFNGEIKGEELPLQWKNIIRRTYASVGNKFEEGEFKSGVKEIFNLIKQGNDFFDKNKPWILINNNKKKCEEVLYICSQILVALTDLMNPIIPFTCEKIKMFLGIKDIKWSFKERKNIRVNRVEFLFDKIDKKVAIEELNRLKNKKI

SEQ ID NO: 4951 - protein, 407 aa, Fulvimarina pelagi HTCC2506
MSVSLDLADPKTRPAVDAAGLSPVDVDERTSLIGMSREELGEALAAVGVPAKQVRMRTAQLWHWLYVRGVSDFAHMANVSKDLRNKLDAAYTIARPEIVTEQVSVDGTRKWVFRFPPRGAGRPVEIETVYIPEEGRGTLCVSSQVGCTLTCTFCHTGTQRLVRNLTAGEIVSQVLLARERLGDFPDVDTPAGAIVPSEGRLVSNVVMMGMGEPLYNFDNVATALGVISDGEGLSVSKRRITLSTSGVVPEIVRAGEETGVMLAISLHAVNDELRDELVPINKKYPLATLLEACRNYPGLSNAKRITFEYVMLKGVNDSMEDARNLVRMLKGIPAKINLIPFNPWPGSRYECSDWDQIERFADYVNQAGYASPIRTPRGRDIFAACGQLKSESERMRKKDRDRIELLN

SEQ ID NO: 4952 - protein, 435 aa, Burkholderia pseudomallei K96243
MADSYFPRWRAQPRDDAARVIAPDERLPWPQTFAMGVQHVVAMFGSTVLAPLLMGFDPNLCILMSGIGTLLFFVLVGGRVPSYLGSSFAFIGLVIAVTGYAGGGANPNVPVALGGIVACGVVYALIGLVVAAVGTRWIETLMPPVVTGAIVAVIGLNLAPIAVKGVSASTFDATLALVTVLCVGGVAVFARGMLQRLLILVGVLIAYVIYAVLTNGMGLGKPIDFAIVAQAAWFGVPTLHRPVFDPHAMLLIAPVAVILVAENLGHIKAVSAMTGRNLDRYVGRAFIGDGLATVVSASMGGTGVTTYAENIGVMAVTRIYSTLVFVAAALIAIALGFSPKFGAVIQTIPGPVLGGVSIVVFGLIAVTGARIWVVNRVDFSDNRNLIVAAVTLVLGAGDFSLKLGGFALGGIGTATFGAILLYALLRKEKEPGPMV

SEQ ID NO: 4953 - protein, 714 aa, Arabidopsis thaliana
MQKSGVNRNPSLKVAIPQAQQSLRRLGFCSQIATGGSQQSSPIVFPEKRNKKVKASSRRGEVTNDPQVKPKPDEHRIDIGGGDEKSDLLGSLVYAGKLVLDKRKSASGKDATEIQQPAATDISIKKAVDAKLTSSALVWGSDMLQLNDVVSVTYNVGLRHFTVHAYPIGKGSCGLSCFTKPKRSRKDFRFVAPTVEEAVQWVASFGDQQCFINCLPHPLVAKKQASSELFSVPIDTPPELVFRCKSAPKMLVILNPRSGHGRSIKVFHNVVEPIFKLAGIKMEVVKTTKAGHARELASTVDINLCSDGIICVGGDGIINEVLNGLLTRSNPKEGVSIPIGIVPAGSDNSLVWTVLGVRDPISAALSIVKGGLTATDVFAVEWIHTGIIHFGMTVSYYGFVSDVLELSEKYQKRFGPLRYFVAGFLKFMCLPKYSYEVEYLPAQKEDAEGKIRLEKEAVDMQDLYTDVMRRSSREGFPRASSLSSIDSIMTPSVGELDTCSSTHASTEPSEYVRGIDPKMKRLSSGRRDVTAEPEVIHPQAQSTTPNWPRTRSKSRMDKGWMGLTSVQDPPTRCSWGNTGGQDREDISSTVSDPGPIWDAGPKWDTEPSAWDVENSIELPGPPEDIETGLRKQSITPIFEDKWVSRKGHFLGIMVCNHACRTVQSSQVVAPNSEHDDGTMDMLLVHGCGRLRLLRFFILLQTGRHLSLPYVECVK

SEQ ID NO: 4954 - protein, 243 aa, Yersinia pestis KIM
MPCAMNWRWRLMVKFKAIRGVAFDLDGTLVDSAPGLARAIDMALAHQGLPAAGEALVSTWIGNGADVLVERALHWAGREHNAQLVAQTRELFDHYYAKTVEQGSQLFPQVKATLAQLAANGLPIGLITNKPTPFVAPLLTSLGISDYFSVIIGGDDVVVKKPHPAPLYLLLGKLGLHAREMLFVGDSRNDIMAAQAAGCPCIGLTYGYNYGEAIATSHPDCVLAHFADLLPAIGLPSLKDQEV

SEQ ID NO: 4955 - protein, 97 aa, Brassica napus
  misc_feature (59)..(59): Xaa can be any naturally occurring amino acid
  misc_feature (95)..(95): Xaa can be any naturally occurring amino acid
MEAVVECAKCECCGLVEDCTRDYILGVRAAFGGRWLCGLCSEAVRDEAARGTTARGPTXRGLEDALRDHMAFCGKCRRSPAFRVADGMRQMLRRXSK

SEQ ID NO: 4956 - protein, 420 aa, Pyrococcus horikoshii
MVEQDPFEIAVKQLERAAQHMKISEEALEFLKRPQRIVEVTIPVEMDDGSVKVFTGFRVQYNWARGPTKGGIRWHPEETLSTVKALAAWMTWKTAVMDLPYGGGKGGIIVDPKKLSDREKERLARGYIRAVYDIISPYEDIPAPDVYTNPQIMAWMMDEYETIARRKTPAFGIITGKPLSIGGSLGRNEATARGASYTIREAAKVLGWDGLKGKTIAIQGYGNAGYYLAKIMSEDYGMKVVAVSDSKGGIYNPDGLNADEVLKWKREHGSVKDFPGATNISNEELLELDVDVLAPAAIEEVITKKNADNIKAKIVAEVANGPVTPEADEILFEKGILQIPDFLCNAGGVTVSYFEWVQNITGYYWTLEEVRERLDKKMTKAFYDVYNTAKEKNIHMRDAAYVVAVQRVYQAMLDRGWVKH

SEQ ID NO: 4957 - protein, 408 aa, Arabidopsis thaliana
MSNMFSRIAMTNSIVLLLFSLTFLEHGLLFQGVSSLGINYGQVGDNLPPPDKVLQLLSSLHINKTRIYDTNPRVLTSFANSNIELFVTVENEMLPSLVDPQQALQWVTTRIKPYFPATKIGGIAVGNELYTDDDSSLIGYLMPAMMSIHGALVQTGLDKYIQVSTPNSLSVLQESYPPSAGCFRPEVAGVMTQLLGFLRNTNSPFWINAYPYFAYKDSPTKIPLDYVLFNPNPGMVDPYTKYRYDNMLYAQVDAVIFAMARLGFKDIEVGVSETGWPSKGDGDEVGATVANAAVYNKNILRRQLQNEGTPLRPNLSFDVYLFALFNEDLRPGPTSERNYGLYQPDETMTYNVGLLSSSSLTSTSTTSSTSIISLTSSASTALKKGKQRLMYWTCVYLLAIHMLIRRSY

SEQ ID NO: 4958 - protein, 341 aa, Glycine max
FGSRDHSADAQRTDLMTITRFVLNQQSNHPESRGDFSILLSHIVLGCKFLCSAVNKAGLAKLIGLAGETNVQGEEQKKLDVLSNDVFIKALVSSGRTCILVSEEDEEATFVEASKRGKYCVVFDPLDGSSNIDCGVSIGTIFGIYLIKEDHEPTIEDVLQPGKNMLAAGYCMYGSSCTLVLSTGSGVNGFTLDPSLGEFILTHPDIKIPKKGKIYSVNEGNAKNWDDPTTKYVENCKYPRDGSSPKSLRYIGSMVADVHRTLLYGGIFLYPADKKSPNGKLRVLYEVFPMSFLMEQAGGQAFTGNQRALDLVPKKLHERSPIFLGSYEDVEEIKALYAAEE

SEQ ID NO: 4959 - protein, 537 aa, Triticum aestivum
  misc_feature (319)..(319): Xaa can be any naturally occurring amino acid
  misc_feature (340)..(340): Xaa can be any naturally occurring amino acid
  misc_feature (375)..(375): Xaa can be any naturally occurring amino acid
MSMQQQQQQPARANLLGAMPAASMISLAFTAAVATAALWVAVAVARYNRKYRGLRLPPGPHGWPIVGNLFQVAFSGKLFIHYIRDLRREYGPILTLRMGVRTLVVISSAELVHEALVEKGTEFASRPAENTTRNIFSSNKFTVNSAVYGAEWRSLRRNMVSGMLSTSRLREFRPARLRAMDRFVARMRAEAAASADGASVWVLRNARFAVFCILLDMTFGLLDLEEEHIVHIDAVLKRVLLAVGVRMDDYLPFLRPFFWRKQRRALAVRREQVDTLLPLINRRRAILRDMQSSPPDPNVAAPFSYLDSLLDLHIEGREXADDELVTLCAELINGGTDTTXATAIEWAMARIVDNPSIQARLHEEIMQQVGDARPXDDKDIESMPYLQAFVKELLRKHPPTYFSLTHAAVKPGSKLAGYDVPTDANLDIFLPTISEDPKLWDRPTEFDPDRFLTGGETADMTGSAGIRMIPFGAGRRICPGLAMGTTHIALMVARMLQEFEWRAHPSQPAVDFKDKVEFTVVMNQPLLATVKPRKMSL

SEQ ID NO: 4960 - protein, 121 aa, Aspergillus oryzae
MSERFAPKVPVQLEDPKDDPITVEELSKCDGTDPNRPTWVAIKGIVFDVSKNPAYGPNGSYRVFAGKDSSRALACSSLKPEDCRPKWDDLEDKEKTVLDEWFTFFSKRYNIVGKVKDATNY

SEQ ID NO: 4961 - protein, 437 aa, Saccharomyces cerevisiae [sequence omitted]

SEQ ID NO: 4962 - protein, 380 aa, Glycine max
MEVPEMEGKTESHMTSAAAFVEGGVQEACDDACSICLEDFCKSDPATVTNCKHEFHLQCILEWCQRSSQCPMCWQPISLRDATSQELLEAVELERSLRDTPSRNAAIFHHPTLGDFELQHLPMGVNEADIEERIIQHLTAAAAMRRSHHLSRREGHRTRPSAHGRPHFLVYSTQPSAPPSAAGGGSEPAAIPVGSPSTPLTFDGNEQSSLQQIPHVQTQSSSLTSASTVSTTNLQGVHSDDRSFASHSFPASQDRAQPSEQSFSDSLRSRFNAVSMRYKDSISKGTRGWKERLFSPNSSMSELGSEVRRELNAKIASVSRLMERLETRENNSAAGTSLSNHLVNRSIAETSNQSNVEARGENSLHGNNTPTTFSASSDSK

SEQ ID NO: 4963 - protein, 284 aa, Oryza sativa (indica cultivar-group)
MAKKSVGDLTAADLEGKRVFVRADLNVPLDDNQNITDDTRVRAAIPTIQYLIKNGAKVILSSHLGRPKGVTPKFSLAPLVPRLSELLGIQVTKAEDVIGPDVEKLVSELPNGSVLLLENVRFYKEEEKNDPEFAKKLASLADLYVNDAFGTAHRAHASTEGVTKFLKPSVAGFLLQKELDYLVGAVSSPKRPFAAIVGGSKVSSKIGVIESLLEKCDILLLGGGMIFTFYKAQGLSVGSSLVEEDKLELATSLLAKAKEKGVSLLLPSDVIIADKFAPDANSQR

SEQ ID NO: 4964 - protein, 390 aa, Synechococcus sp. RS9916
MASLLEQLSAMTVVVADTGDLEAIRRFTPRDATTNPSLILAAAQIPAYQNLIDEALRSSRKLIGENAPVEDVVHEALDEISVIFGKEILKIVPGRVSTEVDARLSFDTEATIAKGRKLIRLYNDAGISNDRVLIKIASTWEGIKAAEVLEKEGIHCNLTLLFGFGQAVACAEAGVTLISPFVGRILDWYKAETGRDMYPGPEDPGVLSVTRIFNYFKTYGYKTEVMGASFRNTDEIVELAGCDLLTISPKLLDQLRGMDAPLTRKLDGANPSSSEAQIHVDRSRFDALMADDRMATDKLGEGIKGFSKAIETLEAQLAHRLAELEGGAAFRHAVQEIFLLNDMNGDGCITRDEWMGSDAVFDALDLDHDGRLTPEDVRKGFGAALTLTTA

SEQ ID NO: 4965 - protein, 476 aa, Oryza sativa
RKDYTTPSTMSLQTPRIGRLLSRQALHAPIRRRAFHRSSRLDVVKPFLLADIGEGITECQLIQWFVQPGARVEHFDKLCEVQSDKASVEITSPFDGVIKKLYYEPDDMAVTGRPLVDIDMDGDEAEAEAEKLGEAETSADKGENTKVNTASHETESRPTERRRNGNGKDDFSSLATPAVRHLMKELNVNITDVEGTGRDGRVTKEDVHRFVSQKTQQQMEVESPSTSPASTSASTSTLSTATQDQKLPLTPVQTQMFKVMTKSLSIPHFLYSCSADMTSVTATRKKLNAMKTSEKLTHLPFIIKATSLALQQHPLLNSALDTSDPKKPSLTYRSSHNFGVAVDTPSGLLVPVIRDVQNLSIAQIAQQLKALSEKARNGKLAPGDFSGASFTISNIGSVGGGVVAPIISEPQVAILGVGRSKVVPAFDENDQLVRREELVLSWSADHRVVDGAECARCAEKVKGLLEEPTAMLLEMR

SEQ ID NO: 4966 - protein, 473 aa, Arabidopsis thaliana
MKVELVFIPSPGVGHIRATTALAKLLVASDNRLSVTLIVIPSRVSDDASSSVYTNSEDRLRYILLPARDQTTDLVSYIDSQKPQVRAVVSKVAGDVSTRSDSRLAGIVVDMFCTSMIDIADEFNLSAYIFYTSNASYLGLQFHVQSLYDEKELDVSEFKDTEMKFDVPTLTQPFPAKCLPSVMLNKKWFPYVLGRARSFRATKGILVNSVADMEPQALSFFSGGNGNTNIPPVYAVGPIMDLESSGDEEKRKEILHWLKEQPTKSVVFLCFGSMGGFSEEQAREIAVALERSGHRFLWSLRRASPVGNKSNPPPGEFTNLEEILPKGFLDRTVEIGKIISWAPQVDVLNSPAIGAFVTHCGWNSILESLWFGVPMAAWPIYAEQQFNAFHMVDELGLAAEVKKEYRRDFLVEEPEIVTADEIERGIKCAMEQDSKMRKRVMEMKDKLHVALVDGGSSNCALKKFVQDVVDNVP

SEQ ID NO: 4967 - protein, 447 aa, Nitrosomonas europaea ATCC 19718
MKYNSIEEFKNYVSERNPGQPEFLQAVSEVIESLWPFIVDHSRYAEQGLLDRLIEPERMIIFRVAWVDDRGEVKVNRGYRIQYNSAIGPYKGGTRFHPSVNLSILKFLAFEQTFKNALTTLPMGGGKGGSDFDPKGKSPGEIMRFCQAYAAELFRHVGADTDVPAGDIGVGGREVGYMAGMVKKLTNRSDCVFTGKGLTFGGSLLRPEATGYGLVYFAEEMLNHSGCSLKGMRVSVSGSGNVAQFAIDKAMSLGAKVVTVSDSSGTVVDEAGFTPEKLAILAEVKNRLYGRVNEFAERVEAQFLPGEKPWHVPVDVALPCATQNELNENDAAILIRNGANCVAEGANMPCTAGAVERFHHAKVLFAPGKASNAGGVATSGLEMSQQAMRLSWTSGEVDMRLQEIMRAIHHSCTEYGKKPDGTVNYVDGANVAGFVKVAEAMLAQGVI

SEQ ID NO: 4968 - protein, 192 aa, Ligularia fischeri
KKPAAVNWIEGRGKSLVCEAVITEEVVKKVLKTSVPALVELNMLKNLTGSAIAGSLGGFNAHAANIVSVVFIATGQDPAQNIESSHCLTMMEAVNNGKDLHVSVTMPSIEVGTVGGGTQLASQSACLNLLGVKGANSESPGSNARLLARVVAGSVLAGELSLMSAIAAGPLVKSHMKYNRSNRDMTAVASTV

SEQ ID NO: 4969 - protein, 72 aa, Glycine max
LGLSVGVKYRSWPAKWLPDVMPHSLKVRAVAMFEAVQEIAIYIHRFHNLDLFQQGWYQIKITMRWEDDEDVS

SEQ ID NO: 4970 - protein, 606 aa, Zea mays
MCGILAVLGCADEAKGSSKRSRVLELSRRLKHRGPDWSGLRQVGDCYLSHQRLAIIDPASGDQPLYNEDQSVVVAVNGEIYNHLDLRSRLAGAGHSFRTGSDCEVIAHLYEEHGEEFVDMLDGVFSFVLLDTRHGDRAGSSFFMAARDAIGVTPLYIGWGVDGSVWISSEMKALHDECEHFEIFPPGHLYSSNTGGFSRWYNPPWYDDDDDEEAVVTPSVPYDPLALRKAFEKAVVKRLMTDVPFGVLLSGGLDSSLVATVAVRHLARTEAARRWGTKLHSFCVGLEGSPDLKAAREVAEYLGTLHHEFHFTVQDGIDAIEDVIYHTETYDVTTIRASTPMFLMSRKIKSLGVKMVISGEGSDELFGGYLYFHKAPNKEELHRETCRKVKALHQYDCLRANKATSAWGLEARVPFLDKEFINAAMSIDPEWKMVQPDLGRIEKWVLRKAFDDEEQPFLPKHILYRQKEQFSDGVGYSWIDGLKAHATSNVTDKMLSNAKFIFPHNTPTTKEAYYYRMVFERFFPQKSAILTVPGGPSVACSTAKAIEWDAQWSGNLDPSGRAALGVHLAAYEHQHDPEHVPAAIAAGSGKKPRTIRVAPPGVAIEG

SEQ ID NO: 4971 - protein, 533 aa, Frankia sp. EAN1pec
MTLLPRYGTNGTKQTMAMDQVSHTRLAAAHWPAAPSPHSLDVTVGDALREAARRRPDRIALVDGTEDRETRRQWTYAELLDTSLRWARALRREFDPGDRVAVWATNCPEWILFQFGTALAGLTLVTVNPAYRSSELGFVLRQSRAQGILVQRELRGRDLPGVVHEIADQLPELRWVMPLDQWVAYVEEADPGDVETDLPPVRPEDPVQIQYTSGTTGFPKGAYLAHQGMALNARLYAEAIGASERDTWVNPLPLFHTAGCGLATLGILQTGGCHVLPQGFETDLMFDLIDTYKATVTLGVPTMFIRMLEKLPTGSMLLDSLRIVTTGGAPVPVELVRRLEKEFGVMVAIGFGQTESSPYITHTRPGQDLPHWAETVGRPLPRVEVKISRPDGSVADVDEGGEICTRGVCVMKGYFENPEATSQTIDQNGWLHTGDVGTMDSHGYVRVLGRFKDLIIRGGENIYPRDVEAALSEHPDVTDVAVVGLPDGEWGEIVGAFVQTSKPLTADGLQAFLRGKLASYKIPQVWRFPKEFP

SEQ ID NO: 4972 - protein, 338 aa, Tropheryma whipplei TW08/27
MLVSGIFLSDILDPSGSLSDDISPALDRVEDLLLETVGDCHEIVSHLLVSGGKRARPLLVLLTSCMGSGINDAVIRAAAGIELIHLGSLYHDDVMDNAYIRHGSITAHRLWGKSAAILAGDFLFAKAGVLGLNLDKRAIAVQTEAFQRMISGQLSETLGISDSLDPLEAYIEVSRGKTGSLIAASAQVGAILGDASLSTLEPLRDFGESIGVAFQLVDDVIDLSGKSGKTPGSDIRAGVMSLPILLLSNAAKDDRDSAVLLEEIERVRRHSGACGSDDYSSEMNAVLAHLRKHDVTARTLEIARTWGDKAKHALKKLPECAPRDALLAFVETVVSREF

SEQ ID NO: 4973 - protein, 422 aa, Pseudomonas aeruginosa PAO1
MSDLKTAALEYHAQPRPGKLSVELTKPTATARDLSLAYSPGVAEPVREIARDAELAYQYTGKGNLVAVISDGTAILGLGNLGPLASKPVMEGKGVLFKRFAGIDVFDIEVDAESPQAFIDTVKRISITFGGINLEDIKAPECFEIERALIEQCDIPVFHDDQHGTAIVTAAGMLNALELAGKKLEEAKIVCLGAGAAAISCMKLLVSMGAKVENIYMIDRKGVIHAGRDDLNQYKSVFATETDKRTLADALEGADVFVGLSGANLLEPEDLKRMAPNPIVFACSNPDPEIKPELAHATRNDVIMATGRSDYPNQVNNVLGFPFIFRGALDVRATRINEEMKIAAALALRDLAKQPVPEDVCAAYGVDKLEFGREYIIPKPMDKRLITVVSDAVAKAAIETGVATLPYPKNYPLKSVDDVFNG

SEQ ID NO: 4974 - protein, 287 aa, Gibberella zeae PH-1
MLYLVGLGLSDETDITVKGLEVVKKASRVYLEAYTSILLVEQSVLESYYGRSITVADREMVESNSEEILRNAQNEDVAFLVVGDPFGATTHTDLVLRARELEIPVRTVPNASIMSGIGACGLQLYNFGQTVSMVFFTDTWKPASFYDRIKENRQIGLHTLVLVDIKVKEQSLENMARGRLVYEPPRYMTVGQCAQQMLEIEEERKEGVYAKDSLAIGAARVGGRTEKFVAGTLEELCSTDEELGPPLHSLVLLGRRTHELELDYVRQFAVDKEKWDKIWNAEYGKQL

SEQ ID NO: 4975 - protein, 377 aa, Fulvimarina pelagi HTCC2506
MASQRITDFLATNPVEGPCLVVDLDVVKENFNAFRKALPDSAIFYAVKANPAPEILKLLASLGSNFDCASVAEIKMALAAGVGPDRISFGNTIKKERDVAAADALGVSLFAVDCIEEVEKVARAAPAARVFCRVLTDGEGAEWPLSRKFGCMPAMAIDVLTHARDLGLRATGISFHVGSQQTDTNAWDAAIGDAKFVFEALERRGINLTLVNMGGGFPTRYLKDVPTAQAYGHAIFESLKKHFGNRLPETIIEPGRGMVGDAGVIKAEVVLVSKKSDTDENRWVYLDIGKFGGLAETMDEAIRYPIRTRHDGGATEPCVLAGPTCDSADVLYEKKPYPLPLALTIGDEVLIEGTGAYTTTYASVAFNGFEPLASYVI

SEQ ID NO: 4976 - protein, 238 aa, Gibberella zeae PH-1
MSDSKKEGAYGGAPSGDTDFRKTWDLEEYAAKGKEREAKEKEEGKARYEAKLAGKKYFKPLTGDETYTSARRHVIDFTQQIGKTQLVPGGAGVGKRGRGAGQYCEACDLTFKDNRQYIEHITTPQHLMNTGQTMNVKRATAEEVHERIEAYIRRQEDLEKEKQTSLHERLQLREEEAEKEAEERRKRRRDEMERKRLKQEEATKVKTEYGEDVRIEGEHDEDDMMASMGFVGFGTSKK

SEQ ID NO: 4977 - protein, 145 aa, Zea mays
MMVSGGRAALVVAGRALRGGAMAAAQEASNVQATYHLYNPAQNGWDLNPGTYCATWDADKPLSWRQKHGWTAFCGPAGQKGPGRCGKCIRVKNRATGASIVARIVDQCSNGGLDLDYETVFKKIDTNGQGYQMGHLNVDYQFVAC

SEQ ID NO: 4978 - protein, 552 aa, Burkholderia pseudomallei K96243
MSTPTDISPPIALERDAVLDQAHVGDIKGAFGTIAHHDTAPRSGWWARVRTLLAILGPGLIVMVGDNDAGAFGTYTQAGQNYGTSLLWTLLLLVPVLFVNQEMVLRLGAVTGVGHARLIFERFGKFWGAFSVIDLFILNALTIVTEFIGITFVLDFFGVSKVAGVCIAAALTMAAVSTGDFRRFERFAVALCVLSLLLVPVLVSIHPPVHQMARDLFVPTWPAHAKRSDVMLLVIGIVGTTVAPWQLFFQQSYVIDKRITPRFIKYEKADLWIGIVLVMIGAIAMISFSAALYAGRPEAGGFTDAGGVIAGLAKYAGPTSAMLFAIALLDACIIGAAAVSLATAYAIGDVFRIRHSLHRGVSDAKGFYLVYFGIVAAAAALVLMPGSPLGLLTEAVQTLAGVLLPSATVFLLLLCNDRAVLGPWVNSARLNLFTGAVVWVLVMLSIILTASVMYPDMSGEAMLEVLAGGTLFAALGLAATFVLRRRAGGADRANVAHVDRAARDTWRMPPLDALPAPRVTLSTRIWMGVLRGYLVLAVGLVIVKVVQMAFFR

SEQ ID NO: 4979 - protein, 420 aa, Pyrococcus endeavori
MVEQDPFEIAVKQLERAAQYMKISEEALEFLKRPQRIVEVTIPVEMDDGTVKVFTGFRVQYNWARGPTKGGIRWHPEETLSTVKALAAWMTWKTAVMDLPYGGGKGGIIVDPKKLSDREKERLARGYIRAIYDVISPYEDIPAPDVYTNPQIMAWMMDEYEAISRRKTPAFGIITGKPLSIGGSLGRNEATARGASYTIREARKVLGWGDLKGKTIAIQGYGNAGYYLAKIMSEDYGMKVVAVSDSKGGIYNPDGLNADEVLKWKQEHGSVKDFPGATNITNEELLELEVDVLAPAAIEEVITKKNADNIKAKIVAEVANGPVTPEADEILFEKGILQIPDFLCNAGGVTVSYFEWVQNITGYYWTLEEVREKLDKKMTKAFYDVYNTAKEKNIHMRDADYVVAVQRVYQAMLDRGWVKH

SEQ ID NO: 4980 - protein, 444 aa, Xylella fastidiosa Temecula1
MNHSRSHALFVQAQTRIPGGVNSPVRAFRSVGGEPFFVARADGPYLFDVDGHRYIDYVGSWGPMIVGHNHPAVREAVQVAISNGLSYGAPCAAEVTMAETIARLVPSCEMVRMVNSGTEATLSAIRLARGATGRNYIVKFEGCYHGHGDSFLVKGGSGMLTLGIPSSPGVPAELSKLTITLTYNDFDAATALFEEMGHHIAAVIVEPVIGNANCIPPQPGYLQHLRTLCTQYAVLLIFDEVMTGFRVALGGAQALYGVTPDLTTFGKIIGGGMPVGAYGGRRDLMQHIAPTGPIYQAGTLSGNPVAMAAGLAMLELIQAPDFYTHLSNAAAALCTGLQQAASQAGIAMTTQQIGGMFGLFFTDQQVETYAQATACNTDRFNRFFHAMLQRGVFFAPSAYEAGFISSAHSPNIIETTLEAARTAFQTIANEAAILSKSETPIKMR

SEQ ID NO: 4981 - protein, 419 aa, Thermococcus litoralis
MVEQDPFEIAVKQLERAAQYMDISEEALEFLKRPQRIVEVSIPVEMDDGSVKVFTGFRVQYNWARGPTKGGIRWHPEETLSTVKALAAWMTWKTAVMDLPYGGGKGGVICNPKEMSDREKERLARGYVRAIYDVISPYTDIPAPDVYTNPQIMAWMMDEYETISRRKDPSFGVITGKPPSVGGIVARMDATARGASYTVREAAKALGMDLKGKTIAIQGYGNAGYYMAKIMSEEYGMKVVAVSDTKGGIYNPDGLNADEVLAWKKKTGSVKDFPGATNITNEELLELEVDVLAPSAIEEVITKKNADNIKAKIVAELANGPTTPEADEILYEKGILIIPDFLCNAGGVTVSYFEWVQNITGDYWTVEETRAKLDKKMTKAFWDVYNTHKEKNINMRDAAYVVAVSRVYQAMKDRGWIKK

SEQ ID NO: 4982 - protein, 263 aa, Triticum aestivum
  misc_feature (116)..(116): Xaa can be any naturally occurring amino acid
MAQPAELSREENVYMAKLAEQAERYEEMVEFMEKVAKTIDSEELTVEERNLLSVAYKNVIGARRASWRIISSIEQKEESRGNEDRVTLIKDYRGKIEVELTKICDGILKLLDSHLXVPSSTAPESKVFYLKMKGDYYRYLAEFKSGTERKDAAENTMVAYKAAQEIALKELPPTHPIRLGLALNFSVFYYEILNSPDRACDLAKQAFDEAISELDSLSEESYKDSTLIMQLLRDNLTLWTSDISEDAAEEMKDAPKGESGDGQ

SEQ ID NO: 4983 - protein, 453 aa, Burkholderia pseudomallei K96243
MEFDYDLFVIGAGSGGVRLSRVAASYGARVGIAEEERIGGTCVLRGCIPKKLLVYASHYSHDVEDAAGYGWTFDIGLFSWPTLIEAKDREIARLSGIYVDLLNKSGVEIHTGRATLVGAHTVDVAGRRVTARHIAVATGSRPVLPPIPGIEHAITSREALELPELPQRIAIVGGGYIAVEFAGIFNGLGVDVDLFYRGEQILRGFDDDVRHALHGEMTKQGVAIHTRATIEAIERGADGGLTLRLAEGAYGPYDAVLYATGRVANGDGLGLEAVGVARDANGAIEVDAYSATTVPSIHAIGDVTARPQLTPVATRDGMLLAANLFGGKRIAADHRYVPSAVFSQPEIATVGLTEAQARAELGALDIYKTSFRALRHTLSGRDEKTFMKLVVARDSQRVVGAHMVGRDAAEIIQGIAIAIRAGATKAQFDETVGIHPTAAEEFVTLRQKEPDDA

SEQ ID NO: 4984 - protein, 880 aa, Oryza sativa (japonica cultivar-group)
METFLSAVLADLLSRSISFVIDRYCQQQQGVEENLQQLQRMLLRIQTVDEEANGRRITNQAMLLQLKTMRNVMYRGYYFLDNFRYRIALGHAPDEVDDHSLASFPFNPLKRFRFSTMARKIVSEDQEKKELLKMLGRLESIISEEFVMSLRSYPRMVRQPYCSYLLLENCMFGRQAEQERIISFLLEPHRAGAEGVAVLPIIGPARVGKSTLVENVCHDERVRKYFSTIVFYYTGSTEGAVADTGVIKHQNPASTKQSLVVIELVDDMDDETWRRILSSLRGDNIAAPVSKIIITSQSNKIATFGTTETLQLDMLPKEAFWYFLKTIAFGSTNPEEEPKLTSICMEIAAQANGAFLHANIIGGILRSNFSVQFWYKVLKRMKIITNWHFRLLGEHPRDMFAAKSGRTIVWFSKLNRFVPVTYNEASSSRLNDHPTSNAFIAKKGQLDENIDALEWQSSIPPYYKYRTRYAMIEQPNTLSTGKRSRSLSEGCTLKLRTEFELTFLPASYAAKIVRRPKITTVVAQQPPGIRRALADVSNLVNGRAALPVVNRQKAPAAADKCRKPIKQRNENNKAKPEVIVISSDSEKQKKSPAQRAASRRAPIQTLTSILTKCSRASGGVISPKKELIYDIDASDAHNELAVIDYVEDIYRFYRSTENTYRPLCTYMVSQTEINERMRAILTDWLIEVHYRLMLMPETLYLTVYIIDQYLSLENVARNELQLVGVSAMLIACKYEETWAPLLAIVFSAAQFAYDVQLAIMFNAVQFAHDFKDFLVISDNSFSRQQVLSTEKSILNKLQWNLTVPTMYMFILRYLKAALGDKELEHMTSVIAAAAVYAARCTLGPCPEPTMERSSGVPHRLSRATIAVCLLLHDLIFAHEI

SEQ ID NO: 4985 - protein, 459 aa, Bacillus cereus ATCC 14579
MSKLVVIGGGPAGYVAAITAAQNGKGVTLIDEAELGGTCLNVGCMPTKSLLESAEIHDIVRKANDYGVTLNTGSISIDWNQIQARKSQIVMQLVQGIQYLMKKNKIKVVKGKAKFETDHRVRVVQGNKEEVVDGESFIIASGSEPTELPFAPFDGKWILNSSHAMSLESVPSSLLIVGGGVIGCEFASIYSRLGTKVSIVEMAPQLLPGEDEDIANILREKLEKDGVKIFTGAVLKGLNNYKKQASFEYEGITHEVTPEFVLVSVGRKPRVQQLGLEKAGVQFSNKGISVNEHMQTNVSHIYAAGDVIGGIQLAHVAFHEGTTAALHASGEDVKVNYHAVPRCIYTAPEIASVGLSEKGAREQYGDILIGEFPFTANGKALILGEQVGKVKVIVEPKYQEIVGISIIGPYATELIGQGTVMIHTEVTADIMRDYIAAHPTLSEAIHEALMQAVGHAVHA

SEQ ID NO: 4986 - protein, 399 aa, Bacillus cereus ATCC 14579
MAVEVVMPKLGMAMKEGIITNWNIKAGDNVAKGELIASINSEKIETEIEAPADGTVLDIAVSEDEGVPPGTVICYIGKPNEKVEMQESTHVVEEKTFNIEVQNVQNQEPNGKEVAKQRIKISPVAKKIAKSENLGIKVLVGTGPGGRITKADVLKALEVRGIVPEISEQEESNVIPVTGMRKAIANRMHASLQNSAQLTLTMKVDVTDLVALHKEIAKVVQKRYDNKLTITDFVSRAAVLALGEHKEMNSAYIDDAIHQFEHVHLGMAVALEKGLIVPAIRFANNLSLVELSKEIKNVAQKARAGSLSSDDMHGTTFTISNLGSFGIEYFTPVLNTPETGILGIGAIEHVPVYKGKKLKKGSMLPLSLTFDHRVLDGAPAAAFLRTIKHYLEEPITILL

SEQ ID NO: 4987 - protein, 396 aa, Synechococcus sp. CC9605
MPTSKRLASLGNAVFARVDAAKQAYRLEASSLERPGLVDLSIGSSDLRPPTTLLDTMASAVMAFDSSSYCLQAGLRPFHAAVADWCRHRFDVAVDPDHEVQLLVGSQEGTAHLPLALLDSGDAALHLDPCYPSHTGGLHLAGARTKALALSPDNDWRPDLSTISPQLWDQLKLFVLGYPHNPSARVGDQEDLNRITAIAARHDVVIAHDNPYVDLALDGEPPALLKAPSWRECGIEFFSLSKGWCLGGFRLGFAVGAAPLIAALRRAKAVIDFNQSLALQQGAIQALQSFPDWPRQLHPTYRERRDRVVETLRARGWSVPCPEMAMYLWFPLPDAAHRRGWSDEDAARELLQRSGVALTPGSGFGDGGRQWLRMALVRPVNELVEVAERLADAMDD

SEQ ID NO: 4988 - protein, 344 aa, Bacillus cereus ATCC 14579
MTRTVSMSTAINEAMKISMRRDENVILIGEDVAGGAQVDHLQDDEAWGGVLGVTKGLVQEFGRNRILDTPISEAGYMGAAMAAAATGLRPIAELMFNDFIGSCLDQVLNQGAKFRYMFGGKAKVPVTVRTMHGAGFSAAAQHSQSLYALFTSIPGIKVVVPSTPYDAKGLLLAAIEDDDPVIFFEDKTLYNMKGEVPEGYYTIPLGKADIKREGSDVTIVAIGKQVHTALAAAEQLSKKGLEVEVIDPRSLSPLDEDTILASVEKTNRLIVIDEANPRCSIATDIAAIVADKGFDLLDAPIKRITAPHTPVPFSPPLEKLYLPTPEKVIETISEMIGDQSLLHV

SEQ ID NO: 4989 - protein, 428 aa, Mesorhizobium sp. BNC1
MATEIRVPTLGESVTEATIGRWFKKVGDAIAADEPVVELETDKVTVEVPAPSAGTLQEIAVKEGDTVEVGALLGSIGEGAAAAPAKAAPAAREKKEAVAQAAGASGAGSTGEAIEKTANVGGEPPIEERKRPPAPSAAKLLAENRLSTDEVAGSGKDGQVLKGDVLAAIERGGRGAPSQPAELPKVARAPSAPEDEVREERVKMTRLRQTIARRLKDAQSNAAMLTTFNEVDMTAVMDLRKKYKDLFEKKHGVKLGFMGFFTKAVCHALKEIPAVNAEIDGTDIIYKNFCHIGVAVGTERGLVVPVVRDADRMTIAEIEKEIGRLGAEARDGKLALADMQGGTFTISNGGVYGSLMSTPILNAPQSGILGMHKIQERPMVVGGQIVVRPMMYLALSYDHRIVDGKEAVTFLVRVKDVLEDPERLVLDL

SEQ ID NO: 4990 - protein, 470 aa, Mesorhizobium sp. BNC1
MPDTYDVVVIGTGPGGYVCAIKAAQLGLKTAVVEKRTNHGGTCVNVGCIPSKALLHATEMFAEAGHSFADLGIDVGTPKLDLKKMLAHKEKTVDQNVKGLDFLFKKNKIDVFRGAGRIAAAGKVVVTGEDGKEQTVETKNIVIATGSDVAGIPGVDVDFDERVIVSSTGALELPAVPARMVVVGGGVIGLELGSVWSRLGAKVTVIEYLDTILGGMDGEVAKQFQRMLAKQGFGFKLGAKVTGIAKTEGGASVTFEPAKGGEAETIDADVVLVATGRKPYIDGLGLKEAGVEVDERGRVKTDGHLRTNVPGIYAIGDVITGPMLAHKAEDEGVAVAEIIAGQAGHVNYDVIPSVVYTSPEVASVGKTEEELKKAGIEYNAGKFPFSANGRARSMLHTDGFVKVLADKKTDRVLGVHILGFGAGEMIHEAAVLMEFGGSSEDLARTCHAHPTMSEAVKEAALATFYKPIHS

SEQ ID NO: 4991 - protein, 412 aa, Aspergillus oryzae
MNSLRQFTRRKALQSLAVPPSQGFSTIRLWQRHFNSTPAVASRLAGIDPSKLTVTKTSSPKELTPAKDLVFGKTFTDHMLAIEWSASNGWDAPRIVPYQNLSLDPSACVFHYAFECFEGMKAYKDNNGQIRLFRPDKNMERLNKSSSRIALPTVDGEALTQLVGELVKLDSRFIPSARGYSLYLRPTMIGTQSTLGVGPPGSALLFVIASPVGPYYPTGFKAISLEATDYAVRAWPGGVGDKKLGANYAPCIVPQLSAASRGFQQNLWLFGEEEYVTEVGTMNLFIALKNKETGQKELVTAPLDGTILEGVTRDSVLGLARERLAPNGWTVSERKIRMSEVAEAADEGRLIEVFGSGTAAIVSPVRNISYKGKMVDCGLKEDEEAGEIASQMKNWIEGIQYGDEDHKWSYVL

SEQ ID NO: 4992 - protein, 510 aa, Saccharomyces cerevisiae
MPTSGTTIELIDDQFPKDDSASSGIVDEVDLTEANILATGLNKKAPRIVNGFGSLMGSKEMVSVEFDKKGNEKKSNLDRLLEKDNQEKEEAKTKIHISEQPWTLNNWHQHLNWLNMVLVCGMPMIGWYFALSGKVPLHLNVFLFSVFYYAVGGVSITAGYHRLWSHRSYSAHWPLRLFYAIFGCASVEGSAKWWGHSHRIHHRYTDTLRDPYDARRGLWYSHMGWMLLKPNPKYKARADITDMTDDWTIRFQHRHYILLMLLTAFVIPTLICGYFFNDYMGGLIYAGFIRVFVIQQATFCINSMAHYIGTQPFDDRRTPRDNWITAIVTFGEGYHNFHHEFPTDYRNAIKWYQYDPTKVIIYLTSLVGLAYDLKKFSQNAIEEALIQQEQKKINKKKAKINWGPVLTDLPMWDKQTFLAKSKENKGLVIISGIVHDVSGYISEHPGGETLIKTALGKDATKAFSGGVYRHSNAAQNVLADMRVAVIKESKNSAIRMASKRGEIYETGKFF

SEQ ID NO: 4993 - protein, 865 aa, Zea mays
  misc_feature (376)..(376): Xaa can be any naturally occurring amino acid
  misc_feature (406)..(406): Xaa can be any naturally occurring amino acid
MLSGIIDGLTGANKHARLKGTVVLMRKNVLDLNDFGATVVDSISEFLGKGVTCQLISSTLVDANNGNRGRVGAEANLEQWLTSLPSLTTGESKFGVTFDWEVEKLGVPGAVVVKNNHAAEFFLKTITLDDVPGRGAVNFVANSWVYPAGKYRYNRVFFSNDTYLPSQMPAALKPYRDDELRNLRGDDQQGPYQEHDRVYRYDVYNDLGEPDGGNPRPILGGSAEHPYPRRCRTGRKPTKTDPNSESRLSLVEQIYVPRDERFGHLKMSDFLGYSIKAITQGIIPAVRTYVDTTPGEFDSFQDIINLYEGGIKLPKIQALEDMRKLFPLQLVKDLLPAGGDYLLKLPIPQIIQEDKNAWRTDEEFAREVLAGVNPHXSITRLTEFPPKSTLDPSKYGDHTSTITAEXHREDLEGLTVQQALDGNRLYILDHHDRFMPFLIDVNNLEGNFIYATRTLFFLRGDGRLAPLAIELSEPYIDGDLTVAKSKVYTRRPAAVEAWVWQLAKAYVAVNDSGWHQLVSHLAEKHAVMEYVVIATNRQLSVTHPVHKLLSSHFRDTMTINRLARQSLINGGGIFEMTVFPGKYALGMSSVVYKSWNFTEQGLPADLVKRGVAVADPSSPYKVRLLIEDYPYASDGLAIWHAIEQWVGEYLAIYYPDDGALRGDEELQAWWKEVREVGHGDHKDAPWWPKMQAVSELASACTTIIWIASALHAAVNFGQYPYAGYLPNRPTVSRRRMPEPGSKEYEELERDPERAFIHTITSQIQTIIGISLIEILSKHSSDEVYLGQRDTPEWTSDARALAAFKRFSDALVKIEGKVVGENRDPQLRNRNGPAEFPYMLLYPNTSDHSGAAAGLTAKGIPNSISI

SEQ ID NO: 4994 - protein, 298 aa, Saccharomyces cerevisiae
MSEFKVKTGLAQMLKGGVIMDVVTPEQAIIAERAGACAVMALERIPADMRKSGQVCRMSDPRMIKEIMEAVSIPVMAKVRIGHFVEAQILEELQVDYIDESEVLTPADWTHHIEKHNFKVPFVCGAKDLGEALRRINEGAAMIRTKGEAGTGDVSEAVKHITKIKAEIQQYKENLKTESDFAAKATELRVPVDLLKTTLSEGKLPVVNFAAGGVATPADAALLMQLGCEGVFVGSGIFKSSDPEKLACAIVEATTHYDNPAKLLQISSDLGDLMGGISIQSINEAGGKNGARLSEIGW

SEQ ID NO: 4995 - protein, 217 aa, Synechococcus sp. CC9605
MTDANPRLSRQQALRLIEGAYLAAATGLIWLALYYLPVGGALFRLALPLPLILLQLRRGSRSGVEGLLLSVLLLTALMGPLRGPLLLFPYGLLSLWLGWSWCRGISWWLSWSGGVVLGTAGFLVRVLVLSLLVGENLWVVITRAGSALLDRLIAALHLPITPDLTQVQLMALLLVVVQEVIYVLSLHALAYWIFPRLKSPIPEPPRLLHGLVALDPL

SEQ ID NO: 4996 - protein, 459 aa, Oryza sativa (indica cultivar-group)
MGIGNGSPSDSRHVSHKEIRDETTPLLPIKEEEEGIHEFNGASFSGAVFNLSTTIVGAGIMALPASIKMLGIIPGILMIILVALLTEASIDMLVRCSHEGKITSYGWLMGETFGQWGRIVLQASVVINNIGMMIVYMIIVGDVLSGTSTSGVHHRGIFEGWFGPHLWNSRPVVLLATTLFVFGPLVSFKRLDSLRYTSALSVALAVVFVVITAGIAIVRLIEGTVEIPKLFPELDGTNSIWELFTAVPVVVTAYICHYNVHSIDNELEDRTQTKPIVQTSLALCSSVYIATSFFAYLLFGEGTLADVLANFDSNLHIPFSSVFNDVVRVSYVVHIMLVFPIVFFALRLNLDGLLFPTARHISRDNRRFAIITGSLLAVIYLAAIFIPSIWDAFQFTGATAAVLIGFIFPAMIILRDPYGIATKRDKILALTMIVLAVLSNSVALYSDALNIIFHRKVEA

SEQ ID NO: 4997 - protein, 360 aa, Chlamydomonas reinhardtii
MLQTAPMLPGLGPHLVPQLGALASASRLLGSIASVPPQHGGAGFQAVRGFATGAVSTPAASSPGHKPAATHAPPTRLDLKPGAGSFAAGAVAPHPGINPARMAADSASAAAGASGDAALAESYMAHPAYSDEYVESVRPTHVTPQKLHQHVGLRTIQVFRYLFDKATGYTPTGSMTEAQWLRRMIFLETVAGCPGMVAGMLRHLKSLRSMSRDRGWIHTLLEEAENERMHLITFLQLRQPGPAFRAMVILAQGVFFNAYFIAYLLSPRTCHAFVGFLEEEAVKTYTHALVEIDAGRLWKDTPAPPVAVQYWGLKPGANMRDLILAVRADEACHAHVNHTLSQLNPSTDANPFATGASQLP

SEQ ID NO: 4998 - protein, 276 aa, Nitrosomonas europaea ATCC 19718
MDTYAVIGNPVAHSKSPFIHARFAQQTGRIIHYTALLAPLDRFEQTVLDFRKTGGKGMNITVPFKFEAFTLASRLTDRASAARAVNTFRFEETGEILGDNTDGVGLIRDIEVNLNFPLAGKRILLMGAGGAASGVILPLLQQQPDLLAIANRTPDKAVSLQRQFASYSNITTGHYHDFAGQHFDLIINATSASLHNELPPVPADLFRNAFAYDMLYSSRLTPFLELARVQGAGYLADGAGMLVEQAAESFLLWHGIRPETQTVIRQLRDNLRHPTS

SEQ ID NO: 4999 - protein, 268 aa, Oceanobacillus iheyensis HTE831
MDNMLLAFLLTLFAGLATGVGSLIAFMAKTTNTKFLSFALGLSAGVMIYVSMVDIFFKAKDALTAYLGDTQGYWLTVIAFFGGMLLIGFIDRFIPKYTNPHEVKKVEDMKKPHQPLRDPDLMKMGLFTALALAIHNFPEGIATFVSTLHDPSIGLAIAIAVAIHNIPEGIAVSVPIYYATGDRKKAFKYSFLSGLAEPLGAIVAILILMPFLNDLMFGIIFAMVAGIMVFISLDELLPAARKYDEAHMSMYGVISGMALMAVSLLLLA

SEQ ID NO: 5000 - protein, 291 aa, Neisseria meningitidis Z2491
MLQGSLVALITPMNQDGSIHYEQLRDLIDWHIENGTDGIVAVGTTGESATLSVEEHTAVIEAVVKHVAKRVPVIAGTGANNTVEAIALSQAAEKAGADYTLSVVPYYNKPSQEGMYRHFKAVAEAAAIPMILYNVPGRTVVSMNNETILRLAEIPNIVGVKEASGNIGSNIELINRAPEGFVVLSGDDHTALPFMLCGGHGVITVAANAAPKLFADMCRAALQGDIALARELNDRLIPIYDTMFCEPSPAAPKWAVSALGRCEPHVRLPLVPLTEGGQAKVRAALKASGQL

SEQ ID NO: 5001 - protein, 150 aa, Brassica napus
  misc_feature (65)..(65): Xaa can be any naturally occurring amino acid
DLSLIPGAASKSAKKQNRDNTNTELWFEDLAQLSLPIFRTVILSMRSEDLSSDVIESCLISYAKXHIPGILRSNRKPSSSSSTAASENEQREILETITSNLPLDKSSISATTRFLFGLLRTAIILNASETCRDLLERKIGSQLERASLDD

SEQ ID NO: 5002 - protein, 571 aa, Oceanobacillus iheyensis HTE831
MAKKIEGIAASSGIAIAKAYELKTPELSFERSNIDDPTSEINRLDKALEISKQELEKIKAHTLKEIGEEHAEIFSAHLLVLSDPELIGPMKDKINEEKINAEAALDEVATMFIEMFKAMDNEYMRERAADIQDVTKRVMSHLLGVTFPDPALIDEQVVVIAEDLTPSDTAQLNREFVKGFATDIGGRTSHSAIMARSLEIPAVVGTKNITSSVQKDDVIIVDGLDGNIIINPSEEEIQAYKQKQADFAKKQEEWAKLKDEPSFTKDGEQVELAANIGTPEDVEGVLNNGGEGVGLYRTEFLYMGKSELPSEDEQFDAYKTVLEKMKGKPVVVRTLDVGGDKEISYLDLPKELNPFLGYRAIRFCLENEHVFRPQLRALLRASAYGNLKIMFPMIATIEEFRQAKALLMEEKDSLKNDGIEVSDDIEIGIMVEIPSTAVIAKQFAKEVDFFSIGTNDLIQYTMAADRMNEQVSYLYQPYNPAILNLINTVIEAAHAEDKWVGMCGEMAGDSIAIPLLVGLGLDEFSMSATSILPARTQLLSLNKKELVKAKEQFLAMSTSEEVVAFVKEITE

SEQ ID NO: 5003 - protein, 429 aa, Oceanobacillus iheyensis HTE831
MPYITDVYAREVLDSRGNPTIEVEIFTESGAFGSAIVPSGASTGEYEAVELRDGDKDRYLGKGVQKAVENVNDLIAPELIGIDVTRQNIIDALMIDLDGTENKGKLGANAILGVSMAAAHAAANYLEVPLYNYLGGFNAKTLPTPMMNILNGGEHADNNVDIQEFMIMPVGAPTFKEALRTGAEIFHALKKVLTSKGYNTAVGDEGGFAPNLGSNEEALQTIVEAIEAAGYKPGEEVKLAMDVAASEIYSDGKYNLKGEGVVRSSEEMVDWYEEMISKYPIISIEDGLDENDWDGFKILTDRLGDKVQLVGDDLFVTNTNKLSKGIDQGIGNSILIKVNQIGTLTETFEAIEMAKRAGYTAVISHRSGETEDVTIADIAVATNAGQIKTGAPSRTDRVAKYNQLLRIEDELAGMGEYGGLASFYNLANK

SEQ ID NO: 5004 - protein, 316 aa, Vibrio vulnificus YJ016
MSNKLEQLRKLTTVVADTGEIDAIKKYQPEDATTNPSLILKAAQIAEYAPLIDASIEYAKTQSDDKAQQIQDTCDMLAVNIGKEILKTIPGRISTEVDARLSYDMEGSVAKARQLVKMYNDAGITNDRILIKLASTWEGIRAAEILEKEGINCNLTLLFSFAQARACAEAGVFLISPFVGRIMDWYKAKEGRDFEAQEDPGVLSVTKIYNYYKEYGYKTVVMGASFRNIGEILELAGCDRLTIAPALLAELEAAEGEVVEKLVDSKGAAERPAPMTHAEFLWEHNQDPMAVEKLAEGIRNFAVDQGKLEAMIAAKL

SEQ ID NO: 5005 - protein, 409 aa, Yersinia pestis KIM
MGSVMTDKLAVNRNTFDQVILPVYAPAQFIPVKGKGSRVWDQQGTEYIDFAGGIAVTALGHCHPALVSALHQQGETLWHTSNVFTNEPALRLAQKLIAATFADRVFFANSGAEANEAAFKLARHYAIERHSPYKTKIIAFHNAFHGRTLFTVSVGGQPKYSDGFGPKPADIIHVPFNDLAAVKAVMDDHTCAVVLEPIQGEGGITSATPEFLQGVRALCDQHNALLVFDEVQSGMGRSGKLFSYMHYGVTPDILTTAKALGGGFPISAMLTTEEIASVMTVGTHGTTYGGNPLACAVAEAALDVINTPEVLNGIEQRHGLFVQALQSINSKYDVFSDIRGMGLLIGAELTAKYRGQAREFLAAAAANGLMILNAGPDVLRLAPSLVIELEDIQQGMARLEKAMASVIKG

SEQ ID NO: 5006 - protein, 663 aa, Vibrio vulnificus YJ016
MDRKHLANAIRALSMDGVQKANSGHPGAPMGMADIAEVLWRGHLNHNPSNPEWADRDRFVLSNGHGSMLIYSLLHLSGYELSIDDLKNFRQLHSKTPGHPEYGYAPGIETTTGPLGQGITNAVGMAMAEKALAAQFNKEGHDIVDHFTYVFMGDGCLMEGISHEACSLAGTLGLGKLIAFWDDNGISIDGHVEGWFSDDTPKRFEAYGWHVIPAVDGHNAEAINAAIEAAKADPRPTLICTKTIIGFGSPNKSGSHDCHGAPLGAEEIAATRKELGWEHGPFEIPQEVYAEWSAKEAGAAKEAAWNEKFAAYEAAYPELAAEFKRRVNGELPAQWEEKANQIIADLQANPANIASRKASQNALEAFGKMLPEFMGGSADLAPSNLTMWSGSKSLEASDFSGNYIHYGVREFGMTAIMNGIALHGGFVPYGATFLMFMEYARNAMRMAALMKVQNIQVYTHDSIGLGEDGPTHQPVEQIASLRLTPNMSTWRPCDQVESAVAWKLAIERKDGPSALIFSRQNLAQQERTAEQVADIAKGGYILKDSDGKPELILIATGSEVELAVKAAEQLTAEGKKVRVVSMPATDAFDKQDAAYRESVLPSDVTARIAIEAGITDFWYKYVGFDGRIIGMTTFGESAPADQLFEMFGFTVENVVNTAKELLA

SEQ ID NO: 5007 - protein, 343 aa, Oryza sativa
MAGSRAAGRGGRPLLGGGGGKRGGGGGGGGGGGGKSSSYTTTVILAALLLASVALLLLVALGALSLPSGGGVGVGHAGIGLPRPRPRFRRSAAFESGLEMRGGEKGEPWTEVLSWEPRAFLYHNFLSKEECEYLISLAKPHMKKSTVVDASTGGSKDSRVRTSSGMFLGRGQDKIIRTIEKRISDYTFIPVENGEGLQVLHYEVGQKYEPHFDYFHDEFNTKNGGQRIATLLMYLSDVEEGGETIFPSSKANSSSSPFYNELSECAKKGLAVKPKMGDALLFWSMRPDGSLDATSLHGGCPIQRLLTNSNLSMLLLKERKEKRSFLAHVEDFNFSIEKHYNFF

SEQ ID NO: 5008 - protein, 552 aa, Ustilago maydis 521
MSVVTVQTKPFEGQKPGTSGLRKRVKVFSQQHYTENFVQAILSAIPTGAPNSTLVVGGDGRYFSKPAIQAIIRLAAGNGVSKLIIGQDGILSTPAASHVIRSYKATGGILLTASHNPGGPENDFGIKYNMDNGGPAPESITNKIFDITKTITEYKIVEGPPVDLSKIGETTFGKLEIQIIDNVKDYVDYLSQIFDFALIKHFLKTSGFTVRFDALHGVTGPYGRALFVEQFGLDESSIQNCIPSEDFGGGHPDPNLTYAKSLVDAVEKENISFGAASDGDGDRNMIIGKGAFVNPSDSVAIIADWAQKAIPYFKSGIKGLARSMPTSGAIDRVAAKNGYECFEVPTGWKFFGNLMDAGRLSICGEESFGTGSDHIREKDGLWAVVAWLSILAAANKEKPGTSVSDVLLAFYKQYGRNFFSRYDYEEVDSDGANKLMAHLRDQFESASFKGSKLGDFQVAESGDFSYTDPIDGSVSKNQGLYIKFVDGSRIIFRLSGTGSAGATIRLYVEKYSNDDNEFGADAQVGLKPLIEQALAVSKLQEFTGRSKPTVIT

SEQ ID NO: 5009 - protein, 528 aa, Anabaena variabilis ATCC 29413
MDAKALWQRYQEWLYFHEGLGLYLDVSRMRFDDAFVKSLLPKFDKAFADMAELEKGAIANPDENRMVGHYWLRNPDLAPTPEIAQEIVQTLEQIEAFAEKIQTGAIHPPKANRFTDIISIGIGGSALGPQFVAEALAPEFPPLKIHFIDNTDPAGIDKILTHLRNNLASTLVLVISKSGGTPEPRNGMIEVKKAYAGQNLDFAQYAVAITSTGSNLDKVAQAEGWLATFPMYDWVGGRTSEMSSVGLVPAALQGIDVRAMLEGAKEMDDATRVPEVKNNPAALLALSWYYSGNGKGEKDMVVLPYKDSLLLFSRYLQQLVMESLGKEKDLDGKTVYQGIAVYGNKGSTDQHAYVQQLREGVPNFFATLIEVLEDRNGASPEIDPGVTSGDYLSGFLLGTRQALYENQRDSITVTIPQVNARTVGALIALYERTVGLYASLVNINAYHQPGVEAGKKAAAVILDLQTKVVGLLQKEKTALSLEQIAEKIGAADQVEAIYKILRHLQANQRGVVFQGNLGQPSSLKVSIS

SEQ ID NO: 5010 - protein, 200 aa, Brassica napus
MGDEIMNNISETRIEDQTQIRQSSYCHQCHQRRSDVVGNCVTKRLNTTCMVKYCSSCLWNRYKEIPEDVSSKEDWLCYKCRGICDCSKCLKTQGKKPTGFLRENGSSSYAVKNPKNAKRQLKLNDSSEGYNEENPAAGKRTKPILKKKEKSQLEEVKLPQGSESITVFGIDLPSENAGRVLQFLEFCSKFGKALGMRGGE

SEQ ID NO: 5011 - protein, 570 aa, Escherichia coli B
MSEKHPGPLVVEGKLTDAERMKLESNYLRGTIAEDLNDGLTGGFKGDNFLLIRFHGMYQQDDRDIRAERAEQKLEPRHAMLLRCRLPGGVITTKQWQAIDKFAGENTIYGSIRLTNRQTFQFHGILKKNVKPVHQMLHSVGLDALATANDMNRNVLCTSNPYESQLHAEAYEWAKKISEHLLPRTRAYAEIWLDQEKVATTDEEPILGQTYLPRKFKTTVVIPPQNDIDLHANDMNFVAIAENGKLVGFNLLVGGGLSIEHGNKKTYARTASEFGYLPLEHTLAVAEAVVTTQRDWGNRTDRKNAKTKYTLERVGVETFKAEVERRAGIKFEPIRPYEFTGRGDRIGWVKGIDDNWHLTLFIENGRILDYPGRPLKTGLLEIAKIHKGDFRITANQNLIIAGVPESEKAKIEKIAKESGLMNAVTPQRENSMACVSFPTCPLAMAEAERFLPSFIDNIDNLMAKHGVSDEHIVMRVTGCPNGCGRAMLAEVGLVGKAPGRYNLHLSGNRIGTRIPRMYKENITEPEILASLDELIGRWAKEREAGEGFGDFTVRAGIIRPVLDPARDLWD

SEQ ID NO: 5012 - protein, 337 aa, Anabaena variabilis ATCC 29413
MKIRVGINGFGRMGRLALRAAWGWPELEFVHINEIKGGAVAAAHLLKFDSVHGRWTPEVEAEGERVLIDSTPLSFSEYGKPEDVPWEDFGVDLVLECSGKFRTPATLDPYFKRGVQKVIVAAPVKEEALNIVMGVNDYLYEPEKHHLLTAASCTTNCLAPVVKVIHEGLGIKHGIITTIHDNTNTQTLVDAPHKDLRRARATSLSLIPTTTGSATAIALIYPELKGKLNGIAVRVPLLNASLTDCVFEVNRPTTVEEINALLKAASEQAPLQGILGYEERPLVSIDYKDDPRSSIIDALSTMVVDETQVKILAWYDNEWGYVNRMVELARKVALSLK

SEQ ID NO: 5013 - protein, 286 aa, Magnetococcus sp. MC-1
MLSKALNINGETGLLAVIGDPVSHSLSPKMHNLALRHCQLNYCYVALPVKPHNLVRAVQGFAAMGMRGFNATIPHKENLLPLMHTLSEEASHIGAVNTVVIDDDGKMTGHNTDAYGFITGLKEAWRSDLSGLTAIMLGSGGAARAILYGLIQAKAARVIIANRTIERAQALIEAMQPYAPNTQLMVAPTQADQLPLESCDLLINTTSMGLKGETIPYIDLARLPHHAFVSDIVYGAHPTPLLRATAQHQLGGQDGLPMLIHQGAKAFELWTGHSMPVELVEHTLRQ

SEQ ID NO: 5014 - protein, 512 aa, Oceanobacillus iheyensis HTE831
MSQNKLAALIILDGFAIRDEVKGNAVKQANTPNFDRFWNQYAHNQLEASGKAVGLPDGQMGNSEVGHLNIGAGRIVYQSLTRVNVSIDEGDFYEVDAFIKSVEHAKKHDKALHLFGLLSDGGVHSHINHLFALLRLAKKHELENVFVHAFLDGRDVGPKTASKYIKETQDVMDELGVGQFATISGRYYSMDRDKRWDRVKKCYDAMVYGEGPSYKSAQEVVDDNYANEIYDEFVIPSVITDDNDEPVATIKDEDSIIFYNFRPDRAIQISRTFANEDFRDFERGDKAPKKLDFVMLTNFSETVDGYVAYQPVNLDNTVGEVLAQNNLNQLRIAETEKYPHVTFFMSGGREKEFPGEKRILIDSPKVATYDLKPEMSVYEVTDALLKELDKGEQNAIILNFANPDMVGHSGKLQPTIDAIEAVDECLGKVIDKITELGGHAIITADHGNSDEVMTLEDKPMTAHTTNPVPVIVTKDDIELRDGGILADLSPTLLDLLNVEKPKEMTGNSLIKK

SEQ ID NO: 5015 - protein, 463 aa, Magnetococcus sp. MC-1
MTKNPILIIGGGISGLSTAWFLHKKGEKVILLESRDRVGGNIRTSRNPEGYLIEHGPNSTLQKPGDEEDALGRIITDMALESELQEANPLAARRFVMKGGQLHVLPTSPPGFIKTPLFSLSAKLRLCLEPFIGKSEQEESIAQFVIRRLGQEFLDYAIEPFVSGVYAGDPKQLSVRAAVAKIYALEAKYGSLIKGAIALGKIRKAAGMPRGRMISFETGMETLPATIANRLPHQSIHTNAQVTALCQHGAAWQVSWQQGGQHGGEPHSIIASQVVLATPASVSAQLLRPLSPQAADLLESIRYAPVDSVALGYAKQDINHSLDGFGFLIPRKEQVTTLGGLFSTTLFPGRAPQDKALLTCFIGGMTNPSITQWSEEKVVTQVDQDMMAALGIQHGAEYVHLTRYTHAIAQYEQGHLQRVGDIDRALAGYKGLHLRANWRDGVSVSDCVLNGEKSAQKILAGVS

SEQ ID NO: 5016 - protein, 252 aa, Oceanobacillus iheyensis HTE831
MRKKVIAGNWKMNKVLSEAGEFMNSVVPKAPKGNDVEAIVCAPFPFLSKLVEQAKGSEVKVAAQNMHFEDSGAFTGEVSPVMLKDLGVTHVVLGHSERRELFAETNELVNKKTKAAFAHDLTPIVCVGETLDQREANETMNIVGEQVKQAVAGLTNEQVAETIIAYEPVWAIGTGKTATSEQANEVCTEIRKVVAEVTSADVAEKVIIQYGGSVKPANVDELLAQSDIDGALVGGASLDPESFLQLVEAGTK

SEQ ID NO: 5017 - protein, 393 aa, Oceanobacillus iheyensis HTE831
MNKKTINDLQVEGKRVFTRVDFNVPLKDGEITDDTRIRAALPTIEQLTAQGAKVILASHLGRPKGTVVEELRLDPVADRLSDLLGKEVLKTDQVYGEEVDQAISELENGGVLLIENVRFEAGEEKNDPELVEAFANMADLYVNDAFGAAHRAHASTTGVAEKLPAAAGKLMEKEIEALGNALENPERPFTAIVGGAKVKDKISVIDNLLDKVDNLIIGGGLAYTFIKAQGHEIGKSLLEEDKIDLAKEFMNKAKEKGVNFVLPVDAIVADDFSEEANTKIVDIDKIPSDWEALDIGTKTREKYSSIVKDSKLVIWNGPMGVFELNAFAGGTKAVAEALASTEGYSIIGGGDSAAAVEKFGLAEEMDHVSTGGGASLEFMEGKVLPGLAALNDK

SEQ ID NO: 5018 - protein, 383 aa, Zea mays
MGPARQSRLSRVAPGPGDGRDACPCSSSPPSALPLPLPQPVSLYPRNEYNTNRGKGASGKPRWGKQGSEAKWSGAGLRLGSARGRSLLPVFHGVGVGGCGDSRSLKRRVVCGGRKEPHGAGRHGEEEEEEEEMVVCSTRKSFKDSLKVLEADIQHANTLAADFSRDYDGACLQMRMSYSPAAHFFLFLVQWTDCSLAGALGLLRILIYKVYVDGSTTMSTHERKGALGEFYAVIFPSLMQLAKGIRRRGRPEGRGRRATERYPEEGTRTRGKEAGFRRADIEREEECGICMEMNGKVVLPSCSHAMCIKCYRQWRSRSQSCPFCRDSLKRVNSGDLWMLTDCRDVVDMATVTRENIRRLFMYVEKLPLVAPDNIFYAYDSHVK

SEQ ID NO: 5019 - protein, 216 aa, Anabaena variabilis ATCC 29413
MSFIDSHSPQNVVPVEEIRYDERGLVPAIVQDYLDGTVLMMAWMNRESLQKTLDTGETWFWSRSRQELWHKGGTSGHTQKVQSIRYDCDSDALLVGVEQIGDIACHTGERSCFHQVEGKIVAPPGDTLSQVFQVICDRQNHPSESSYTSKLFAGGDNKILKKIGEESAEVVMACKDDDQEAIAGEVADLLYHTLVALAHHQVDIKAVYRKLQERRR

SEQ ID NO: 5020 - protein, 634 aa, Xanthomonas campestris pv. campestris str. 8004
MSTATNPLDLDVCAREPIHIPGLIQPYGVLLVIDPADGRIVQASTTAADLLGVPMAALLGMPYTQVLTLPEAQPFAVDDQPQHLMHAEVRFPQRATPPASAWVAAWHLYPQQWLVEMEPRDARLLDVTLREAMPLLRSVERDPGIAEAAVRVAKGLRSLIGFDRVMIYRFDEEWNGDIIAEARKPELEAYLGLHYPASDIPAQARALYLRNRVRQIADVGYQPSPIQPTVHPQLGTPVDLSDVSLRSVSPVHLEYLANMGVTATLVASIVVNDALWGLISCHHYSPHFTNHAMRDVTDAVARTLAGRIGALQAVARARLESVLLTVREKLITDFNDAEHMTVELLDDMAPDLMDVVDADGVAIFHGNDISRHGTTPDVAALRRIRDHIESEHHEALREDAVGALHVDAIGEVFPELADLAPLAAGFIFVPLMPQSRSALLWTRREQIQQIKWAGNPQLAKLEDIPNSRLSPRKSFDLWQQTVRGRARRWSPLHLESARSLRVLIELMERKRFQQDFTLLEASLSRLRDGVAIIERGTANAAHRLLFVNTAFADVCGSDVAELIGRELQTLYASDAPRANVELLQDALRNGRAAYVTLPLQVSDGAPVYRQFHLEPLPSPSGVTAHWLLQLRDPE

SEQ ID NO: 5021 - protein, 335 aa, Oceanobacillus iheyensis HTE831
MAVKIGINGFGRIGRNVFRQSLKNNEVEVVAINDLTDANMLAHLLKYDSVHGKLQEEVTVNGSNLVIDGKEIKVLSERDPAELGWGDLGVDIVIESTGRFTNKEDAEKHIQAGAKKVIISAPAKGEDLTIVMGVNDDQYDPSEHNVISNASCTTNCLAPFAKVLNDNFGIKRGLMTTIHSYTNDQQILDLPHKDYRRARAAAENIIPTSTGAAKAVGLVLPELNGKLNGNAVRVPTPDGSLTDLVAELDKNVTIEDVNNAMKEAAEGPLKGILEYSEEPLVSSDIVGNNHSSIFDALSTIVMEDNMVKVVSWYDNEMGYSARCIDLAIFMNNKGL

SEQ ID NO: 5022 - protein, 422 aa, delta proteobacterium MLMS-1
MSRRLDDPLVLLLAGGVGSRLNNLVQSRAKPAVPFGGIYRIIDFSLSNVMNAGFSQVGVLTQYKPLSLMRHIGDGAAWDFAGRTRGAKILPPRTGSRDSDWYKGTADAVRQNIDFIRTYPSPEVVILSGDHIYSMDLADLVGSHRRKKADLTVATMVVPKEQIHQFGAAITDAQGRIVEWEEKPAVPRTDLASMGIYVLSTDYLLNYLEKYRDDLDFGMDLIPRAIATDRVFAYPFRGYWRDVGTIQAYWEANMDLLAADSPLNPAAWGTRPNPEAEGLPYDRCPARFMGDGTVRQSLIPAGCIIEGTVLNSVLAPGVRVGPQAVVRDSILFHDCRVAAGATVDLAILDKRVQVGEKAVVGQGEDKTVANRANPKHLYSGISLIGKQARIPAGAVIGRNCIIAPGCRDDDFPTATLASGESL

SEQ ID NO: 5023 - protein, 432 aa, Anabaena variabilis ATCC 29413
MVNTTIKTTKSQEIFAAAQNLMPGGVSSPVRAFKSVGGQPIVFDHVKGAYIWDVDGNQYIDYVGTWGPAICGHAHPDVIGALHEALEKGTSFGAPSFLENVLAEMVIAAVPSIEMVRFVNSGTEACMAVLRLMRAFTNREKVIKFEGCYHGHADMFLVKAGSGVATLGLPDSPGVPKSATSSTLTAPYNDLEAVKALFAENRDQIAGVILEPVVGNAGFITPDAGFLEGLRELTHEHGALLVFDEVMTGFRIAYGGAQEKFGVTPDLTTLGKVIGGGLPVGAYGGRRDIMSMIAPAGPVYQAGTLSGNPLAMTAGIKTLELLQKPGAYEYLERITKKLADGLLQVAQETGHAACGGHISAMFGLFFTSGPVHNYEDAKNSDTAKFGRFHRGMLERGVYLAPSQFEAGFTSLAHTDEDIDQTIAIAREVLSSI

SEQ ID NO: 5024 - protein, 446 aa, delta proteobacterium MLMS-1
MPKAKPDVMAVVLAGGRVDELSVLTAHRPKSAVPFGGFARVIDFALSNLMQSGLELVAVLSQYRSFSLINHIGIGASWDMIGRHRGVFVLPPYQGFGQSSWYRGTADAVRQNLDFIQFHAPETILVISGDHVYHMDYREIIAYHRQKGADCTFACVEVPDSLAHRFGVAEIDDEDGRIGGRVLQYQEKPAEPCSRWASMTVYCFKPRVLYELLAANAREDESFEFGRDILPRAMATHRKVYGYKFRGYWGYTRTIEEYWQTSMDLLGYQPRLPLEQWGIRTNLEQRDIRDCPPLKVGEEAVISNSLVYNGCQVEGRVENSVLFPGVQVKPGAVVRDSVLFFDNVVGRDCHLEKVVSDVNVTVGDGVVIGVPAPSPAAGGATGTGRASGAENLAGGESGGDATTVTVLGWNNQIPAGMVIGAGCTLYPSLGPEKMARQRVADGEVLR

SEQ ID NO: 5025 - protein, 533 aa, Pseudomonas aeruginosa PAO1
MKLLAVRRLLRIQRVVIRYRLDDLILELPMLPWWLRLLGATLPWRWLPRRKLELTRGARLRLALQDLGPIFIKFGQILSTRRDLLPDDIANELAWLQDKVPPFPPELAVKRIEEQLGAKIEQVFARFEREPLASASVAQVHAARLKSGEEVVVKVIRPNLEPVIRSDIAWLFILARLAERVSSEARRLHPVEVVSDYEKTIVDELDLLREAANASQLRRNFEGSPLLYVPQVYWDWCRPKVLVMERIYGIPVTDLETLRDQRTDFKALAERGVEIFFTQVFRDSFFHADMHPGNIFVSTRAPWSPQYIAVDCGIVGSLTDEDQDYLARNLIAFFKRDYRKVAQLHIDSGWVPAETKVNDFEAAIRTVCEPIFEKPLKDISFGQVLLRLFQTARRFNMEIQPQLVLLQKTLLNIEGLGRQLYPELDLWATAQPFLERWMRERVSPKQLLRNFQQQVEQVPHLSQMARDTLERLSQPHAHNAPPPEWKGSRHDWLGRLVGAVLLVGAAEVGLGQQLEAWPAWVMLAGGVFLILRR

SEQ ID NO: 5026 - protein, 134 aa, Pseudomonas aeruginosa PAO1
MKDWLDEIHWNADGLVPAIAQDHETGRVLMMAWMNREALALTASENRAIYWSRSRGKLWRKGEESGHVQKLHELRLDCDADVVILMVEQVGGIACHTGRESCFYRVFENGAWKTVDPVLKDPDAIYEHAGHHHE

SEQ ID NO: 5027 - protein, 503 aa, Tropheryma whipplei TW08/27
MRPVLVVDFGSQYSQLVVRAIRECGYYAEFASPSISAAECLALSPIAIFLSGGPASAYKDNAPKLDEEIFNCGIPIFGICYGFQLLAQAFGGSVKKANAPEYGPADITIVNKAFFSGQPDRQTVWMSHGDSVIRAPKNFCILSTSQDAVLSFCNRDRTIAGVQWHPEVKHSRFGKHTIKAFLSSFAAPNWDPEQTICGTVDSIRKTVGCKRVLCALSGGVDSVVAATLTHRAIGDRLRCVFVDHGLLRLNEREQVEEYCSSLGLNVSTYDASDCFLSALSGIRDSEQKRKVIGREFIACFSKLQERFDIKPHFLLQGTLYPDLVESGATPGGATIKSHHNVGGLSDNLGFELLEPLKYLFKDEVRKIGLQLGIPKHIVHRQPFPGPGLAIRIIGEVTNKKLSILRAADAIVRHELRDWTDIWQCPVILLSDVQSVGVRGDSRSCGFPIVIRPVSSDDAMTADWYRLPYDVLARISGRITNEIPEIVRVVLDITPKPPATIEWE

SEQ ID NO: 5028 - protein, 2228 aa, Gibberella zeae PH-1
MALVPQPPASARQFGAEDDGLVCLELEDGSTFQGYSFGAQKSIAGELVFQTGMVGYPESVTDPSYRGQILVITFPLVGNYGVPSREAMDELLGDLPAHFESNQIHIAGLVTASYAGEDFSHFLATSSLGTWLKEQGVPAMYGVDTRALTKKIREKGSMLGKMRLEMRGVTNGAVTSQVDGALAALPLDHFEQVEWVNPNNKNLVQEVSIKEPKLYKPPQSVARKHPSGRTIRVLCLDVGMKFNQLRCFLKRGVEVLVCPWDYDIASAIDEFDGLFLSNGPGDPAVLENTVKNIASVLEKNEIPVFGICLGHQLLARAAGATTKKMKFGNRGHNIPCTSMVTGKCHITSQNHGFAVDTDSLTNGWKELFVNANDGSNEGIYHTEKPYFSVQFHPESTPGPRDTEFLFDVFINTMANCAEKPELLKTPVHFPGGTIEENEALHPRVSVRKVLVLGSGGLSIGQAGEFDYSGSQAIKALKEEGIYTVLINPNIATIQTSKGLADKVYFLPVNADFVRKVIQYERPDAIYVTFGGQTALQVGIQLKDEFESLGVKVLGTPIDTIITTEDRELFARSMDSIGEKCAKSASANNIDEAMHAVKDIGFPVIVRAAYALGGLGSGFANNEDELMELCNKAFAASPQVLIERSMKGWKEIEYEVVRDAQDNCITVCNMENFDPLGIHTGDSIVVAPSQTLSDEDYNMLRTTAVNVIRHLGVVGECNIQYALNPFSREYCIIEVNARLSRSSALASKATGYPLAFIAAKLGLNIPLKEIKNSVTKSTCACFEPSLDYCVVKMPRWDLKKFTRVSTQLGSSMKSVGEVMSIGRSFEEAIQKAIRAIDPHNLGFNDTEALMSIEDELQTPSDQRLFAIANAMHEGYTVDKIWELTKIDKWFLTKLKGLSDFSKRMTGYSTTDITSSPSILLQAKRLGFSDRQLAKFWSSNEIAVRRLRLEAGIQPFVKQIDTVAAEFPAFTNYLYMTYNASEHDVSFDDHGVMVLGSGVYRIGSSVEFDWCSVRAIRTLRASGFKTIMVNFNPETVSTDYDEADKLYFENILLETVLDIYQLENSSGILGAMGGQTPNNIALALHRAGVKVLGTSPEMIDNAENRYKFSRMLDRIEVDQPTWKELTSFSEAQDFCNAVSYPVLVRPSYVLSGAAMNTVYSEKDLKNYLDQAVEVSRDHPVVITKYIENAKEIEMDAVAKDGKVIGHFVSEHVENAGVHSGDATLILPPQDLEATTIQRIEEATRKIGAALNVTGPFNIQFIAKDNDIKVIECNVRASRSFPFVSKVMGVDLIEMATKAIMGQPFQAYPPTDLAPNCVGVKVPQFSFSRLSGADPVLGVEMASTGEVACFGVDKNEAYLKALMSTGFKIPKKNILLSIGSYKDKREMLPSVQKLEKLGYKLFATSGTADFLQEHGVQCQYLEVLGKEEDRSSEFSLTQHLAKNTIDLYINLPSNNKYRRPANYMSKGYQTRRMAVDYQIPLVTNVKNAKILVEAIARHFELEVSKRDYQTSHRTIVLPGLINIAAFVPGIASANSDDIQTVTQASISAGFSMIRVMPLGVDGAITDALTLNTAQQNSRRGGYCDYNFSVAATSDNADQISHVTGEVGSLFIPFNHLSGNISKVAAVTAHFDSWPNHKPIVTDAKLTDLASILLLASLHNRRIHVTSVTNKDDIKLIALSKAKGLQVTCDVSIYSLYLSRDEYPECERLPTAVDQKALWAHLSTIDVFSIGSLPYRLATSLGHKGDPHMGIYDALPLLLTSVAEGRLTVDDIKDRLYTNPMEIFELHEQSGTTIEAEIDRPYNLAPGNFWSPFEGRVMRGSVQRVTFQNTTVCLDGEVLKVSPQGKDMSSHIAPPMSPPTKPTTSIAQATDSPRDRRLSMLANFQPLNRLRGVDSDAAPVGELAPGLQPQPMVSSSLQQLLARPSSFKNTHVLSVKAYSRADLHLLFTVAQEMRLGVQREGVLNILRGRLLTTLFYEPSTRTSASFDAAMQRLGGRTIAISTSHSSVKKGETLQDTLRTLACYGDAVVLRHPEESSVHVAEKYSPVPVINGGNGSKEHPTQAFLDLFTIREELGTVQGLTITFLGDLLYGRPVHSLVYLLRHYQVQVQLVAPKSLALPPKVREQLVASGQLLCESETLTPEILARSDVLYCTRVQRERFPTEEEYQQVKNSYRVDNASLKHAKSSCIVMHPLPRNEEVAEEVDFDQRAAYFRQMRYGLYCRMALLALVMADS

SEQ ID NO: 5029 - protein, 296 aa, Arabidopsis thaliana
MENPAKRVLMTSNGDEVSRNIAFHLAKHGCKLVMMGNEGSLRSIVDKIRDSIEGAFPADVIALDMESDSEVAFHAAVQKAWELSGHFDAFLNSYTYQGLICFLFFTTLPLMLLCVDHSFIQQSFFLAGKVQDILQVSQDEFHRITKINLTAPWFLLKAVATRMKDHGSGGSIVFMATIASGERALYPGADAYASTSAAIHQLVRASAMSLGKHKIRVNMISRGLHLDDEYTASVGRDRAQKLVKDAAPLGQWLNPDTDLYSTVIYLISDGSRFMTGTTVLVDGAQSLTRPRLKSYM

SEQ ID NO: 5030 - protein, 374 aa, Oryza sativa (japonica cultivar-group)
MQMSTNPNHYPVFPHSFRNQHVVSFQTSTIANGSGAIPVCPASSGGMNSDMTLLNTTPSTIVSTSSPNMLADSNQSLKYAAPMAVDWSYPELQLLNDGLLKYANEPGIMKYIKIAAMLPEKTVRDVAMRCQWMAAKKENTRRRKTDEHYLGKKTRDRKDKMVESSWATNRQVQTTDIRSPSTLACNTVRDNQFQSGASEIDRAMLNILEENARVLKQIGENIMTSQVQNNIDLFHHARRNISDLLQSMSQMPGIMSKMPPLPVSIDDRLASYILPGVNLVQNNIDLFHHARRNISDLLQSMSQMPGIMSKMPPLPVSIDDRLASYILPGVNLCDGGPPAIGLGAPDQGAVKAPLSRWAQGERDLSNTFCSEVFP

SEQ ID NO: 5031 - protein, 571 aa, Triticum aestivum
  misc_feature (246)..(246): Xaa can be any naturally occurring amino acid
  misc_feature (255)..(255): Xaa can be any naturally occurring amino acid
  misc_feature (508)..(508): Xaa can be any naturally occurring amino acid
  misc_feature (534)..(534): Xaa can be any naturally occurring amino acid
GRAHCHTRHTHPNPRPQLKCHDSGHISSHGPRLAMDKAYITILTIAFLFLLHYILGKVSNGRRGRGAVQLPPSPPAIPFLGHLHLLEKPFHAALLRLAARLGPVFSLRLGSRRAVVVSSAECARECFTEHDVTFANRPRFPSQLLVSFDGAALATSSYGPHWRNLRRVAAVQLLSAHRVSCMSGVIAGEVRAMARRLFRAAAASPGGDGAARVQLKRRLFELSLSVLMETIAPTHAPETKAARSDXDADTALSEXAQEFKMVVVELIPYLGAANTWDYLPVLRWFDVFGVRNKILAAVSRRDAFMLRLIDNERRRLDNAGTEGDKKSMMAVLLNLQKTEPEVYADTMITALCANLFGAGTETTSTTTEWAMSLLLNHPAALKKAQAEIDAAVGTSRLVTADDVPRLAYLQCIVSETLRLYPAAPMLLPHESSADCKVGGYNVPSGTMLMVNAYAIHRDPEAWERPLEFVPERFEDGKAEGRFMIPFGMGRRGCPGETLALRTIGMGLXSRVQCFQWGTRGRRRRLKLPEGGGLXTPKVGPLKARGPGRPPAMRERSSQPLYGPTFLGTRGL

SEQ ID NO: 5032 - protein, 460 aa, Mesorhizobium sp. BNC1
MSGGEAQGVQPRRKRPASARPAIEDKPGLDARRTAAKLLAAVIDARTPLDALTDNEHGHPQYLSLEQRDRALVRAILISALRHRCTIEKLVGRRLDRPLPPNAHSLSHILHVGAAQILFLDVPDSAAVDLAVTQAKADPRAARFSGLVNAVLRNLARRKHELPKALENTRDAPAWFAERLEAVYGHDQTDAILKAHRLEAPTDFTVRSDPALWAERLGGRVLPNGSVRLDRLPSPIPELPGFAEGAWWVQDAAASLPARLLGDVEGLFVADLCAAPGGKTAALALEGAWVSAVDISASRLKRLKANLDRLGLSAEIVQADVLSWEPERKFDAVLLDAPCSSTGTVRRHPDVPWTKTPEDIAKLADLQRRLLERALTLIHPSGIVVFSNCSLDPSEGEELVRDVLGKQAGIALDPILPEELPGAEHFVTAEGFLRTTPAHFGTESQLDGIDGFFAARLRRS

SEQ ID NO: 5033 - protein, 606 aa, Rhodobacter sphaeroides 2.4.1
MELRNIAIIAHVDHGKTTLVDELLKQSGAFRDNQSVAERAMDSNDIERERGITILAKCTSVEWNGKRINIVDTPGHADFGGEVERILSMVDGVVLLVDAAEGPMPQTKFVTSKALALGLRPIVVLNKVDKPDAEPDRALNEVFDLFANLGASDDQLDFPALYASGRSGWADEQLDGPRKDLSALFELVLRHVPAPKQLAAREEPFRMLATTLSADPFIGRILTGRVEAGTVKAGDTLKALSRTGDRIEQFRVSKVLAFRGLSQTPIDLGEAGDIVTLAGMSKATVADTLCAPEVDVPLPAQPIDPPTISVTFGINDSPLAGKDGNKVQSRVIRERLMKEAEINVAIKVTDTPGGEAFEVAGRGELQMGVLIENMRREGFELSISRPRVLFREEDGQRMEPIEEVTIDVDDEFTGAVIEKLTGPRKGDLVEMKPAGAGKTRIIAHVPSRGLIGYHGQFLTDTRGTGVLNRVFHEWAPHKGPIEGRRVGVLVSMENGSSVPYALWNLEERGHLFIGAQESVYVGMIIGEHSRENDLEVNPLKGKKLTNVRASGTDEAVRLTPPVRLSLEQAIAYIDDDELVEVTPKIVRMRKRYLDPHERKRAAKAAE

SEQ ID NO: 5034 - protein, 473 aa, Prunus persica
  misc_feature (146)..(146): Xaa can be any naturally occurring amino acid
  misc_feature (194)..(194): Xaa can be any naturally occurring amino acid
MVFFRSVNALSKLRSRLGQQSNLRDSVRWLQTQTSTDLDLRSQLKELIPEQQERLKKIKAEYGKVQLGNITVDMVLGGMRGMTGLLWETSLLDPDEGIRFRGLSIPECQKVLPGAKPGGEPLPEGLLWLLLTGKVPSKEQVDALSXELRSRAAVPDYVYKAIDALPITAHPMTQFTTGVMALQVQSEFQKAYDXGIYKSKYWEPTFEDSLSLIAQLPVVASYVYQRIFKDGKVIPVDDSLDYGANFSHLWGFDDPKMHELMRLYVTIHSDHEGGNVSAHTGHLVASALSDPYLSFAAALNGLAGPLHGLANQEVLLWIKSVVDEVGENVTTEQLKDYVWKTLNSGKVVPGFGHGVLRKTDPRYSCQREFALKHLPDDPLFQLVSKLYEVVPPILIELGKVKNPWPNVDAHSGVLLNHFGLTEARFFTVLFGVSRSIGIGSQLIWDRALGLPLERPKSVTMESLENYCKKAASS

SEQ ID NO: 5035 - protein, 408 aa, Gluconobacter oxydans 621H
MTEEFHRIRRLPPYVFAEVNKAKAAARAAGDDIIDLGMGNPDSAPPAHVVQKLIETVGNPRAHGYSVSRGIPGLRKAMANYYERRFNVSLDPETEVIATLGSKEGLANLAAAITSPGDTILVPNPSYPIHQFGFIIAGASVRSIPATPDEDMLRALERAVRHSVPKPTALIVNFPSNPTAFVANLDFYKELVAFARREEIWILSDLAYAEIYFNENEPPPSLLAVPGAKDVAVEFTSMSKTYSMAGWRMGFAVGNPRLIQALTRIKSYLDYGAFTPIQVASVAALNGPQDYVSEIRAMYKDRRDVLLRGLQSAGWDVPAPAGSMFAWAPIPPAFAEMGSVAFSKLLLKEAGVAVAPGLGFGEYGEGFVRIGLVENTQRLRQATRAIKGFMSRHGAGAGTADLLGAASS

SEQ ID NO: 5036 - protein, 689 aa, Oryza sativa (indica cultivar-group)
MAETPRRIRRGGAGLSLVVVALLLAVAARAQQEYEANQQNACYATNASSTLGYTCNATSASAAAAAPCDAYLVFRSSPPLYASAVSISYLLNVAAAAVADSNAVDPVAPVAADRLVLAPVPCGCSPGGYYQHNASHTIRDTGVETYFIIANLTYQGLSTCQALIAQNPLHDSRGLVAGDNLTVPLRCACPSPPQAAAGVKHMVTYLVTWGDTVSAIAARFRVDAQEVLDANTLAESSIIYPFTTLLVPLKNAPTPDMLAPPAQAPPPPAPAPPRAQPPPGGSGSGKGVAVGVGVGCGVLALAGVFGLLFFCLRRRRGVGEESVRPGKVVGDVSSSAEYGALASGKQTTTATSMSSLSAARSLMASEVREALESLTVYKYSELEKATAGFSEERRVPGTAVYRGVFNGDAAAVKRVSGDVSGEVGILKRVNHCSLIRLSGLCVHRGDTYLVFEYAENGALSDWLHGGDAATGVLGWRQRVQVAFDVADGLNYLHHYTNPPCVHKNIKSSNILLDADLHGKMSSFGLARALPAGDGAAAAAAQLTRHVVGTQGYLSPEYLEHGLITPKLDVFAFGVVLLELLSGKEAAFSGDGENGEALLLWESAAEALVDGGGEDAGSNVRAFMDPRLGGDYPLDLAMAVASLAARCVARQPAARPAMDEVFVSLAAVYGSTVDWNPSDHGNSGSSLIGR

SEQ ID NO: 5037 - protein, 255 aa, Anabaena variabilis ATCC 29413
MDWKEIRGNWVLVPRNPVGIIHFLGGAFVATAPHLTYRWLLEQLGNKGYVVIATPFVNTLDHIAIANSVLLNFERTIERLHDSGALRKLYLPTYGIGHSMGCKLHLLIGSLFPVERAGNILISFNNYAAKDAIPLVEQFNTTLAIEFTPSPLETNKLVQESYNIRRNLLIKFNNDNLDQSAALTKILQVRFPEMVTAQTLPGTHTTPLGQDVKWQTGSSFTPFDALGQWFKQEVYRDLNQLNRAILLWLNPLSPP

SEQ ID NO: 5038 - protein, 182 aa, Pisum sativum
MALNLCTSPKWIGTTVFDSASSSKPSLASSFSTTSFSSSILCSKRVGLQRLSLRRSISVSVRSSLETAGPTVTVGKVTEVNKDTFWPIVNAAGDKTVVLDMFTKWCGPCKVIAPLYEELSQKYLDVVFLKLDCNQDNKSLAKELGIKVVPTFKILKDNKIVKEVTGAKFDDLVAAIDTVRSS

SEQ ID NO: 5039 - protein, 290 aa, Oryza sativa (indica cultivar-group)
MADEHEWWNSPCSARTGDDEAACSTADADESAVGSTPMSFGHGVQPASLSDAAASSSSSSFLLAGQHMDYWTQDFMGGRAAAAATASFDTLLQLQLQLQGGDAASRRLLLGDHAAAPPRHLVVPGAPYGGGGGDDTAAPPRGLSPTPYEAADNLQQQQSFPGGHHVVSNTDRLHDHHQDAGSPSPATRSSPGSPAAAKKPRIEAPSPMPTFKVRKEKLGDRITALQQLVSPFGKTDTASVLHEAIEYIKFLHDQVAPLIDWTRLYLHAVSELTVPEVWAPRAATTPTGIS

SEQ ID NO: 5040 - protein, 437 aa, Magnetococcus sp. MC-1
MTPSADLIQWDKRHCWHPFTQAQTAPDPIPMASARGATLTSVDGRTFIDLNASWWVTTHGHAHPAIAAAIAQQAQTLEQVIFAGFTHAPAVNLATRLSETLGGDLDRVFFSDDGSTAVEVALKMAAQYHINQGTPRHRFVAFRGGYHGDTVGAMSMGQGSGFFDAFQAMLFHVDLLDYPATWLGDPTPELREALVLSQLDDYLATHGPQCGALLMEPLVQGAAGMRMARAGFVQQVMERCRAAGVLVILDEVMTGFGRTGTLFAFQQCGDYPDIICLSKGLTAGFMPMSVTVVREPIYQAFMGEGFERALAHGHSFTANPLGCVAALASLELFEQEGSLARIGQIAALHQQRLEPLQKHAKAVRPRVCGSIGAIDLRVADGGYGAEIGPKLKAFFIEKGLLMRPLGNTVYLLPPYCVSDAQLHQGWDAIEEALDTLL

SEQ ID NO: 5041 - protein, 109 aa, Emericella nidulans
GASEHVPPITSKAEFQEKVLNAKGFVVVDCFATWCGPCKAIAPTVEKFAQTYTDASFYQIDVDELSEVAAELGIRAMPTFLLFKDGQKVSDVVGANPGALEAGIKALLA

SEQ ID NO: 5042 - protein, 403 aa, Neisseria meningitidis Z2491
MIIDVKVPMLSESVSEGTLLEWKKKVGEAVARDEILIDIETDKVVLEVPSPQAGVLVEIVAQDGETVVADQVLARIDTAATAAAEAPAAATAAAEAPAAAPAEAAPAAAPAAAQNNAAMPAAAKLAAESGVDVNALQGSGRDGRVLKEDVQNAAAKPAAAAAPAVALPAGARPEERVPMSRLRARVAERLLASQQENAILTTFNEVNMKPIMDLRAKYKEKFEKEHGVKLGFMSFFVKAAVAALKKYPVVNASVDGKDIVYHGYFDIGIAIGSPRGLVVPILRDADQMSIADIEQAIVDYAKKAKDGKIAIEDLTGGTFSITNGGTFGSMMSTPIINPPQSAILGMHATKERAVVENGQVVVRPMMYLALSYDHRIIDGREAVLTLVAIKDALEDPARLLLDL

SEQ ID NO: 5043 - protein, 477 aa, Neisseria meningitidis Z2491
MSQYDVVVIGAGPGGYVAAIRAAQLGFKTACVDAGVNKAGNAPALGGTCLNVGCIPSKALLQSSEHFHAAQHEFAEHGITVGDVKFDVAKMIERKDAIVTKLTGGVKFLFQKNKVTSLFGTASFAGKNGDAYQIEVDNKGEKTVIEAKHVIVATGSVPRPLPQVAIDNVNVLDNEGALNLTEVPAKLGVIGSGVIGLEMGSVWNRVGAEVTILEAAPTFLAAADQQIAKEAFKYFTKEQGLSIELGVKIGDIKSEGKGVSVAYETAAGEAKTEVFDKLIVAIGRIPNTKGLNAEAVGLEKDERGFIKVDGECRTNLPNVWAIGDVVRGPMLAHKASDEGVAVAERIAGQKPHIDFNNVPFVIYTDPEIAWVGKTEEQLKAEGVEYKKGTSGFGANGRALAMGKAKGTVKVLADAKTDRILGVHMIGPVVSELLTEGVTALEFFASSEDIARIIHAHPTLSEVVHEAALAADKRALHG

SEQ ID NO: 5044 - protein, 149 aa, Glycine max
MPRGTLEVVLISAKGIDDNDFLSSIDPYVILTYRAQEKKSTVQEDAGSKPQWNESFLFTVSDSASELNLKIMDKDNFSQDDCLGEATIHLDPVFEAGSIPETAYKVVKDEEYCGEIKVALTFTAERNEEQGYDAPEESYGGWKESSGEY

SEQ ID NO: 5045 - protein, 291 aa, Gibberella zeae PH-1
MAPHFVDDKTEICLPFILAQLKLHREESPDRPFVIGLNGIQGAGKSTLVKSLSKALESQNVPTLVCSIDEFYLTRQDQVALAESDPENALIQHRGEPGTHDLPLAKAFFEAVLKGEPTKLPKYDKAIKGGKGDRLPESEWTLVNQPGQPKIQAIILEGWCVGFRPLTREGVEARLNMPNRTLKQHKLEHLLFINEKLSEYNTLTDSFDSFIQIDAEDLGYVYGWRLEQEDHLREERGDPEAGMCSQEVVKFVDGYYPAYELYTDRLRKGVLANRPGRQLRMVNHHIPLQTA

SEQ ID NO: 5046 - protein, 951 aa, Vibrio sp. Ex25
MKLVKRSDSVSKETNQLGVSRRAFMKNTSLAAGGAVVGASLFAPGMMKKAQAKSVDPEAKTEVKRTICSHCSVGCGIYAEVQNGVWTGQEPAFDHPFNAGGHCAKGAALREHGHGERRLKYPMKLENGKWKKLSWDQAIEEIGNKVMDIRKESGPDSVYFLGSAKHSNEQAYLFRKMASLWGTNNVDHQARICHSTTVAGVANTWGYGAMTNSFNDMHNCKSMLFIGSNPAEAHPVAMQHILIAKEKNNCKIVVADPRRTRTAAKSDHYVSLRPGSDVAFIWGVLWHIFENQWEDKEFIRQRVFGMDEIRAEVAKWTPAEVERVTGVSEEDVYQTAKLLSENRPGCIVWCMGGTQHTTGNNNTRAYCVLELALGNIGKSGGGANIFRGHDNVQGATDLGVLSDTLPGYYGLSEGAWRHWSKVWEIDYEWIKGRFDDNAYSGQKPMHSAGIPVSRWVDGVLENKDNIRQRENIRAMFYWGHAVNSQTRGVEMKKAMQKLDMMVIVDPYPTVAAVMNDRTDGVYLLPATTQFETYGSVTASNRSLQWRDQVIEPLFESKPDHEIMYLLSKKLGYSDLLFKNIRVENNQPVIEDLTREFNKGMWTIGYTGQSPERLKAHQQNWHTFHKTTLEAEGGPVNGETYGLPWPCWGTPEMKHPGTHILYDTSKTVAEGGGNFRTRFGVEFEGKSLLAEDSYSKGCEIKDGYPEFTDKLLKQLGWWDDLTAEEKAAAEGKNWKTDLSGGIQRVAIKHGCIPFGNAKARAIVWTFPDRVPLHREPLYTPRRDLVTDYPTWEDKDAIFRVPTLYKSIQEQDKSGEYPIVLTSGRLVEYEGGGEETRSNPWLAELQQEMFVEVNPKDANDLGFRDGDDVWVEGAEKGRIKVKAMVTRRVKPGLAFIPFHFGGKFEGEDLRPKYPEGTQPYVVGESANTATTYGYDPVTLMQETKVTLCNIRKA

SEQ ID NO: 5047 - protein, 151 aa, Aspergillus oryzae
MFSRVAFSSAFRPLSRPQSLPLRPYGFQLPSALYARLLSSETKSAIDKAIASAPVVLFMKGTPETPQCGFSRASIQILGLQGVDPKKFVAFNVLEDAELRQGIKEYSDWPTIPQLYLDKEFVGGCDILMSMHQNGELAKLLEDKNVLVAAD

SEQ ID NO: 5048 - protein, 312 aa, Glycine max
MISPQTKQSFGSLFLLFLVLLQKRFEMGVIVENPNSSKPIVIREVWASNLESEFEVIREVIDDYPFISMDTEFPGVVFRPHVVDPTKPYLFRLRPSDHYRFLKFNVDALNLIQVGITLSDADGNLPHLETGNRFIWEFNFRDFDIDRDDYASDSIDLLRRQGIDFRRNTAEGIDSNLFAELVMSSGLVCNDSVSWVTFHSAYDFGYLVKILTRRNLPNGLEEFLKMLRAFFGNNVYDIKHMMQFCDTLYGGLDRLARTLNVDRAVGKCHQAGSDSLLTWHVFQKMRDIYFVKDGPHKHVGVLFGLELTCSAP

SEQ ID NO: 5049 - protein, 503 aa, Agrobacterium tumefaciens str. C58
MTTFSDLGLSQKVLSAIADAGYTTPTPIQAGAIPPALEKRDICGIAQTGTGKTASFVLPMLTLLEKGRARARMPRTLILEPTRELAAQVAENFEKYGKNHKLNVALLIGGVSFEDQDRKLERGADVLICTPGRLLDHCERGKLLMTGVEILVIDEADRMLDMGFIPDIERIAKMIPFTRQTLFFSATMPPEIQKLADRFLQNPTRIEVAKPSSTAKTVTQRIVAAHNKDYEKRAVLRDLVRAEEAELKNAIIFCNRKKDVADLFRSLDRHGFSVGALHGDMDQRSRTTMLQNFRDGQLTLLVASDVAARGLDIPDVSHVFNFDVPIHAEDYVHRIGRTGRAGRSGKAFTLVTKSDAKYLDAIEKLIAEKIEWLSGDLSSLPAPMESFESNSGRRGTKERSGRGRDRNRRDAPASPVENINQDAQSVVDTDIAAHGEDKVKAERRPEKTPRNSERNSRNLNSLHANDDNRDRRRHYRDHDDGPTPVGFGDDIPAFMLIVANAKA

SEQ ID NO: 5050 - protein, 190 aa, Aspergillus oryzae
MKVFSSTCTFDYSWEEVSTANWRKYCPWNDKSTHVVAVDTLSRTIDSETGILRTERLITCDQSVPQWVLSLFGGSATSHVYEVSYVDPKSKKVTMCSTNLTWSNVLNVQETVTYQPSSAKPACTTNFNQEAKITALCGGWQKIKNKVEEASVERFSQNAKRGREGFEAVLEMSRRVFGEQRERENDRLQS

SEQ ID NO: 5051 - protein, 106 aa, Neorickettsia sennetsu str. Miyayama
MKDIFAKIEGIIRRHDVVLFMKGTSGLPMCGFSGAVVNILKALDVTFYGVNVLEDPELREGIKKFADWPTIPQLYVKGEFIGGCDIVREMYENRELQTLFEDSLAG

SEQ ID NO: 5052 - protein, 337 aa, Nostoc sp. PCC 7120
MIRVAINGFGRIGRNFARCWLGRENTNIELVAVNDTSDPRTNAHLLKYDSMLGKLKNVDITADDNSITVNGKTIKCVSDRNPENLPWKEWEIDLIIEATGVFVSKEGATKHINAGAKKVLITAPGKNEDGTFVMGVNHHDYDHNLHNIISNASCTTNCLAPIAKVLNDKFGIIKGSMTTTHSYTGDQRLLDASHRDLRRARAAAINIVPTSTGAAKAVALVIPELKGKLNGVALRVPTPNVSMVDFVVQVEKRTITEEVNQALKDASEGPLKGILDYSELQLVSSDYQGTDASSIVDANLTLVMGNDLVKVMAWYDNEWGYSQRVLDLAELVAEKWV

SEQ ID NO: 5053 - protein, 307 aa, Ustilago maydis 521
MNIDKLVRCLDNSSISLGAYSCNSSSAPYGQILDAHMLCRPTRRYRRAAPRELQEKHAHGRTRGPRQGATKADKRPAMTCSMHIMAERPKKSGAGAGRNSQRGRRGGRSARPSAKAAAVGSNAQNAAVIAASNRSKPPIVIPGRGSGGGSKIILSNLPLDVTEAQVKELFATTIGPLRKVAMSYRATGQSTGVCTVEFQRADDAGRAYTQYNNRLIDGKKPLKVEVVVDPSKVAAAPAAAPKGAKAVKGAAAAGPAKGKGGRGATSAQGRGRGRGAKREARPKKTVEDLDAEMEDYNKQASTDAPAS

SEQ ID NO: 5054 - protein, 269 aa, Triticum aestivum
  misc_feature (232)..(232): Xaa can be any naturally occurring amino acid
NKFVQKSRLVPVRNSRDIVDPRVRKECSEVVHEETGHALKVPFRRVHLTGDSGHFDTYDTSGPQNISPRLGLPKIRKEWIDRREKLGSPRYTQMYYAKQGIITEEILYCAKRENLAPEFVRSEVARGRAIIPSNKRHLELEPMIVGRNFLVKGNANIGNSAVVSSIEEEVHKLQWATMWGADTVMDLSTGRHIHETREWIIRNSSVPIGTVPIYQALEKVNGIAEDLSWEVXFRDTLIEPAGAGWWITSPFPRWGGCFPYNFPLHQQKE

SEQ ID NO: 5055 - protein, 471 aa, Oryza sativa (indica cultivar-group)
MAFFRGLTAVSRLRSRVAQEATTLGGVRWLQMQSASDLDLKSQLQELIPEQQDRLKKLKSEHGKVQLGNITVDMVLGGMRGMTGMLWETSLLDPDEGIRFRGLSIPECQKVLPTAVKDGEPLPEGLLWLLLTGKVPTKEQVDALSKELASRSSVPGHVYKAIDALPVTAHPMTQFTTGVMALQVESEFQKAYDKGMSKSKFWEPTYEDCLNLIARLPAVASYVYRRIFKGGKTIAADNALDYAANFSHMLGFDDPKMLELMRLYITIHTDHEGGNVSAHTGHLENPGVSVWPFNALGKVGSALSDPYLSFAAALNGLAGPLHGLANQEVLLWIKSVIGETGSDVTTDQLREYVWKTLKSGKIVCHDTFIRRLFLALVMEFYVSKLYEVVPPILTELGKVKNPWPNVDAHSGVLLNHFGLSEARYYTVLFGVSRSIGIGSQLIWDRALGLPLERPKSVTMEWLENHCKKVAA

SEQ ID NO: 5056 - protein, 945 aa, Echinochloa frumentacea
MAASVSRAVCGLQGSCLNGRRSRDAPSGRRSVAAPRVWPSKAGVLLLGSGSGRSQHCAPANATADAVPIATKKRVFLFGKGKSEGNRGMKELLGGKGANLAEMSSIGLSVPPGFTVSTEACEQYQAAGCTLPQGLWDEVLDGLACVEEYMGAGLGEPQRPLLLSVRSGAAVSMPGMMDTVLNLGLNDEVAAGPAAKSGDRFAYDSYRRFLDMFGNVVLDIPHALFEEKLEHMKEAKGLKDDTDLTASDLKELVEQYKDVYVEAKGEPFPSDPKKQLELSVLAVFNSWDSPRAKKYRSINQITGLRGTAVNVQCMVFGNMGNTSGTGVLFTRNPSTGQKKLYGEFLVNAQGEDVVAGIRTPEDLDAMKDCMPQAYEELVENCNILEGHYKDMMDIEFTVQENRLWMLQCRSGKRTGKGAVKIAVDVVNEGLVDRHAAIKMVEPGHLDQLLHPQFENPSAYKDQVIATGLPASPGAAVGQIVFTAEDAEAWHAQGKAAILVRTETSPEDVGGMHAAAGILTARGGMTSHAAVVARGWGKCCVSGCASVRVNDAEKVVAIGDKVLQEGDWLSLNGSTGEVVLGKQPLSPPALSGDLGIFMSWVDEVRKLKVLANADTPEDALAARNNGAEGIGLCRTEHMFFASDERIKAVRQMIMAPTLELRQKALDRLLPYQRSDFEGIFRAMDGLPVTIRLLDPPLHEFLPEGNVDEIVRELCAETGSNEEEALARIEKLSEVNPMLGFRGCRLGISYPELTEMQARAIFEAAITMTKPGCSSFSRDNVPLVGTPQELGHQVAVIREIANTVFTAMGKTISYKIGTMIEIPRAALVADEIAEQAEFFSFGTNDLAQMTFGYSRDDVGKFLPIYLSQGILQHDPFEVLDQRGVGELVKFATERGRKTRPNLEVGICGEHGGEPLSVAFFAKTGLDYVSCSPFRVPIARLAAAQVLV

SEQ ID NO: 5057 - protein, 384 aa, Oryza sativa (indica cultivar-group)
MEQQGCQWGGEGDISFATKADGDRSCGLEKSPPLLEFQMRWNPTIIPPLLLFPNMGVGSPYTGYRKSTCFLFGMWLAMWPFLFEKINKTKFVFSGETVPPKERVLLFANHRTEVDWMYLWDLALRKGRLQCIKYILKKSLMKLPIFNWAFHIIEFIPVERKWEVDEPLIRSRLSELKNPKDPLWLAVFPEGTDYTEKKCIKSQEYAKEHGLPILNNVLLPKTKGFHCCLQELRDSMDSVCDITIAYKHRPPTFMDNVYGIDPSEVHIHVKIIQVSDIPTSEDEVADWLIERFKLKNKLLSDFSALGHFPNEGTEDDLSTLKCIANFVAVISTTTVLTYLTLFSSVWFKIFVAFSSAFLTFATLYSIHLPQLICSPEAGTHAKKS

SEQ ID NO: 5058 - protein, 299 aa, Oryza sativa (indica cultivar-group)
MAVENGAALFGEEELRDVSGVRVGDRFVEVTCGCTSARYGDAVGRLRLFASGELQVSCDCTPGCDQDKLSPAAFEKHSGRETAGRWQNTVWVMVKGDKVALSKTCLLRYYHKKLKSSSANGGGRRPPCHRDEFVRCAGCGKERRFRLRTKEECRLYHDAMARHDWTCKDMPPAGRCRVRVSCEEEEERASRKASRGCTRAATCKGCVRTWVLGRQWHSMNVEAVASALCTFTCAADRDGFDVRTVVCSVQTVQTYRESTLLYHCGCSNGTEGVLDLTHHDTIISAIVDIHVQRLTVRLI

SEQ ID NO: 5059 - protein, 250 aa, Nicotiana tabacum
MVLIAFGSIGDSFSVGSLKAYVAEFIATLLFVFAGVGSAIAYNKLTADAALDPAGLVAVAVAHAFALFVGVSIAANISGGHLNPAVTLGLAVGGNITILTGFFYWIAQLLGSTVACLLLKYVTNGLAVPTHGVAAGLNGFQGVVMEIIITFALVYTVYATAADPKKGSLGTIAPIAIGFIVGANILAAGPFSGGSMNPARSFGPAVVAGDFSQNWIYWAGPLIGGGLAGFIYGDVFIGCHTPLPTSEDYA

SEQ ID NO: 5060 - protein, 289 aa, Brucella suis
MDDKSMARGRKAFVTGFPIKHSRSPLIHGFWLKELGIDGSYEAVEVKPEDFSSFAASLAANGFAGGNVTIPHKEAAYAAAESLDEAACAIGAVNTLWLENGRLCGGNTDAYGFAANLDASAPGWDKADRALVLGAGGASRAVVHALLSRGVCHVSVVNRTLSRAEELAAHFGARVYAHGWDEAQALVSNAGLIVNTTALGMSGHGEGQDFPIDLTCAPKEAVATNIVYVPLRTAFLNKAEKAGLKTVDGLGMLLHQAVPGFERWFGQRPQVTQALREHILADMAKAGAL

SEQ ID NO: 5061 - protein, 368 aa, Xylella fastidiosa Temecula1
MSKRDYYQVLGVPRTASEDDLKKAYRRCAMKYHPDRNPGDAAAEAAFKECKEAYEVLADTKKRKLYDTHGHAAFEHGVGSGNTPDMNDIFGDIFGNIFGGARASRRGADVGYMVELDLEEAVAGVERQIQIPTLVECTHCHGSGSEDGHVETCGTCRGSGQVRIQRGIFAMQQTCPHCGGRGVIIRNPCKVCNGAGRVEDHKTLSVKIPAGVDNGDRIRLSGEGEQGPDGVPPGDLYVEVRVREHPIFQRDGDDLHCEVPVRISQAALGDIVRVATLDGEAEIRIPAETQSGKLFRLRGKGVRSVRSRTEGDLYCRIVVETPVNLTAEQRKLLEQFEMTFAGEDARKHSPKSATFLDGVKSFWDRMTS

SEQ ID NO: 5062 - protein, 403 aa, Arabidopsis thaliana
MGFFGRLFGSKKKSDKAASSRDKRRWSFTTRSSNSSKRAPAVTSASVVEQNGLDADKHAIAVAAATAAVAEAALTAAHAAAEVVRLTSGNGGRNVGGGGNSSVFQIGRSNRRWAQENIAAMKIQSAFRGYLARRALRALKALVKLQALVRGHIVRKQTADMLRRMQTLVRLQSQARARASRSSHSSASFHSSTALLFPSSSSSPRSLHTRCVSNAEVSSLDHRGGSKRLDWQAEESENGDKILEVDTWKPHYHPKPLRSERNNESPRKRQQSLLGPRSTENSPQVGSSGSRRRTPFTPTSRSEYSWGCNNYYYSGYHPNYMANTESYKAKVRSQSAPKQRVEVSNETSGYKRSVQGQYYYYTAVEEESLDVGSAGYYGGGGGDSDRLNRNQSAKSRMHSSFLV

SEQ ID NO: 5063 - protein, 674 aa, Methanococcus maripaludis S2
MDDKKIADLRPKITDYLKENYSEDMLKESERVAVDLNGMYHYGMFEFIEFIESDPKEAINLLKECYYDAYHVYKGERADCTVTIKNLPLMINKNSRGNERTIEDIKGKTHGKLVEIEGIIVMATKIKLALKEAVHICTACGEKRRTKIERPFQANFDPVCPKCAQNMTLLEDESEYVDFQELKIQQPLDLMEDPEEPPKFISVLLEDTQGIYCGRVKVTGIPIKNQKNKNIPLHDLLILGYNCEPISEKLDVSFNDEEIEQFETLAKNKDVLKILSRRIAPQIKGNDIIKQSIVLQQVRGVKKGRKRADSHILLITDPGTGKSDVLRFISGIPGNVYSSISTASGVGLTAGVVQERTEIGDSTWVIKPGVLVKANGGTACLDELTVERSVLSYILEAMESQTIHISKGGLNTKLPAGCSILAACNPKYGRYNEHVAVIEQINIPAPLLSRFDLIFPIKDTPNRNRDSDIAYHILDTHIALMDKSKNEEIGLFSETIGELKVDFDFFCKYIAYARQKTPKFTKESKEVIHDFYLNLRKTSVQITARQLEALVRLSEAHAKVRLKSEVEPEDAKFAIYLMIESLKEVAYDHETDSFDIDKIFGTSRNERSKLNIIFDIIRRSSKVAYGGTVSRGDLLTEAQLEGIPELEVIDLIGKLKVIGDIYEPKIGFYKDARA

SEQ ID NO: 5064 - protein, 496 aa, Triticum aestivum
MVAMVERWAGLGSAMASIIFLWSMVQNHVPVTLRLYLTTWAAKLAACFSPYLQITILENSAGRFQQSEFFYAVEAYLSDACASRARRLKAELGSDSSNLQVSVDDHEEVTDEFSGVTLWWYASKKHSKGNVISFYPGEDERRFYQVVFHRSHRDLVVGSYLPFVLAEGRTVIVKNRQRRLFTNCGGRRRRYLRNSVWDYVKFEHPATFDTLAMDTDQKEAIMDDLIAFKDGKEYYTKVGKAWKRGYLLYGPPGTGKSTMIAAMANFLDYDVYDLELTSVKNNTELRKLFIEMTSKSIIVIEDIDCSIDLTGKRRKGKKASSNKDSDNEYEADPTEPQKDDESKVTLSGLLNFIDGLWSASGGERIIIFTTNHKEKLDPALIRRGRMDKHIEMSYCRFEGFKVLAKNYLDIVEHVLFGEIQQLLEETDMSPADVAENLMPVSKKKKKDPNMCLAGLIAALKQAKKDAVEAAAAAKAKEEEEAEAKKAKEKEEPKEDK

SEQ ID NO: 5065 - protein, 341 aa, Mesorhizobium sp. BNC1
MSERLEDIAARMVADGKGILAADESSGTIKKRFDSIGLESTADNRRDYREMLFRADEAMRNSISGVILYDETLRQQAKDGTPLVEIISRSGAVPGIKVDAGAKPLAGFPGETITEGLDGLRERLKEYYELGARFAKWRGVIAVSDDLPTWGSVKQNAQALARYAALCQEAGIVPIVEPEVLMDGTPATHSIDRCYEVTEWVLKTVFTELFDARVALEGMVLKPNMVIDGKNARKASREEVAEKTVRCLKATVPAAVPGIAFLSGGQSDEEATAHLSLMNASHSMPWKLTFSYGRALQAAALKAWGGKSENVAAGQRAFAHRARMNALAARGDWKQELEVAA

SEQ ID NO: 5066 - protein, 398 aa, Mesorhizobium sp. BNC1
MAGFKTLDDLKDVAGKRVLLRVDLNVPVKDGEVTDTTRIERVAPTITELSDKGAKVILLAHFGRPKGKPDAEASLQPIAHAVEAVLDRRVHFASSCIGEPAKKAVDEMTGGDILLLENTRFHAGEEKNDPEFTKALAANGDIYVNDAFSAAHRAHASTEGLAHLLPAYAGRTIQAELEALQRGLGDPKRPVVAIVGGAKVSTKIDLLTNLVKKVDCLVIGGGMANTFLAARGTSVGKSLCEHDLRETAKQIMIDAAEAGCAIILPVDAVVARKFEAGAETETVDIDAVPEDAMILDVGPKSVEKVKEWLDRADTLVWNGPLGAFELSPFDKATMEVAKYAARRTRESLLVSVAGGGDTVAALNQADVSDDFSYVSTAGGAFLEWMEGKDLPGVAALQK

SEQ ID NO: 5067 - protein, 531 aa, Triticum aestivum
  misc_feature (140)..(140): Xaa can be any naturally occurring amino acid
  misc_feature (186)..(186): Xaa can be any naturally occurring amino acid
  misc_feature (222)..(222): Xaa can be any naturally occurring amino acid
  misc_feature (359)..(359): Xaa can be any naturally occurring amino acid
MEGAMVEWWPWFGSAVASTIFLWSMVQNHIPDTLRLNLAALAAKLTAYFNPYLQITISENGAQRWKRSELFLAVEAYLSDACARRARRLKAELGKDSKNIQVSIDDHEGVTDDFSGATLWWHASKQRPKSNVISLYPGEXDEKRFYRVTFHKQHHDLVLDSYLPFILGRGAAPVIIKNRQRPPCFXQQSPAAASSPYGAKSAWSHVPFEHPATFDTLAMEPXKQKEDVIDDLMAFQESKEYYAKVGKAWKRGYLLYGPPGTGKSTMIAAAPGFLDYDVYDLELTAINNNTELRKLFIETTGKSIIVIEDIDCSADLTGKRRKDKKASRDKDSDGNDKPKLPIEPEKDDATKVTLSGLLXNLIDGLWSACGGERIIIFTTNYKEKLDPALIRRGRMDKHIEMSYCRFESFKVLAKNYLDVVGHELFGEIQQLLEETDMSPADVAENLMPMSKKKKRDPDVCLAGLIEALKQAKEDAAVAKAKEEEKAKEAEAKKAKEKEEAEVKKAKEKEEGKDKTSEEAIGDNRQADKIQE

SEQ ID NO: 5068 - protein, 474 aa, marine gamma proteobacterium HTCC2143
MRVYDKFYINGQWVDPVVAKSMDVINPATEEVCATISIGSSADVDKAAIAARAAFNTFSQTSKQERIDLLSSICETYQKYYNDIADAISEEMGAPTKLAVNAQAAMGIAHMSTALEILKSYVFEETAGSSLVFKEPIGVCGLITPWNWPVNQISCKVAPALAVGCTVILKPSEVAPLSGYLFSKVLHEAGVPAGVYNMINGDGPGVGTALSCHPEVDMMSFTGSTRAGALVAQNAAPTVKRVTQELGGKSPNIVLADVDLEAAVTRSIMSMYTNTGQSCNAPSRMLVPADKMDEAAALAAKVTASVVVGDPKAEATTMGPVVSEVQFNKIQSLIQQGIDEGATLVCGGVGRPDGIDKGFFVKPTVFAGVNNNMTVAREEIFGPVLTILPYDSIEEAIEIANDTPYGLAGYIQGDDMEQVRAVASKIRAGNINVNGQSGDLNTPFGGYKQSGNGREWGAHGFTDFLEIKAVSGAS

SEQ ID NO: 5069 - protein, 1262 aa, Acinetobacter sp. ADP1
MSLEFGMNMMDNDPQMDTAKPHFGYISEFKEKTELEQHINDAWRRPEPETVETLLQAASISDELNHKIYELAFELANGLRERKTSSGKAGIVQGLLQEFSLSSQEGIALMCLAEALLRIPDAATRDLLIRDKINQGNWKDHVGQSSLMFVNAAAWGLMLTGKLMETPKQGSLSGLLTSILARSGRGVIRKAVDVAMRMMGEQFVTGETIEEALDNAKSHEHKGFRYSYDMLGEAALTTHDAERYFNDYTQAIHAIGQASNGKGVYDGPGISIKLSALHPRYQRSQIARVHDELYGKVFNLALLSKKYDIGLNIDAEEADRLEISLELLERLCFEPELADWKGIGFVIQAYQKRCFYVVDYVVDLAKRSKKRLMIRLVKGAYWDSEIKKAQIDGMHDYPVFTRKVHTDLSYIACAKKLLAAPEQIYPQFATHNAQSLATIYELADPGKYYAGQYEFQCLHGMGEPLYEQVVGSRSDKKLGIPCRIYAPVGNHETLLAYLVRRLLENGANTSFVNRIADQNLKIEDLIQSPFDEIAINAQREGQAGLKHPAIPLPHNLYGSLRQNSKGFDLANDATLTALNETAQQLEHKVWESRPLLAQTVDQIDVSPQALLNPAVHLDIVGYVQEATLEQVDVALESATQAQQAWANTEKNHRAATLKKAANLMESRMQELMVLLCREAGKTYANAISEVREAVDFLRYYATQIESLKPTAQIEPLGTVLCISPWNFPLAIFTGQIAAALGAGNCVIAKPAEQTPLIAAQAVHILHEAGIPKSVLQLLPGRGETVGAKLSSDQRIQGVMFTGSTEVAKILQKTVAKRLSPSGHPIPLIAETGGQNAMIVDSSALTEQVVIDVLNSAFDSAGQRCSALRILCVQEDNSKTLVTMLKGAMQQLIMGNPFLLKTDIGPVIDLEAKQTIDQHIQKMRSKGYPVYQLIFNHEAASQAQLSQGTFVTPTLIELPNLDDLEREVFGPVLHVITYKHGEIKQLLQHINAKGYGLTMGLHTRIDETINTVVQHAEVGNLYINRNIVGAVVGVQPFGGEGLSGTGPKAGGPLYLYRLMASCTEKAIQTPFGIPAENVAVPLTQLSLFREFSAWIKKQYPAHQLPNVVPLNVGHAFDLQGPTGETNRYMMLPRKRILAIASNELELCHQMLAIFAVNSQVALLESNPSLQKFGQDLPTVVRQAIIEIRGVEHGDFDAVLHHGSTEELQVLQTQIANRQGPIVGITHLQNSEQVIPLERLVIEHAISVNTAAAGGNASLMTMSE

SEQ ID NO: 5070 - protein, 337 aa, Mesorhizobium sp. BNC1
MTVKVAVNGFGRIGRNIVRAIYESGRKDIDVVAVNDLGPVESNAHLLRYDSVHGRFPGEVKVEGDSISIGADSFKVLAERDPSKLPWKDLGVDIVLECTGLFTSKDKASAHLAAGAKRVLVSAPADGADITVVYGVNHDKITKDHVVLSNASCTTNCLAPVAKVLNDAFGIEKGFMTTVHSYTGDQPTLDTMHKDLYRARAAALSMIPTSTGAAKAVGLVLPELNGKLDGVSIRVPTPNVSVIDFKFVPKRKVTVQEVNEALVAAATEGPLKGVLAYTKEPLVSSDFNHDPASSTFALDQTKVIDGDLVRVMSWYDNEWGFSNRMADVTAVIANTLR

SEQ ID NO: 5071 - protein, 686 aa, Mesorhizobium sp. BNC1
MCRLLLRARAPPVPDRPQPTQRAHMISREKHDRMANAIRFLSMDAVEKAKSGHPGLPMGTADIATVLFTRFMKHDPKTPHWPDRDRFVLSAGHGSMLLYSLLHLLGYEDITIEEIKNFRQLGSRTAGHPEYGFAAGIETTTGPLGQGFGNAVGMAIAERLLNARYGDDLVNHFTYALVGDGCLMEGISQEALTLAGHLRLNKLIVLFDDNHISIDGPVSLADSTDQCARFAASGWNTLRADGHDPDAIASAIETARQSDRPTLIAFRTTIGYGSPSKAGTNKVHGSPLGADEIAKTRSALGWDSPPFVVPSEVLDDWRLAGLRSAKERGSWEKRLAAADTETRAQFERRMRGDLPAAFPGVIVDYKKKLAQQNTAVATRNASEMALEVINDCIPETVGGSADLTGSNNTKTSQTTPITPTDFSGRYIHFGIREHAMAAAMNGIALHGGLIPYGGTFLTFSDYARPAMRLASLMHIRSIFVMTHDSIGLGEDGPTHQPVEHLAALRAIPNHNVFRPADATETAECWQLALESRKTPSTIALTRQKLQPVRLEFEEENLCARGAYELLPASDEAKVTIFASGSEVEIAVKARVMLEERGYPTRVVSVPCFELFEEQSQDYQRAILGDAPVRIAIEAGVRQGWDRFIGVDGIFIGMHGFGASGPAPELYQHFGITAEAAVEAVEARLPD

SEQ ID NO: 5072 - protein, 336 aa, Thlaspi caerulescens
MSTAPLSGFFLTSLSPSQSSLQKISLRSSPTVACLPSSSSSSSSSSSSSSRSVPTLIRNEPVFAAPAPIITPYWSEEMGTESYQEAIEALQKLLIEKEELKTVAAAKVEQITAELQTGTSSDKKAFDPVETIKQGFITFKKEKYETNPALHGELAKGQSPKFMVFACSDSRVCPSHVLNFQPGDAFIVRNIANMVPPFDKVKYGGVGAAIEYAVLHLKVENIVVIGHSACGGIKGLMSFPLDGNNSTDFIEDWVKIGLPAKSKVISELGDSAFEDQCSRCEREAVNVSLANLLTYPFVREGLVKGTLALKGGYYDFIKGAFELWGLEFGLSETSSV

SEQ ID NO: 5073 - protein, 357 aa, Synechococcus sp. CC9605
MHAVLALETSCDESAAAVLRRHADGRIDVLASRIASQVEEHARWGGVVPEIASRRHVEALPGLVEAVVDEAGVTLGQLDAIAATITPGLAGALMVASVTGRTLAALHQRPFLGVHHLEGHLASVMLGDVPQQAPYLVLLVSGGHTELILVAEDGGMTRLGRSHDDAAGEAFDKVARLLGLGYPGGPAIQAVAETGDATRFRLPKGRISLPGGGFHPYDFSFSGLKTAMLRTVETLRQTTDSLPLADLAASFEQVVADVLVQRSLRCAADHGVQQLVMVGGVAANRRLRQSMLEQGNQRGIAVSIAPLAFCTDNAAMIGAAALMRLGQNAACTSFESGVAARWPLDQANALYTPDPPF

SEQ ID NO: 5074 - protein, 888 aa, Glycine max; identical to SEQ ID NO: 993

SEQ ID NO: 5075 - protein, 355 aa, Solanum tuberosum
MMTRGATRMTRVVMGHMGPRYFSTTVLRNDPGTGVVGGAAAGLLHGFPANPSEKVAVTWVRHFSAMGSRSASTAALNDKQQEKESSDKKVENTATAAANGGAGKSVVSYWGVPPSKATKPDGTEWKWNCFRPWETYEADMSIDLTKHHAPVTFLDKFAYWTVKVLRFPTDVFFQRRYGCRAMMLETVAAVPGMVGGMLLHCKSLRRFEQSGGWIKALLEEAENERMHLMTFMEVAKPNVYERALVFTVQGVFFNAYFAAYLISPKLAHRIVGYLEEEAVHSYTEFLKELDNGNIENVPAPAIAIDYWRLPKDATLRDVVLVVRADEAHHRDVNHYASVRTYKADDLDLFGIDGCI

SEQ ID NO: 5076 - protein, 257 aa, Brassica napus
  misc_feature (223)..(223): Xaa can be any naturally occurring amino acid
PSKVSLSHSHSRRVRDDDTCSNRAAAASRGWWAEDIAELGIDLYWRTMIAIKSGSKVPSSLIGDALRVYASKWLPSLQRNRKQVGKKEDSDSDSETDVSSKHRLLLESIISLLPAEKAAVSCSFLLKLLKAANILNASSSSKMELARRVALQLEEATVSDLLIPPTSYKSEMLYDVDVVATILEQFMILGQTSPPTSPLRGKKGMMDRRQRSRSAENIDLEFXESRRSSSASHSSKLKVAKLCDGYLQQIARDVSLP

SEQ ID NO: 5077 - protein, 321 aa, Oryza sativa
MASVASFPVINMENLETEERGARMEVIRDACENWGFFEMLNHGIAHELMDEVERVSKAHYANCREEKFKEFARRMLEAGEKGADVKGIDWESTFFVRHRPVSNLADLPDVDDHYRQVMKQFASEIEKLSERVLDLLCENLGLEKGYLKKAFAGSNGPTFGTKVSSYPPCPRPDLVDGLRAHTDAGGIILLFQDDQVSGLQLLKDGEWVDVPPMRHAIVANIGDQLEVITNGRYKSVMHRVLTRPDGNRMSIASFYNPGADAVIFPAPALAGADAAAAAYPRFVFEDYMNLYVRHKFEAKEPRFEAMKSAAEVVHAAPIATA

SEQ ID NO: 5078 - protein, 269 aa, Neisseria meningitidis MC58
MPDFSMSNLAVAFSITLAAGLFTVLGSGLVMFSKTPNPRVLSFGLAFAGGAMVYVSLTEIFSKSSEAFAEIYDKDHAFAAATMAFLAGMGGIALIDRLVPNPHETLDAQDPSFQESKRRHIARVGMMAAFAITAHNFPEGLATFFATLENPAVGMPLALAIAIHNIPEGISIAAPVYFATRSRKKTVWACLLSGLAEPLGAALGYLVLQPFLSPAVFGSVFGVIAGVMVFLALDELLPAAKRYSDGHETVYGLTTGMAVIAVSLVLFHF

SEQ ID NO: 5079 - protein, 385 aa, Thermus thermophilus
MRGLSRRVQAMKPDAPVAVNAKALELRRQGVDLVALTAGEPDFDTPEHVKEAARRALAQGKTKYAPPAGIPELREALAEKFRRENGLSVTPEETIVTVGGSQALFNLFQAILDPGDEVIVLSPYWVSYPEMVRFAGGVVVEVETLPEEGFVPDPERVRRAITPRTKALVVNSPNNPTGAVYPKEVLEALARLAVEHDFYLVSDEIYEHLLYEGEHFSPGRVAPEHTLTVNGAAKAFAMTGWRIGYACGPKEVIKAMASVSRQSTTSPDTIAQWATLEALTNQEASRAFVEMAREAYRRRRDLLLEGLTALGLKAVRPSGAFYVLMDTSPIAPDEVRAAERLLEAGVAVVPGTDFAAFGHVRLSYATSEENLRKALERFARVLGRA

SEQ ID NO: 5080 - protein, 520 aa, Triticum aestivum
MVERWAGFGSAMATVIFLWSVVQNYVPPTFRLYLTAWAAKVAACFNPYLQITISEYGAERFQRSDFFLAVEAYLSEACARRARKLKAELGKDSKNLQVTVDDHDEVTDDFSGTTIWWYASKRQSKAQVISFYPGEDERRFYKVIFHRRHRDLVVDSYLPFVLGEGRAVTVKNRQRRLFTNNASRNWNPYRSKSVWSHVPFEHPATFDTLAMHPDEKEAIVDDLMAFQESKDYYAKVGKAWKRGYLLYGPPGTGKSTMIAAMANFLDYDVYDLELTAVKNNTELRKLFIETTGKSIIVIEDIDCSIDLTGKRRKDKKASGDKDSDSDDKPKLPMDPEKDDATKVTLSGLLNFIDGLWSACGGERIIIFTTNHKEKLDPALIRRGRMDKHIEMSYCRFEGFKVLAKNYLDVIEHDLFGEIQRLLEETDMSPADVAENLMPMSKKKKRDPDLCFSGLVEALKQAKEGAAAAAAKAKAEEEAKEAEAKKVKEKEETEVKKAKEENKGKDKAPEKANGDIKEGDK

SEQ ID NO: 5081 - protein, 417 aa, Vibrio sp. Ex25
MDYFNYQDDGQLWAEDVPLQALAEQYGTPLYVYSRATLERHWKAFDSAVGQHPHLVCYAVKANSNLGVLNALARLGSGFDIVSGGELERVIAAGGDPKKVVFSGVGKTPAEMKRALELGIKCFNVESEPELERLNKVAGELGVIAPISLRINPDVDAKTHPYISTGLRDNKFGIAFDRAPDVYKFAQSLPNLNVQGIDCHIGSQLTNIDPFIDATDRLLALIDDLKAQGINIRHLDVGGGLGVVYRDELPPQPSDYAKALLGRLENHQDLELIFEPGRAIAANAGILLTRVEFLKHTEHKNFAIIDAAMNDLMRPALYQAWQDIVPVSPRTGEAQTYDLVGPICETGDFLGKDRALVLQEGDLLAVRSAGAYGFVMSSNYNTRTRAAEVMVDGKQSHLVRQREELTSLWQLEQILPE

SEQ ID NO: 5082 - protein, 446 aa, Zea mays
MPVGELAARPGGAMAAAAVGGDDAVVMQLAAAEGEETVITVNCPDQAGLGCDLCRTILEFGLRITRAADVSTDGHWCFVVFWVVPRSSSIRIRWASLKNRLMSMCPSSYSIPFYPDMSQPEPGPSQFYLLKLLSPDRKGLLHDVTHILSDLELIIHRVKVSTTPDGRVVDLFFITDGMELLHKKERQEETCSTLIAALGPSISCEVLSAEGFQQGFSSLAPEIAEELFRVELAGDGEMCSSSLISAELKKVQTATINFDNSLSPAHTLVQIICADQKGLIYDILRTMKDCNIQIFYGRFRSDKKGGRPGSKGCREVDLFVKQVDGKKVTDPEKQDALRARLRSEMLHPLRVMVVSRGPDTELLVANPVELCGKGRPRVFYDATLALKALGVCIFSAEIGRQAASERQWEVYRFLLDDSREFPLTNSLANRNRVVDRVRKTLMGCYN

SEQ ID NO: 5083 - protein, 406 aa, Arabidopsis thaliana
MSSIIHGAGAATTTLSTFNSVDSKKLFVAPSRTNLSVRSQRYIVAGSDASKKSFGSGLRVRHSQKLIPNAVATKEADTSASTGHELLLFEALQEGLEEEMDRDPHVCVMGEDVGHYGGSYKVTKGLADKFGDLRVLDTPICENAFTGMGIGAAMTGLRPVIEGMNMGFLLLAFNQISNNCGMLHYTSGGQFTIPVVIRGPGGVGRQLGAEHSQRLESYFQSIPGIQMVACSTPYNAKGLMKAAIRSENPVILFEHVLLYNLKEKIPDEDYICNLEEAEMVRPGEHITILTYSRMRYHVMQAAKTLVNKGYDPEVIDIRSLKPFDLHTIGNSVKKTHRVLIVEECMRTGGIGASLTAAINENFHDYLDAPVMCLSSQDVPTPYAGTLEEWTVVQPAQIVTAVEQLCQ

SEQ ID NO: 5084 - protein, 113 aa, Agrobacterium tumefaciens str. C58
MAMSGIHDIIDSEVKSNDIVLFLKGTPQFPQCGFSGQVVQILDYLGVEYKGVNVLADADIRQGIKDYSNWPTIPQLYIKGEFVGGCDIVKEMFQSGELQSHFQEQGISVRGAA

SEQ ID NO: 5085 - protein, 139 aa, Neorickettsia sennetsu str. Miyayama
MKRTLSILKPDVISRNITGKVNAYIEAAGLQIIAMKQLHLTRIQAEAFYVVHKDRFFFNDLVNFMTSAPVIVQVLSGDDAVHRYRKLMGDTDPKKAAKGTIRGDFAESIDANCVHGSDSEENAKNEIAFFFSRCEIFDR

SEQ ID NO: 5086 - protein, 300 aa, Burkholderia pseudomallei K96243
MHMQSRFEGIWLPIVTPFHARETGTVDHAALARLARHYSDEGIAGFVAGATTGEGALLNAGEQEAIFATLRDAAPARPIVLGITASATHAAAERARALAALRPDGLLVTPPVYVRPTQAGVQRHIEAVVEAADLPVLVYNIPYRTGVNVELDTLKALSRDARVAGVKECGGTMERMLRLVHETPLRILSGDDNQNFAALCAGAHGAIASAAHVLPAWHVRVYALLREGRLDDARRIAVALQPLVADLFAEPNPAPVKALLAAQGWCDNALRLPFLPVEEALATRLVAHWESLRQSEAAGA

SEQ ID NO: 5087 - protein, 458 aa, Neorickettsia sennetsu str. Miyayama
MYLFFRVFRIAYFVFYAYFELLYRKNYSVLVSEVEKMGPAFIKFGQFFSSMGDFICSDLSTELRKLCDNVKPVSYVEVKASIEKEFSKGIDRLFKWIDERPTASASIAQVHKAITLSGEVVAVKILKPGVKKIFKRDIKIAFSIVYILSFFLPKRFNLITILKKFSASTKNELDLKMEAAALSEMKDKLLTNKTVVIPEVYWGLTTNEILTMSWLEGVPLTHCKLCDPQFARRLVETFFVQVYVNGFFHGDMHLGNIFLISGHKVGLVDFGIIGRIDEQTKVYVLELIKGFLERDYDRVAELHYSAGYVERSRTDFASACRALAEPIVDKPLKEVSLSRLLGDFFKLSRDFRIEINPNLILMQKNLIFLEANCAKLDPEINVWRIIEPMIRRWYKDRMCPTVLVREKIHKIAVVLKEAFEDNKESKYRAVTASRCEVFFWICLASIINFLAILACRFF

SEQ ID NO: 5088 - protein, 166 aa, Mesorhizobium sp. BNC1
MDLIRQLEAEQAQKIAAKRTLPDFSPGDTLRVQVRVTEGNRTRVQAFEGVCIARSGSGLQENFTVRKISYGEGVERVFPVYSPLVEAVEVVRRGKVRRAKLYYLRDRRGKSARISENTGARARKLNDAEREAAAQERARIEAEKVAAAEALAAEKAAAEAAEAKSE

SEQ ID NO: 5089 - protein, 121 aa, Polaromonas sp. JS666
MNLIQTLEQEEISRLNKTIPAYAPGDTVIVSVNVVEGTRKRVQAFEGVVIAKRNRGLNSSFIVRKVSNGEGVERTFQVYSPLIAKIEVKRRGDVRRAKLYYLRSRSGKSARIKEKLGAKAA

SEQ ID NO: 5090 - protein, 332 aa, Oryza sativa (indica cultivar-group)
MESQVLVALALSLVGGLSTSIGIAKWLSISQSRVPGNFCVSGALFVILNPTPNLKMLGLLQGFAAGLMLSISFLDLAHNALNSIGFLKGNLWFFAGVLFFGLVVKFIPEPTVVPTADAGKKQGLRVGLNLAIAIALHNIPEGVAVALPLYFATNSKWQAFKVATLSGFAEPLGVIIVAYLFPSSLNPEVLEGLLGSVGGVMAFLTLHEMLPLAFDYAGQKQAVKAVFVGMAFMSARLINIDLDTEQLVNLIPQHTVTLPWSGTNAILTQLISGFCIVSLYFLEISLPKELVIVFDHFTVKMNSLGWVAKHHPESECNLRLLGRNRTQLELAD

SEQ ID NO: 5091 - protein, 978 aa, Anabaena variabilis ATCC 29413
MNTKCPSRDFTYQDWILTETRFNPEQLHSRSTVFTIGNGYLGTRGSLEEGHARGLPATFIHGVYDDVPVVYTELANCPDWLPMIIAINGDRFRMDQGEILQYERKLDVSQGLLSRSLRWRSPSGSIIDIHFERFASLADHHILGQRCQITAHDGDCLVEIQASINGYAENQGFNHWEGIDQGKTEPGIWLQSRTRGTQIEIGMAAKMTISGVEAALQVSIVPGYPTISASFLAKSQQTITVEKLVTVFTSREVNKPVTAAQEKLAQLPDYTTLLTANKQAWDEVWQKSDIYIEGDPTAAFAVRYNLFQLLIAAPYHDEKVSIPAKTLSGFGYRGHIFWDTEIFILPFFTFTQPALARNLLSYRHHTINGARRKATHYGFKGAMYAWESGDTGDEVTPRWALPDNYYGEDVRIWCRDREIHNSADIAYAVWQYWQATSDDVWMRDYGAEIILDAAIFWSSRVEYNSQGDRYEIRGVIGTDEYHEFVHNNTFTNRMVQWHLEKALKVADWLRHTFPEGAKELEEKLQLTPELETHWQDIIKKICIFYDSSTGLIEQFEGFFQLKDINLEDYEPRQRSMQAILGIETTNQHQVLKQPDVLMLLYLMRLSAEFPYNEKALKSNWDYYAPRTDITYGSSLGPAIHGILASDLGKSATAYERFMQALMVDLEDSRGNTNDGIHGASAGGIWQAVIFGFGGIQLTEQGPIANPHLPPNWTRLKFQLHWRGQWYPFDLPGGVGIGDWGLGTGGVTSTQSPTPHTHSPDIRGFIFDLDGVLTDTAEYHYLGWQRLADEEGIPFNRKANEALRGVSRRESLMRIIGDRPYSEAQIQEMMERKNCYYVELIEHITPKDLLPGAIALLDELRQAGIKLGIGSASKNAHTVIERLGLADKVDAIADGYSVQKPKPAPDLFLFAAHQLGLEPKQCVVVEDAAAGVEAALAGGMWAVGLGPVERVGAAHVVLPSLAGVTWTDLRTKLNEAAGV

SEQ ID NO: 5092 - protein, 520 aa, Debaryomyces hansenii CBS767
MLRNSASNIVKATYTRRLYSTYDSSSKVLSSLKNKDLIRTQGYINGQWVASSDNSTFEVNNPALASGAGTKIADVSSMTTKDYVRAINSAQDAFSDFKKTTGRYRSDLLMNLYRLMQENQDDLAKLIVLENGKPYADAFGEVAYASSFFQWFAEEAPRVYGDIIPSALADSKILVMRQPIGVCGILTPWNFPAAMITRKLGAAAATGCTTVIKPASETPLSALALAYLAEQAGFPKGSVNVLPSSDAAGVGKLMCENPTIKKVSFTGSTNVGKLLMSQSSSTLKKLSMELGGNSPFIVFNDADIDKAVDGAIGSKFRSSGQTCICTNRLFVHESIYDEFASKLTKKLSETVKLGNGLADGTTHGPLIHGKSMNKVRSHIEDATSKGAKVLLGGNKREDLGVNFHELTVLGGVTQEMDIFNEETFGPVAPLIKFKSDEEVISLANDTDVGLAGYFYSSNINRVFKVAEELQVGMIGANTGAISESALPFGGVKESGFGREGSKYGIDDYTVVKSVVLGGLD

SEQ ID NO: 5093 - protein, 560 aa, Ustilago maydis 521
MGRITNPYVLTALACTGGMLFGFDISSLSAIIASPNYLVYFGDDKNTVECADRPGALCNPGPSADVQGGITASMAGGSFIASLFSGIVADRFGRRYAIFLGCILWVIGSILTCAVQNIGMLIVGRIFNGMCVGLCSAQVPVYLSELSPSRIRGRLVGCQQWACRLSTLLTQTQTVIRITWGIAIFFFISFGCSHIGNRIDGEQDGRGTASFRTPWGIQMVPALVLMALVPLMPESPRWLIANARKQEALEILAQVHANGDQDSPLVLAEYHEIVQNIEESSGEGTGYLDLFKHGNAWRTHIAMFTQIWSQLTGMNVMMYYLSYVFEMAGITGNIALISNGIQYIINVLMTVPALLYVDRWGRRPTLLVGSTLMTIWLFAVAGLMAGYGHYYPDSNNSVVRWKVEGPASKAVIACSYLFVASFAPTWGPVSWIYVPELFGNRLRGKSNSVSTASNWAFNFALGYFVPPAFHNIQWKSYIIFGCFTVAMTIHVFLAFPETAGKTLEEVDEIFQSGVPAWKTRPGSSRSDQDIEALKNEAVYTKNPTSPGSDSADEKELKGDV

SEQ ID NO: 5094 - protein, 158 aa, Synechococcus sp. CC9605
MAADSKDTAVTDENTETAVEAAPEATVAKSSKASSAAAKKLSPEALIRSFESSQQKDDLPEIYVGDTVRVGVRISEGNKERVQPYEGVVISKRHGGLNQTITVRRIFQGIGVERVFMLHSPQVASIKVERRGKVRRAKLFYLRERVGKATRVKQRFDR

SEQ ID NO: 5095 - protein, 313 aa, Oryza sativa
  misc_feature (35)..(35): Xaa can be any naturally occurring amino acid
MSALYLARGASKVVRRITSETSVELKILTEKWQLXLAGLVFQYIHGLAARGVHYLHRPGPTLQDLGFMILPELGKERGYISETLFTFIFLSFVLWTFHPFILQTKRFYTVLIWRRVLAFLCASQFLRIVTFYSTQLPGPNYHCREGSALARLPHPQNVAEVLLINFPRGVIYGCGDLIFSSHMIFTIVFVVTYQKYGNIRFIKMLAWCIAIAQSLLIIASRKHYSVDVVVAWYTVNLVVFFVDKKLTELPDRSAGSTSVLPVSIKEKDSKLKEDKTRMLNGNSVDSADWRPWTQMNGKHIENGNHLDTETTKT

SEQ ID NO: 5096 - protein, 467 aa, Pseudomonas aeruginosa PAO1
MTHDTGLRRGLNARHIRFMALGSAIGTGLFYGSASAIQMAGPAVLLAYLVAGAAVYMVMRALGEMAVHEPVSGSFGHYASSYLGPLAGFVTGWTYAFEMIIVCLADVTAFGIYMGFWFPDVPRWIWVLSIVLFIGGLNLCHVKVFGELEFWLSLVKVGAIVAMILAGLGIMFFGFSLGGAATSATGVHNLWQHGGFLPNGWAGLVASLSVVVFAFGGIEIIGITAGEAQDPQRVIPRAINAVPLRILLFYVLTLFVLMAIFPWQQIGSNGSPFVQIFDGLGIESAAAILNVVVITAAISAINSDIFGAGRMLYGMARQGQAPVGFSRVSRHGVPWMTVLLMAVALLLGVALNYLIPQSVFLLIASIATFATVWVWLMILLAQVGMRRRMGPRQVAALKFPVPLWPFAPAAAIVFMLFIFVVLGYFPDTRPALWVGAIWIALLVIAYRRWVRPKGDAAHGVLQAQGGL

SEQ ID NO: 5097 - protein, 504 aa, Zoysia tenuifolia
MASPAAVPQRQLFIDGEWRAPALGRRIPVVNPSTEAHIGEVPAGTAEDIDAAVKAARAALKRNRGRDWARAPGAVRATYLRAIAAKVTERKPELAKLEALDCGKPYDEAIWDMDDVAGCFEFFAGLAEDLDKKQNSPVALPENFKCHLRREPIGVVGLITPWNYPLLMATWKVAPVLAAGCTAVLKPSELASVTCLELGDICKEVGLPKGVLNIVTGLGPDAGAPLAAHPDVDKVSFTGSSATGQKIMTAAATMVKPVSLELGGKSPIVVFDDVDIDKAVEWTLFGCFWTNGQICSATSRLLIHTKIAKEFIERMVAWAKNIKVSDPLEEGCRLGPVVSEGQYEKIKKFVANAKSEGATILTGGVRPKHLEKGYYIEPTIITDVSTSMEIWREEVFGPVLCVKEFSTEDEAIELANDTHYGLAGAVLSADRERCQRVAEEIDAGAIWVNCSQPCFCQAPWGGNKRSGFGRELGEGGLDIYLNVKQITEYTSDEPWGWYKPPSKI

SEQ ID NO: 5098 - protein, 147 aa, Synechococcus sp. RS9916
MVTEGDDADPLCVPTMSTSPTQAITTAAAPAPVGPYNQAVKAGDWLYCSGQIPLDPATGTMVGDGDVEAETRQVLKNLNAVLTEAGADASRVVRTTVFLADLNDFQKVNALYAGMFGEGVSPARACVQVAALPLGAKVEIDCVAYLG

SEQ ID NO: 5099 - protein, 503 aa, Zoysia tenuifolia
ASPAAIPQRQLFIDGEWRAPALGRRIPVVNPSTEAHIGEVPAGTAEDIDAAVKAARAALKRNRGRDWARAPGAVRAKYLRAIAAKITERKPELAKLEALDCGKPYDEATWDMDDVAGCFEFFAGLAEALDKKQNTPVSLPENFKCHLRREPIGVVGLITPWNYPLLMATWKVAPALAAGCTAVLKPSELASVTCLELADVCKEVGLPSGVLNIVTGLGPDAGAPLAAHPDVDKVSFTGSSATGQKIMTAAATMVKPVSLELGGKSPIVVFDDVDIDKAVEWTLFGCFWTNGQICSATSRLLIHKKIAKEFIERMVAWAKNIKVSDPLEEGCRLGPVVSEGQYEKIKKFVANAKNEGATILTGGVRPKHLEKGYYIEPTIITDVSTSMEIWREEVFGPVLCVKDFSTEDEAIELANDTHYGLAGAVLSADRERCQRVAEEIDAGAIWVNCSQPCFCQAPWGGNKRSGFGRELGDGGLDIYLNVKQITEYTSDEPWGWYKPPSKI

SEQ ID NO: 5100 - protein, 504 aa, Zoysia tenuifolia
MASPAAIPQRQLFIDGEWRAPALGRRIPVVNPSTEAHIGEVPAGTAEDIDAAVKAARAALKRNRGRDWARAPGAVRAKYLRAIAAKITERKPELAKLEALDCGKPYDEATWDMDDVAGCFEFFAGLAEALDKKQNTPVSLPENFKCHLRREPIGVVGLITPWNYPLLMATWKVAPALAAGCTAVLKPSELASVTCLELADVCKEVGLPSGVLNIVTGLGPDAGAPLAAHPDVDKVSFTGSSATGQKIMTAAATMVKPVSLELGGKSPIVVFDDVDIDKAVEWTLFGCFWTNGQICSATSRLLIHKKIAKEFIERMVAWAKNIKVSDPLEEGCRLGPVVSEGQYEKIKKFVANAKNEGATILTGGVRPKHLEKGYYIEPTIITDVSTSMEIWREEVFGPVLCVKDFSTEDEAIELANDTHYGLAGAVLSADRERCQRVAEEIDAGAIWVNCSQPCFCQAPWGGNKRSGFGRELGDGGLDIYLNVKQITEYTSDEPWGWYKPPSKI

SEQ ID NO: 5101 - protein, 269 aa, Moraxella sp.
MQAWVIGNWKQNPATSHDVNALLDDLCAAISTTKQMSHDNSARCQIMVAPSLIHLAAVNGRLKDTSILCAAQDVSGHSASVGAYTGECSAQQIVDAGATWTILGHSERRQYHQESNDALLQKMIHALSQDLGVVFCIGESQEQYDTKQTLTVIDNQLVVIKEFITQQPELIDALPTRLIIAYEPVWAIGTGKVPTVAEVSATHKHIKQTLAGFADSLSNMTVLYGGSVNADNANSFAADPMIDGALVGGASLKADSFLTIATAFSQASI

SEQ ID NO: 5102 - protein, 504 aa, Zoysia tenuifolia
MASPAAIPQRQLFIDGEWRAPALGRRIPVVNPSTEAHIGEVPAGTAEDIDAAVKAARAALKRNRGRDWARAPGAVRAKYLRAIAAKITERKPELAKLEALDCGKPYDEATWDMDDVAGCFEFFAGLAEALDKKQNTPVSLPENFKCHLRREPIGVVGLITPWNYPLLMATWKVAPALAAGCTAVLKPSELASVTCLELADVCKEVGLPSGVLNIVTGLGPDAGAPLAAHPDVDKVSFTGSSATGQKIMTAAATMVKPVSLELGGKSPIVIFDDVDIDKAVEWTLFGCFWTNGQICSATSRLLIHKKIAKEFIERMVAWAKNIKVSDPLEEGCRLGPVVSEGQYEKIKKFVANAKNEGATILTGGVRPKHLEKGYYIEPTIITDVSTSMEIWREEVFGPVLCVKDFSTEDEAIELANDTHYGLAGAVLSADRERCQRVAEEIDAGAIWVNCSQPCFCQAPWGGNKRSGFGRELGDGGLDIYLNVKQITEYTSDEPWGWYKPPSKI

SEQ ID NO: 5103 - protein, 309 aa, Agrobacterium tumefaciens str. C58
MQDIQGIVDSIYDSMLPRLGEGKVADYIPELAKVDPNQFGIAITTVDGTTYTAGNALVPFSIQSISKVFMLTLALGKAGETVWNRVGREPSGSSFNSIVQLEHEHGIPRNPFVNAGAIVVTDIVLSGHQPREAIGELLRFVRYLADDDTISIDDTVAKSEQATGFRNFALANFMRSFGNLHHPVEHTLGVYFHQCALSMTCAQLSRAGLFLANRGRNPLSGHTVVSDRRARRINALMLTCGHYDGSGDFAYHVGLPGKSGVGGGIMAVAPGNASIAVWSPGLNKVGNSALGSQALELLATKTGWSVFGA

SEQ ID NO: 5104 - protein, 107 aa, Rhizobium leguminosarum bv. viciae 3841
MSGFSLSDLESIVAERSKAPPEQSWTAKLVAGGQPKAAKKLGEEAIEAVMAAVTGDRDNLTYEAADVLYHLLVVLKIAEIPLENVMAELERRTAQSGLKEKASRQSS

SEQ ID NO: 5105 - protein, 185 aa, Ustilago maydis 521
MSLLRQSTQAFRVATSASSSTRWMNTSSVLRNTAQPNTSPAPAQRTDNQGRDLAAEQLKRHEQAVTADLVSSAPEELHQRSVRIFRPTKTANSSGKAGTKVWRVDFDILQGSARWENPLMGWASSGDYMQGTSLKFRSKEDAIHFCEKQGWDYHVTEPKVARIPPKSYAANYNHIPGKLRIHHTK

SEQ ID NO: 5106 - protein, 333 aa, Vibrio sp. Ex25
MTIKVGINGFGRIGRLALRAAFDWPELEFVQINDVAGDAATLGHLLEFDSVQGRWHHEVQVEGNELVINGKRIATTQQRDIDAVNWSGCDVVIEATGVHRKTSYLDQYLDQGVKRVVVSAPVKEEGIANIVVGVNDHIFDPEKHRIVTAASCTTNCIAPVVKVIHEKLGIEQSSFTTIHDLTNTQTILDAPHKDLRRARACGMSLIPTTTGSATAIVEIFPDLKGKINGHAVRVPLANASLTDIIFDVKRDTTAEEVNALLKEASEGELKGILGFEERPLVSIDYKGDQRSTIIDAQSTMVVGSRMVKIYAWYDNEMGYATRTAELVRNVGLA

SEQ ID NO: 5107 - protein, 146 aa, Glycine max
  misc_feature (54)..(54): Xaa can be any naturally occurring amino acid
MASSLSFVSSSHLTLRTPSLTLRKLSPPRTSVSFSVKAQSVALSQDDLKKLAAXKAVEAIKPGMVLGLGTGSTAAFAVDQIGKLLSSGELHDIVGIPTSKRTEEQARSLGIPLVALDTHPRIDLAIDGADEVDPNLDLVKGRGGAL

SEQ ID NO: 5108 - protein, 115 aa, Brassica napus
  misc_feature (15)..(15): Xaa can be any naturally occurring amino acid
LFHHLLEYELVSPFXLTQKLNNPFDLESDDWLRNFSKEHLSRTFHLLGTQLHHLWNTFLAFHRENNTKILEYLRDTWRRDRRAEWSIWMVHSKVEMPHHFISGMYDTSNHSSHKR

SEQ ID NO: 5109 - protein, 340 aa, Escherichia coli B
MSTMNVLICQQPKELVWKQREIPIPGDNEALIKIKSVGICGTDIHAWGGNQPFFNYPRVLGHEICGEVVGLGKNIADLKNGQQVAVIPYVACQQCPACKSGRTNCCEKISVIGVHQDGGFSEYLSVPVANILPADGIDPQAAALIEPFAISAHAVRRAAIAPGEQVLVVGAGPIGLGAAAIAKADGAQVVVADTSPARREHVATRLELPVLDPSAEDFDAQLRAQFGGSLAQKVIDATGNQHAMNNTVNLIRHGGTVVFVGLFKGELQFSDPEFHKKETTMMGSRNATPEDFAKVGRLMAEGKITADMMLTHRYPFATLAETYERDVINNRELIKGVITF

SEQ ID NO: 5110 - protein, 136 aa, Triticum aestivum
  misc_feature (28)..(28): Xaa can be any naturally occurring amino acid
GLYPARRPPASVQTHHEPEVVVEKIAGXVKTEGQPPVPEEEKKGFLEKIKEKLPGGHKKPEEASSVPVTQGVPAPVTHAVPTPVHEPGPAPEEVSTPDPKEKKGLLGKIMDKLPGFHKTGEEDKAPPATGEHKPSA

SEQ ID NO: 5111 - protein, 357 aa, Helicobacter pylori 26695
MKASIYDFTLKELSQLLKPSFRAKQLYLWLYAKYKTSFKDMQNNFSKDFIAYLEREFALRTIEITHVRESVDGSKKYLFKSLRDNHTFEAVLLKMKDKKIDAETNAILEREKYTVCVSCQIGCQVGCSFCFTQKGGFVRNLKASEIIQQALLIKEDNNLPLEKALNIVFMGMGEPLNNLDEVCKAIEIFNTGMQISPKRITISTSGVADKIPILAGKNLGVQLAISLHAVDDKTRSSLMPLNKKYNIECVLNEVRKWPLEQRKRVMFEYLLIKDLNDSLDCAKKLLKLLNGIKSKVNLILFNPHEGSKFERPSLENARMFADFLNSKGLLCTIRESKALDIEAACGQLREKKLSQQI

SEQ ID NO: 5112 - protein, 329 aa, Helicobacter pylori 26695
MPILFDCNAIASQVLKDEASALLESVGQFQKPNDLEAIVKLILKSQENGGKLVIVGVGKSALVAQKIVASMLSTGNRSAFLHPTEAMHGDLGMVEKNDVVLMISYGGESLELLNLVSHLKRLSHKIITFTKSPNSSLSKLGDYYLSLKIQKEACPINTAPTTSTTLTLALGDVLMACLMRAKNFSQEDFASFHPGGLLGKKLFVKVKDLLQTTNLPLIAPSTSFKDALIEMSEKRLGSAILVNEANELVGVLSDGDVRRALLKGVSLKSEVRHFATLKPKSFKNLDALLLEALEFLERHKIQLLVCVDDHNKVLGVLHLHQLLELGLKA

SEQ ID NO: 5113 - protein, 507 aa, Zoysia tenuifolia
MAAAPRDVPRRGLFIGGGWREPSLGRRLPVVNPATETTIGDVPAATAEDVELAVAAAREAFRRDGGRHWSCASGAVRAKFLRAIAAKIKEKKSDLALLETLDSGKPLDEANADMDDVAACFEYYADLAEAFDGKQRLPISLPMENFKSYALKEPIGVVGLITPWNYPLLMATWKVAPALAAGCTAVLKPSELASLTCLELGAICIEIGLPPGVLNIITGLGPEAGAPLASHPHVDKVAFTGSTETGKRVMTAAAQMVKPVSLELGGKSPLIVFDDIDNIDNAVEWAMFGIFANGGQVCSATSRILVHEKIAKQFLDRLVAWAKHIKISDPLEEGCRLGSVVSEGQYEKIKKFISTARNEGATILYGGARPQHLRRGFFIEPTIITDVSTSMQIWREEVFDPVVCVKEFSTESEAVELANDTHYGLAGGVISNDPEICERLTKAIQAGIIWINCSQPCFVQAPWGGNKRSGFGRELGEWGLDNYMTVKQVTKYCSDEPWGWYQPPSKL

SEQ ID NO: 5114 - protein, 367 aa, Triticum aestivum
  misc_feature (311)..(311): Xaa can be any naturally occurring amino acid
  misc_feature (357)..(357): Xaa can be any naturally occurring amino acid
MGKGGKGEAAAAVAGEGENMAAWLVAKNTLKIMPFKLPPLGPYDVRVRMKAVGICGSDVHYLKEMRIAHFVVKEPMVIGHECAGIIEEVGDGVKHLAVGDRVALEPGISCWRCRHCKGGRYNLCDDMKFFATPPYHGSLADQIVHPGDLCFKLPDNVSLEEGAMCEPLSVGVHACRRADVGAEKSVLIMGAGPIGLVTMLSARAFGAPRIVIADVDDHRLSVAKSLGADAVVKVSGNTEDLAGEIERIQAAMGGDIDVSLDCAGFSKTMSTALEATRPGGRVCLVGMGHNEMTVPLTSAAIREVDVVGIFXRYKDTWPLCLEFLRSGKIDVKPLITHRFGFSQGEVEEAFEVSAPRXRDAIKVMFNL

SEQ ID NO: 5115 - protein, 507 aa, Zoysia tenuifolia
MAAAPRDVPRRGLFIGGGWREPSLGRRLPVVNPATETTIGDVPAATAEDVELAVAAAREAFRRDGGRHWSCASGAVRAKFLRAIAAKIKEKKSDLALLETLDSGKPLDEANADMDDVAACFEYYADLAEAFDGKQHLPISLPMENFKSYALKEPIGVVGLITPWNYPLLMATWKVAPALAAGCTAVLKPSELASLTCLELGAICIEIGLPPGVLNIITGLGPEAGAPLASHPHVDKVAFTGSTETGKRVMTAAAQMVKPVSLELGGKSPLIVFDDIDNIDNAVEWAMFGIFANGGQVCSATSRILVHEKIAKQFLDRLVAWAKHIKISDPLEEGCRLGSVVSEGQYEKIKKFISTARNEGATILCGGARPQHLRRGFFIEPTIITDVSTSMQIWREEVFGPVVCVKEFSTESEAVELANDTHYGLAGGVISNDPEICERLTKAIQAGIIWINCSQPCFVQAPWGGNKRSGFGRELGEWGLDNYMTVKQVTKYCSDEPWGWYQPPSKL

SEQ ID NO: 5116 - protein, 465 aa, Synechococcus sp. RS9916
MVLALATVAQNLDSASFDLIVLGAGSGGLAAAKRAARHGARVAIVEGDRVGGTCVIRGCVPKKLLVYGSQVQEQLADAASYGVTVTAAQQDASVLLNNVRNEVDRLNALHISFLEKAGVTLVRGWGRFLDDHRIAVRRDGDGEREEVLQGSRILIAVGGQPSRPSIPGADLAWVSDQMFLQESYPQRVVIVGAGFIACEFACILRGLGVDVTQLVRRDHLLRGFDRELADAVQEGMVEKGIDLRFGTAPTAIEGSPGDLVVCTDGGERLPCGGVLLATGRRPFLDGLDLASAGVQVEGHRVPVDADQATNVPHIHAVGDVTDRICLTPVAVDEGRAFADAAFGGIHRQVNHDLVASAVFSQPELATVGLSEEAAVERLGADQVVVHRARFRSMAQALPKRGPRCLLKLVVDNTSDRVLGCHMVGEHAAEIIQMAAIAIGMGATKADFDRTMALHPSVAEEFVTMG

SEQ ID NO: 5117 - protein, 297 aa, Solibacter usitatus Ellin6076
MKMVLKIAFCCCLTAAAGMAQRGGGGHGGGGMGGGGGMRGGGGMGGGGMRGGGGWGGGGMRGGGGWGGGGMRGGGSWGGSGWRGGGSWGGSGWRGGGWGWRGNGWGWRGGRSVFIGGGWGWPGWGWGGGWGWGGGVWPASSYVWDSSSYWPGYSDTSYGAPSYASPAYATPAYANQGFQQQQPANNITVIYPPQNPQVTVNPVVREYDQFGQQIGGPSPNNTSMGNTAVGNAGSTLFLIAFHDHTIRAAVAYWVQGNVLHFVTTEHETKQVSLDSVDRDLSRQINAERRVQFSLPAR

SEQ ID NO: 5118 - protein, 502 aa, Zoysia tenuifolia
SPAAIPQRQLFIDGEWRAPALGRRIPVVNPSTEAHIGEVPAGTAEDIDAAVKAARAALKRNRGRDWARAPGAVRAKYLRAIAAKITERKPELAKLEALDCGKPYDEATWDMDDVAGCFEFFAGLAEALDKKQNTPVSLPENFKCHLRREPIGVVGLITPWNYPLLMATWKVAPALAAGCTAVLKPSELASVTCLELADVCKEVGLPSGVLNIVTGLGPDAGAPLAAHPDVDKVSFTGSSATGQKIMTAAATMVKPVSLELGGKSPIVIFDDVDIDKAVEWTLFGCFWTNGQICSATSRLLIHKKIAKEFIERMVAWAKNIKVSDPLEEGCRLGPVVSEGQYEKIKKFVANAKNEGATILTGGVRPKHLEKGYYIEPTIITDVSTSMEIWREEVFGPVLCVKDFSTEDEAIELANDTHYGLAGAVLSADRERCQRVAEEIDAGAIWVNCSQPCFCQAPWGGNKRSGFGRELGDGGLDIYLNVKQITEYTSDEPWGWYKPPSKI

SEQ ID NO: 5119 - protein, 360 aa, Zea mays
MPTELEELVGFIAHPNPQIRAVATENLVPYSLSDPAIFKTEELKPVKHLKFLVRDHEKIAENALNILINLTEDPVVLESVATDEKFLEMVFSHIVYPEEPNADLLAMLLANLSKYDGSKAFLQRKQEAPSQLGSDDNVLNQLMDLFVKGQDGAYNKKADYDYLAYVFADLAKHTEIRQYFLTSQPYDGVIPLTKLKVFTEHKSDIRRKGVANTIKNAAFEIPAHPSFLSESDINILPYILLPITGNEEYDVDETMEMLPDLQLLPPDKKRDSDTANIQAHVETLTLLTATLEGRELMRKINVYPIIRETHMRVNDEGVQEACDRLVQVLMRDEATEDAPEEVEERVKEIEEDEDEELVEV

SEQ ID NO: 5120 - protein, 357 aa, Xylella fastidiosa Temecula1
MSKKILILPGDGIGHEIVAEAVKVLEHVNVRHTLNMRLSFDALGGAAYEKYGSPLADETLARAREADAVLLGAVGGPQWDTIDPALRPERGLLKIRAQLGLFANLRPALLYPQLADASTLKPEVVAGLDILIVRELTGGLYFGQPRGSRISKNGEREAFDTLPYCESEIRRILKVGFEMARLRGKKLCSVDKANVLASSQLWRTVAGEMAKDYPDVTLSHMYVDNAAMQLVRYPKQFDVIVTENMFGDILSDQASMLTGSIGMLPSASLDANNKGMYEPCHGSAPDIAGQGVANPLATILSVAMLLRYGMGYIKTADAIEYAVGVVLDSGLRTADIWSEGMTKVGTVAMGDAVVAAL

SEQ ID NO: 5121 - protein, 105 aa, Arabidopsis thaliana
MPISATMVGALLGLGTQMYSNALRKLPYMRHPWEHVVGMGLGAVFANQLVKWDVKLKEDLDVMLAKARAANERRYFGIYYPLLVFGLSASQILLFFRKIGDVFGV

SEQ ID NO: 5122 - protein, 429 aa, Crocosphaera watsonii WH 8501
MIHDIFMPALSSTMTEGKIVSWTKSPGDKVSKGETVVVVESDKADMDVESFYDGYLATILVEAGQEAPVGDAIALIAETEAEIAQAQQKSPSSPQKSPEPSPPQKEELATATAPVSTATATVTAPPSTNGKSNRIVASPRAKKLAKQLGIALNTVEGSGPYGRIVAEDIEKAAGKTPTPPAIATQTPVTTPTPKVAVTPTPTPVTAGETVPLNTLQKAVVQNMMATLQVPTFHVGYTITTDELDKLYKQLKPKGVTMTALLAKAVAVTLEKHPVVNANYGEQSIRYPQSINIAIAVAMPDGGLITPVLQNADKIDIYSLSRTWKDLVDRARSKQLQPEEYSSGTFTLSNLGMFGVDRFDAILPPGQGSILAIGASSPQVVATADALLGVKRQMAVNITCDHRVIYGSDAAAFLQEFANLLENNVQSLTM

SEQ ID NO: 5123 - protein, 202 aa, Rhizobium leguminosarum bv. viciae 3841
MAETAASRTGSVSRKTNETSISVSVNLDGTGKSTISTGVGFFDHMLDQLSRHSLIDMEIDAKGDLHIDDHHTVEDTGIAIGQAISKALGDRRGITRYASIDLAMDETMTKAAVDLSGRPFLVWNVAFSAPKIGTFDTELVREFFHALAQNAGITLHILNHYGANNHHIAETCFKAVARALRTATEIDPRQAGRVPSTKGTLV

SEQ ID NO: 5124 - protein, 549 aa, Arabidopsis thaliana
MELLLPHPSNSTPLTVLGFLDRAASVYGDCPSILHTANTVHTWSETHNRCLRIASALTSSSIGIKQGQVVSVVGPNVPSVYELQFAVPMSGAILNNINPRLDAHALSVLLRHSESRLVFVDHRSISLVLEAVSLFTQHEKPHLVLLDDDQENDSSSASDFLDTYEEIMERGNSRFKWIRPQTEWQPMVLNYTSGTTSSPKGVVLSHRAIFMLTVSSLLDWSVPNRPVYLWTLPMFHANGWGYTWGTAAVGATNICTRRVDAPTIYNLIDKHNVTHMCAAPMVLNMLINYPLSTPLKNPVQVMTSGAPPPATIISRAESLGFNVSHSYGLTETSGPVVSCAWKPKWDHLDPLERARLKSRQGVRTLGFTEVDVRDRKTGKSVKHDGVSVGEIVFRGSSVMLGYYKDPQGTAACMREDGWFYSGDIGVIHKDGYLEIKDRSKDVIICGGENISSAEIETVLYTNPVVKEAAVVAKPDKMWGETPCAFVSLKCDNNGDGSVPVTEREIREFCKTKLPKYMVPRKVIFQEELPKTSTGKIQKFLLRQMAKTLS

SEQ ID NO: 5125 - protein, 470 aa, Rhizobium leguminosarum bv. viciae 3841
MDMRPDPFVPPAPLPRTVPPSRLEIIRIILRNPLELWGEPSYTLPWIRTNFFGQRTLIVNDPGLIKHVLVDNANNYRMSDVRQLVLRPILRDGLLTAEGPVWKRSRKAVAPIFTPRHAQGFAGQMLRQSEDYARKYEGAGEAGAIFDISTDMTELTFAILADTLFSGEIVTSSGHFADDVNELLHRMGRVDPMDLMRAPSWVPRVTRIGGQKVLEKFRAIVRNTMDMRLAKMKADRSSAPEDFLTLLLEQAGPDGLTKEEIEDNILTFIGAGHETTARALAWTLYCVSNSPHIREGMEEEIDAVLATGAKPVEWLDMMPQTRAAFEEALRLYPPAPSINRAAISDDFWTSPKGERVELEAGVTVLVMPWTLHRHELHWDRPRAYMPERFLPENRASIGRFQFLPFGAGPRVCIGATFALQEAVIALAVLMHRYRFDSTDQTNPWPVQKLTTQPKNGLPMRVTPRIISTKA

SEQ ID NO: 5126 - protein, 388 aa, Mesorhizobium sp. BNC1
MAETFVIAQGGGPTAVINQTVAGIVMETRKLYPGARVLGARYGIRGIRDGNFVNLSDLPDETLLAMATTPSAALGSTRDKPDAAYCDAILEGLRNVGADAFINIGGNDTAGTQAILAEASGGSIAFIHAPKTIDNDLMENDHTPGFISAAEFVAGAFLSIDLDFRALPGIYVGIVMGRHAGFLTAAASAWSLDEEGGPHLIYVPERPFERARFIEDVRAQISRHGRCIVAMSEGVSGSDGRSLVEHIVPPETLERDQHGNVRLSGTDLGRAIEHMLAESLPGTRARVDTFGYLPRGNIATINEVDAQEAFEAGAFAVRAVERLGGSVALKYNDTETTCQLVPLVDVAGKTRQMPENFLHPAENKVSGACRNYLSRLVPRKYRVARPFV

SEQ ID NO: 5127 - protein, 1379 aa, Oryza sativa
MGCRALGPARFYWAVPGPIRMSSKKVPFHRHKENEEARKKREQDEAARVYEEFVESFKGDSTSGSKFVRGGVIDPNAKLRIDSEGGKSKDGGSVPKKGSRYVPSFLPPSFGKEPDKKKEEERPKEKERRKPRVIDEFMEELKFEKELRQKRNQEREQWREGRHTDTSASSSRFDELPDELDPIGKLPGSFDDGDPQTTNLYVGNLSPKVDENFLMRTFGRFGPIASVKIMWPRTEEERRRQRNCGFVAFMNRADGQAAKDEMEGVVVYDYELKLGWGKSVALPSQALPAPPPGHMAIRNKEGGTVILSGPGGPPLASVKPQTSELVLTPNVPDIVVAPPDDAHVRHVIDTMALHVLDGGCAFEQAVMERGRGNSLFSFLFDLKSKEHTYYVWRLYSFAQGSGDSILLEVNCDSKEGDTLQRWRTEPFIMITGSGRWVPPALPSSRSPEREKESTFAAGRSRRVEVERTLTDSQRDEFEDMLRALTLERSQIKEAMGFALDNADAAGEIVEVLTESLTLKETPIPTKVARLMLVSDILHNSSAPVKNASAFRTKFEAALPDVIESFNDLYRSITGRITAEALKERVLKVLQVWADWFLFSDAYLNGLRATFLRSSHLGVIPFHSLCGDTPEIEKKASSEDGSDGFRLNEDGALATGKAAATRELLGLPLAELERRCRHNGLSLCGGKEMMVARLLSLEEAEKERVYEKDAGIKYGQGESHRTGRDDIAVNARNASRPGEGTDSGESDMLGLSHYAMEAGYKRSNESTPAEPVPSKKPKVDPVLPASKWSREDDVSDDEDRKGGRGLGLSYSSGSDIAGDSGKADATEVSTDHSNHHQDTILDEEHRKKLRQIEIAVMQYRESLEEKGLRNTEEIEKKVASHRRRLQSEYGLSFSNDGANSRRSSERTSSERRDRHDDSSRKRHRSLSRSRSPPRRSLERDREHNRNRDTDRSHGNDAGRERDRVREKSASRGRDDHYDRSRDREKDRRKGRLKVHYSHPLRLYNCILPVWSGLKCAKEKWMLRLETVSFCVLHGSSTDTCVMSVRFLFLFFSILLHQHWCFAYLLINMGIYLSTPKTDKFSEDGENDKLKLGLSSMQGWRANMEDAHSALLNLDNETSFFGVFDGHGGRVVAKFCAKYLHSQVLRSEAYSAGDLGTAVHRAFFRMDEMMRGQRGWRELSALGDKINKIGGMIEGLIWSPRGSDSNNGQDDWSFEEAYNLSRDHKPELEAERDRIVKAGGFIHMGRINGSLNLTRAIGDMEFKQNKFLPPEKQIVTANPDINVVELCDDDDFLVLACDGIWDCMSSQQLVDFIHEHIQKESSLSAVCERVLDRCLAPSTIGGEGCDNMTMVLVQFKKPITQNKKADVGEQSVKGVEEAEIK

SEQ ID NO: 5128 - protein, 320 aa, Oryza sativa (indica cultivar-group)
MSGRRDDSAKMAKLKELLHRSENRICADCSAPDPKWASANIGVFICLKCSGVHRSLGTHISKVLSVTLDQWSDNEIDNVIEVGGNSHANAIYEAFLPQNHSKPHPDSTQEEREKFIRSKYELQEFLEPSLRIVSHQSSDSGKHAGSASHSVSSKSEVGMIEFIGILNVKVKGGTNLAIRDMSSSDPYVVLTLGQQKAQTSVIKANLNPVWNEELKLSVPQQYGPLKLQAFDHDMLSKDDLMGEAEIDLQPMINAAAAFGDPGLLGDRQIGRWLKSGDNALVRDSAVVVAGGEVRQELALKLQFTESGEVELEMQWFPLNM

SEQ ID NO: 5129 - protein, 332 aa, Escherichia coli O157:H7 EDL933
MKTLGEFIVEKQHEFSHATGELTALLSAIKLGAKIIHRDINKAGLVDILGASGAENVQGEVQQKLDLFANEKLKAALKARDIVAGIASEEEDEIVVFEGCEHAKYVVLMDPLDGSSNIDVNVSVGTIFSIYRRVTPVGTPVTEEDFLQPGNKQVAAGYVVYGSSTMLVYSTGCGVHAFTYDPSLGVFCLCQERMRFPEKGKTYSINEGNYIKFPNGVKKYIKFCQEEDKSTNRPYTSRYIGSLVADFHRNLLKGGIYLYPSTASHPDGKLRLLYECNPMAFLAEQAGGKASDGKERILDIIPETLHQRRSFFVGNDHMVEDVERFICEFPDA

SEQ ID NO: 5130 - protein, 422 aa, Galdieria sulphuraria
EFGTRKDVQVYFIQVLLYLYKEECQEITTAKDIFLIRWISIKMIAVQPQPKKTPVAEYLQTSQDTPTSLTRYLLEVAKQNKDMGDMVALINGIQFACKKIASLVGKAGVTDLMGIYQQGIVNVHGEEQKKLDVLSNEVLKNALKYSGKMAVIASEEEDVPIMVEESYSGNYVVVFDPLDGSSNLDAGLPTGTIFGVFQQQFSCLIHDYEESIDNMELACLQNTLQPGRRLIAAGYCIYSSSTMLVLSLGNGLHCFTLDTEVGEFVLTRANIQIPQRGNIYSFNESNFYQWDKGVQDYIERLKKGNNQTNCRYSARYVGSMVADVHRTILYGGIFGYPADKKNVSGKLRLVYECAPMAYLVEQAGGKATTGIENILDLTPKDIHERKPLILGSPADIEEFLQVYGMSRVDREDMHMWDNLSSL

SEQ ID NO: 5131 - protein, 430 aa, Zea mays
  misc_feature (108)..(108): Xaa can be any naturally occurring amino acid
MAAVAVSGGHWRRLRTLGRGASGAVVSLAWDAASGELVAVKSAGAIGAAALRREHAVLAGLRSPHVVRCVGGGDAAEEGSSYQLFLEYAPGGSLADEVARSGGSLGEXAVRAFAADVLRGLAYLHARSVVHGDVKARNVLVGAGGRAMLADFGCARALSGSGSGSARRPIVGATPAFMAPEVARGEDQGPPADVWALGCTVVEMATGRAPFGGMGGAGVLAMVHRIAYTDAVPEVPAWLSPEAGDFLARCFARDAADRWTAARLLEHPFVAFARHDDKAPRPSPKSALDAAAFWESETESEDDADDASGSASASERIDSLACSAGALPDWDGEGGWIDVLGEHCGAPGKASSVLVAVPAGEMDVGGGLPSDDGLEADDVPFGGGDVPVPAADAYEKHCSSSDCHALSCQLVPCNLVFNAIKLWVPKKKKK

SEQ ID NO: 5132 - protein, 343 aa, Neisseria meningitidis MC58
MGIKVAINGYGRIGRQVLRAIYDYQIQDQLQIVAVNASGSLETNAHLTKFDTVHGRFEADVSHDGGNLIVNGDKIPFFSTRNPAELPWKELGVDLVMECTGAFTSKEKAKIHLESGAKKVLISAPGGDDVDATVVYGVNDSVLTADMTVVSNASCTTNCLSPVAKVLSESVGIVKGAMTTIHALTNDQTVTDVRHKDLRRARSGVENMIPTKTGAAKAVGLVLPELKGRLDGLAIRVPTVNVSLVDLSFQAARDTTVEEINALMKAASEAGPLKGVLGYNTLPLVSMDFNHTTEASHFDATLTKVVDGNMVKVFAWYDNEWGFSCQMLNTARRMFGLEVRPLK

SEQ ID NO: 5133 - protein, 150 aa, Glycine max
  misc_feature (13)..(13): Xaa can be any naturally occurring amino acid
  misc_feature (104)..(104): Xaa can be any naturally occurring amino acid
VHPYVATGNKNSXKFGIRNEKLQWFLDAVKEHPNELKLVGAHCHLGSLILQVDIFRDAAIIMVNYIDQIQAQGFQVDYLNIGGGLGIDYQHSGAVLPTPRDLIXHIELVSPAPADAEIAKFDVLGPVCESADFFGKDRQLPTPAKVKIFP

SEQ ID NO: 5134 - protein, 308 aa, Xylella fastidiosa Temecula1
MSLDSALRSRIETLLHSNRVVLFMKGRPGMPQCGFSAKAAGILQALGVEYAHVNVLDDQEIREGIKRYGDWPTIPQLYIDGELIGGSDIVSQMYENGELSTLLGVAAPDLTPPSITITPTAVEMLKGTLANAPGSTLALSIDSRFQPTFELAPINTQAIAAEYNGLRVQFDLASARRAEGITIDWVDDIRGQGLVIDNPNAPQPIQELSPGDAAAQVDAGVLTLVDVRPADERAVASVAVPFRTMDGGERAVLEQLPKGTPLAFLCHHGGRSLQAAEHFRSLGFTSIYNIGGGIDAWSTQVDPGVPKY

SEQ ID NO: 5135 - protein, 336 aa, Oryza sativa (japonica cultivar-group)
MTLANIPEIMESLPVETRFTEFPLRQYGGFWLLEVMLNGVAAAETSFQPRPSDILLSSFPKCGTTWLKALAFATLNRSTYPPSDEHHPLLEHNPHDLVGFLEIYPKLELYESLPSPRLLSTHLPYSMLPHRIREQETGCRLVYIYRDPKDAMVSMWHQNKKEKKNRLTFEEMFDMFCEGRCVVGPQWCHAGEYWDESQARPEKVLFLMYEDLLQDTVGNLRTLAEFMGCGFSRQEEDDGIVQQIVELCSLNNLKNLNVNKSGTTLLGISKDGFFRKGGTGDWSNHMSPEMAARLDKIVKERLEGSGHPIISRINAKATTSIGSSNHGASEAKYIKE

SEQ ID NO: 5136 - protein, 121 aa, Chlamydia muridarum Nigg
MGNLIKELQDEQCRTDLVDFCVGDTIRVATNISEGGKERVQVFQGTVMARKGGGAGETVSLHRVAYGEGMEKSFLLNSPKVVSIEVVKRGKVSRARLFYLRGKTGKAAKVKELIGPRAAKK

SEQ ID NO: 5137 - protein, 163 aa, Zea mays
FGSRESFPVSAEVLDSSFCLPIGKAKIERGGKDVTITAFSKMVGYALQAAEILSKEGISAEVINLRSIRPLDRAAINASVRKTNRLVTVEEGFPQHGIGAEICMSVVEESFEYLDAPVERIAGADVPMPYAANLERMAVPQVDDIVRAAKRACYRAVPMAAAA

SEQ ID NO: 5138 - protein, 201 aa, Candida albicans SC5314
MSIHNYTTPNRILYYNYQYIRLQQLSTKMGANASILDGFIEDTNFSIEEIDRLRKRFMKLDKDGSGQIDKQEFLSIPGISSNPLATRLMDVFDKDGDGSIDFEEFITGLSAFSGKSDNLNKLRFAFNIYDIDRDGYIGNGELFIVMKMMVGKNLKDEELQQIVDKTLMEADLDGDGKLNFEEFKNAVNTDTIANTLTLNMF

SEQ ID NO: 5139 - protein, 408 aa, Crocosphaera watsonii WH 8501
MWGLIACHNYAPKYISYKIRKVCELIAELVPDNLVTAQKTQDKQQVNLIKQLQTYLKTSVDYETNLLTRLVNQETDTLLNLVNAQGVALSYGETLNLVGKTPKKAAIEDLILWLKSNHREKVFATHNLSKIYNQGKDIITESSGILAISILLNSTSYYIIWFRPEVIQTVNWAGDPNESFSIGVDGEIKLCPRNSFAIWKETVKNTAIPWKKFEKEAAEKLREILLLAALEFSHTVMEEAVKKAEAANRIKGEFLANMSHELRTALNAILGFAQIMRRSSKLDAEQQENLSIITGSGEHLLNLINQVLDLSKIEAGRTIINKTELDFYRLLDDLEDMFQFKAEEQKLRLLFERSPNVPQYIRTDQVKLRQVLVNLINNALKFTEEGGVSLRVRGESLNFMETNDTKET

SEQ ID NO: 5140 - protein, 1422 aa, Vibrio sp. Ex25
MIEIVIDGKYRIVEEGLTLLEAAKVCGVEIPSLCGMNKSNEKIPCDLCVVEVESGGTKRACDLKVYRGLNVVTQSEQLSEHRRKALNRIMTDHYADCEAPCKTACPAGVDIQSYLYHISQNDHQKAIEVIKRTLPMPLSIGRVCPAFCESECRRSLVDEPIAIRQLKRHAADADLAAHEAYVPEKKPAKHRKIAVVGSGPGGLTAGYYLSNEGYDVTVFESMPKAGGWLRYGIPEYRLPKDILDKEIELMCRNGMQVETNKKLSVDFTLSQLSEDYDAVCLAVGASQAVEMKYPGSELDGCYLGVDYLKDYVTEQNYVTGKKVAVIGGGNTAIDCARTARRAGADTTLIYRRTRDEMPAEDYEIVEAEHEGVKFHFLTNPAENIADENGRVKAIRLERMALGEPDASGRRSPKPTGEFFTEAFDTVIAAVSQKPDLSFLENDELSIPLTRWNTSESDSQTMHTGTGNIFSIGDFRRGPATAVEAVGDGRVAAKAIDLFLNGDMADMPKPAFNSRKEKKLAQVDPLHFENIQKVARSIMPELTPAQREQSFAEVELGFDNEEAMKEAARCLECGCQANTDCALRDYSTEYHAEQHFDVSVDVSSASVIGHQDWLDLRAKDLRHKYEVDRSSEFIEFDANRCISCGQCIQACREQAVHGVLSFVSDKNGRPALRPDDRPRFRSDEKGASCSGLTLMGNSNCVQCGACVQACPTGAMVDSRDRSQGRTEQLKAVDTICTYCGVGCKLTMFVDERQNKIRYVKGADSPVNQGMLCVKGRFGFDFISSEERLTTPLIRKDGWLQPASWDEAIQLVASKLSTIKQDFGNNALAGFSSAKTTNEDNYAFQKFIRRELGTNNVDHCARLCHASSVTGLEASLGSGAMTNDIPSIKHSDVIFIIGSDTTSAHPIIASHIKQAIRHHGARLIVADPKRVDMAEHADLYLAHRPGTDVMLLNGVMQQIIKNGWYDQEYIEERVDGFDTLLQEVMSPAYNLDKVELVTGIKADDIFAMARMIGTAKRTAVYYSMGITQHTTGHDNVRSIANLQLLCGNIGIEGGGINPLRGQSNVQGACDMGALPNCYPGYQKVYNPIVRQKFAIEWDAPNLPSEQGLTLTEIIDAACKREVRGMYIMGENPVLSDPNQAHVIEGLEALDFLVVQDIFLTETAQYADVVLPSCSFAEKSGHFTNTERRVQRVNAAVKAPGEAKEDWWIIQAIANAMGSDWHYQCVSEITSEIARVTPQYAGLRWDAITPNGVQWPSNKNNPNGTRIMHQTQFTRGKGQMVGVPFRYAAELPDEEYPLVLTTGRVLEQFHTGTMTRKTKGLDNLAGPRAMISVEDAEAIGIHNGQRLKVSTRRGSIEIDAFVTKRMQKGVVFIPFHFVESPVNRLTTTATDPHAKIPEFKVAAVKIEISETAAQPEPVEEAVHHL

SEQ ID NO: 5141 - protein, 77 aa, Glycine max
  misc_feature (47)..(47): Xaa can be any naturally occurring amino acid
MGSAPSRSSPRQWSWGSALAGAVTTAAAAGVLVCRPRDPSFELISMXLSTFHFRPPAALDIGLTLTVHATNPNVVPV

SEQ ID NO: 5142 - protein, 357 aa, Yarrowia lipolytica CLIB122
MSSNPSFVLRKPLDLVFEDRPDPKIQDPHSVKVAVKKTGVCGSDVHYYLHGGIGDFIVKAPMVLGHESAGEVVEVGPEVKDLKVGDRVALEPGVPSRLSQEYKEGRYNLCPCMVFAATPPYDGTLCRHYIIPEDFCVKLPDHVSLEEGALVEPLSVAVHCNKLAKTTAQDVVIVFGAGPVGLLAVGVANAFGSSTIVCVDLVPEKLELAKKFGATHTFVPTKGDSPNESADKIRALIKGAGLSDSPNVALECTGAEPSIQTAVSVLATSGRLVQVGMGKDDVNFPITKCIVKEITVLGSFRYCHGDYPLAVQLVASGKIDVKKLVTNRFTFKEAEQAYKTAAEGKAIKIIIDGPEEE

SEQ ID NO: 5143 - protein, 141 aa, Escherichia coli O157:H7 EDL933
  misc_feature (36)..(36): Xaa can be any naturally occurring amino acid
MSQTFYRCNKGEIMSKTIATENAPAAIGPYVQGVDXGNMIITSGQIPVNPKTGEVPADVAAQARQSLDNVKAIVEAAGLKVGDIVKTTVFVKDLNDFATVNATYEAFFTEHNATFPARSCVEVARLPKDVKIEIEAIAVRR

SEQ ID NO: 5144 - protein, 746 aa, Cyanothece sp. PCC 8801
MTNSAKTLCPYCGVGCGLEVLPPAQPGKPTNRDSQGTPIWQVRGDRSHPSSQGKVCVKGATVSESLDKNRLKYPMMRDSLDESFRRVSWDEALEAIVHRIQTVLQTQGPDGLSMYGSGQFQTEDYYIAQKLFKGFLGTNNFDANSRLCMSSAVAGYTQSFGSDGPPCCYEDLELTDCAFLIGTNTAECHPIVFNRLRQHHKQNRKVKMVVVDPRRTKTAEVADLHLAIKPGTDIDLFNGIAHLLMRWGTIDTYFIDECTQNFPAYAEVISHYPPELVARNCEIRLDDLETAAKYWAKSERVLSLWSMGMNQSSEGTAKVRTLINLHLMTRNIGKPGAGPFSLTGQPNAMGGREAGGLANILPGYRVITNPQHCAEMEQFWGRPPGSIRPQRGLTGVEMMRALETGDIGFLWIAATNPAVSMPDVKRTQEALRRSPFTVYQDAYYPTETSEYAHILLPAAQWSEKTGVMTNSERVVTLCPEFRDPPGEARPDWAVLAEVGRRLGFVEAFRFNSSAEVFAEFVQCTEGRPCDYSGLSHDRLRQQGPLQWPYPYQWPSPEGEEEKEQNRTNKRLYTDLRFNTPDGRARFAAYHSKGLAEPPDTDYPFILTTGRLYGHWHTQTRTGHIPKIRKMHPTPFIEIHPRDAARFKIEENSLVEVRSRRGVARFPAMITEAIAPGTVFVPMHWGALWADDAEANALTHPIACPSSLQPELKACAVQLEKVTIPTGSLHGEPSELDLKRNQALTRK

SEQ ID NO: 5145 - protein, 1084 aa, Wigglesworthia glossinidia endosymbiont of Glossina brevipalpis
MPKRKDIKSILIIGSGPIVIGQACEFDYSGTQACKALKEEGYKIILINSNPSTIMTDPDIADSTYIEPINIKIIEKIIKKEKPSAILPTLGGQIALNCALKLDELGILKKFNVEMIGVNSESIKKAENRYLFVKSMNNIGLKTAKSGVVESTEEAIKLTSKIGFPCIIRSSFEMGGSNSGILYNKKDLIYFFSKIKKNYYEKIKFSIDEFLLGWKEYELEIIRDKKDNCIIVCSIENIDPIGVHTGDSISVSPIQTLSDKEYQIMRNAAISIMKEIGVNSGGANVQFAIHPKSRKMIIIEMNPRVSRSSALASKATGFPIAEISAKLSIGYNLDELMNKVTNNQIPISFEPVMDYVVTKIPRFNFEKFVESDNTLTTQMKSIGEVMAIGRNQQESLQKAIRSLEINIYGFDSIVNLSDKNVKKIIYKKLMKSDSNRLWYIADAFRIGISIERISYITKIDCWFLYQIYEIVKLEYKVIKKGINKLNKEFLFFLKQKGFSDIRIANLLNVSYKKLIELRQYYNIHPVYKRIDTCSGEFSTNTSYMYSTYSDECESNPNKKNKKIIILGSGPNRIGQGIEFDYCCVQAITTLKHSKYEAIIINCNPETVSTDYNISDRLYFEPITIEDVLEIVRIENPIGVILQFGGQTPLKLSNELNSFKIPIIGTQYKYINLAENREKFKKIINNIGLNQPKSFVSKNINSVIKQAEMIGYPIIIRPSYILGGRYMKIIYNKKDLMLYFKNKKNISINFPILLDEFLTNAIEVDVDAIFDGKNLLICGIIEHIELAGIHSGDSTSVFPPFSLSKEIQSSIKEQTKKISHAFKIKGFLNIQFAIKNRMIYLIEVNPRASRSIPFISKATGISFTKIAILSMIGKSLLHQKIVQEKYPPYFSVKESTFPFNKFPKCKGVLGPEMYSTGEVMGISKCIYTALSKAILGSKLNINKIFSKKKAFLLFSSRYKKNFLTIIKFLLKNNFKIDTTVDLAKILINNGLLFSDINKIYDKNINIKKHIMHEKYDYIVYFYNENEFNEKKKSFWSFSLNQKIYFDRKSYEDFFIIKALSMDPTKEILSLQEFHNKINLLKNKII

SEQ ID NO: 5146 - protein, 812 aa, delta proteobacterium MLMS-1
MKCTENWLKEYVTTELDTAGIASRLTMLGLEVDTVEPLYRDLEGVVVGKVLEVERHPNADRLSLCTVDDGSGTSRRVVCGAANVRAGMFSPLARPGVVLPGNFKIKASKIRGEKSEGMLCADRELGLDDGRGESGGIMDLDPAEFPDLAPGVELSTVMGLRDTMIEVDLTPNRPDCAGVIGLAREVAGVTGQPLRPPITELPADWTAAAEPLPFKVEVEAAACQRYAARLLRGVRVGPSPWWLRQRLLAVGLRPINNVVDVTNYVMLEYGQPLHAFDHDKLAGGLIRVRQAAAGEQLTTLDGVQRQLTGEMLVIADAAKPVAVAGIMGGADSEVGGDSVNILLESACFAAKSVRKTAAALKLATDSSYRFERGVDPEAAPRALARAVELIVAIAGGEAVPGGVDYREGVVEPPLLTLRLRRINELLGTELALSTVQKLLAGIEIYGEPAGEEALRVQPPSFRVDLEREIDLIEEVARLVGYEQIPTTMPQVAMAAPAVGDEAAGLKALLSARGCYEAINYSFINPAAADWLNWPAADGRRRWLPLLNPLSEEQSVMRSSLLPGLLENARHNINHQCGDLRLFEWGRVYQRPDPDAAPREMERLAAVLSGRRYPEAPLLWEGEAEADIYDIKGLLEEMLEYLQRPGLELTVAVETPAGTVPGHGLTLTYEGKKLGEAGKFQPAVLKAFGIKQQVFYLDLDMESLMALPVAERAFHSLPRYPAVKWDLAMLVAEETPAGEMLAAVIEAGGKLLERAEIFDVYRGRNIEPGKKSVAFAIHYRDAERTLNEEKVAVVHQKIIDLLESRFHGQLREA

SEQ ID NO: 5147 - protein, 549 aa, Shewanella sp. MR-7
MTLASIRRGYHVIKTLLQYGLDDVLPPKMTPWYFKLARNSLFWIRNKHKGKSGGERLKLAMQELGPVYIKLGQMLSTRRDLLSDEWANELAMLQDKVPPFDGALARQAIEAELKAPIESFFDDFNETPLASASISQVHTATLKSNGKAVVLKVLRPNVEAKIQADLLLMSQTAKVIDYLLGEGNRLRPSEVIEDYRVTILGELNLKLEALNAIKLRNNFLDSDALYIPYVYEEFCYPRLMVMERIYGIPVSDIAALKAQGTNFKLLAERGVELFFTQVFRDNFFHADMHPGNIFISRDHPENPYYIGLDCGIMGTLSEVDKRYLAENFLAFFNRDYHRIAQLYIESGWVSEKTDLQAFEQAIKVVCEPMFNKPLDEISFGHVLLELFRTARHFDIVVQPQLVLLEKTLLYIEGLGRQLYPQLDLWQTAKPFLEQWMAEQVGPKAMFKKVSTKLPYWSDKLPEFPELIYDNLKLGRKLLSSQQQMLDKYLKYQQQAHKSNYLLITSAILLICGTLLFNQDATLWSPYVCLISGAALWIIGWRSRPKNRKF

SEQ ID NO: 5148 - protein, 159 aa, Prochlorococcus marinus str. MIT 9515
MSEFLAFLDNSVLFWSLISCLLAQFFKIIFNFFATGKFRFGIMFETGGMPSSHSALITGATSGIGLQLGFDSPIFALAIAISLIVMYDASGVRKSAGIQAAEINKLSKILDPKSQVDLKEALGHTKSEVIVGSLLGPLITLPGIVYIGSPLHILDLIIN

SEQ ID NO: 5149 - protein, 515 aa, Mycobacterium sp. MCS
MYLTQALHRAVQQTPDLPATVFGERVRTWAQTADRAARLASAFQGLGVRSGDRVALLAQNCDAYHDFLFAVPWADGVAVPVNTRWSVHEIAFSLEDAGALVLVVDDVFLDMVEELRELAPTVQAYIHAGDRARPEGVLDFEDIITAHDPIEDARRGGDALAAIYYTGGTTGTPKGVMLSHANLMAAALGALSTGQFLEPRGRLLHSAPMFHLADGSGWLARNLVGGTHVILPSFTPDAVAVAVERYQITDMFLAPTMIQMFVDSPAAAQHDLSSLKHLIYGASPISQAVLERAMRLLPQVKLLQAYGMTELSPTTTVLTGEEHLDPALLRSAGRAVPIAEVKIVDEDDNEVPRGTVGEVAARGPHVMLGYWNRPEETAQALRGGWMHTGDGGYLDDNGYLFIVDRIKDMIVTGGENVYSAEVENALAQHASVATCAVIGVPDADWGERVHAVVVLQEGMTATAQELRDHCGSLIARYKAPRTVDFVDSLPLTAAAKVSKVDLRQRYWKGASRSVN

SEQ ID NO: 5150 - protein, 528 aa, Borrelia burgdorferi B31
MKYTLIKKVLIYLRTYIMNTQAILVLDFGSQYSQLIARRIREIGVYTKVIPYYTPLKEIKNMNISGIILSGSPASVYSKEAPTLNMEIFNLKIPILGICYGMQIIVKLFGGLVSKDSKQEYGSSEIFLRDEKSLLFSELPNKFQIIMSHGDSIEKIPDNFKQLAFTKNCIASISNETQKIYGLQFHPEVTHSEFGDQIIKNFVFKICQAQINWSLEGNLETIVKKIKLKVGSKKVILGLSGGTDSLVCALLIKKAINENLICVFVNTGLLRKNEDKKILELKHQYDLNIKYIDASTKFLNRLKNISDPEEKRKIIGKEFVDVFEKITLEDQNIEYLAQGTIYSDVIESKSKDSSSSKIKSHHNVGGLPDKMSLKLLEPLNEFFKDEIIQIGINLGIKKESLYRHPFPGPGLAIRIIGEVTQEKINILQEADNILTEELFINDLYYQIRQAFVVLLPVKSVGVMGDQRTYEYTAVIRCVNTQDFMTAEWTELPYSFLKKVSSRIINEVRGINRVCYDISSKPPSTIEWE

SEQ ID NO: 5151 - protein, 339 aa, delta proteobacterium MLMS-1
MSRPIGITVSRHIMDSQRLHPEATGELTGLLYELIVAAKTISAEVNMAGLADILGMSGKTNIQGEHVQKLDEFANNTIKRRMARCGYLAAMTSEEEADIIPVVEGYEGKYTLAFDPLDGSSNIDVNVSIGTIFSVHRRLTPEDGPGEESDLLQAGRQQVAAGYVIFGSSTMLVLTTGDGVHGFTLDPSVGEFYLSHPNIRVPEKSKYFSVNEGNHCYWQEPVRRFLEHLKEEDKASGRPYSGRYIGSMVADFHRNLIAGGVFLYPRDSKDPTKPYGKLRLLYEAAPMALLIEQAGGRAITDDGREILDITPEDLHQRVPLVIGSRHDVALFEEFMNGHR

SEQ ID NO: 5152 - protein, 222 aa, Rhizobium leguminosarum bv. viciae 3841
MLVKDVMITKVVGVSPDNSVRRAAEIMLANHVSGVPVIDDAGRLVGIISEGDLLRRTELGREATAELGTSALTAEEKATAYVRSNAWRVADVMSCDPIVVEGDTSLARVSALMQEHHIKRLPVMRDGVLVGIVSRADLLKAIVTADQDETASGDEAIRRSIATRLSENADLLGKDTTVTVTDGVAHLWGTIDTEECKKAARVAAESVRGVRRVVEHFSEDRR

SEQ ID NO: 5153 - protein, 490 aa, Neorickettsia sennetsu str. Miyayama
MPLILCILDGWGVLPQDEYNAIYQARTPHYCTLLEKFPHSLLSASSLEVGLPEGQMGNSEVGHMTIGSGRIIYHDLVRINRELEKIDKNPQLNVFANKLKGKRCHLVGLLSDGGVHSHVAHINKISNYLTSRGVAVCIHAFLDGRDTAPKAAKRYITEENTRRIATLAGRYYGMDRDKNWDRTVEAYRVIVKPSKQQRIFEKADEAIEYYYSQGISDEFIPPSVIGDYEGAQDGDGLFIANFRPDRARQITSELIGKTSFCKDKIKFSEMMTMSQYFEESLPSLILRQQIKNTLSEIISGAGMHQLKIAETEKYAHVSYFFNGGKEAAFAREERILINSPRVKTYDLEPKMAALEVTDALIKAIKSKRFDFIVVNYANADMVGHTGNLSATIEAIETLDNCLGKLYKEACELNGYEMIVTSDHGNAECMYDHSTKLSNTAHTTNPVPFIVASQRVKHVNNGGLYNIAGTVLKLLGIEKPTELANDLICFE

SEQ ID NO: 5154 - protein, 175 aa, Triticum aestivum
  misc_feature (33)..(33): Xaa can be any naturally occurring amino acid
  misc_feature (116)..(116): Xaa can be any naturally occurring amino acid
MAPTVMASSATSVAPFQGLKSTAGLPVSRRSNXASLGSVSNGGRIRCMQVWPIEGIKKCETLSYLPPLSTEALLKQVDYLIRSKWVPCLEFSKVGFIFREHNASPGYYDGRYWTMXKLPMSGCTDATHVINEVEDVKKEYPDAYVRIIGFDNMRQVQCVRFIDFKPPGCEESGKA

SEQ ID NO: 5155 - protein, 394 aa, Arabidopsis thaliana
MAQNGYLVPADPSAVVTVKKKTPQASWALIDATGQSEPLDVDKYEIMHRVQIHARDLRILDPNLSYPSTILGRERAIVLNLEHIKAIITSEEVLLRDPSDENVIPVVEELRRRLPVGNASHNGGQGDGKEIAGAQNDGDTGDEDESPFEFRALEVALEAICSFLAARTAELETAAYPALDELTSKISSRNLDRVRKLKSAMTRLTARVQKVRDELEQLLDDDDDMADLYLSRKLSSASSPISSIGEPNWYTTSPTIGSKISRASRASLATVHGDENDVEELEMLLEAYFMQIDSTLNRLTTLREYIDDTEDYINIQLDNHRNQLIQLELVLSSGTVCLSMYSLVAGIFGMNIPYTWNDGHGYMFKYVVGLTGTLCVVVFVIIMSYARYKGLVGS

SEQ ID NO: 5156 - protein, 253 aa, Rhizobium leguminosarum bv. viciae 3841
MTQTRFIGKTVLITGAGTGMGRAAALRLVAEGAQIALVGRRPDPIRQLLSEIEASGGAAIAIACDIADNEAVAATVEQTIERFGRLDAVFANAGVLGEFKPLAVTDADDFDALIATNLRGTFFTLKHCLPFLKGGSILINASWTAGGVMPGAGAYASTKGALLAMMRTFAVEQGPRNIRINAINPGIILTPMADDVIDPVFAARLAAHTPLGRNGTSEDLAGTVAWLLSEDANFVTGQEITVDGGYTIGGLRP

SEQ ID NO: 5157 - protein, 229 aa, Oryza sativa
  misc_feature (219)..(219): Xaa can be any naturally occurring amino acid
SRRSVLPGIGHYGRGAIEPGKYGDLAKPMEGTNLWPKYPSNFDALLKNYISLLRDLSRKIMQGIALALGGPVDAFEGRTAGDPFWVCRLIGYPVSTDIVEEHRTDIGCGAHTDYGLLTLVNQDDDICALEVKNQSGEWIYAKPIPGTFVCNIGDMLKVWSNGIYQPTLHRVVNNSPRYRVSVAFFYESNFDAAIEPVEFCRERTGGVAKYEKVVYGEHXIKKVLNNFIK

SEQ ID NO: 5158 - protein, 139 aa, Prochlorococcus marinus str. NATL1A
MDQSEESLFEEALNRYKAGSQADELIEDFQKIVSTTPNNAAAWTCLSWLQLLCNSPQEALRSARYAVKLNGQDPQSRINLSLALLETNSKGVRDHIDYVKRAMLVLPELEKELKESFEDGLSRKPNWKTLIKIKNWLDL

SEQ ID NO: 5159 - protein, 136 aa, Ustilago maydis 521
MARTKQTARKSTGGKAPRKQLATKAARKSAPAAGGVKKPHRYKPGTVALREIRRYQKSTELLIRKLPFQRLVREIAQDFKTDLRFQSSAIGALQEAAEAYLVSLFEDTNLAAIHAKRVTIQPKDIALARRLRGERS

SEQ ID NO: 5160 - protein, 487 aa, Rhizobium leguminosarum bv. viciae 3841
MKAQPKASHFIDGEYVEDTDGTVIESLYPATGEVIARLHAATPAIVERAIAAAKRAQPEWAAMSPMARGRILKRAADIMRERNRVLSELETLDTGKPIQETVVADPTSGADAFEFFGGIAPAGLNGSHIPLGQDFAYTKRVPLGVCVGIGAWNYPQQIACWKAAPALVCGNAMVFKPSENTPLGALKIAEILHEAGLPKGLFNVIQGDRDTGPLLVNHPDVAKVSLTGSVPTGRRVAAAAAGNLKHVTMELGGKSPLVVFDDADLDSAVGGAMLGNFYSTGQVCSNGTRVFVQKTIKDEFLKRLKVRTEAMLIGDPMDEATQVGPMVSWAQREKVISYIEKGKAEGATLIAGGGIPNNVSGEGYYVQPTVFADVTDDMTIAREEIFGPVMCVLDFDAEDEVIARANASEFGLSGGVFTADLTRAHRVVDRLEAGTLWINTYNLCPVEIPFGGSKQSGFGRENSLAALEHYSELKTVYVGMGPVVAPY

SEQ ID NO: 5161 - protein, 439 aa, Anabaena variabilis ATCC 29413
MVDLHEKKAPHQVVIVGGGFGGLYTAKTLAKANVSVTLIDKRNFHLFQPLLYQVATGTLSPGDISSPLRAVFSKSKNTQVLLGEVKDINPKAQHVILDDKVVPYDTLIVATGANHSYFGKDHWKDLAPGLKTVEDAIEMRRRIFGAFEAAEKETDPEKRRAWLTFVIVGGGPTGVELAGAIAELAYKTLKEDFRSIDTSETKILLLQGGDRILPHIAPELSQVAAESLQKLGAIIQTKTRVTNIENDIVTFKNGDEVKEIPSKTILWAAGVKASPMGEVLAERTGVECDHAGRVIVEPDLTVRGYKNIFVVGDLGNFSHQNGKPLPGVAPVATQQGEYVAKLIKKRLKGQTLPEFRYNDVGSLAMIGQNLAVVDLGLIKLQGFIAWVFWLLIHIYFLIEFDTKLLVVFQWAWNYITRNRRSRLITGREAFVEPKTVNQQ

SEQ ID NO: 5162 - protein, 348 aa, Prunus armeniaca
MAAKTELGSLTVQELLGKGKGEQVPEKYIHKVGAPNASSAQLMDIPVIDLGLLLTPSSITAPQLEKLRSALTTWGCFQVINHGMTPEFLDEVREMTKQFFALPVEEKQQYLRQVNDIQGYGNDMVFSEQQTLDWSDRLYLSVYPEEHRKLKFWAQDPKSFSETLHQYTMKLQVVTKTVLEAMARSLNLDVNCFRDLYGEQGKMDVRFNFYPPCSRPDVVLGVKPHADGTIITLLLQDKQVEGLQFLKDDQWFRAPIVPEALLINVGDQAEILSNGIFKSPVHRVVTNPDKERISLAAFCIPESDKDIEPFESLVNESTPGLYKKVKNYVGIYFEYYQQGKRPIEAAKI

SEQ ID NO: 5163 - protein, 219 aa, Brucella suis 1330
MPMKNDHSPDQRTLSELFEHNRQWAAEKQEKDPEYFSRLLSSQRPEFLWIGCSDSRVPANVVTGLQPGEVFVHRNVANLVHRADLNLLSVLEFAVGVLEIKHIIVCGHYGCGGVRAAMDGYGHGIIDNWLQPIRDIAQANQAELDTIENTQDRLDRLCELSVSSQVESLSRTPVLQSAWKDGKDIIVHGWMYNLKDGLLRDIGCDCTRNALQFACQPAE

SEQ ID NO: 5164 - protein, 475 aa, Glycine max
MCWIDLVESKPRNTHFCFVHGRKRSRRRRRRRRQGQCEQSHTDLPIETRKRNLSSMDFSLCLSSPIISTLVHFLLVASLFCPVCSSDIGNIGNTPVANQTFKPQEEAHKMNIIRTRLQQINKPAVKTIQSPDGDVIDCVVSHQQPAFDHPMLKGHKPLDPPERPKGHNQMDMSENFQLWTMSGESCPEGTIPIRRTTEQDMLRASSVSRFGRKIRRRVRRDTNSNGHEHAVGYVSGEQYYGAKASINVWAPRVANQDEFSLSQMWVISGSFGDDLNTIESGWQVSPELYGDRYPRFFTYWTSDAYQATGCYNLLCSGFVQTNNRIAIGAAISPTSSYAGGQFDISLLIWKDPKHGNWWLEFGSGILVGYWPSFLFTHLRDHASMVQFGGEIVNSRQSGSHTSTQMGSGHFASEGFGKASYFRNMQVVDWDNNLVPLSNLRVLADHPNCYDIQGGINNVWGNYFYYGGPGRNVRCP

SEQ ID NO: 5165 - protein, 199 aa, Oryza sativa (japonica cultivar-group)
MMMMGKRGGRKNPMRRTTSMTEFAPPVDVLVGGRVADEAEAEAEADEATELEVSGGGEVEEEDAAVEEASYGWFGAGADGAGVRADWLAAYRARAAPALAGLRRNSADFSAVETAAFLRACGLCNRRLGPGRDTFMYKGDTAFCSLECRQQHITHEEWKEKRALAIATAAAAPPQPPPSMPDPTAAGSDNPAGGTLAAA

SEQ ID NO: 5166 - protein, 666 aa, Chlamydia muridarum Nigg
MGSLSIHLTTPLPLGAQKLSSDRYRFSLVAPRAQQVILVLLDPFSEIHEIPLSSTDHRTGAIWHIEISGISNEWSYAYKLRQSDSAFPNFSTNAYIADPYSKNIFSPQLFGSSKQPNDYTFSYLKQEDFDWEGDTPLRLPKENYFIYEMHVRSFTQDPSSQVTHPGTFLGIIEKIDHLKKLGVNAVELLPIFEFDETIHPFKNKDFPHLCNYWGYSSINFFCPSRRYTYGTDPCAPAREFKTLVKTLHRAGIEVILDVVFNHTGFEGTSCPLPWIDLESYYMVNDNGDLLNFSGCGNTVNTNTPIAIKWILDALRYWVQEMHVDGFRFDLAAVFSRDLQGVPRSLTPILQAISSDSILSETKLIAEPWDAGGLYQLGHFPSISTRWSEWNGCYRDHVKAFLNGDPHQVSSFASRISGSRDIYPAGNSTNSINYICSHDGFTLYDSVAYNHKHNEENGENNRDGTSANYSYNFGCEGETTDPNICQLRERQMKNFFLALFLSQGIPMIKSGDEYGHTAYGNNNHWCLDTKINHFLWDRLAERKEFFSFLCQIITLRTTHAELFNTNFLSEETITWLNSQGLPREWTPDHYLAFELKHPNYSLFIAFYSGNERIEIALPKLRQEHLAYEKIVDSTTGFFSQILSPKLSLEPYSSLVAISRKKKPIEPK

SEQ ID NO: 5167 - protein, 197 aa, Brassica napus
MKAPNMETITKSLEKSMQNFSLSDRRRRVGDRFGRSSTTTEESSNEHVPPISDRTLELNSHISLPCHWEQCLDLKTGEIYYINWKNGMRVKEDPRKVMMNADNDSGESCGTFCSEEDSSYYDSEESSSESSPSSRENQKEEEEEDEEEEEEEEEEAVLVVAGCKACFMYFMVPKLVEDCPKCAAQLVHFDRPHSASP

SEQ ID NO: 5168 - protein, 145 aa, Crocosphaera watsonii WH 8501
MTSNFDVIVLGAGGIGSAAAYYLAKEKKRVLILEQFNINHNKGSSYGYSRVIRYAYDNPIYVKLMRAAYSLWFALEKEAKETLYIKTGELDFGLINSPSMQEVANSMTQENIPYQTLTATEINKRFPQFNIPETMEGLYQEDTGI

SEQ ID NO: 5169 - protein, 172 aa, Crocosphaera watsonii WH 8501
MSLGLTLPLTIMPCQLAFFKVANSEDFIPGNFPIFLAHLNEKYGQFPYGLPACDHQGLKLSTFYGWDTVETIKEVDYTPSLQWTENLRSFLKQYLPNANGELIETRRCLYTMTPDKHFIIDQHPEYANIFIAAGFSGHGFKFTTLVGKILTDLVIKKETEYDLSLFKINRFL

SEQ ID NO: 5170 - protein, 194 aa, Brassica napus
  misc_feature (88)..(88): Xaa can be any naturally occurring amino acid
  misc_feature (105)..(105): Xaa can be any naturally occurring amino acid
MYSSDDIWNYDMYCFKKKKKKKKKKSESTQPSRMEEHGFESTTISDVMNAKGKSADGSWLWCTTDDSVYDAVKSMTQHNVGALVVVKXPGEQQSLAGIITERDYXRKIIVQGRSSKSTKVGDIMTEENKLITVTPETKVLVAMQLMTDNRIRHIPVIKDKGMIGMVSIGDVVRAVVTEHREELNRLNAFIQGGY

SEQ ID NO: 5171 - protein, 264 aa, Oryza sativa (japonica cultivar-group)
EPSSSSAAAAAISCSSSNDDEKPPPSLEGKELRRVEEEEPAAAARPEKLTEGSSRAAEAEEEEEVVEDEEDDDEEDEGKVAEAIDLGPRVSIKEQLEMDKEDESLRRWKEQLLGSVDLNSVGESLEPDVRITSLCILSPGRTDVLLPLPVEPSNSKEPWFTLKEGSTYRLKFTFSVSSNIVSGLRYTNTVWKAGIRVDKTKEMLGTFSPQLEPYTYVTPEETTPSGVFARGSYSAKTKFVDDDRKCYLEINYTFDIRRDWPCKS

SEQ ID NO: 5172 - protein, 477 aa, Neisseria gonorrhoeae FA 1090
MSQYDVVVIGAGPGGYVAAIRAAQLGFKTACVDAGVNKAGNAPALGGTCLNVGCIPSKALLQSSEHFHAAQHDFAEHGITVGDVKFDAAKMIERKDAIVTKLTGGVKFLFQKNKVTSLFGTASFAGKNGDAYQIEVDNKGEKTVIEAKHVIVATGSVPRPLPQVAIDNVNVLDNEGALNLTEVPAKLGVIGSGVIGLEMGSVWNRVGAEVTILEAAPTFLAAADQQIAKEAFKYFTKEQGLSIELGVKIGDIKSEGKGVSVAYETAAGEAKTEVFDKLIVAIGRIPNTKGLNAEAVGLEKDERGFIKVDGECRTNLPNVWAIGDVVRGPMLAHKASDEGVAVAERIAGQKPHIDFNNVPFVIYTDPEIAWVGKTEEQLKAEGVEYKKGTSGFGANGRALAMGKAKGTVKVLADAKTDRILGVHMIGPVVSELVTEGVTALEFFASSEDIARIIHAHPTLSEVVHEAALAADKRALHG

SEQ ID NO: 5173 - protein, 393 aa, Neisseria gonorrhoeae FA 1090
MIIDVKVPMLSESVSEGTLLEWKKKVGEAVARDEILIDIETDKVVLEVPSPQAGVLVEIVAQDGETVVADQVLARIDTAATVAAEAPAAAPAEAAPAAVPAAAQNNAAMPAAAKLAAETGVDVNVLQGSGRDGRVLKEDVQNAAAKPAAAVAPAVALPAGARPEERVPMSRLRARVAERLLASQQENAILTTFNEVNMKPIMDLRAKYKEKFEKEHGVKLGFMSFFVKAAVTALKKYPVVNASVDGKDIVYHGYFDIGIAIGSPRGLVVPILRDADQMSIADIEQAIVDYAKKAKDGKIAIEDLTGGTFSITNGGTFGSMMSTPIINPPQSAILGMHATKERAVVENGQVVVRPMMYLALSYDHRIIDGREAVLTLVAIKDALEDPVRLLLDL

SEQ ID NO: 5174 - protein, 537 aa, Bacillus cereus G9241
MMMNVPLTISSMMERAEKLFSKKEIVSRTHDTVTTLTYKQLGERTRRLSSALKKLGIKEGERIGTLAWNHHRHVEAYFAIPGIASVLHTINIRLSPQHISYIIQHAEDRILLIDEDLVPLVENIQSQLSTVQAYIIMTDKDELPNTTLEPVYHYEKLLEEGDPTFQFVKDIDENTPAGMCYTSATTGNPKGVVYTHRSTVLHCMALGLADTAALSESDAAMAIVPMFHVNAWGLPFAATWFGSKQVLPGPMFTPKILLEMIQSEKVTLAAGVPTIWLGVLQELENNSYDLSSMTRILCGGAAAPKSVIKAFEQKHNVPFIHAYGMTETSPLVTLARLKSYETELSYEEQLEIRSKQGYLVPGVEMKVVGTNGEVKWDGTEMGELCLRAPWIAESYYNDDRTVEGFRDGWLYTGDVVTVDEEGCVKIVDRTKDVIKSGGEWISSVDLENALMAHDAIFEAAVVAVPHPQWQERPVACVVQKKNSTVTKEEIYEFLKPQFAKWWLPDDIVFMEEIPKTSVGKFLKQALRKELEHLHREK

SEQ ID NO: 5175 - protein, 412 aa, Triticum aestivum
MQLASPIYFLEGGGERDNQDPNLGLAFKRRSKSWPATRPDLQPTPATMARHHLLLFLPLLALAFSFVVAAPERQGDAAAFIDGASHRYLRDQQEDQATSMSLDEVSAAVSVLLGFAPPAMLPAPSSAKFNKLLLPNPFDRPRSVFLMQLDGSHDYVDCFISDAGSIYKTKIDGAKSAAIELTDKDELIVIRSDESSGLDVLDNELANLATWLAGSYQKADSKLNIPLKSGNSLTLFLTKEADVEFASSLISLLKTIKRGIQVHEDFSGGIVSHAELLVCHFTGIKALEDEYGPAEIVKQGAEVVQTALTKAFDQLQGAYNGKIVGLVISAKEASTSLASIIDAPSSLHISRRLAEASKTNATASIAAIYLVRLSLAWITGIILLVSTLIGICLLMNMPLTRDTLLYSNVKID

SEQ ID NO: 5176 - protein, 475 aa, Prunus armeniaca
MSTLKARSVQARASDGDLENLVPSKPQGKSSGTVFPFVGVACLGAILFGYHLGVVNGALEYLSKDLGIAENAVLQGWVVSALLAGATVGSFTGGALADKFGRTRTFQLDVIPLAIGAFLCATSQSVQTMIVGRYLLAVGIGITSAIVPLYISEISPTEIRGALGSVNQLFICIGILGALVAGLPLAANPLWWRTMFGVAIVPSVLLALGMAASPESPRWLFQQGKISEAEKAIKTLYGKERVSEVMHDLTSATQGSVEPEAGWFDLFSSRYWKVVSVGAALFLFQQLAGINAVVYYSTSVFRSAGITSDVAASALVGAANVFGTAVASSLMDRQGRESLLLISFGGMAASMLLLSLSFTWKVLAPYSGPLAVAGTVLYVLSFSLGAGPVPALLLPEIFASRIRAKAVSLSLGMHWISNFVIGLYFLSFVTKFGISSVYLGFAGVCLLAVLYISGNVVETKGRSLEEIERALSVST

SEQ ID NO: 5177 - protein, 427 aa, Neisseria gonorrhoeae FA 1090
MSKSIKLNVPGRAGLELPVLEASIGHDVVDIRGLTKNTGLFAFDPGFVSTASCESKITYIDGDQGLLYYRGYPIEQLAEKSDYLEVCYLLIYGELPTPEQKAEFDNTVRRHTMVHEQLTWFFRGFRRDAHPMAMMVGVVGALSAFYQDSLDITNPEHRKIAIYRLISKIPTIAAMCYRYSNGLPFNYPKNNLSYSENFLHMMFATPCEDYKPNPVLARALDRIFILHADHEQNASTSTVRLAGSSGANPFACIAAGIACLWGASHGGANEAVLKMLDEIGDVSNVAAYMEGVKQRKYRLMGFGHRVYRNMDPRASIMRETCYEVLKELGLEDSPKFKLAMELEQIALKDPFFIERKLYPNVDFYSGIVLSALGIPTEMFTVIFALSRSVGWISHWHEMISDPSLKIGRPRQLYTGSERRDYVPAGER

SEQ ID NO: 5178 - protein, 463 aa, Escherichia coli CFT073
MLAFLNQVRKPTLDLPLEVRRKMWFKPFMQSYLVVFIGYLTMYLIRKNFNIAQNDMISTYGLSMTQLGMIGLGFSITYGVGKTLVSYYADGKNTKQFLPFMLILSAICMLGFSASMGSGSVSLFLMIAFYALSGFFQSTGGSCSYSTITKWTPRRKRGTFLGFWNISHNLGGAGAAGVALFGANYLFDGHVIGMFIFPSIIALIVGFIGLRYGSDSPESYGLGKAEELFGEEISEEDKETESTDMTKWQIFVEYVLKNKVIWLLCFANIFLYVVRIGIDQWSTVYAFQELKLSKALAIQGFTLFEAGALVGTLLWGWLSDLANGRRGLVACIALALIIATLGVYQHASNEYIYLASLFALGFLVFGPQLLIGVAAVGFVPKKAIGAADGIKGTFAYLIGDSFAKLGLGMIADGTPVFGLTGWAGTFAALDIAAIGCICLMAIVAVMEERKIRREKKIQQLTVA

SEQ ID NO: 5179 - protein, 440 aa, Escherichia coli CFT073
MMLPFLKAPADAPLMTDKHEIDARYRYWRRHILLTIWLGYALFYFTRKSFNAAVPEILANGVLSRSDIGLLATLFYITYGVSKFVSGIVSDRSNARYFMGIGLIATGIINILFGFSTSLWAFAVLWVLNAFFQGWGSPVCARLLTAWYSRTERGGWWALWNTAHNVGGALIPIVMAASALHYGWRAGMMIAGCMAIVVGIFLCWRLRDRPQALGLPAVGEWRHDALEIAQQQEGAGLTRKEILTKYVLLNPYIWLLSFCYVLVYVVRAAINDWGNLYMSETLGVDLVTANTAVTMFELGGFIGALVAGWGSDKLFNGNRGPMNLIFAAGILLSVGSLWLMPFASYVMQATCFFTIGFFVFGPQMLIGMAAAECSHKEAAGAATGFVGLFAYLGASLAGWPLAKVLDTWHWSGFFVVIAIAAGISALLLLPFLNAQTPREA

SEQ ID NO: 5180 - protein, 340 aa, Helicobacter pylori 26695
MANLENLDWKNLGFSYIKTDFRFIATYKNGSWSQGGLVSENMLQLSEGSPVLHYGQACFEGLKAYRSQKGKALLFRPLENAKRLQTSCERLLMPKVSEELFLRACAEVVKANQKWLAPYKSGASLYLRPFVIGVGDNLGVKPANEYLFIVFCAPVGAYFKGGIEKGGARFITTIFDRAAPKGTGGVKVGGNYAASLLAHKMATEQGYDDCIYLDPTTHTKIEEVGAANFFGITHDDAFITPHSPSILPSITKKSLMVLAKEYLNLKVEEREILMDELDAFKEAGACGTAAIITPIKEIVHNNKSYFFEAPGHITKRLYDLLLSIQQGEQEAPKDWIFEVG

SEQ ID NO: 5181 - protein, 179 aa, Triticum aestivum
  misc_feature (9)..(9): Xaa can be any naturally occurring amino acid
  misc_feature (119)..(119): Xaa can be any naturally occurring amino acid
MAPTVMASXSGTSVAPFQGLKSTAGLPVSRRSNGASLGSVSNGGRIRCMQVWPIEGIEKFETLSYLPPLSTEALLKQVDYLIRSKWVPCLEFSKVGFIFREHNASPGYYDGRYWTMWKXLPMFGCTDATQVINRGGKRSRKEYPDAYVRIIGFHKHAPRCSAVIFIAFKPAGCDESGKA

SEQ ID NO: 5182 - protein, 472 aa, Brassica napus
MVLGAAARVAIVGCRRLVCSSSHASPLLVSSQCRQMSMDAQSVSEKLRSSGLLRTQGLIGGKWIDSYDKTTIKVNNPATGEIVADVACMGVKETNDAIASSYEAFQSWSTRTAGERSRVLRRWFDLLVAHKEELGQLITLEQGKPLKEAIGEVAYGASFIEYYAEEAKRVYGDIIPPNASDRRLLVLKQPVGVVGAITPWNFPLAMITRKGGPALASGCTVVVKPSELTPLTALAAAELALQAGVPPGALNVVMGNAPEIGDALLASPQVRKITFTGSTAVGKKLMAAAAPTVKKVSLELGGNAPSIIFDDADLDVAVKGALAAKFRNSGQTCVCANRVLVQDGIYDKFAEAFSEAVQKLEVGDGFKEGATQGPLINDAAIQKVESFVQDAVSKGAKVLLGGKRHSLGMTFYEPTVIRDVTSNMIMSRGGFRAPVAPLIRFKTEEDAIRIANDTIAGLAAYIFTNSVQRSWR

SEQ ID NO: 5183 - protein, 739 aa, Crocosphaera watsonii WH 8501
MTNSTKTICPYCGVGCGLEVLPPAQPGKAVNRDSEGNPIWQVRGDRSHPSSKGKICIKGGTVSESLVKDRLKYPMMRDSLTDEFRRVSWDEAMEAIVNRMQKVRLTQGPDALCMYGSGQFQTEDYYIAQKLFKGFLGSNNFDANSRLCMSSAVAGYIQSFGSDGPPCCYEDLELTDCAFLIGTNTAECHPIVFNRLRLYHKKNRKVKMVVVDPRRTQTAEAADLHLAIKPGTDIDLFNGIAYLLMRWGRIDSLFIDECTQNFPAYAEVIRHYSPELVARKCGIRIQDLEKAAKYWGESQRVLSLWSMGLNQSSEGTAKVRTLINLHLMTGDIGKPGAGPFSLTGQPNAMGGREAGGLCNILPGYRLVNNPQHRAEVEQFWGVRPGTIQPQRGRTAWEMIQGLETGEVGFLWIAATNPAVSMPDLKRTQAALKRSPFTVYQDAYYPTETATYAHILLPAAQWSEKTGVMTNSERVVNLCPQFRDPPGEARADWEIFAEVGRRLGFEKQFSFPNSAQVYAEFVKITEGRPCDSSGLSYEKLRRYGPLQWPYADTWPCLEGEELDRQNRTNKRLYTDFCFNTPDGRARFGAYHSRGLAEPSDQAYPFVLTTGRLYGHWHTQTRTGRIPKINKKHPEPFIEIHPRDAAKLNIKENSLLEVRSRRGKAYFPAKITKEIAPGTLFVPMHWGALWAENAEANALTHPTACPSSLQPELKTCAVQISIARVNEVRNQRSEVVFETRI

SEQ ID NO: 5184 - protein, 418 aa, Neisseria meningitidis MC58
MANKLRNYTINFGPQHPAAHGVLRMILELDGEQIVRADPHIGLLHRGTEKLAETKTYLQALPYMDRLDYVSMMVNEQAYCLAVEKLVGIDVPIRAQYIRVMFAEVTRILNHLMGIGSHAFDIGAMTAILYAFRDREELMDLYEAVSGARMHAAYFRPGGVYRDLPDFMPKYEGSKFRNAKVLKQLNESREGTMLDFIDAFCERFPKNIDTLETLLTDNRIWKQRTVGIGVVSPERAMQKGFTGVMLRGSGVEWDVRKTQPYEVYDKMDFDIPVGVNGDCYDRYLCRMEEMRQSVRIIKQCSEWLRVNPGPVITTNHKFAPPKRTEMKTGMEDLIHHFKLFTEGMHVPEGETYTAVEHPKGEFGVYIISDGANKPYRLKIRAPGFAHLQGMDEMAKGHMLADVVAIIGTQDIVFGEVDR

SEQ ID NO: 5185 - protein, 327 aa, Glycine max
  misc_feature (73)..(73): Xaa can be any naturally occurring amino acid
MKGLFKSKPRTPADVVRQTRDLLLFVDRSPETRESKREEKHMSELFKNIRELKSILYGNSESEPVSEACAQYXYLLKLNLEARKDATQIVANLQRQQVQSKLIASDYLDTNLDLMDVLVSGYENTDMALHYGAMLRECIRHQIVAKYVLDSPHMKKFFDYIQLPNFDIAADAASTFKELMTRHKSTVADFLNNYYEWFFDEYNSKLLESSNYITRRQAVKLLGDMLLDRTNSAVMTRYVSSRDNLRILMNLLRESSKSIQIEAFHVFKLFAANQKKPADIISIFVANRSKLLRLLGDLKTDKEDEQFEADKAQVIKEIAALEPRDLA

SEQ ID NO: 5186 - protein, 246 aa, Zea mays
  misc_feature (110)..(110): Xaa can be any naturally occurring amino acid
  misc_feature (241)..(242): Xaa can be any naturally occurring amino acid
VRLQLPVRNSRVDPRVRLTEKQTEVETVMSEVSGFPMPQLDPRVLEVYRGVREVLCKYRSGKLPKAFKVIPALSNWEQILYVTEPEAWTAAAMYQATRIFASNLKERMAXRFYNLVLLPRVRDDIAEYKRLNFHLYMALKKALFKPGAWFKGILIPLCESGTCTLREAIIVGSIITKCSIPVLHSSAAMLKIAEMEYSGANSIFLRLLLDKKYALPYRVLDALVFHCLAFRTEKRQLPVLXXQCLL

SEQ ID NO: 5187 - protein, 827 aa, Vibrio vulnificus CMCP6
MESIVIIGNGMVGHQLVEQLVASGSHLEKRIIVIGEERFVAYDRVHLSAMFSGQSHQDLLLSSEEWYQKHGIELILGVAVVGIDRQSKRVTLEDESQLSYDQLVFATGSYPFVPPMAGSERSKVFVYRTLDDLSQIKQACLGAKKGAVVGGGLLGLEAANALRLLGLETHVVEFAPRLMPVQLDEGAGAVLKSKIEQLGLTVHTSTATEKIIDGETAYHRMVFKDAPPLEVDVIVFSAGIRPRDQLARDCGLELGERGGIVINNACQTSDTAIYAIGECALWQGKIFGLVAPGYAMARVVAQQLRGGSEAEFSGADMSTKLKLLGVDVASIGDAHKATPKATEMVLHDAAAGIYKKLVVDQSGTTLLGAILIGDNQDYDVLLQSYLNKTPLPQPAVSLLFDTSALKGDVSDNTVICSCHNVTKGDLISAIQAGAHELGELKALTKAGSGCGGCSAMVKSVLDQQLSVMGLEVNTQLCEHFSQTRQALYHICQVEKIRDFGSLLAKHGKGHGCDICKPTAGSIFSSLWNEHIMEPEHSPLQDSNDAFMANLQKDGSYSIVPRIPGGEITPEKLIVLGEVARQYDLYTKITGGQRVDLFGAQVEQLPEIWQTLIDAGFETGHAYGKSVRTVKSCVGSTWCRYGVDDSVGLAIELENRYKGLRAPHKLKFAVSGCTRECAEAQSKDIGVIATEKGWNLYVCGNGGMRPRHADLLAADLSKAELIRLIDRVLMFYVRTADRLQRTSVWLENLDGGLDYLKSVVLDDSLHLCEQLEQQMAHVVDTYHCEWKQTLTNPEKLMRFRPFINSTQQSTLLGYQRTRGQRIPVKLED

SEQ ID NO: 5188 - protein, 484 aa, Rhodopirellula baltica SH 1
MLDFGTAGTQTLGRREIIGTAVEQRASDEQRSNIGQSKLNQRVFLWSLTSSLAGFLFGFDTVVISGAEKAIQGLWALGDFQHGLALSAALWGTVIGSLVGGWPTDKFGRKKTLLWIGILYLVSAIWSGFATDVFSFMIARFIGGLGVGISTVAAPLYISEISPPKHRGTLTGLFQFNIVFGIMVAFASNYLIGTWGNENAWRWMLAVEAIPALIFTVMCISLPSSPRWLIAVKKDQAAGMSVLKQLRPDASDEEVQRTVDEIVASLRAESDLTPAEPFWSRRLFTPISIAFLVAFFNQLSGINAVLYFSPRIFELAGMGEQAALLQSIGIGITNLIFTFVGLYLIDRLGRRTLLLIGSAGYILSLGTCAYAFQSETFSIVPACIFAFIASHAMGQGAVIWVLISEVFPNEHRAAGQSLGSFTHWIFAALLTLVFPAVVETFHPAAIFGFFCFMMVLQGLWVITMLPETKGISLEQMEAKLGIRV

SEQ ID NO: 5189 - protein, 1184 aa, Cryptococcus neoformans var. neoformans
MFVTRPPFSPLDHRGSPLEDDHTNTSGSSRDDVPSSHSTNTAFHEFKSSTPFPPHYLNVPSGLAFKTYLEKWGPEQIMGFLAIHGCEHHSGIFIKNSIDGKLLLDLDMSVLTSLGITKVGERVRLMAGIKCLRQRIAHEAEKDNVRSAHLCNGSLGMDRVKVMIHPKMSASLYVCRQGPFDSDPSTARRSRLTPSSSADRERNPSPMQRSQEVMKHSFITRSSGGQVIPPLWSGQIHNHGIDNSPTPGLYQPPMQRSVPLRSSVSYSDIAAKGMPLLVTQSINSAADHTFAVTDSHDTTSSLGGHLPRPDYFHSTNDAFQTCTKGEDNTISELPQRNQESSPSKWKKSGVICEDEAMLDSSPFAPTSPKHPFAINVTGNNVMEYPPNLPIKNCLSLRSFQSPDKSAGEDRLNMNPRAPSLDDLRRKLVKFVNAEDGTTRTVNVMKATSGAEVLERALRKFGKTGTGSAPFLDEENHNGGKYEGSLCIDGWGVFAEDLLGEEIGPMTEGDLFDICASLQNGAAIQRDALILRQTSESQKRKDMRFYLGNMPVLPTPVNLPISFYSPHSGQFERNSALQHTAQHQPLLSKNRSRASMMSIMSGLGVSHPDIKQPTHDSVQSPTSVTRSSSKKKSMYNFFGHRPPSELISSHLADYFPSAKKRDVAKVRGSMLRLNIAHTAEHDPRSVKSLGMIETDDMPFSSTEQSLTEQGGHYFDPSTCQPADTSSRGHVDHIITDHAGNSKGYYRLPCDEKASPTVKTQELHSANSANSILRACPPNLPPTYQSARLTDLHSDSTFSQLQLLRHSSSLSFKQPSSSHRRTVDEITAEMQHRQTSLSSNRPTSTIDSDISGPPCDSETSPDHTSDVSDVSESSSEYWDDQSSVSSKDSDHNTVEHTRAFTSNGSKRNIKWIKGALIGAGSFGSVFLGMDAQSGLLMAVKQVELPRGIAKMEARRRDMLSALEREIELLKDLQHENIVQYLDSSADANHLNIFLEYVPGGSVAALLNSYGAFEEALVGNFVRQILTGLNYLHERDIVHRDIKGANILVDNKGGIKISDFGISKKVENSLLNGLHPNRPSLQGSVFWMAPEVVKQTSYTSKADIWSVGCLVVEMLTGTHPWARLTQMQAIFQIGSMGQPDIPSDISAHAADFLSRAFALDYRMRPSATSLLQHAFIIHDGSGGNDEV

SEQ ID NO: 5190 - protein, 1239 aa, Ustilago maydis 521
MSSSQRPVVQPIPPFKGAPLQATDVQNRRPTAAEAYVALANRKAGANVVSTRATGCENHRPSQHQPTSHHASQRQQPAPAADRRVQQSQPSERPKPASRLEREKKRHHNDPKNIGHWRLDKLIGQGASGRVRLAIHDQTGQKAAVKIIPRTLINASRMSLRDADVKANKMILGIEREIVIMKLIEHPNLLGLWDVYETSKDLFLIMEYVAGGELFDHLVAQGKLSPRDARGYFRQIIFGMDYCHRFNICHRDLKPENLLLDETKKIVKVADFGMAALQPTEKMLETSCGSPHYASPEIVSGKRYKGTASDIWSCGIILFALLCGRLPFDDPNIQQLLGKVRAGKFIMPEWLEPASKDLIWRMLEVDPEKRIKMADIMRHPWFTNNGTESSVNPVSTSLDSLQMEELTLDTIDIDILGNLKTLWFELSEQDIIKELLAPGPSWQKTFYTLLVAHRENHSADDEDDMNDDILDEQIVTASAVPAHALLSTTSAAKTLEKPRPRRTSDAAGATSAPASPRLESVEMDRRHSTPEKGSVYHTTSRRPDNVTPPKVASPHVRPANPSPRLRPSPLDSPASTLDSAFVSASKLKVASPTKPRALGSSHGADKSGYVLPQISLQTASPQRNERPAVDLQRRNTSPTKPNTVGVTAPLSARIALANMYDAPTLSHTATASCGSTSSTASSTVSVSAARNRANRGSGSEMMPPLALPGRASSRPVSPTKSTFGAQATLPPQTAPQPAPPRPSTSRAYTTQPTPCIQVPQVGDATMQRFFQEIADELASIRATGEKPDALQSKLDQLKNSMAWQQQQQQQQLQSQPMAVTASAPSARTRNSEMNQFEDAEDDVSEGESMRSVSQASSHQQTYTPSTPMTPLSPVELIAPLALTDKSGAGARSSVASSSASASARNSVRSARSGTEASSSGTTSRPTSVFSNISTGSTGLGRKRSLLGLRRADKHAQQQHATATEANTIRSIAYESTPTPTALASVFAAPASGRFVPNGGATTASSVRMQRLNPGLGLDIGASSAAGIISPPSTPQSPNTATLSPAPAASASAIASASAPGKKDSWFAGLFNWKPATFTLMSSENFSETLTECIRRLQSYGVRVAMDDSSDVHHTTLKCSINEYRESNGVVTAAKPLRFRVDVHILAVGSPATNSAYMGGGLGLSLHGGAVGTNVNATSIMTHGLPSPALSTYSRASTPGGVTFATSVLVVQEKGALSTFKLIHARLRREWMLDLGSAII

SEQ ID NO: 5191 - protein, 164 aa, Cordyceps bassiana
MANPKVFFEVSANGEPLGKIVMELRKDVVPKTAENFRALCTGEKGYGFKGSSFHRVIPGFMCQGGDFTNHNGTGGKSIYGEKFADENFQLKHTGPGILSMANAGPNTNGSQFFLCTATTGWLDGKHVVFGKVVEGLDVVKKVEKFGSDSGKTSKKIVIDASGEC

SEQ ID NO: 5192 - protein, 386 aa, Brassica napus
  misc_feature (106)..(106): Xaa can be any naturally occurring amino acid
  misc_feature (274)..(274): Xaa can be any naturally occurring amino acid
  misc_feature (370)..(370): Xaa can be any naturally occurring amino acid
MGCFNSKHSSPPPRPIRRRSDTAANRGHPQNTHKPHVLPTPPSHRRVVNSSPKKHRNNDDDAPRSKTTGVSLRSGLPHGNVEAEQVAAGWPSWLSSAAPEAVHGLXPLRAEDFEKREKIGQGTYSNVFRACEVSTGRVMALKKIRVQNFETENIRFIAREIMILRRLDHPNIMKLEGIIASRNSNSMYFVFDYMEHDLEGLCSSPDINFTEAQIKCYMQQLLLAVEHCHLRGIMHRDIKAANILVNNKGVLKLADFGLANIVTPRNKNQLTSRXVVTLWYRAPELLMGSTSYSVSVDLWSVGCVFAEILTGRPPLKGRTEIEQLHKIYKLCGSPDEELWRNNKLHPQTKMFGQQHQYEGCLRETFEEFPXTAVNLLENLFSIDPEK

SEQ ID NO: 5193 - protein, 350 aa, Dechloromonas aromatica RCB
MKICVLPGDGIGPEITAQAVRVLNSLDLKFEMEEALLGGGAVDATGNPYPEATQKLARAADAVLLGAVGGPKWDSLPREQRPERGLLGIRKDLNLFANLRPAILYPELANASTLKPEVVAGLDILIIRELTGDIYFGQPRGVREENGERVGFNTMVYSESEIRRIGHVAFQAAQKRDKRLCSVDKMNVLECTQLWRDVMIEISRDYPDVELSHMLVDNAAMQLVKAPKQFDVMVTGNMFGDILSDEASMLTGSIGMLPSASLDDKNKGLYEPSHGSAPDIAGKGVANPLATILSAAMMLRYTFGLEEQALRVENAVKKVLAQGYRTGDIYERGTNKVGTREMGDAVLAAL

SEQ ID NO: 5194 - protein, 158 aa, Oryza sativa (japonica cultivar-group)
MLMGRKIMGLLLGCVGLVAVMHVAAAQQAFGVRATYHFYRPAANGWDLTATGAFCSTWDAGKPFDWRSKYEWTAFCGPVGPTGRDSCGKCLRVTNRVTGAQTTARIVDKCANGGLDLDWDTVFSKIDTDGQGFQRGHLTVDYSFVNCGDNNYLAEVVI

SEQ ID NO: 5195 - protein, 159 aa, Neisseria meningitidis MC58
MANLVKTFLLGELVKGMGVTLKNFFARKDTIYFPEEKTPQSVRFRGLHAQRRYPNGEERCIACKLCEAVCPAMAINIESEEREDGTRRTKRYDIDLTKCIFCGFCEEACPTDAIVETHIFEYHGEKKGDLHMTKPILLAIGDKYEAEIAKRKAADAPYR

SEQ ID NO: 5196 - protein, 647 aa, Flaveria bidentis
MISLNSSFLERSSVAGGSRTQSQSLRLSVRRPVVASMLNSNSLPERNVNVSVDSAVRDVNAPVAVEVDRSVGEKPFAVVGGGVEDMYGEDTATEDQYITPWSVSVASGYSLLRDPHHNKGLAFTEKERDAHFLRGLLPPVVVNHDLQVKKMMHNIRQYQVPLQRYQAMMDLQQRNERLFYKLLIENVEELLPIVYTPTVGEACQKYGSIFENSQGLFISLKDKGRILEILKIWPHKKIQVIVVTDGERILGLGDLGCQGMGIPVGKLALYTALGGVRPSACLPITIDVGTNNEKLLNDEFYIGLKQKRAAGQEYAELMNEFMSAVKQNYGEKVLIQFEDFANHNAFDLLEKYRTTHLVFNDDIQGTASVVLGGLISALKLVGGSLADQKFLFLGAGEAGTGIAELIALEISKQTNIPLEESRKKVWLADSKGLIVKSRLDSLQHFKKPWAHDHEPVNEFLDAIKTIKPTVLIGSSGTGQTFTKEVVETMSSLNEKPIILALSNPTSQSECTAEQAYTWSESRAIFASGSPFKPVEYNGKLYVSGQANNAYIFPGFGLGLIISGAIRVHDDMLLAASEALAEQVTQEHFDKGLIFPPFTSIRKISAHIAAKVAAKAYELGLASRLPQPENLVAYTESCMYSPKYRIYR

SEQ ID NO: 5197 - protein, 493 aa, Rhizobium leguminosarum bv. viciae 3841
MAFTSALTKHVPFSSPLLRDAGYIDGVWTSGDATKTFDVLNPATGELLASLPDMGAAETRAAIDAAHAAQPGWAARPARERSTILRKWFDLMVANADELAAILTAEMGKPFPEARGEILYAAAYIEWYAEEAKRIYGETIPAPSDDKRMIVIRQPVGVVGTITPWNFPAAMITRKIAPALAVGCTVVSKPAEQTPLTAIALAVLAEQAGIPAGVFNVIVGVDGPAIGRELCGNEKVRKISFTGSTEVGRILMRQCADQIKKVSLELGGNAPFIVFDDADLDAAVEGAIASKYRNAGQTCVCANRLYVQSNVYDAFAAKLAAKVAEMSVGDGFEPGVVIGPLIDEQGLAKVEDHVSDALAKGAKLLTGGKRIDGAGTFFTPTVLTGVARGMKVAREETFGPVAPLFRFDTVEDVINQANDTEFGLAAYFYAGDLKKVWRVAEALEYGMIGINTGLMSSETAPFGGIKQSGLGREGSRHGADDYLEMKYLCIGGV

SEQ ID NO: 5198 - protein, 129 aa, Salmonella enterica
FGDNGSGMHCHMSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGIKNKIHPG

SEQ ID NO: 5199 - protein, 426 aa, Rhizobium leguminosarum bv. viciae 3841
MNATSLTDRKNAAISRGVGMTTQIYADRAENAEIWDKEGRRYIDFAAGIAVLNTGHRHPRVIAAVKDQLDRFTHTCHQVVPYESYVHLAERLNALLPGDFEKKTIFVTTGAEAVENAVKIARAATGRSAVIAFGGGFHGRTFMGMALTGKVVPYKVGFGAMPGDVFHIPFPVELHGVTADQSLAALKKLFAADVDPQRVAAIIIEPVQGEGGFYSAPAAFMKALRELCDQHGILLIADEVQTGFARTGRMFAMDHHEVAPDLTTMAKSLAGGFPLAAVTGRAAIMDAPGPGGLGGTYGGNPLGIAAAHAVLDVIVDEDLCNRANLLGGRLKQRLESMRETVPEIVDIRGPGFMNAVEFNDRTTGLPSAEFANRVRLIALDKGLILLTCGVHGNVIRFLAPITIQDEIFGEALDILEASMLQASAAK

SEQ ID NO: 5200 - protein, 524 aa, Triticum aestivum
  misc_feature (277)..(277): Xaa can be any naturally occurring amino acid
  misc_feature (321)..(321): Xaa can be any naturally occurring amino acid
MAMASPWQAGRRINIEGMARPVAVDHRISLPYYFRIADNLLRQANIYREEKNLIDLYIILLRYSSLLSETIPKHRDYHAFKSREKEFLKKGPHNSDKLLNVISELESLKPIGKQQIAELNRRAAEERNGPHETYAGNGASSRTDQLAASPYMVQPAFGSSTGPLQKSSSRWNHQEASPQGVEPDRHLVKSYASLPYPKDETLSRHSVLGPNGLHGQWTRPVSGVKVQYPSYPELNQSNIPSLVPAILNQNDSHGPNTTSLDGLTNNNGDMQSVLSLXDDGQWSLPVKEPASVSPASFEEEFSQLNIRQPNPPPVLAQVHPXRRPISPSRVADPRPGLAPCDTGRFQNLHVPVALMESFLRLAEANTAKNLETCGILAGNLKKRTFYVTTLIIPKQESTSDSCQATNEEEIFEVQDKGSLFTLGWIHTHPTQTCFLSSIDLHNHYSYQVMLPEAIAIVMAPTDTTRKHGIFHLTDPGGMGVIHDCQETGFHPHEEPLDGTSIYEHCSHVYMNPSVKFDMVDLRRV

SEQ ID NO: 5201 - protein, 132 aa, Salmonella enterica
GSGMHCHMSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGIKNKIHPGEAMDKNL

SEQ ID NO: 5202 - protein, 881 aa, Vibrio vulnificus CMCP6
MHGCSKTTCPYCGVGCGVEVKPDELVGDKEHPANHGALCVKGAALAESLNMPSRLLYPKLSGEQVSWELASDWIAQRFHQAMEEYGPDSVAMYVSGQLLTEDYYVANKLMKGYVGSANIDTNSRLCMSSAVAAHVRAFGEDVVPVSYDDLEHAELIVISGANTAWTHPVLFRRIQQIRENNPNVKLVVIDPRKTVTAEQADLHLPIANDSDVSLFHGLLAYLLEQQGSDKGIDTEFIELHTQGFAALQALVSSGAYQLEQVASHCGIDIQALRTFYQWFSRSNATMTLFCQGVNQAQNGVDKANAIINAHLATGQIGKRGAGPFSLTGQPNAMGGREVGGLANQLAAHRGFDPDSIRAVQQFWQSPRIAEQPGLKALDLFKAVERGEIKVLWIMATNPVVSMPDNRWIRQALERCPCVIVSDITADSDVAHYADLLLPAAGWGEKQGMVTNSERRMSRQRRFISPPGEAKPDWQAICEVGARLSLKLQAKNGFAFESEAAIFREFAGLTAINSDSHYKLDLAQYQNLSDEAYEQWRPTQWGGESPYADGRFSHPDGKARFVAMTELANSRDESIGRGLWRLNSGRQRDQWHTMTRTGHIEKLAASELEPSVYLNRLSAGKLELQAGELANITNPDTLQSLLAKVVIDESMAFGELFMSMHWAGRYGGQSQVNAVVSASGDPISGQPAFKSSLVEVEKAPVVSFGVMISDFSPAIATDYCAYQHQDQSGVWRVASLTLPPQQLAEINLPPGSQVRRVSWQHELGWITLQLQSDTDEANQAKLQAIFIASSQPLKADYQQLQKLIGEPINWQALMQAGFATRVSQLVCSCLRVTDRQIEQAIEQKGVTTLTQLQNQLQCGTNCGSCIPQLKQYFAPAIAQPSR

SEQ ID NO: 5203 - protein, 464 aa, Francisella tularensis subsp. tularensis SCHU S4
MEAQKEYKRIVYIIATIAALGGLLFGLDQGFIGNAGDTLNKLYGLDAKAAGSFNAILVTGGILGTICSGFFTKFFGRKNTLMIAGFAFLAGALVSSFLPPINILTFCRFLLGFGVGLASFATPLYLAETAPTKIRGSISTLFQLMITFGIFLISLTNITIVMCLCHQKISLALMFSVIAFFAFLMFVGCFFLPKSPRWLLSKGKDQEAHKVLTRLRAAHEIDTEIAETKKVLKTDHGSVVESLAKKYFWKILLVGVIIQMFQQLVGINMMIYYAPHFLSNVGLNVLIAALAVYLVNFLSTFPAIKWVEKWGRKKLLTVGAVVMMSSLVVSAVCFYFIKHTQDPADFIKYVLLISCLVYIFGFACSWGPVAWIICSEIFPIKTREIGMTVTTVVNWTFAGFVIANSNVIMTKVAFGDVIIFLVYAAFCLAAIFFLKMFVPETKGVSLEKIEDNLISGKKLRDLGQ

SEQ ID NO: 5204 - protein, 460 aa, Francisella tularensis subsp. tularensis SCHU S4
MQTEKKINFVVVHVAIIAALAGLLFGMDIGYVNGSLHFISETFGLSVEQSGHVSSVLLLGAACGALFSGFLSKRYGRRKVLLIAAAIFSIFTIVGILAPNYQIFISSRFILGIAVGIASFIAPLYLSEIAPKEFRGALIALYQLMITIGLFLVFLTNSALERTGSWRVMLAVLAIPSVIMFFGCLTLPRSPRWLILKGNDNEAALVLKKIRSSEAEALEEHNEIKQTTHRGVSVFSLLKQKFFIKVVLLGIALQAFQQFTGMNAFMYYSTDIFKLAGFTNPSTSTIVIGLLNMLTTFLAIKYVDKFGRKPILYFGLSLLIISCIIVGFIFKTHFVYGQAMVLSQTLQWTALIFCLLFIFGFAISMGPVIWILCSEIQPIEGRDFGVTASTMSNWICNAIIGNFALTWLTFHPDSTFFGFAISCIICILFVKFFVPETKDVSLEEIENNLRSGKSLAKIGR

SEQ ID NO: 5205 - protein, 317 aa, Gibberella zeae PH-1
MSFHPDNLPSLNGKVFIVTGGNAGMGYYTVLHLAAHGAHVYMCCRSLEKGNAAIAEIKKEHPSANIDLLQMDLMDFSSTVAAAKHFLTRETSLHGLINNAGIMATPFDMTKDGHEAQWQTNYLSHWVFTEHLIPVMQRTAKTLPPGSVRIVNLTSSGHLGAPKTGINFDDLTLKDQGVWERYGQGKLANILHTKSLHNKYGPGSENKDGEIWVTAVHPGLVETNLATTVDPTEKGMLTLVSALRCFRMLWTADKGSWNSLYCAASQDMKAEQSGQYMEIFHRFGEPWWASSAAKDEELAKKLDVWTRETMGKEGWVQ

SEQ ID NO: 5206 - protein, 706 aa, Fusarium oxysporum
MAPRGFEDEELTISLSSSHVRRPQQQQQQQSQQQQQHASSDAPTPGSRPADAPLKERIKTEQRIGAYKVLRTLGEGSFGKVKLAIHNGTGQQVALKIIARKKLISRDMAGRVEREIEYLQLLRHPHIIKLYTPNEIIMVLEYAGGELFDYIVQHGRMKEPEARRFFQQMLCAVEYCHRHKIVHRDLKPENLLLDENLNVKIADFGLSNIMTDGNFLKTSCGSPNYAAPEVIGGKLYAGPEVDVWSCGVILYVLLVGRLPFDDEHIPSLFAKIAKGTYSIPQWMPAGAANLIKKMLVVNPVHRATIEDIRADPWFTTDLPAYLQLPVEEFFNTGVDPNKAIKKNDIAPNASEKVQERLHNEVTEKISKTMGYGKSDVEEALQAAEPAAIKDAYMIVRENKMMQVNHNPEALLAEPEGSSPMLSMSSARSTTSQATTTPRPYVSKVGILPSSLPAYHKDYMEREKAGSVENSPPKVLINDEPPSNRTDAEKEETARRLRPHSRSQLRMDEANTRPQGMTPINPPKKNKPVRWQFGIRSRNSPWEALLCIHKALHKLGATYIPDEDYESRTAEERAEASGEGSFADSHDNNRGSSSSIDPKKRYNLPADPWHINVRWDTSAIKKKAASVPGTPSSPSTPEGQHHPKEPFVALHMDIQIYEMEHGVYLVDFKCSGYETAHGRLLEEKDVTSPFPFLDMAAKLIMQLAEAD

SEQ ID NO: 5207 - protein, 291 aa, Neisseria gonorrhoeae FA 1090
MLQGSLVALITPMNQDGSIHYDQLRQLIDWHIENGTDGIVAAGTTGESATLSVEEHLSVIEETVKHVAKRVPVIAGTGANNTVEAIALSQAAEKAGADYTLSVVPYYNKPSQEGMYRHFKAVAEAAAIPMILYNVPGRTVVSMNNETILRLAEIPNIVGVKEASGNVGSNIELINRAPEGFAVLSGDDHTALPFMLCGGHGVITVAANAAPKLFADMCRAALQGDIALARELNDRLIPIYDTMFCEPSPAAPKWAVSALGRCGPHVRLPLVPLTEGGQAKVRAALKASGQL

SEQ ID NO: 5208 - protein, 297 aa, Prochlorococcus marinus str. NATL1A
MPVDFLTQSADSGARLAIRLLQDAAQRGDIDPWDVDVIPVVDGFLDQLKQRIEIPKKISQHFSQNGGSYEVDLAQSSEAFLAASVLVGLKAEVLEAEMFSVDMGNEDDSELDFGEQGWLDESFQLPLRPERHLFRRPVAPPPFRRPVTLGELINQLETIAESLKNDDLNNRRKLRQKKLSNREVIAQVSSLAHREKLPETTAALAIFINKWEKALHWVDFELLVKSWKENSASNDLDTDRVGVFWALLFLCSQGKVEIDQKGSLFSPISLKRLLQPGMVAQLPLASLDVTDVSPAAA

SEQ ID NO: 5209 - protein, 403 aa, Oryza sativa (indica cultivar-group)
MDATAIGNGALHSNGAGADTKGKPIKCKAAVAHGPGEALVMEEVEVAPPARMEVRLKVLFTSICHTDLSAWKGENELQRKFPRILGHEAAGVVESVGEGVEDLAPGDHVVPIFTGECGACTYCESSKSNLCKTYRVNPFRSTMVTDGGTRFTMIDRSSGARNPIYHFLNTSTFAEYTVIDSACAVKINPKAPLEKMSLLSCGVSTGVGAAWNTANVSKGSTVAIFGLGAIGLAVAEGARLRGASRIIGVDINPEKFSKGKEMGITDFINSKACSKPVHEVIMEMTDGGVDYSFECTGITDVLREAFVSTHDGWGLTVVLGIHATPRMLPLHPMELFDGRRITGCVFGDFKGKSQLPEIVEKCMQGEININFDGFITQEMPFADINKAFQLLEEGKSLRCLLHV

SEQ ID NO: 5210 - protein, 454 aa, Mesorhizobium loti MAFF303099
MSDAEATAPRSSWRFAGRDEDDQPSLREVNSTIAVPSSGVWFRRLFAFMGPGYMVSVGYMDPGNWATDLAGGAQFGYTLLFVIMLSNLMAILLQALAARLGIATGRDLAQACRAYYPRPVNFVLWIACELAIIACDLAEVIGTAIALKLLFGIPLIGGAILTALDAFLVLLLMNKGFRYLEAFVIALLIIIFSCFAIQIFVAAPPAGTILHSMFVPSSEIVTNPAMLYIAIGIIGATVMPHNLYLHSSIVQTRAYERTEKGKRDAIKWATTDSTIALMLALFVNAAILIVSAVAFHNTGHQDVAEIDQAFELLSPLLGLGIASILFAVALLASGLNSTVTATLAGQIIMEGFLRLRIPNWARRLLTRGLAIVPVVVVTALYGEKGTGQLLVFSQVILSMQLPFAVVPLVQFVSDKKKMGNLAIPRGVAALAWVVAAIILVLNFKLLYDTLFGVG

SEQ ID NO: 5211 - protein, 264 aa, Mesorhizobium loti MAFF303099
MSGQANKGTAVVTGASSGIGAIYADRLAGQGYDLVLVARRADRLEELAEKLRYAYDRKVSVISADLSDDDDVRRVEQAISADDSVTLLVNNAGLGGQQVVATADADAAERMIKVNVIALTRLTRAVLPGLLARNRGAIVNIASVLAYETSFGGIYSGTKAYVVNFTEALHREVAGTGVKVQVVLPGATRTDFWELAGSDIDQLPKEIIMSADDMVDAALVGLARGEAVTVPALADAAKLDTFLGARQAFYGSLHADKPAARYAA

SEQ ID NO: 5212 - protein, 391 aa, Shewanella sp. MR-7
MSQFQSIDVADYYDAQTFKRIEEFAKDKATPFVVIDTNIIAKQYDDMVNSFPYADVYYAVKANPAAEILTLLKNKGSNFDIASIYELDMVTNVGVTPDRVSYGNTIKKRQDVRAFYERGVRMYASDSEADLRMIAEEAPGSRIYVRILTEGTDTADWPLSRKFGCQNEMAYELLVLAKELGLEPFGISFHVGSQQRDIGAWDSAIGKVKSIFDRLRDEHNIVLKMINMGGGFPANYIDKTNQLGVYAEQITHFLKEDFGDDLPQIILEPGRSLISNAGVLVSEVVLISKKSYTALERWVFTDVGKFSGLIETMDEAIKFPIFTHKQGELDKCVIAGPTCDSADIMYEHYSYGLPNDLAIGDRMYWLTAGAYTTTYSAVCFNGFPPLKDYYL

SEQ ID NO: 5213 - protein, 336 aa, Pseudomonas putida KT2440
MSRVTLSRYLIEQTRSNNTPADLRFLIEVVARACKEISHHVSKGALGGVLGSMGTENVQGEVQKKLDVISNDILLEANEWGGHLAGMASEEMDNAYQIPGRYPKGAYLLVFDPLDGSSNIDVNVSVGTIFSVLRCPNQYLSQNESLNEEAFLQPGTEQVAAGYAIYGPQTMLILTLGNGVKGFTLDRELGSFVLTHENIRVPETTAEFAINMSNQRHWEAPVQRYVGELLAGETGPLKKNYNMRWIASMVADVHRILTRGGLFMYPRDAREPSKPGKLRLMYEANPMSFIIEQAGGASTNGYDRILDIKPESLHQRVSVILGSKEEVERVTAYHKE

SEQ ID NO: 5214 - protein, 193 aa, Glycine max
GWRTFKRPGADAFLEHLGRFYEMVEHSDQLTMHVQYVDPVADRLDPKGNILHMLSRVATKYENGKHYRKCLQAVETEIDLSKLNRNPAQVLYISAHAKESSLQPENSVEIKPWKLENDDTQLLDLIPFLEYVAMARPSDIRAVLASYQSGDIAAEFIERSKEHQRSVDIFLCSITFLYLIDGNLNVDVPTPLL

SEQ ID NO: 5215 - protein, 478 aa, Fragaria x ananassa
MEKPAELVLIPSPGIGHLVSTLEIAKLLVSRDDKLFITVLIMHFPAVSKGTDAYVQSLADSSSPISQRINFINLPHTNMDHTEGSVRNSLVGFVESQQPHVKDAVANLRDSKTTRLAGFVVDMFCTTMINVANQLGVPSYVFFTSGAATLGLLFHLQELRDQYNKDCTEFKDSDAELIIPSFFNPLPAKVLPGRMLVKDSAEPFLNVIKRFRETKGILVNTFTDLESHALHALSSDAEIPPVYPVGPLLNLNSNESRVDSDEVKKKNDILKWLDDQPPLSVVFLCFGSMGSFDESQVREIANALEHAGHRFLWSLRRSPPTGKVAFPSDYDDHTGVLPEGFLDRTGGIGKVIGWAPQVAVLAHPSVGGFVSHCGWNSTLESLWHGVPVATWPLYAEQQLNAFQPVKELELAVEIDMSYRSKSPVLVSAKEIERGIREVMELDSSDIRKRVKEMSEKGKKALMDGGSSYTSLGHFIDQI

SEQ ID NO: 5216 - protein, 144 aa, Oceanobacter sp. RED65
MSNFLKSIEGEDQGLKADLDKALVSLKYNQDGLIPAIAQQHDTGEVLMMAWMNEAAIRETLETGHVCYWSRSRNQYWRKGESSGNQQILVSLNVDCDGDTLLVKVDQTGAACHTGRRDCFYNEITKDGLSIIKDPIQDPNSLYK

SEQ ID NO: 5217 - protein, 145 aa, Salmonella enterica
FMPKPMFGDNGSGMHCHMSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGIKNKIHPGEAMDKNLYDL

SEQ ID NO: 5218 - protein, 219 aa, Chromobacterium violaceum ATCC 12472
MQDIIAGILKFQREAYPRRAELFRRLAGDQSPATLFIACSDSRVVPELLTQREPGDLFVIRNAGNIVPGYGQEPGGVSASVEYAVTALGVADIVVCGHSDCGAMTAVACGKDLSGMPAVAGWLRHADCAKAINNAGEHDNPAAKVDAMARENVIAQLANLRTHPSVALALQQGRLRLHGWMYDIASGDVLALDPEQRRFLPLRDCPQTATMLDGDCRQP

SEQ ID NO: 5219 - protein, 146 aa, Salmonella enterica
FMPKPMFGDNGSGMHCHMSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGIKNKIHPGEAMDKNLYDLP

SEQ ID NO: 5220 - protein, 371 aa, Colletotrichum gloeosporioides f. sp. malvae
MAQNRPSAFNTLRMGGKLGVKPLTRRGCSANASIREKVQDGITGETRDLQYTQCKIVGNGSFGVVFQTKLSPSGEDAAIKRVLQDKRFKNRELQIMRIVRHPNIVQLKAFYYSNGERKDEVYLNLVQEFVPETVVPRVAVFNKMKTTMPILEVKLYIYQLLRALAYIHSQGIWHRDIKPQNLLLDPTSGVLKLCDFGSAQDLKKTNPNVSYILLANSNSISKLIRIPSNLHAADVWSTGCVMAELMLGQPLFPGESGIDQLVEIIKVLGTPTREQIRTMNPNYMEHKFPQIKPHPFAKVFRKADANAIDLIARLLESTPTERQAAVEAMVHPFFDELRDPSTRLPDSRHQSGEIRDLPPLFDFTRHGKLPP

SEQ ID NO: 5221 - protein, 458 aa, Vibrio vulnificus CMCP6
MFGIFKPKAHIDRVSSDSLDSTYSRLRWQLFIGIFVGYAGYYLVRKNFSLAMPYLIEQGFSRGDLGVALAAVSIAYGLSKFLMGSVSDRSDPRYFLSAGLVMSSLVMFCFGFMPWATGSITAMFILLFLNGWFQGMGWPACGRTMVHWWSRKERGEIVSVWNVAHNVGGGLIGPIFLFGLWMFNDDWRTAFYVPAFFAMIVAVFIWLTVRDTPQSCGLPPIEEYKNDYPDDYNTSHETEMTAKEIFFKYVFSNKLLWSIAIANAFVYLIRYGVLDWAPVYLKEAKEFTVDKSSWAYFLYEWAGIPGTLLCGWISDKLFKGRRAPAGILFMFLVTLAVLVYWFNPAGNPGIDMAALVAIGFLIYGPVMLIGLYALELAPKKAAGTAAGLTGLFGYLGGAVAANAVLGYTVDHFGWDGGFIILVGSCITSIVCLTYALLGEKAHHDAKQKEKEKEQEAIA

SEQ ID NO: 5222 - protein, 148 aa, Salmonella enterica
ATFMPKPMFGDNGSGMHCHMSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGIKNKIHPGEAMDKNLYDLP

SEQ ID NO: 5223 - protein, 470 aa, Francisella tularensis subsp. tularensis SCHU S4
MSDIKTQVVVLGSGPGGYSAAFRAADLGLEVVLVERYAEIGGVCLNVGCIPSKAMLHIAKVINEARHLESLGIIEMGGLKINRENLLKYKDGVIGKLTGGLKGMAQMRKVKIVQGYGKFTSDKELAVEAADGKVTKIAFDNCIIAAGSSVIKLPFVPEDDRIIDSTGALEMKEIPETMLVVGGGIIGLEMAQVYSELGTKITVVEFADQLMNGVDKDLVKAYQKVNSRYDVRLKTAVTAMEAKEDGIYVTMEGDHPAKDERFDRVLMAIGRKPNGKLIDAEKAGVKVDERGFIPVDKQLRTNVPHIFAIGDIVGQPMLAHKAVPEGRTAAEVISGLNHSFDPLVIPSVAYTDPEVAWVGETETSAKAKGIKYEKGVFPWAASGRSLSIDRSEGMTKILFDENHKIIGASIVGTHAGELISEAAIAIEMGCDAEDIALTVHPHPTLSESLMMATEVYEGTATDLPPQKKKK

SEQ ID NO: 5224 - protein, 145 aa, Salmonella enterica
TFMPKPMFGDNGSGMHCHMSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGIKNKIHPGEAMDKNLYD

SEQ ID NO: 5225 - protein, 377 aa, Helianthus annuus
MAHEGEIQPLVCDNGTGMVKAGFAGDDAPRAVFPSIVGRPRHTGVMVGMGQKDAYVGDEAQSKRGILTLKYPIEHGIVSNWDDMEKIWHHTFYNELRVAPEEHPVLLTEAPLNPKANREKMTQIMFETFNVPAMYVAIQAVLSLYASGRTTGIVLDSGDGVSHTVPIYKGYALPHAILRLDLAGRDLTDSLMKILTERGYMFTTTAEREIVRDMKEKLAYVALDYEQELETAKSSSSVEKNYELPDGQVITIGAERFRCPEVLFQPSLIGMEAAGIHETTYNSIMKCDVDIRKDLYGNIVLSGGSTMFPGIADRMSKEITALAPSSMKIKVVAPPERKYSVWIGGSILASLSTFQQMWISKGEYDESGPSIVHRKCF

SEQ ID NO: 5226 - protein, 893 aa, Francisella tularensis subsp. tularensis SCHU S4
MSDFTKDIDVLETQEWLEAFEDVIKREGADRAKFLFEQLLAKGSELGIKSAYSTAKVKNYVNSIDVSEQPSYPGDIELEQKIEAINRWNSTVIVAAANKKDGSIGGHIGTGAGAMTLYEVGFNHFWKAPNDEHAGDLIFYQGHLSPIVYARSFLEGRITAEQLENFRKQAFNGQNAVSSYPHPYLQPTYWQFPTVSMGLGPLQAIYQARFMKYLEARGLAKTSDRKVWAFCGDGEMDEPESIGSITRAGREGLDNLIFVVNCNLQRLDGLVNGNGNIVEELADVFAGAGWNVINVLWSSDWDKLLQDPRGGKKLAQRLSELNDGQFHTIKAHGGAECRRVVFSGDEDLEALAKDMTDDDIQALRRGGHDPLKIYAAYKKAVENPNGRPTLILPMTVKGYGLGEWGESKNIAHNVKKLDTDALEHIKNRFNVPASKEDIENYRLIKLDENSPEMKYLHSKRKDLGGYIPKRLENKQALEIPSYKDFAKSLLDDSGDREFSTTTAFVRILSHLAKDKNLGKHIVPITVDESRTFGMEGLFRQLGIYNPHGQQYVPEDKQQVMFYKESVDGQILQEGINEQGGFCSWIAAATSYSVHKVPMIPFMIYYSMFGFQRFGDLAWAAGDSMAKGFVIGGTSGRTTLNGEGLQHEDGHSHIQAGLIPNCISYDPTYAYELAVILGEGMKRMYVDGDHVYYYITVMNENYSHRAMPEGCEEGIIKGLYKLDEEKKPASKHVQLLGSGSILREVEATAKMLKEEYGITSNVWSMTSANELYREAKDVARANMLHPTAEKKESYIEKCFKNEQGPVIASTDYIKLYTDQLREFIPHTFVNLGTDGFGRSDTRAALRSFFEVDRYHVVVASLYALYLDGKVEASEVKTAIEKYNIDPERMAPFYS

SEQ ID NO: 5227 - protein, 325 aa, Ralstonia eutropha JMP134
MAEITLVEAVNQALGYALEHDPDVMLLGEDIGVNGGVFRATVGLQARFGPQRVLDTPLAEAGIVGAAIGMAAMGLKPVAEIQFTGFIYPAIDNIINHAGRMRHRTRNRLSCPLVVRSPFGAGIHAPEHHSESPEAMFAHMPGIRVVIPSSPARAYGLLLAAINDPDPVIFLEPTRLYRLFRQEVADDGAALPLDACFTLRDGSDVTLVSWGAMVQETLAAADQLAEEGISAAVIDVATLKPLDMQTILESVARTSRCVIVHEAPRTAGFGAEIAAGLADAGLYSLAAPVQRVTGFDTVVPLARLEHTYLPSVARIVDAVRKALSA

SEQ ID NO: 5228 - protein, 218 aa, Prochlorococcus marinus str. NATL1A
MLGFLEKVADYTKEAVSAAKYLVDGLGVTFDHMRRRPVTVQYPYEKLIPSERYRGRIHYEFDKCIACEVCVRVCPINLPVVDWVMNKETKKKELRNYSIDFGACIFCGNCVEYCPTNCLSMTEEYELSAFDRHSLNYDNVALGRLPTSVTSDPSVRPLRELPYLPKGIMDPHELPANQQRAGKLPSQIIKELQAEKSEEKGNNNSSDIVPNKLNSTNK

SEQ ID NO: 5229 - protein, 358 aa, Zea mays
AVASVEPGATSVAASWGVKLTADALLADLADDEFDLISLPGGMPGSSTFGECKVLEKMVKKHVEKGKLYAAICAAPAMTLGTWGLLNGLKATCYPSFIDKLPSEVHAVESRVQIDGKCMTSRGPGTAMEYSVILVEQLYGKEKAKEVAGPMVMRPQHGVEFSMKEVNSTSWNVGGTPNILVPIANGTEEMEATMIIDILRRAKANVVVASLEDKLEIVASRKVKMIADVLLDDALKEQYDLILLPGGLGGAEAYAKSDKLMDLIKKQAEANRLYGAICASPAIALEPHGLLKGKKATSYPAMWNKLADQSECNNRVIVDGNLITSQGPGTSMEFSLAIVEKLFGRERALELAKSMVFI

SEQ ID NO: 5230 - protein, 375 aa, Prochlorococcus marinus str. NATL1A
MVLKPGLEGVPVTKSGICEINGTEGRLSYRGYPISELAQKSSFLETAFLLIWGELPTENELEKFEKDVQMHRRVSFRIRDMLKCFPESGHPMDALQASAASLGLFYSRRAIDDPKYIYDAVVRLIAKIPTMVAAFEQIRKGDDPIQPQDDLPYSSNFLYMLTEREPNPLAARVFDRCLILHAEHSLNASTFSARVTASTLTDPYAVVASAVGTLAGPLHGGANEDVIAMLEEIGRPDEASSFLNDAIAKKRKIMGFGHREYRVKDPRATILQAFAEELFSEFGKDEMYEVAKALEEEAISKLGPKGIFPNVDFYSGLVYRKLGIPRDLFTPVFAISRVAGWLAHWREQLGANRIFRPSQIYEGAKMRNWKPLESR

SEQ ID NO: 5231 - protein, 488 aa, Candida glabrata CBS 138
MDVERQTFKVFNQDFTIDKRFELIKEIGHGAYGIVCSARFTEASEETTVAIKKVTNIFSKTLLCKRSLRELKLLRHFRGHKNITCLYDMDIVFYPDGSINGLYLYEELMECDMHQIIKSGQALTDAHYQSFTYQILCGLKYIHSADVLHRDLKPGNLLVNADCQLKICDFGLARGYSENPEENNQFLTEYVATRWYRAPEIMLSYQGYTKAIDIWSTGCILAEFLGGKPLFKGKDYVDQLNRILQVLGTPPDETLRRVGSKNVQDYIHQLGYIQKIPFSELFPNANEDALDLLEGMLAFDPQKRITVDKALEHPYLTIWHDPADEPECNEKFEFSFESVNEMEDLKRMVVDEVQSFREFVRQPLMDDKSQEDEQQQGSPENYQQTSPTNISPQRLHNNGSHDLLQEPEFLTQTPNQNSTIPDQLQESFVGIHSDNLPEHDTDFPPRPQENILASPMGLPSASDRNSMNNDSFLDLERELEFGLDRRYL

SEQ ID NO: 5232 - protein, 1167 aa, Mesorhizobium loti MAFF303099
MPRRTDIKSILIIGAGPIVIGQACEFDYSGTQACKALKEEGFRVILVNSNPATIMTDPELADATYIEPITPEVVAKIIAKERPDALLPTMGGQTALNTALSLRRMGVLDRYNVEMIGADATAIDKAEDRALFREAMSKIGLETPKSMLANATDVKNADRKTHEAERAALKAEKPDNLDAELDALETRWNLGEGDRKQRYISHAMAIAAQALDHVGLPAIIRPSFTMGGTGGGIAYNRAEFYDIVQSGLDASPTTEVLIEESVLGWKEYEMEVVRDKADNCIIVCSIENIDPMGVHTGDSITVAPALTLTDKEYQMMRNASIAVLREIGVETGGSNVQFAVNPADGRLVVIEMNPRVSRSSALASKATGFPIAKIAAKLAVGYTLDELENDITGGATPASFEPSIDYVVTKIPRFAFEKFPGAEPVLTTAMKSVGEVMAIGRTFQESLQKALRGLETGLTGLDEIEIPGLGHGATVANHADDRNAIRAALGTPTPDRLRMVAQAIRMGTSLEDVHAMCKIDPWFLEQIAGILAMEARIREHGIPQDAVNLRMLKAMGFSDARLASLTRTDAEVVTKIREKLDVHPVYKRIDTCAAEFASPTAYMYSTYEVPFAGALANEAQVSSRKKVVILGGGPNRIGQGIEFDYCCCHAAFALRDAGYEAIMINCNPETVSTDYDTSDRLYFDPLTAEDVLEILRAEQASGELLGVIVQFGGQTPLKLADALEKAGIPILGTSPDMIDLAEDRDRFQKLLHKLGLSQPKNGIAYSVEQARLVAGELGFPLVVRPSYVLGGRAMQIIHDESMLQSYLLDTVPGLVPEDIKQKYPNDKTGQINTLLGKNPLLFDTYLSGAIEVDVDCLCDGKATFVSGILEHIEEAGIHSGDSACSLPVHSLPSELVDELERQTAALARALNVGGLMNVQYAIKDGTVYVLEVNPRASRTVPFVAKTIGRPIAKIAARIMAGETLEDAFAHYGAMPDPRNPGHIAVKEAVFPFARFPGVDILLGPEMRSTGEVMGLDRDFALAFAKSQLGAGVDLPRSGTLFVSVRDEDKKGILPAVKRLAGLGFKVLATSGTQRFLAENGVVAEKINKVLEGRPHIEDAIRNRQVQIVFNTTDGQKAVSDSKSLRRATLMQKVPYYTTLSGAAAVAEAIAALKAGSLEVRPLQEYFA

SEQ ID NO: 5233 - protein, 426 aa, Erwinia carotovora subsp. atroseptica SCRI1043
MKLESLALHHGYESEATTKSAAVPIYQTTSYTFDDTQHGADLFDLKVAGNIYSRIMNPTNAVLEQRLAAIEGGIGALVLSSGMAAIAYSLQALTQVGDNIVSTSQLYGGTYNLFAHTLPRQGVDVRMASFDDFATLESLIDERTRAVFCESIGNPAGNIVDISKIAEIAHRHGVPVIVDNTVATPVLCRPFEHGADIVVHSLTKYIGGHGTTIGGAIIDSGKFDWVANKARFPLLNEPDPSYHGVVYTEAFGPAAYIGRCRVVPLRNTGAALSPHSTFLLLQGLETLSLRIERHCSNAEVLASYLNQHPLVTWVNYGALPDSPYKANCDKITSGKASGIISFGIKGGKTSGGHFIDALKMILRLVNIGDAKSLACHPASTTHRQLNAEELAKAGVSEDLVRISVGIEHIDDIIADVAQALEASQKN

SEQ ID NO: 5234 - protein, 130 aa, Mesorhizobium loti MAFF303099
MTKEIVEVPVLSAAVRALGVPLSLVTRAAGLVFVSGMPPLDLLTGKLVKGDIEVQTEASLKALKHCLEAAGTSLDNVVMVRIYAVNSGFYAAINRVYARYFPENAPSRTFVPVASWPMEFDIEIECVAVG

SEQ ID NO: 5235 - protein, 468 aa, Pseudomonas putida KT2440
MSKSVQLIKDHDVKWIDLRFTDTKGIQHHVTMPSRDALDEDFFEVGKMFDGSSIAGWKGIEASDMILMPVDETAVLDPFTEEPTLIITCDIVDPSSMQGYDRDPRAIAKRAEEYLKSTGIGDTVFAGPEPEFFIFDEVKFHSDISGSMFKIFSEQGSWMTGADVEGGNKGHRPGVKGGYFPVPPFDHDHEIRTAMCNALEEMGQTVEVHHHEVATAGQNEIGVKFNTLVKKADEVQALKYVVHNVADAYGRTATFMPKPLYGDNGSGMHVHMSIWKDGKNTFSGEGYAGLSDTALYFIGGIIKHGKALNGFTNPSTNSYKRLVPGFEAPVMLAYSARNRSASIRIPYVGSPKARRIEARFPDPSANPYLAFAALLMAGLDGIQNKIHPGDAADKNLYDLPPEEAKNIPQVCGSLKEALEELDKGRAFLTKGGVFSDDFIDAFIELKSEEEIKVRTFVHPLEYELYYSC

SEQ ID NO: 5236 - protein, 130 aa, Mesorhizobium loti MAFF303099
MKKQVIEVPVMSDKVRSLGLPCSTAVKANGFVFISATPPVDMVTGEMVRGDIETQTEASLKALKHCLEAAGTSLDNVVMVRIYAVNSGFYNAINRVYARFFSTNPPARSFVPVASWPMEFDIEIECVAVA

SEQ ID NO: 5237 - protein, 426 aa, Idiomarina loihiensis L2TR
MADRKATLQIDGQSIELPVLSPTAGKDVVDVRTLGKHGYFTFDPGFLATGSCESAITYIDGENGVLLHRGYPIGELATKADYLEVCYMLLHGEAPTEKQYHEFKNTITKHTMVHQGIHNFFNGFRRDAHPMAMLCAVTGALSSFYHDDLEIHDENQRLRSAYRLIAKIPTIAAMAYKFSIGQPFVYPRNDLGYAENFLNMMFSVPAEDYKISPAVARAMDRIFTLHADHEQNASTSTVRLAGSSGANPYACIAAGVASLWGPAHGGANEACLRMLAEIGSVENIPKYIEKAKDKDDPFRLMGFGHRVYKNTDPRATVMRESCHEVLKELDRDDPLLDVAMELERIALEDDYFIEKKLFPNVDFYSGIVLKAIGIPTNMFTVIFALSRTVGWVSHWHEMMGEENQKIGRPRQLYTGYTKREFSPIKK

SEQ ID NO: 5238 - protein, 586 aa, Ralstonia eutropha JMP134
MSFALHGIPVSRGVAIGRAHLLAPAALDVSHYLVDEDRLDDEVERLRSARAAVRAELITLKRDLPRDAPEELGAFLDVHAMILDDEALSREPEALIRGRRYNAEWALTTRLEELMRQFDEIEDEYLRERKTDIHQVVERILKVLAGAPVLAPAPVPALAADGEPAPGVIVVAHDIAPADMLQFRHTVFHGFVTDMGGKTSHTAIVARSLDIPAAVGVQSASELIRQDDWIIVDGDAGLVIVDPSAIILEEYRHRQSERALEKKRLQRLRHTPAVTLDGQEIDLLANIEMAEDAGVALSAGAVGVGLFRSEFLFMNRRGELPDEDEQFAAYRGAVEAMHGLPVTIRTIDIGADKPLDGRGDDFETALNPALGLRAIRWSLSEPAMFLTQLRALLRASAFGPVRLLVPMLSHAREIDQTLELLAQAKRQLDERGVPYDPGLKVGAMIEIPAAVLLLPLFLRRMDFLSIGTNDLTQYTLAIDRADNAVAHLFDPMHPAVLQLIARTIREANRAGVPVAVCGEMAGDPSMTRLLLGMGLREFSMHPAQLLRVKQEVLHADCARLEPLVDQVLNAYDPLEQTAALEQLAKP

SEQ ID NO: 5239 - protein, 484 aa, Oceanobacter sp. RED65
MLDTEFLIIGAGFGGIGMAIKLKQQGHNCITLWEKESDLGGCWRDNHYPGAACDVPSHLYSYSFAPNSQWSHKFAPQQEIYDYIKDCADRFKITEHIHFNKEVSEARYDSENNLWRVTDTQGNELRCRYLITATGQLNRPAYPGIAGLESFKGEQFHSARWNHDVDLKDKNVAVIGTGASAIQFVPSVVNKAKHVTLFQRSAPYVIPKPDRPYSKFERWAFKRIPGLLKLSRLKTYLQFEVRFLAFRDLQFLLKPYIAYWRRFMNKQVKDEGKRKKLTPDYIIGCKRILIANNYYPAIDQDHVDLVDSGIAEVTPSGITDKQGNQHDVDVIILATGFKATDFLSPIKIYGQDGISLNNAWKDGAEAYLGMCVNGFPNCFMLYGPNTNLGHSSIIYMLESQINFILKAIDYAKRHDTKTLNVKADIQSKYNDTLQRKIHASVWDQGCTSWYKNESGKNTNNWSGFTLSYRRLTKHFKAKDFATNE

SEQ ID NO: 5240 - protein, 127 aa, Salmonella enterica
MPKPMFGDNGSGMHCHMSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGI

SEQ ID NO: 5241 - protein, 351 aa, Triticum aestivum
  misc_feature (94)..(94): Xaa can be any naturally occurring amino acid
MASSSAAAAPCRFLSPLATTSRTLLSSILPTPATTRRRPLLSSTTAICAAAMAASGKAGSASCKVVDSHLHVWASPLQAAENYPFFPGQEPTLXGEWGLSWSECMDEAGVDGALIVQPINHMFDHSLVTSVLKKYPSKFIGCCLANPADDGSGIKQLEHLIVQEKYRAVRFNPNLWPSGQKMTNEVGRSLFAKAGELGAPVGIMVMKGISSYIQEIEELCTDYPATTVIFDHMAFCKPPTNDDEEKAFSSFLNLSRFPQVYVKYSALFRITREAYPYEDTSQLLSRVISSYGANRIMWGSDFPYVVPECGYKGAKEAISHVAGKAAVSSSDLEWILGKTVSQLFQGAWVTP

SEQ ID NO: 5242 - protein, 165 aa, Glycine max
LFALPHPVWSPSDSNLPEIRSSRQEAKGAAMARTKQTARKSTGGKAPRKQLATKAARKSAPTTGGVKKPHRYRPGTVALREIRKYQKSTELLIRKLPFQRLVREIAQDFKTDLRFQSHAVLALQEAAEAYLVGLFEDTNLCAIHAKRVTIMPKDIQLARRIRGER

SEQ ID NO: 5243 - protein, 223 aa, Neisseria gonorrhoeae FA 1090
MTTQDELKRIAAEKAVEFVPENEYIGIGTGSTINFFIEALGKSGKKIKGAVSTSKKSGELLARYDIPVVSLNEVSGLAVYIDGADEVNHALQMIKGGGGAHLNEKIVASASEKFVCIADESKYVSRLGKFPLPVEAVESARSLVSRKLLAMGGQPELRIGYTTFYGNQIVDVHGLNIDQPLTMEDEINKITGVLENGIFARDAADVLILGTEEGAKVIYPCQG

SEQ ID NO: 5244 - protein, 376 aa, Vitis aestivalis
MGCFPCAGKSNKKGKKNQEKNSKDQIPSTSERLKVNSSVDGRKDASKDGGSDHIAAHTFTFRELAAATKNFRAECLLGEGGFGRVYKGRLESTNKIVAIKQLDRNGLQGNREFLVEVLMLSLLHHPNLVNLIGYCADGDQRLLVYEYMALGSLEDHLHDLPPDKKRLDWNTRMKIAAGAAKGLEYLHDKASPPVIYRDLKCSNILLGEGYHPKLSDFGLAKLGPVGDKTHVSTRVMGTYGYCAPEYAMTGQLTLKSDVYSFGVVLLEIITGRKAIDNSKAAGEHNLVAWARPLFKDRRKFSQMADPMLHGQYPLRGLYQALAVAAMCVQEQPNMRPLIADVVTALTYLASQKYDPETQPVQSSRMGSSTPRSRREL

SEQ ID NO: 5245 - protein, 983 aa, Candida glabrata CBS 138
MSTDKKKEEVPKPETEDLTVKDETKNKDKKKANEEEELSEEDQKLKGDLEMLVQTLLEDDSKLYETTLTQLKEFIKNSTSSMTAVPKPLKFLRPFYPDLCKAYDKWSDKDQKSSLADMLSVLAMTYSDTHQHDSLRFRLLSDTSNIASWGHEYVRHLALEIGEVYNEQVEKEAEDNSTSTESSPQPPHMNFEFSKDVILQLSLEIVPYFMKHNGEEDAVDLLLEIEAIEKLPQFVDENTYKRVCQYMIACVQLLPPPEDISFLQTAYSIYLSELQLPEALSLAIRLGNEDMIRSVFDATSDPIVHQQLAYILAAQRVPFEHPELQEIIGNTKLSEHFLYLAKELNLLTPKIPEDIYKSHLDSSKSVFSSAGLDSAQQNLAASFVNAFLNLGYCNDKMITDNDNWVYKTKGDGMTSAVASIGSIYQWNIDGLQQLDKYLYVDEPEVKAGGLLGIGIASAGVHHDVEPALLLLQEYINHSDTKISTAAILGIGIAFAGSKNDEVLGLLLPVVSNTENSLELAAIAALALSHVFVGTCNGDITTAVMDNFLERTPLELKSEWARFLALSLGLLYLGQGEHVDDVLETINAIEHPMTSAIEVLISSCAYTATGDVLLVQDLLHRLTPKAVKSSDEDEDEDNEELSQEDMNGISAFLGKKENEIAEEPQGNEGADNEMEVDSHQDETTTGENNVKKEENEEEKTEKSEKTENDEEEEDEEESKDEGANDELAYAVIGIALITMGEEIGKEMSLRHFGHLMHYGNEHIRRMVPLAMGLVSVADPQMKVFDTLTRFSHDPDLDVSMNSIFAMGLCGVGTNNARLAQLLRQLASYYSREQDALFITRLAQGLVHLGKGTMTMDIFNDAHVLNKVTLASLLTVLVGLISPSFILKHHQLFYMLNSGVRPKFIITLNEEGEQIKVNVRIGQAVETVGQAGKPKTITGWITQSTPVLLGHGERAELENDEYISYTNNIEGVVILKKNPNFQEEE

SEQ ID NO: 5246 - protein, 255 aa, Triticum aestivum
KSLYKKAGWYRSGIPGISSTHASDTIFTDPFDPRGCSHLQSYSAKLPRYRMQGIAKALSQHGKQLRLAVLQHMNKGIFSWATLISRIQSESPAVIIPHMGLENITVREILRAKGEAQSRAVYWCSTTHLVHEAVKHMTANNVGSLVVLKSGDDKQLAGIVTERDFARKILLPGRPSEETRVEDIMTEENKLITVSSNTNILRAMELMTDEHIRHVPVFDEKVVGMISIGDVVRAIVDQQHQEVKQLKKYITGDYY

SEQ ID NO: 5247 - protein, 526 aa, Clarkia similis
VEFDNIFLDYSRQQASPDTISKLYKLADAAHLKQKIDRMYNGDHINTTENRSVLHVALRAPRNSAICSDGKNVVPDVWNVLDKIKDFSDRVRNGSWIGATGKKLKDVIAVGIGGSFLGPLFVHTALQTDPESSKNARGRELRFLANVDPIDVARNISGLNPETTLVVVVSKTFTTAETMLNARTLREWISSALGPSAVAKHMVAVSTNLPLVEKFGIDPNNAFAFWDWVGGRYSVCSAVGVLPLSLQYGFAVVEKFLQGAHSIDQHFSSAPFEKNVPVLLGLLSVWNVSFLGYPARAILPYSQALEKLAPHIQQVSMESNGKGVSIDGLPLPFESGEIDFGEPGTNGQHSFYQLIHQGRVIPCDFIGVVKSQQPVYLKGEVVNNHDELMSNFFAQPDALAYGKTPEQLKKENVSEHLIPHKTFTGNRPSISILLPTLDAYRIGQLLAIYEHRVAVQGFVWGINSFDQWGVELGKSLATQVRKQLHASRVKGEPVEGFNFSTKTLLTRYLEATSDVPTDPSTLLPNI

SEQ ID NO: 5248 - protein, 414 aa, Shewanella sp. MR-7
MSDIRQQALDYHEFPVPGKTAVCLTKPAETSHDLALAYSPGVAEPVREIAANPDNAYRYTNKGNTVAVITNGTAILGLGNLGPLASKPVMEGKALLFKHFANIDSTDIEVTHNTTEEFINTVAAIAGTFGGINLEDIKAPECFVIERELIERCNVPVFHDDQHGTAIVTAAGMINALEIQGKLISDATFVCMGAGAAAIACMTMLVKCGANRANIYMLDTKGVIHTGRTDLNEYKALFANDTDKRTLQDVIKGADVFLGLSGPNVIGAEEVAMMADKPVIFACSNPDPEIKPELAHATRSDLIMGTGRSDYPNQVNNVLCFPFIFRGALDVRASCINDEMKVAAVHAIAGLAKEEVPASVLKAYPKVSSLSFGPEYVLPKPMDPRLLPRVARAVAQAAIDSGVAAITTLPHYAD

SEQ ID NO: 5249 - protein, 408 aa, Arabidopsis thaliana
MSNMFSRIAMTNSIVLLLFSLTFLEHGLLFQRVSSLGINYGQVGDNLPPPDKVLQLLSSLHINKTRIYDTNPRVLTSFANSNIELFVTVENEMLPSLVDPQQALQWVTTRIKPYFPATKIGGIAVGNELYTDDDSSLIGYLMPAMMSIHGALVQTGLDKYIQVSTPNSLSVLQESYPPSAGCFRPEVAGVMTQLLGFLRNTNSPFWINAYPYFAYKDSPTKIPLDYVLFNPNPGMVDPYTKYRYDNMLYAQVDAVIFAMARLGFKDIEVGVSETGWPSKGDGDEVGATVANAAVYNKNILRRQLQNEGTPLRPNLSFDVYLFALFNEDLKPGPTSERNYGLYQPDETMTYNVGLLSSSSLTSTSTTSSTSIISLTSSASTALKKGKQRLMYWTCVYLLAIHMLIRRSY

SEQ ID NO: 5250 - protein, 526 aa, Clarkia similis
VEFDNIFLDYSRQQASPDTISKLYKLADAAHLKQKIDRMYNGDHINTTENRSVLHVALRAPRNSAICSDGKNVVPDVWNVLDKIKDFSDRVRNGSWIGATGKKLKDVIAVGIGGSFLGPLFVHTALQTDPESSKNARGRVLRFLANVDPIDVARNISGLNPETTLVVVVSKTFTTAETMLNARTLREWISSALGPSAVAKHMVAVSTNLPLVEKFGIDPNNAFAFWDWVGGRYSVCSAVGVLPLSLQYGFAVVEKFLQGAHSIDQHFSSAPFEKNVPVLLGLLSVWNVSFLGYPARAILPYSQALEKLAPHIQQVSMESNGKGVSIDGLPLPFESGEIDFGEPGTNGQHSFYQLIHQGRVIPCDFIGVVKSQQPVYLKGEVVNNHDELMSNFFAQPDALAYGKTPEQLKKENVSEHLIPHKTFTGNRPSISILLPTLDAYRIGQLLAIYEHRVAVQGFVWGINSFDQWGVELGKSLATQVRKQLHASRVKGEPVEGFNFSTKTLLTRYLEATSDVPTDPSTLLPNI

SEQ ID NO: 5251 - protein, 135 aa, Zea mays
  misc_feature (44)..(44): Xaa can be any naturally occurring amino acid
MAAAAAMMVSGGRAALAVAGVLCAVAAMAAAQQASNVRATYHLXAWDADKPLSWRQKHGWTAFCGPAGQKGQAACGKCIRVKNRATGASIVARIVDQCSNGGLDLDYETVFKKIDTNGQGYQMGHLNVDYQFVAC

SEQ ID NO: 5252 - protein, 511 aa, Pseudomonas putida KT2440
MTSTPKPLVLIILDGFGHSDIPEHNAIFAANKPVYDRLCATQPHGLISGSGMDVGLPDGQMGNSEVGHMNLGAGRVVYQDFTRVTKAIRDGEFFENPVLTGAVDKAVGAGKAVHILGLLSDGGVHSHQDHLVAMAELAAQRGAEKIYLHAFLDGRDTPPRSAQSSIELLDATFAKLGKGRIASLIGRYYAMDRDNRWDRVSAAYNLIVDSAAEYTADTALAGLEAAYARDESDEFVKATRIGEAVKVEDGDAVIFMNFRADRARELSRAFVEPDFTEFARARLPKMAAYIGLTQYSAKIPAPAAFAPSSLNNVLGEYLAKNGKTQLRIAETEKYAHVTFFFSGGREEPFEGEERILIPSPKVATYDLQPEMSAPEVTDRIVEAIEQQRFDVIVVNYANGDMVGHTGVFEAAVKAVEALDTCVGRIVDALDKVGGEALITADHGNVEQMEDECTGQAHTAHTTEPVPFIYVGKRNVKVREGGVLADVAPTMLKLLGLEKPVEMTGTSILVDA

SEQ ID NO: 5253 - protein, 505 aa, Oryza sativa (japonica cultivar-group)
MAAPSAIPRRGLFIGGGWREPSLGRRLPVVNPATEATIGDIPAATAEDVELAVSAARDAFGRDGGRHWSRAPGAVRAKYLKAIAAKIKDKKSYLALLETLDSGKPLDEAAGDMEDVAACFEYYADLAEALDGKQRAPISLPMENFESYVLKEPIGVVGLITPWNYPLLMATWKVAPALAAGCTAVLKPSELASLTCLELGGICAEIGLPPGVLNIITGLGTEAGAPLASHPHVDKIAFTGSTETGKRIMITASQMVKPVSLELGGKSPLIVFDDVDIDKAVEWAMFGCFANAGQVCSATSRLLLHEKIAKRFLDRLVAWAKSIKISDPLEEGCRLGSVVSEGQYQKIMKFISTARCEGATILYGGARPQHLKRGFFIEPTIITNVSTSMQIWREEVFGPVICVKEFRTEREAVELANDTHYGLAGAVISNDLERCERISKAIQSGIVWINCSQPCFVQAPWGGNKRSGFGRELGQWGLDNYLSVKQVTKYCSDEPYGWYRPPSKL

SEQ ID NO: 5254 - protein, 248 aa, Ralstonia eutropha JMP134
MYKLVLIRHGESTWNLENRFTGWVDVDLTDTGAAQARLAGKLLKEAGFAFDVAYTSVLKRAIRTLWHVQDEMDEMWIPVRNEWRLNERHYGALAGLNKAETAAKFGDEQVLVWRRSYDTPPPALEPTDPRASYDDPRYANVPREQIPLTECLKDTVARVLPLWNESIAPDIQSGKRVVIAAHGNSIRALVKYLDQISDDDIVGLNIPNGTPLVYELDASLRPLRHYYLGDQEAIAASLAAVASQGKAR

SEQ ID NO: 5255 - protein, 490 aa, Pseudomonas putida KT2440
MARFGTQKLYIDGAYVDAGSDATFEAINPATGEVLAHVQRATEADVEKAVESAERGQKVWAAMTAMQRSRILRRAVDILRERNDELAMLETLDTGKSYSETRYVDIVTGADVLEYYAGLVPAIEGEQIPLRESSFVYTRREPLGVTVGIGAWNYPIQIALWKSAPALAAGNAMIFKPSEVTSLTTLKLAEIYTEAGLPNGVFNVLTGSGREVGTWLTEHPRIEKVSFTGGTTTGKKVMASASSSSLKEVTMELGGKSPLIICADADLDKAADIAMMANFYSSGQVCTNGTRVFIPAEMKAAFEAKIAERVARIRVGNPEDENTNFGPLVSFQHMESVLGYIAKGKEEGARVLCGGERLTAGDFAKGAFVAPTVFTDCTDDMTIVKEEIFGPVMSILTYETEEEVIRRANDTDYGLAAGVCTNDITRAHRIIHKLEAGICWINAWGESPAEMPVGGYKQSGVGRENGVSSLAQYTRIKSVQVELGGYNSVF

SEQ ID NO: 5256 - protein, 539 aa, Aspergillus nidulans FGSC A4
MADQFKARTLKRKNVKGLALNAAPKSTSTLSNGDSQVPGAAGNGESNRTDTLEIGLEFRLDLRSEDLITLKELGAGNGGTVSKVMHASTKVVMARKIIRVDAKENVRKQILRELQVGHDCNSPNIVTFYGAFQNEARDIVLCMEYMDCGSLDRISKDFGPIRVDVLGKITESILAGLVYLYEAHRIMHRDIKPSNVLVNSRGNIKLCDFGVATETVNSIADTFVGTSTYMAPERIQGGAYTVRSDVWSVGLTVMELAVGRFPFDTTDSAAGDRASAGPMGILDLLQQIVHEPAPKLPRSDAFPPVLHEFVAKCLLKKSEERPTPLELYEKDAFLAAAKRTPVDLQEWAISMMERHNRKSYLAPPAPKSLKETRESPSPAQAPSPVQKHGTSRPSRGTTGEIPLNVARDSSSHQRQHAPQSQSHFSSNPSHYSSNSSHYSSRSSRSSPPISLEHLSLESKQDEHRPTRRPSRTPLGDSSSSLDQSLRPSIGSRSASSHNTNSRMPLQSTALPFRVAPTPGGYPTPNSTSWQRRGDHMGAL

SEQ ID NO: 5257 - protein, 552 aa, Dechloromonas aromatica RCB
MPIKLVQSTVSAYQYPLLIKQLLLTPLAIAPEQEITYQGKLRYNYRTLNERIGRLANVLTGLGVESGQTVAMMDWDSHRYLECFFAVPMMGAILQTVNVRLSPEQILYTLNHAKADVLLVNSEFFAILTQIAGQLETVKTIILISDEAELPIAPVAMVGEYEALLAEASPDYDFPDFDENAQATTFYTTGTTGNPKGVYFSHRQLVLHTLGCAAALGGANRQGHIHREDVYMPMTPMFHVHAWGFPYLATMMGVKQVYPGRYQPEVICRLISTEGVSFSHCVPTILHMILSHPHAKTADFTGLKILIGGAAMPEAMAISAQKRGMDLFTGYGMSETCPVLSMAHLESADLNRSLEEQAVIRAKTGRPLPLVDLRIVDPEMADVPHDGKATGEVVVRAPWLTQGYVSAPEDSEGLWAGGYLHTADIGNINPAGYLKVTDRIKDVIKTGGEWTSSLQLEDIIAKHEAVNEVAVIGVPDDKWGERPLALVLLKPEHVGQITEHALRNYAAHAIEAAGISRYGVLLQVSFVKTLVKTSVGKMNKRLMRADPDALRM

SEQ ID NO: 5258 - protein, 817 aa, Arabidopsis thaliana
MGIGWSLHNRDGTQILHGSGAIHPTQSPTEAEAEALRLAVLDLRRLGYSHVTFCGDLKLIYDTLQRCALRGNNASWKYLHIATYLADVLKISKLCSFNFIHISRDANDIADRLAKQARYREITQKSFDIRETPIKFRIEGTTPSFSGSVFALLHDSVSGTFISMDAKMFDTICSRDAISWLPDEVLGKILSLIPTKQAVSTSLLAKKWRTIFRLVDHLELDDSFSLQAVKDQTPGLRKHVRFVFTEDFKIFVDRTLALQCDYPIKNFSLKCHVSKYDERQKACVGRWISNVVGRGVFELDLRMKDPGIHFLPPHLVASKTLVKLTLGTQLCLGQLPSYVSLPSLKSLFIDTIVFYDIEDLCCVLLAGCPVLEELSVHHHDFIATPHTISSPTLKRLSVDYHCPDDVDSASHMSFDLPKLVYLEYSHCALGEYWQINLESLVEAKLDLGLERKVLRMDVTDLIIGIRNVQSLHLSPDSVHVIYSYCRHGLPVFKNLVNLSFGSKNKRGWRLLANLLKQSTKLETLIVKDLNGYTGDVSMPLNKVTSLHILGYRGTADEVKQLKSFIGEFECLELVQVDVAEAAEDNGKILQSKRDLMMLLGVSLPSKCQFKSVLDELNVRVSGILVIGVLDGTQLLLIILLHILGKGNKPLAALTTLNHMKEVGIDPSVLHYTTLIDGLSRAGNLEACKYFLDEMVKAGCRPDVVCYTVMITGYVVSGELDKAKEMFREMTVKGQLPNVFTYNSMIRGLCMAGEFREACWLLKEMESRGCNPNFVVYSTLVSYLRKAGKLSEARKVIREMVKKGHYVHLVPKMMKYRR

SEQ ID NO: 5259 - protein, 490 aa, Bacillus licheniformis ATCC 14580
MSQTLFIDGKWVGAKKGETRQIINPYNQEHIETVSEGDREDAVRAIAAARRAFDDGEWANTPGLERGNIVLKIAELIRRDHEELAELESLDTGKTIEESRADMDDIANVFQYYAGLADKDGGEVISSPIPDSKSKIVREPVGVCGQITPWNYPLLQASWKIAPALAAGNTIVVKPSEITPLTTIKIFKLMEEAGVPEGVANLVLGPGATVGDELARNKDVDLISFTGGIETGKKIMQAASTNVKKIALELGGKNPNIVFKDADFDVAVDQALNAVFFHAGQVCSAGARLLVEESIQDEFVAELVKRAKKIKLGNGFHEETQSGPLISAEHRSKVEKYVEIGLQEGAKLETGGKRPEDPELANGFFYLPTIFSSCTSDMRIVKEEVFGPVLTVETFKTEEEVVSLANDTIYGLAGAVWSKDIEKAERVASKLRMGTVWINDFHPYFAQAPWGGYKQSGIGRELGRMGLEEYTEVKHVYRNTKPAAVNWFKA

SEQ ID NO: 5260 - protein, 372 aa, Zea mays
  misc_feature (305)..(305): Xaa can be any naturally occurring amino acid
LFRRVVSCVCVRARVQSADGDVIHCVPAHLQPAFDHPRLRGQEPEDEPVERPMSKGAAGEEEAGVFPQAWSDGGSKRCPAGTVPIRRTTARDVLRASSARRFGMKARGSSSSNARRDSTSSGHEHAVGYVTGEQFYGAKASLNVWPAKVASAAEFSLSQIWVISGSFGNDLNTIEAGWQVSPELYGDSSPRFFTYWTTDAYQETGCYNLHCSGFVQTNSRIAIGAAISPTSVYNGRQFDISLLIWKDPHRGNWWLQLGSGPLVGYWPSLLFTHLGGHADMVQFGGEVVNSRPSGAHTPTQMGSGXHFPREGSNRAAYFRNLQVVDADNSLVAAAALRLVADRPGCYDIQGGYNTAWGNYFYYGGPGRNVHCP

SEQ ID NO: 5261 - protein, 523 aa, Rhodococcus sp. RHA1
MTTTAAEPNTSTTRALGGRARAFLLAAVAACAACGLIYELALLTLSVSLTGGGITQTSLIVAGFVAALGVGALAAKPLLSTAAASFVVVEIVLGLVGGFSAVTLYVTFTFFGSSAIVLVLATALIGVLVGAEVPLLMTLLQSGRNDTDAESTGKVLANLNAADYAGALVGGLLWPFVLLPIAGMIRGAAITGIINLVAAAVVALILLRWQLSLRTRLFAVVALLVAAACIAVLLVRADGIETTSRQRLYTDPVVAAERSQYQEIVVTERGGDVRLFLDGDLQFSSIDEHRYTESLVYPAMADDPKRVLILGGGDGLAAREVLRLPGVEEIVQVELDPAVIELANTRLSGLNQGALQDPRVHVVLDDAFRWLRDAPDSGFDAVIVDLPDPDTPALGRLYSTEFYGLAAAALNPGGLMVVQSGSPYSTPDAYWRTTSTVASAGLAVTPYHVLVPSFGDWGYVLARRGPEPPALRLPRDVPELRFLDEPTLAASAIFPRDRPRRELEPSTLDRPRIVDDMRKGYER

SEQ ID NO: 5262 - protein, 508 aa, Actinidia deliciosa
MAHRVLCPKILQSLRNSTTTPLLRTSTTTLYSAAVPPPLTVSPLSLHETPDPNPNPNPNPITPTPLSSPTTTILNLNAVKELFSSVPTLKLLRSAANLHVAAIEPMVDLGIWVMNSKLMTAPVAREVTVGAIKHTFYEHFCAGRGPVEAAGTAAKLWDSGLKGMLVYALEHAADNESCDWNLDAFLKTVESIKSLATCSVSSTVVKITAICPLRLLRRVSDLLRWEYNNNQSFQLPWKLNTLPVFSDSSPFYHTPIKPDPLTPEEESDLHLAQQRMLKLCQKCVEVGVPLLVDAEDTSVQPGIDYFTYSAALMHNKGDNPIIYGTIQTYLKDARERLFLAAREAERMGVSIGFKLVRGAYMSSERELAASLGVESPIHNTIHQTHACFNDCASFMLEKIANGSGAVVLATHNIESGNKAAVKATDLGIKKGNENLQFAQLYGMADALSFGLRNAGFQVSKYMPFGPVERIMPYLLRRAEENRGLLCASTLDRQLLRKELMRRLKVAIF

SEQ ID NO: 5263 - protein, 131 aa, Salmonella enterica
SGMHCHMSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGIKNKIHPGEAMDKNL

SEQ ID NO: 5264 - protein, 394 aa, Prochlorococcus marinus str. NATL1A
MAQLETRTEPMVVNFGPHHPSMHGVLRLVVTLDGEDVVDCEPVIGYLHRGMEKIAENRTNVMFVPYVSRMDYAAGMFYEAIVVNAPERLANIKVPKRASYIRAIMLELNRIANHLLWLGPFLADVGAQTPFFYIFREREMIYDLWEAATGQRLINNNYFRIGGVACDLPWGWLEKCKDFCDWFGPKIDEYEKLITNNPIFRRRIEGLGVIGKEQAINWSLSGPMLRAAGVPWDLRKVDHYECYDDFEWDIAWEKEGDCYARYRVRIEEMRQSLKILRQACEMIPGGPTENLEAQRTVEGKKGDLSGFDYQYVAKKVAPTFKIPNGELYTRLESGKGEIGVFIQGNNDVTPWRFKIRAADSNNLQILPHILKGAKVADIMAILGSIDVIMGSVDR

SEQ ID NO: 5265 - protein, 140 aa, Salmonella enterica
KSDVYCQTGVHCQTNLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGIKNKIHPGEAMDKNLYD

SEQ ID NO: 5266 - protein, 1058 aa, Streptococcus pneumoniae TIGR4
MPKRTDIQKIMVIGSGPIIIGQAAEFDYAGTQACLSLKEEGYEVVLVNSNPATIMTDKEIADKVYIEPITLEFVTRILRKEGPDALLPTLGGQTGLNMAMELSKNGILDELGVELLGTKLSAIDQAEDRDLFKQLMEELEQPIPESEIVNTVEEAVAFAATIGYPVIVRPAFTLGGTGGGMCANEKELREITENGLKLSPVTQCLIERSIAGFKEIEYEVMRDSADNALVVCNMENFDPVGIHTGDSIVFAPAQTMSDYENQMLRDASLSIIRALKIEGGCNVQLALDPNSFKYYVIEVNPRVSRSSALASKATGYPIAKLAAKIAVGLTLDEVINPVTGSTYAMFEPALDYVVAKIPRFPFDKFEKGERRLGTQMKATGEVMAIGRNIEESLLKACRSLEIGVHHNEIPELAAVSDDALIEKVVKAQDDRLFYVSEAIRRGYTPEEIAELTKIDIFYLDKLLHIFEIEQELGAHPQDLEVLKTAKLNGFSDRKIAELWGTTDDKVRQLRLENKIVPVYKMVDTCAAEFDSETPYFYSTYGWENESIRSDKESVLVLGSGPIRIGQGVEFDYATVHSVKAIQAAGYEAIIMNSNPETVSTDFSVSDKLYFEPLTFEDVMNVIDLEQPKGVIVQFGGQTAINLAEPLAKAGVTILGTQVADLDRAEDRDLFEQALKELDIPQPPGQTATNEEEAALAARKIGFPVLVRPSYVLGGRAMEIVENEEDLRSYMRTAVKASPDHPVLVDSYIVGQECEVDAISDGKNVLIPGIMEHIERAGVHSGDSMAVYPPQTLSQKVQETIADYTKRLAIGLHCLGMMNIQFVIKDEKVYVIEVNPRASRTVPFLSKVTNIPMAQVATKLILGQSLSELGYQNGLYPESTRVHIKAPVFSFTKLAKVDSLLGPEMKSTGEVMGSDATLEKALYKAFEASYLHLPTFGNVVFTIADDAKEEALNLARRFQNIGYGILATEGTAAFFASHGLQAQPVGKIGDDDKDIPSFVRKGRIQAIINTVGTKRTADEDGEQIRRSAIEHGVPLFTALDTANAMLKVLESRSFVTEAI

SEQ ID NO: 5267 - protein, 501 aa, Oryza sativa (indica cultivar-group)
MATWILGWLLWLPVFLISLYLVDILAHSCRRLPPGPRPLPFIGSLHLLGDQPHRSLAGLAKKYGPLMSLRLGAVTTVVVSSPEVAREFVQKHDAVFADRSIPDSIGDHTKNSVIWLNPGPRWRALRRIMATELFSPHQLDALQQLRQEKVAELVDHVARLARESAAVDVGRVAFATSLNLLSRTIFSRDLTSLDDRGASREFKQVITDIMEAAGSPNLSDFYPAIAAVDLQGWRRRCARLFTQLHRLFDDEMDHRKLHSRHGGPGENGKEKDDFLEVLLRLGARDDDIAGLDGDTLRSLFIDLFAAGSDTSSSTIEWAMVELLKNTLSMGKACDELAQVVGSRRRIEESEIGQLPYLQAVIKETLRLHPPVPLLPHRAKMAMQIMGYTIPNGTKILINVWAMGRDKNIWTEPEKFMPERFLDRTIDFRGGDLELIPFGAGRRICPGMPLAIRMVHVVLASLLIHFKWRLPVEVERNGIDMTEKFGLTLVKAIPLCALATPT

SEQ ID NO: 5268 - protein, 516 aa, Clarkia similis
RQQASPDTINKLYKLAEAAHLKQKIDRMNNGDHINSTENRSVLHVALRAPRNSVICSDGKNVVPDVWNVLDKIKDFSERVRNGSWVGATGKELKDVIAVGIGGSFLGPLFVHTALQTDPEASKNARGRELRFLANVDPIDAARNISGLNPETTLVVVVSKTFTTAETMLNARTLREWISSALGVSAVAKHMVAVSTNLPLVEKFGIDPNNAFAFWDWVGGRYSVCSAVGVLPLSLQYSFAVVEKFLQGAHSIDQHFSSAPFEKNIPVLLGLLSVWNVSFLGCPARAILPYSQALEKLAPHIQQVSMESNGKGVSIDGLPLPFESGEIDFGEPGTNGQHSFYQLIHQGRVIPCDFIGVVKSQQPVYLKGEVVNNHDELMSNFFAQPDALAYGKTPEQLKKENVSEHLIPHKTFTGNRPSLSILLPTLDAYRIGQLLGIYEHRVAVQGFVWGINSFDQWGVELGKSLATQVRKQLHASRVKGEPVEEGFNFSTKTLLTRYLQATSDVPADPSTLLPNI

SEQ ID NO: 5269 - protein, 527 aa, Clarkia similis
VEFDNIFLDYSRQQASPDTINKLYKLAEAAHLKQKIDRMNNGDHINSTENRSVLHVALRAPRNSVICSDGKNVVPDVWNVLDKIKDFSERVRNGSWVGATGKELKDVIAVGIGGSFLGPLFVHTALQTDPEASKNARGRELRFLANVDPIDAARNISGLNPETTLVVVVSKTFTTAETMLNARTLREWISSALGVSAVAKHMVAVSTNLPLVEKFGIDPNNAFAFWDWVGGRYSVCSAVGVLPLSLQYSFAVVEKFLQGAHSIDQHFSSAPFEKNIPVLLGLLSVWNVSFLGCPARAILPYSQALEKLAPHIQQVSMESNGKGVSIDGLPLPFESGEIDFGEPGTNGQHSFYQLIHQGRVIPCDFIGVVKSQQPVYLKGEVVNNHDELMSNFFAQPDALAYGKTPEQLKKENVSEHLIPHKTFTGNRPSLSILLPTLDAYRIGQLLGIYEHRVAVQGFVWGINSFDQWGVELGKSLATQVRKQLHASRVKGEPVEEGFNFSTKTLLTRYLQATSDVPADPSTLLPNI

SEQ ID NO: 5270 - protein, 382 aa, Haemophilus influenzae
MAKKDYYEVLGLQKGASEDEIKRAYKRLASKHHPDKNQGSKEAEEKFKEINEAYEVLGDDQKRAAYDQYGHAAFEQGGGAGGFGGGFGGADFGDMFGDIFGDIFGGGGRGRQRVVRGEDLRYDLEISLEEAVKGTTKDIQINTLAHCDSCGGSGAEKGSKVETCPHCHGSGRIRRQQGFFVSESICPTCHGSGKKIEKPCRNCHGEGRVHKKENLSVKIPAGVDTGNQLRLAGKGAAGENGAPAGDLYVVIHVREHNIFERDGSNLYCEVPISFATAALGGEIEVPTLDGRVKLKIPAETQTGKLFRMRGKGVASTRSGYAGDLICRIVVETPVNLTSEQKELLHKLEESLQGKDLSKHAPKSSGFLDGVKKFFDNLGKSDK

SEQ ID NO: 5271 - protein, 379 aa, Staphylococcus aureus
MAKRDYYEVLGISKDASKDEIKKAYRKLSKKYHPDINKEEGADEKFKEISEAYEVLSDDNKRATIDQFGHDGPQGFGGQGFNGSDFGGFSGFGGGGFEDIFSSFFGGGSQRDPNAPQKGDDLQYTMTLTFEEAVFGTTKEISIRKDVTCETCHGDGAKPGTSKKTCSYCNGAGHVAVEQNTILGRVRTEQVCPKCNGSGQEFEEACPTCHGKGTENKTVKLEVKVPEGVDNEQQIRLAGEGSPGVNGGPAGDLYVVFRVKPSETFKRDGDDIYYKLNVSFPQAALGDEIKIPTLNNEVMLTIPAGTQTGKQFRLKEKGIKNVHGYGYGDLYVDIKVVTPTKLTDRQKELMKEFAQLNGEEINEQPSNFKDRAKRFFKGE

SEQ ID NO: 5272 - protein, 805 aa, Gibberella zeae PH-1
MCIVLLTTAHPDYALIAIDNRDEFILRPTSRPHWWTHSTSGRPVLSSRDLQRAEKGTWMGLSKDGHLAVLTNYRETDIKDQNHPIHAAKSRGGMVTAWLGTPPEESLKDSVHKLVENDGVKGVGGFSMVCGKLRKNTSGIAIVSNRAGNVNDVPIIAKERDEMWGLSNTAFDATGKEEEWAKISIGKKLFREAINSSVSDKLNQEDLISNLLDVLTHDTLPRNENASLVEYISELKKSVFIPLIGDEKHRKAMEAAMAKGPGVWATDDQKAAEELMSEGRPDPSTTPIMGFETGMYGTQRQTVVLVDWEGKVTMVERALWDGNGNAVPKGEGDLKFEFSINGWNDESCNGTMDTFRAGLEGKRLPSSKLRLPTTSNFLTRSKRKRPVVSAPIGPVKNSRGADFVRSDTLIIVPTIKDCCSDDSSSDKENAQAIKTTRRISASFSTHGSLASPPTVAKSGLTATSSHQSLLSAAPIKPLPTTASFTNFSRKTLANSSSYGVYPTVDTIFQDENVPPPDHKEVAPAETVSSTMNKSRLPKSRTLTVLSEIRSSISRTSMNSKPSSPRPLADQSRKASSSSTSSLLTSSSSRLCLPGYSSTSASRTNSTSTLVTELLPKPDQITSSQPSAYWSGRFVSLHDRFLTEEFSTEGAVSKDSSSDNSFRAFVMKTDRAAVNSRPTHLSHSTTTSALTSLTVTKPRNKTSTKDARCLRVFHHLENLCITIEARRSLLAWQQTYARRMDKPSLLPQGGSMEHKSLMGRIFSGGKGTSGNTRHSLPAMNGPSGLPVSKKRPSLASKQRGKRLSFN

SEQ ID NO: 5273 - protein, 819 aa, Oryza sativa (indica cultivar-group)
MAALLLWLSWLLLSLLSIYLLDLLAHSRRCLPPGPRPLPLIGSLHLLGDLPHHSLAGLAKKYGPLMSLRLGAVTTVVASSPEVAREFLQKHDAVFATRSTPDATGDHARNSVAWLPPGPRWRELRKIMATELFSTRRLDALHELRQEKVAELVDHVARLARDGTAVDIGRVAFTTSLNLVARTIFSHDLTSLDDHGASKEFQRLITDVMEAVGSPNLSDFFPALAAVDLQGWRRRLSGLFARLHRLFDAEMDHRRLHGMKEKDGDFLEVLLRLAARDDDTARLDGDTLRSLFTDLFTAGSDTSSSTVEWAMAELLQNPISMAKLCDELRRVVGSRRRIEESEIGQLPYLQAVIKETFRLHSPAPLLLPRQATRTIQIMGYTIPKGTRVLINVWAMGRDEDIWPEAGKFMPERFLERTIDYKGGDLELIPFGAGRRICPGMPLAVRMVHVLLASLLIHFKWRLPAEVEGNRIDMTEKFGVTLAKANHLCAMAAPTYTGNILTAKQLRDHELQLRTNISALTDKKTQMMEPDAIAMPVVTEDDVRHAISRWTGVPLHKVSMDESRKLLKLEEALHRRVVGQGEAVAAVSRAIRRARLGLKHPGRPVASLVFAGPTGVGKSELAKALAAYYYGSSESEEAAMVRLDMSEYMEKHAVARLVGSPPGYVWHGEGGQLTEAVRRRPHAVVLLDEVEKAHRDVFDLLLQVLDDGRLTDGKGRTVDFKNTLIVMTTNIGSSLIVNNGGDGAAAAGRIKNTVTDEMKRHFRPEFLNRLDEVIMFQPLTELESFRGRGGPLKPREPDQYSDAPKNVVGHTDKNAILDLR

SEQ ID NO: 5274 - protein, 501 aa, Clarkia unguiculata
MASPALISETEAWKDLKAHLEGIKMTHLRELMGDTERCQSMMVEFDNIFLDYSRQQASPDTISKLYKLADAAYLKQKIDRMYNGDHINSTENRSVLHVALRAPRNSAICSDGKNVVPDVWNVLDKIKDFSDRVRNGSWIGATGKELKDVIAVGIGGSFLGPLFVHTALQTDPEASKNARGRELRFLANVDPIDVARNISGLNPETTLVVVVSKTFTTAETMLNARTLREWISSALGPSAVAKHMVAVSTNLPLVEKFGIDPNNAFAFWDWVGGRYSVCSAVGVLPLSLQYGFAVVEKFLQGAHSIDQHFSSAPFEKNIPVLLGLLSVWNVSFLGYPARAILPYSQALEKLAPHIQQVSMESNGKGVSIDGLPLPFESGEIDFGEPGTNGQHSFYQLIHQGRVIPCDFIGVMKSQQPVYLKGEVVNNHDELMSNFFAQPDALTYGKTPEQLKKENVSEHLIPHKTFTGNRPSISILLPTLDAYRIGQLLAIYEHRVAVQGFV

SEQ ID NO: 5275 - protein, 400 aa, Mesorhizobium loti MAFF303099
MAFLADTLSRVKPSATIAVTQKARELKNAGRDIIGLGAGEPDFDTPDNIKNAAIEAIRRGETKYPPVSGIVPLREAIAKKFKRENNLDYKPEQTIVGTGGKQILFNAFMATLNPGDEVIIPRPYWVSYPEMVAICGGTSVFADTSIENGFKLTAEVLEKAITPKTKWLLMNSPSNPSGAAYTQAELRALADVLLKHPHVWTLTDDMYEHLTYGDFAFKTIAEVEPKLYERTLTMNGVSKAYAMTGWRIGYAAGPVQLIKAMDMIQGQQTSGACTIAQWASVEALNGPQDFIARNKAIFQGRRDLVVSMLNQARGITCPSPEGAFYVYPSCAQLIGKKTKAGKVIDTDEAFCSELLEAEGVAVVFGSAFGLGPNFRISYATSDALLEEACTRIQRFTASLT

SEQ ID NO: 5276 - protein, 465 aa, Oryza sativa (japonica cultivar-group)
MGRKIKVKKKKASSKKAEASSSRVPSAPAKVWQPGVDTLEEGEELQFDPQAYNYLRGFNIGWPCLSFDVVRDQLGLVRSEFPHTLYGVAGTQAERATWNYIGIFKICNINGKKREPIPASAIDGDSDMDSESSSDEEDEAVNEDTMPILHLKKVAHAGCVNRIRSMNQEPHICATWGDTGHVQVWDFSSFLNSLAESGAVAHNEDDRIHNHVPVKIFGSHKDEGYAIDWSPLVTGRLVSGDCNKCIHLWEPTSNSWNVDTNPFVGHTASVEDLQWSPTEADIFASCSADRTISIWDIRTGKKPCISVRAHNADVNVISWNRLASCMIASGCDDGSFSIRDLRLIKDDSLVAHFEYHKHPITSVEWSPHEPSTLAVSSADHQLTIWDLSLEKDAEEEAEFRARMREQADAPEDLPPQLLFVHQGQKDLKELHWHPQIPSMIISTAADGFNMLMPSNIDTTIREADA

SEQ ID NO: 5277 - protein, 380 aa, Clarkia unguiculata
MATPSLISETETWKDLKAHLEGIKKTHLRELMGDTERCQSMMVEFDNIFLDYSRQQASPDTINKLYKLADEAHLKQKIDRMYNGDHINSTENRSVLHVALRAPRNSAICSDGKNVVPDVWNVLDKIKDFSERVRSGSWVGATGKELKDVIAVGIGGSFLGPLFVHTALQTDPEASKNARGRELRFLANVDPIDAARNISGLNPETTLVVVVSKTFTTAETMLNARTLREWISSALGVSAVAKHMVAVSTNLPLVEKFGIDPNNAFAFWDWVGGRYSVCSAVGVLPLSLQYGFAVVEKFLQGAHSIDQHFSSAPFEKNIPVLLGLLSVWNVSFLGYPARAILPYSQALEKLAPHIQQVSMESNGKGVSIDGLPLPFESGEI

SEQ ID NO: 5278 - protein, 671 aa, Idiomarina loihiensis L2TR
MCGIAGVFHHQTERAIEPQTLVNMAAIMHHRGPDGFGYEVQQDYGVGFSHARLSIIDLDEKRGRQPFISADKRLMLTHNGEFYDFKRIRADLTARGARFNSKSDSEIVLHLFERYGLEDTLKELRGEFAFGLFDAKDESLYLVRDRFGIKPLYWTETEHGVVFGSELKVLFAHPDVKREFSAEGLYHQLIQVMVPGSTAFEGINQVQPGYVVKLQRKNGKVVATEHKYWDVDFPPEESYPGADVDEESYIEGVRAKLLEAVQHRMTADVPVGCYLSGGIDSCAILGLASASTQTSVKAFTIGFDSADYDETPIAEEMAAATKADHHIMRLKADDLYDHFVKTLWHTERTIYNTLGVAKYLMSKEVHEAGYKVVMTGEGSDELFAGYPAFRKDMFLHGLDHLPEVERVEWQELLEKNNKLFKGAMLAREEFVSEAFNQKMGFTPSCVQPWLSCSSVALPLMSENKRKQVEGYDPSLAIANTLDKDMLDGRHPLDRAQYVWIKTMLEGQILTWGGDRVDMANSMEARPAFLDHHLAEYAFTVPPHLRIKGNKEKYVLREAMKGLLPETLYKREKFAFMAPPAHTDPEKWKAVEKLAEQFLNAEAVKSAGLLDYDEVVRTFERHQDENVPNEERVQLDAVINHMLGVQVLHHHFVATDVPAQAQQRATELGWTA

SEQ ID NO: 5279 - protein, 410 aa, Erwinia carotovora subsp. atroseptica SCRI1043
MPGVIESTSRTSRKVKLSLMGPAFIAAIGYIDPGNFATNIQSGAAYGYTLLWVVVWANLMAMLIQLLSAKLGIATGKNLAEHIRDRFPRPAVWAYWVQAEIIAMATDLAEFIGAAIGFKLLLGVSLLEGAILTAIATFLILMLQQRGQKPLEMVIGGLLLFVAAAYIVELVFSQPELSALAKGMAIPSLPTSDAVLLAAGVLGATIMPHVIYLHSSLTQHEGGHSRAERYSATKVDVAIAMTIAGFVNLAMMATAAAAFHFSGNQDIADLDKAYLTLEPLLGKAAAVIFGLSLVAAGLSSTVVGTLAGQVVMQGFVRFHIPLWVRRAVTMLPSFIVILSGMDPTRVLVLSQVVLSFGIALALVPLLSFTGNRELMGSMVNGKWVQRIGQLIVVLVVSLNMYLLIDTIIGI

SEQ ID NO: 5280 - protein, 279 aa, Myxococcus xanthus
MARSDEGFFPGRDRTRLCWKPILADAEPVPHVAVVHGYGDHFGRYGFVTDALLADGFAVHGFDYRGHGKADGRRAYCEKWPDYLEDLEVFWERVRAVSEGKKAFVLAHSHGGLMSATWASSRRVEGLTGLVLSAPYLKLAITPPASKLMAARAVGKLVPWLSISSGLKVEDLTHDTDVQRATREDPLHQAIATPRWFVESTRAQGEAVLLAPKIQVPLFVLCGAEDGVAAPAAAREYFERAGSPDKKFKEYPGMRHEPLNEVGRAEVFRDISGWISAHL

SEQ ID NO: 5281 - protein, 536 aa, Oryza sativa (indica cultivar-group)
MADMKQEEISHPPMDQLQGLEYCIDSNPSWGEAIALGFQHYILCLGTAVMIPTLLVPLMGGNAHDKAKVVQTMLFVTGINTMLQTLFGTRLPTIIGGSYAFVIPVISIIKDPSLAQITDDHTRFIMTMRAIQGALIISSCIQIILGYSQLWGICSRFFSPLGMVPVVALVGLGLFERGFPVIGRCVEIGLPMLVLFVALSQYLKHVQVRHFPILERFSVLISIALVWVYAHILTASGTYKHTSLLTQINCRTDRANLITSADWIDIPYPLQWGPPTFSADHAFGMMAAVVVSLIESTGAFKAAARLASATPPPPYVLSRGIGWQEYNAFALYVNNQGIGLLFDGLFGTGTGSTVSVENIGLLGSTRIGSRRVIQISAGFMIFFSILGRFGALFASIPFTMFAAIYCVMFGYVGAVGLSFMQFTNMNSMRSLFIVGVSLFLGISIPEYFFRYTMSALHGPAHTRAGWFNDYINTVFSSPPTVGLIVAVILDNTLEVRDAARDRGMPWWARFRTFRGDSRNEEFYTLPFNLNRFFPPS

SEQ ID NO: 5282 - protein, 379 aa, Pseudomonas putida GB-1
MKAIVYNGPRDVAVKDVPDAKIEKPTDVLVRITTTNICGSDLHMYEGRTSFEAGRVFGHENLGEVIEVGAGVDRVKVGDRVCLPFNIGCGFCENCEKGLTGFCLTANPGAAGAAYGFAEMGPYQGGQAELLRVPYADFNCLVLPEDAQEREDDYVMLSDIFPTGWHATELAGLLPGESIAIYGAGPVGLMAAHSAIIKGASQVFVIDNQPDRLQLAAQLGATPINAVEQKAVEEIMNLTHGKGTDRGCECVGYQCCDKHGHEANYLTMNNLVASTKATGGIGVVGVFVPEDPGAKNELAKEGKMAFDFGAFWFKGQQIRTGQANVKAYNRRLAELIHHGRAKPSQIISHRLKLAEGPEAYKHFDARDDGWTKVVLKPAA

SEQ ID NO: 5283 - protein, 126 aa, Salmonella enterica
NGSGMHCHMSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGIKNKIHPG

SEQ ID NO: 5284 - protein, 131 aa, Salmonella enterica
HCHMSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGIKNKIHPGEAMDKNLYDL

SEQ ID NO: 5285 - protein, 239 aa, Francisella tularensis subsp. tularensis SCHU S4
MITQTMFNSKFYRFLPVVFLIIGIIAFFSFGGQSYLSLNALKENYQSIIVFANNHFLLSILVFSCAYIIVVALSIPGATIMTLLGGLLFGLLLGSFVVVVAATVGASVVFFAVKTALGDSLKTKAKGGIEKMRRGFERDVFNYLLLLRLIPIFPFFIINIAAGMFGVKFRDFFWATLLGIIPGSVVYVWVGTSFAYAIQQGDEINLGIILEPQFIVPIVALAILSVVPVFIKKFNKKAY

SEQ ID NO: 5286 - protein, 480 aa, Myxococcus xanthus DK 1622
MEKVLNYIGGELLPARGGGWLDKPEPATAETYAHVPDSDASDVQHAVEAAARAFPAWAATPATERSRMLRRIADGIRSRLDAFARAESIDTGKPLSVASTVDIPRSILNFEFFADAVTQFSSEAHQTDDVALNYTLRAPLGVVGCISPWNLPLYLLTWKIAPALAMGNCVVAKPSEVTPMTAYLLAQVCRDVGLPPGVLNLVHGLGPKVGAAMSEHPDISAISFTGSTRTGAEIARVAAPAFKKLSLEMGGKNPNVIFADCDFDEALATTLRSSFANQGQICLCGPRIFVQRPLYERFKEALVTRTRALKVGDPLEAGTDQGALVSQQHFDKVLGYVSLAKQEGGRILTGGQRANVPGRCRNGWFVEPTLIEGLDAGCRTNQEEIFGPVASIMPFDSEDEVLAWANSTRYGLAASVWTQDVKRAHRFASRLHSGIVWVNTWMLRDLRTPFGGVKDSGVGREGGWDALRFFTEPKNVCIKL

SEQ ID NO: 5287 - protein, 230 aa, Ralstonia eutropha JMP134
MHEIERLLKGFERFQQHYFEDEPELFDTLRDGQRPPTLLIGCSDSRVDPALLLGCDPGELFTVRNIGNLVPPCTGNHEGSLHGVSAAIQFAVEQLRVARIIVMGHAGCGGIRALLAQPAGAEHEDAVAGRDFIGPWVRIASSARRHVDDTLAGASSAQRQRACEQAAILVSLGNLETFPFVRRELDRGRLTLHGWYFDLEAGALLAYSHRADSFLPLVCPIGRGNSSAKN

SEQ ID NO: 5288 - protein, 559 aa, Arabidopsis thaliana
MGYEKFTWVIKNFSSLQSEYIKSDIFVIGGCKWCLLAYPNGKQNASYLSLYLDGPTLKTLPCGCRRRIRFRLTVVNQLSENLSRRGEGKRWFDKKLPLCGYEEVLLLTKLNAKHGGFLVNNEVKIVAEVDVLEVIGKLDVSKESQEVIKPRKRMRLYGDGGAVSSHLHKETSSVDVNGFQVLPSQAESVKRIFERHPYMALEFRAKNQQLRASCINVLLSLIKTLCQSLQDISIDDLGQTEQVLTFLQNSGFKVDWLERKLEEVKEKKIQEHIGKSRMQGLEEDLKVFKKKCSDIEALLEKEKEELKGLKQKCSDIEALLEKEKGKVLAAAARTPLTLDRMNILIGYREMISLTKLNAKKGGFLVNNKVKIVVEVDVLQVVGGLDVSQEVTQPLKRIRLNDDGAASTHLQTIDVNGFLVLASQVESVKRIFESHPEMTLTFRANNQQLRTSCINVLLNLIETMCMSPQNLSIADLGQTEQALTYLKNSGFKVDWLERKLEEVTEKKIQEHIEALLEKEKEELKDLKQKCSDTEALLEKEKTKVLAAARAPPLTLDDVVS

SEQ ID NO: 5289 - protein, 463 aa, Listeria monocytogenes EGD-e
MTKVNSFFRKKSFHNPATDKHHLNKSLGAFDLTMLGVGAVVGGGIFILPGQVASVIAGPGIIISFIIAGIACCLAALCYSEFASKLPVAGSAYTYSYHVFGEGVAWILGWSLILEYGLAVAAIASGWSSYMKSLLAGFDLHIPTAISSAYDPSAGTYFDLLAFVVVMVIGILLSFGIRESTRVNNIMVLVKIAVVVLFILVGAFYVKPDNWTPFLPFGVQGVITGASTVFFAYIGFDAVSSAAEEVKNPQKNMPIGIISSLAVCTLLYILLSAVLTGVVPYTDLVDVSAPVAFALQAINQNWIAGLLSVGAIVGMTTVVLVMSYGGTRLLFAMGRDGLLPKSFSKISKNDTPVRNTMIFATVMGLIASTVPMADLAQLINIGTLFAFAMVSIGIFFLRRNPDLNQKGFKTPFYPVVPALSFLLCVYLMINLSKTTWIAFGIWFVIGILVYTFYGRKHSALRIK

SEQ ID NO: 5290 - protein, 138 aa, Leptospira interrogans serovar Lai str. 56601
MNQLLREVLTPDAERTQNFTVGDTVKVHYKIVESGKERVQIYEGVVISVANEANGKTFTVRRVSYDVGVERIFPLFSPRIAKIELIRKGKVRRAKLYYLRNLAGKAARIKELKGGKALVSEDRKRQQAAAATKSTTTE

SEQ ID NO: 5291 - protein, 256 aa, Brucella suis 1330
MTKFWIGTSWKMNKTLAEARLFAEALKAADAGRSPDIQRFVIPPFTAVREVKEILSGTSVKVGAQNMHWADQGAWTGEISPLMLKDCNLDIVELGHSERREHFGETNETVGLKVEAAVRHGLIPLICIGETLEDRESGRAAAVLEEEVRGALSKLSEAQKQAEILFAYEPVWAIGENGIPASADYADARQAEIIAVAQSVLARRVPCLYGGSVNPGNCEELIACPHIDGLFIGRSAWNVEGYLDILARCATKVQAN

SEQ ID NO: 5292 - protein, 102 aa, Cucumis sativus
KLLVLVFTKSSRFARLQNIKCAIAGKNLYTRFSCSTGDAMGMNMVSKGVQNVLDFLQEDFPDMDVIGISGNFCSDKKPAAVNWIEGRGKSVVCEAVIKGGCG

SEQ ID NO: 5293 - protein, 377 aa, Vigna radiata
MADAEDIQPLVCDNGTGMVKAGFAGDDAPRAVFPSIVGRPRHTGVMVGMGQKDAYVGDEAQSKRGILTLKYPIEHGIVSNWDDMEKIWHHTFYNELRVAPEEHPVLLTEAPLNPKANREKMTQIMFETFNTPAMYVAIQAVLSLYASGRTTGIVLDSGDGVSHAVPIYEGYALPHAILRLDLAGRDLTDALMKILTERGYSFTTSAEREIVRDMKEKLAYIALDYEQELETAKTSSAVEKSYELPDGQVITIGAERFRCPEVLFQPSMIGMESPGIHETTYNSIMKCDVDIRKDLYGNIVLSGGSTMFPGIADRMSKEITALAPSSMKIKVVAPPERKYSVWIGGSILASLSTFQQMWIAKAEYDESGPSIVHRKCF

SEQ ID NO: 5294 - protein, 285 aa, Pseudomonas putida GB-1
MRDFPTPPFPSQPQDVPGSQRKMEPYPDCGEQSYTGHNRLEGKIALITGADSGIGRAVAIAYAREGADVAIAYLNEHEDAQETARWVESAGRQCLLLPGDLAQKQHCYDIVEKTVSQFGRIDILVNNAAFQMSHETLEEIDDDEWVKTFDTNITAIFRICQAALPSMPKGSSIINTSSVNSDDPSPSLLAYATTKGAIANFTAGLAQLLAKKGIRVNSVAPGPIWTPLIPATMPDEAVKNFGSSYPMGRPGQPVEVAPIYVLLGSDEASYISGSRYAATGGKPIL

SEQ ID NO: 5295 - protein, 121 aa, Zea mays
MAGTGRSMLLSLLLFAVTLSLLEMYRGWFAASELKTIAGGFVSSLLFLLLLTFIGNYQEASGVRTGWGAVVVAQLVALIVAGTVHRVCITTCFLFSAGILYEVDKLSGMILARSESKARRY

SEQ ID NO: 5296 - protein, 413 aa, Coprinopsis cinerea okayama7#130
MASTVRVLGLRSLPSLRCSSSSYSRLARPTPLLTAQTRLFSVGLQRVSQRPALVSASLLSRSYATQPPASETTEAAAAATTPEPEVQAIVESVSDPLSFTDAVVHQIPPLAYGDFAALGLASWSPIGLIAWSYELLQVSTGLPWFYTIIAGSALWRFVCVPFALSNIRNSTKLRPFQPQILQARERMTAAQTKRDAIELQRASVEMKKVYSEAGVSPFTGMILPMFAQLPITIGMFFALKRMAQLPVEQMKESGVAINLDLPWTGPISWLSDLTVADPTYLLPAAFCGLINLQIAVGAREMDTSNPSAGHLMNVFRGLSVLTIYFMSSFPQGLFLGLLTTSGLTIVQSLLLRSDGVRRLVGIPVVKREMQGKLPSFLESFRYARKMMEDKQKAAVAAAAQQHRHNVRRGPKPL

SEQ ID NO: 5297 - protein, 361 aa, Oceanobacter sp. RED65
MSKNVLILPGDGIGPEIVTEAVKVLNVINDKLSLDLDFVDGLVGGAAYDVHGTPLPDETMEKAHAADAILLGAVGGPKWDNLENRDHRPEKGLLGLRSGLELFGNLRPAILYPQLADASSLKPEVVSGLDILIVRELTGGIYFGQPRGIRMLENGEREGYNTYVYSESEIRRIAKVAFESAQKRNKKLCSVDKANVLEVTVLWREILEEMSKDYPDVELSHMYVDNAAMQLVRAPKQFDVMVTGNMFGDILSDAAAMLTGSIGMLPSASLNQSNKGMYEPCHGSAPDIAGKGLANPLATILSAAMMLRYSLEESKAADEIEAAVSRVLDQGLRTADIMSEGMQQVSTAEMGDAVVAQLTEA

SEQ ID NO: 5298 - protein, 464 aa, Aeropyrum pernix K1
MDRVLRELFLLSSRDINPWTGRVFTHVYDPGMDEVRKAASKALELYRDKTMLDFTVYPSIIELEKQLLGFAGHLFHAPEGYSGTFTYGGTESIILAVLAARERWRRAGKSGAGKIVMPITAHPAFAKAAYLLGLKVERVPVDSVTLQADPAIIEEKIDRDTVMIVASAVDYPYGSLDPVEDLGDIAAARDVWLHVDACIGGMVLAFASDAGEEVGKFDFGVEGVRSFSVDMHKYGYAPKGSSILLFRRARDKKPTIFVDSSWPGYPLVNQAILSTRSAGTLAAAWAVARTLGVEGYRELAGMVLEARRRIQKGLESLGLEVLGRPKAGILSFTDSDIDVVEVATRLGRAGWVVQLQPGNKHLGFPTSIHLTISPIHARVVDSFLAAVEESIRGAPEPESRFEPALIEEGFKAVEDLLRRIENAGFDDKAVRVVNEMIYLLKPDVVAELIKEAMLEIFKPSWPGW

SEQ ID NO: 5299 - protein, 123 aa, Salmonella enterica
KPMFGDNGSGMHCHMSLAKNGTNLFSGDKYAGLSEQALYYIGGVIKHAKAINALANPTTNSYKRLVPGYEAPVMLAYSARNRSASIRIPVVASPKARRIEVRFPDPPPPPYLCFAALLMAGLD

SEQ ID NO: 5300 - protein, 296 aa, Cryptococcus neoformans var. neoformans B-3501A
MSLQGQLTTIPCGPFFYPVFTSGDLTATRAVVFIGGLTNGLGAVPFTYPLSDALGKAGWKLIQFHWSSAYGGYGTGSLDRDREEMQALVKYLKTTGGLSKVIIMGHSTGSQNVIHYLSSSINNDPAYHVDGGIMQAPVSDREVCAKDKPYCDYLSLAEEMVKKGRGHEIMPDEFCKKAGFGGVEMKMTAYRLWSLMGVGGDDDYFSADIPLEPTQPYVHSLSTSFGALTAPALALFSEKDAEWIVARPEDLLPKWADAANGKLEWRIIKGASHDVNEKEAQAVLCEDVLSWLRKFE

SEQ ID NO: 5301 - protein, 364 aa, Shigella flexneri 2a str. 301
MMSKNYHIAVLPGDGIGPEVMTQALKVLNAVRNRFAMRITTSHYDVGGAAIDNHGQPLPPATVEGCEQADAVLFGSVGGPKWEHLPPDQQPERGALLPLRKHFKLFSNLRPAKLYQGLEAFCPLRADIAANGFDIQCVRELTGGIYFGQPKGREGSGQYEKAFDTEVYHRFEIERIARIAFESARKRRHKVTSIDKANVLQSSILWREIVNEIATEYPDVELAHMYIDNATMQLIKDPSQFDVLLCSNLFGDILSDECAMITGSMGMLPSASLNEQGFGLYEPAGGSAPDIAGKNIANPIAQILSLALLLRYSLDADDAASAIERAINRALEEGIRTGDLARGAAAVSTDEMGDIIARYVAEGV

SEQ ID NO: 5302 - protein, 303 aa, Yarrowia lipolytica CLIB122
MSVILCSSSYDNTIKFWEALSGICSRTIQHPDSQVNRLAITPDKRYLAAAGGNTVRLYDIRSNNPKAVMTFEGHTGNVTALAFQYDGKWMVTSSEDGTVKVWDMRTATVQRNYKHRCPVNDVVIHPNQGEIISCDQEGNIRIWDLGENTCTHQLIPEEDVPVRSVSVASDGSMLVAGNNKGNCYVWKMHNTRDVTSLHPITKFRSHSKYITKVLLSPDVKHLATCSADNTARIWSIKNGFSLETTLTGHQRWVWDCAFSADSAYLVTASSDHYVRLWELASGQIIRQYSGHHKGALSVALNDV

SEQ ID NO: 5303 - protein, 115 aa, Streptococcus pneumoniae TIGR4
MNPLIQSLTEGQLRTDIPSFRPGDTVRVHAKVVEGNRERIQIFEGVVIARKGAGISENYTVRKISNGVGVERIFPIHTPRVEKIEVVRYGKVRRAKLYYLRALQGKAARIKEIRR

SEQ ID NO: 5304 - protein, 150 aa, Salmonella enterica
ATFMPKPMFGDNGSGMHCHMSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGIKNKIHPGEAMDKNLYDLPPN

SEQ ID NO: 5305 - protein, 127 aa, Salmonella enterica
FMPKPMFGDNGSGMHCHMSLAKNGTNLFSGDKYAGLSEQALYYIGGVIKHAKAINALANPTTNSYKRLVPGYEAPVMLAYSARNRSASIRIPVVASPKARRIEVRFPDPAANPVSVLCRPADGRSGR

SEQ ID NO: 5306 - protein, 659 aa, Coccidioides immitis RS
MAGLSLEDSQHAPSHATGRAPYIPPHLRGQQRAGPTMPVDGAAPQGRPPMNPGSWGPNGAPPNNWAPRGANNINGAPAWGAAGGGGARFDPNAYGHPGHRGGQSHGGAGSGAARGSGDGQWRDGKHIPGPPNARLERELFGVPNDPSKQHTGINFANYDDIPVEASGHDVPEPVTTFTNPPLDDHLISNIKLATYKTPTPVQKYSIPIVMGGRDLMACAQTGSGKTGGFLFPILSQAFKNGPSAVPTQNANQFSYGRQRKAYPTSLILAPTRELVSQIYDEARKFAYRSWVRPCVVYGGADIGSQLRQIERGCDLLVATPGRLVDLIERGRISLCNIKYLVLDEADRMLDMGFEPQIRRIVEGEDMPPVNGRQTLMFSATFPRDIQMLARDFLKDYVFLSVGRVGSTSENITQKVEYVEDADKRSVLLDILHTHGTGLTLIFVETKRMADSLSEFLINQNFPATAIHGDRTQRERERALEYFRNGRCPILVATAVAARGLDIPNVTHVVNYDLPTDIDDYVHRIGRTGRAGNTGLSTAFFNRGNRGVVRDLIELLKEAHQEVPAFLENIAREGSGYGGRGGGRGGGRGRGANATRDMRRMGGGGPPMSGTPSYSGGYGGGANNYGGSYSSAPSYGGYGGGYGGGSYGNPSGPTGPSSWW

SEQ ID NO: 5307 - protein, 401 aa, Prochlorococcus marinus str. NATL1A
MSKRSLSSLGAEDLCGKRVLVRVDFNVPLGDEGQITDDTRIRAALPTINDLLDKSARVILSAHFGRPKGEVNETMRLTAVAQRLSELLGKTVVKTESCIGAEAKSKVDAMSNGDVVLLENVRFISGEEKNDTEFAKELASLAEVYVNDAFGAAHRAHASTEGVTKFLSPCVAGYLMEKELKYLQGAIDQPKSPLAAIVGGSKVSSKIGVLESLIDKCDKIIVGGGMIFTFYKARGLSVGNSLVEEDKLELASALEKKAKEKGVEFLLPTDVVLADNFSPDANSKLSKVDAISEGWMGLDIGSESVELFQNALKDCKTVIWNGPMGVFEFEKFANGTNAIANTLAELSAQGCCTIIGGGDSVAAVEKAGLAKNMSHISTGGGASLELLEGKVLPGVSALDDA

SEQ ID NO: 5308 - protein, 1471 aa, Gibberella zeae PH-1
MAEKDLGRAEEAIAANHHTELADPAYRNSIETDSTRAEGRQDRAQNHGVSVEQAEADFAELQREFTGVSRASRRKSRASNADPEKNVAAEDEAEVESLFDLEAALRGGLDREKEAGIKSKHIGVYWDDLTVKGFGSMSNFVPTFPDAFVGFFDVITPVINMLGLGPKPPQVALLDKFRGVCKPGEMILVLGKPGSGCTTFLKSIANQRYGYTAVEGEVLYGPWANTDFDQYRGEAVYNAEDDVHHPTLTVEQTLGFAIDTKMPKKRPGNMSKAEFKESVISMLLKMFNIEHTRHTIVGDHFVRGVSGGERKRVSIAEGMITNAAVLSWDNSTRGLDASTALDFAKSLRIQTNLYKTTTFVSLYQASENIYNLFDKVLVIDGGKQVYFGPASTARNYFEGLGFAPRPRQTSADYLTGCTDEWEREYAPGRSEENAPHNPESLAEAFRASDAFKSLDAEMAEYKASLTQETDTHNDFQMAVKESKRGTSKRSIYQVGFHLQVWALMKRQFTLKLQDRFNLFFGWFRSIVIAIVLGTLYLDLGKNSASAFSKGGLLFIALLFNAFQAFSELAGTMTGRAIVNKHKAYAFHRPSALWIAQIFVDQVFAASQILLFCIIVYFMTNLVRDAGAFFTFFLMILSGNIGMTLFFRIIGCVSPDFDYAIKFAVIVITLFVVTSGYIIQYAQEQVWLRWIFWINILGLSFSSMMMNEFQRIDMECTADSLIPSGPGYTDIDYQVCTLAGSKAGTTFVSGSDYVAQGFSYHPGDLWRNWGIVLALIIFFLILNVALGELVNFGMGGNAATIFAKPNKERKALNEKLNDKRDARRKDRSNEEGSDITLKSESVLTWENLNYDVPVPGGTRRLLNNVFGYVRPGELTALMGASGAGKTTLLDVLAARKNIGVIHGDILVDAIAPGKEFQRSTSYAEQLDVHEPTQTVREAFRFSAELRQPYHVPMEERYAYVEEIISLLEMESIADAIIGTPEFGLTVEQRKRVTIGVELAAKPELMLFLDEPTSGLDSQSAFNIVRFLKKLAASGQAILCTIHQPNAALFENFDRLLLLQRGGRTVYFGDIGKDAHVLRSYLESHGAVAKPTDNIAEFMLEAIGAGSAPRVGDRDWADIWEDSAEFAQVKETIIHLKRERQEAVGSNTKNREMEREYASPFTHQMKVVSTRMFRSFWRMPNYLFTRIFAHVAVALITGLMYLNLDNSRSSLQNRVFIIFQVTVLPALIITQVEVLYHIKRALFFREQSSKMYSPFVFTSSVVLAEMPYSLLCAVAFYLPLYFMPGFQTDPSRAGFQFLMVLITEIFAVTLGQVLASITPSPMISTQFDPLVIISFALFCGVTIPPPQMPGFWRAWMYQLTPFTRLISGMVTTALHGVEVICKQSELNAFSAPPNMTCGEYMEPFFEQGGRGYLVNNSTQDCEYCAYKVGDEFYSTFNISFDNRWRDLGIYACFIVSNLIILVTASRYLNWNRR

SEQ ID NO: 5309 - protein, 496 aa, Mentha spicata
MELDLLSAIIILVATYIVSLLINQWRKSKSQQNLPPSPPKLPVIGHLHFLWGGLPQHVFRSIAQKYGPVAHVQLGEVYSVVLSSAEAAKQAMKVLDPNFADRFDGIGSRTMWYDKDDIIFSPYNDHWRQMRRICVTELLSPKNVRSFGYIRQEEIERLIRLLGSSGGAPVDVTEEVSKMSCVVVCRAAFGSVLKDQGSLAELVKESLALASGFELADLYPSSWLLNLLSLNKYRLQRMRRRLDHILDGFLEEHREKKSGEFGGEDIVDVLFRMQKGSDIKIPITSNCIKGFIFDTFSAGAETSSTTISWALSELMRNPAKMAKVQAEVREALKGKTVVDLSEVQELKYLRSVLKETLRLHPPFPLIPRQSREECEVNGYTIPAKTRIFINVWAIGRDPQYWEDPDTFRPERFDEVSRDFMGNDFEFIPFGAGRRICPGLHFGLANVEIPLAQLLYHFDWKLPQGMTDADLDMTETPGLSGPKKKNVCLVPTLYKSP

SEQ ID NO: 5310 - protein, 500 aa, Mentha x piperita
MELQISSAIIILVVTYTISLLIIKQWRKPKPQENLPPGPPKLPLIGHLHLLWGKLPQHALASVAKQYGPVAHVQLGEVFSVVLSSREATKEAMKLVDPACADRFESIGTKIMWYDNDDIIFSPYSVHWRQMRKICVSELLSARNVRSFGFIRQDEVSRLLGHLRSSAAAGEAVDLTERIATLTCSIICRAAFGSVIRDHEELVELVKDALSMASGFELADMFPSSKLLNLLCWNKSKLWRMRRRVDAILEAIVEEHKLKKSGEFGGEDIIDVLFRMQKDSQIKVPITTNAIKAFIFDTFSAGTETSSTTTLWVMAELMRNPEVMAKAQAEVRAALKGKTDWDVDDVQELKYMKSVVKETMRMHPPIPLIPRSCREECEVNGYTIPNKARIMINVWSMGRNPLYWEKPETFWPERFDQVSRDFMGNDFEFIPFGAGRRICPGLNFGLANVEVPLAQLLYHFDWKLAEGMNPSDMDMSEAEGLTGIRKNNLLLVPTPYDPSS

SEQ ID NO: 5311 - protein, 1517 aa, Gibberella zeae PH-1
MSALYGINANNDATAAKQGAPGAGSTGNNVPLADQHQNSTDEAINEKPPTSSPADTLGKGDDEDDSEMERRTSIVQALARSYSHASASHPGGQNPFQAGEDSPLNPNSPNFNAREWAKSIVALVRQDGNSFRSAGVCYQNLNVYGYGGASDYQSDVGNVWLGLEDVIGRVTGRSQQRIDILRNFDGVVHAGEMLVVLGPPGAGCSTTLKTIAGELNGIYVDDGSYFNYQGLSAKEMHSHHRGEAIYTAEIDVHFPMLSVGDTLTFAARARQPRELPQGLNRNDFADHLRDVVMAMFGISHTANTRVGNEYIRGVSGGERKRVTISEAALSGAPLQCWDNSTRGLDSANAIEFCKTLRLQTELFNNTAVVSIYQSPQSAYDLFDKATVIYEGRQIFFGRADAAKQYFVNLGFECPARQTTPDFLTSMTAPNERIVRDGFKGKVPRTPDEFATAWKNSAEYAALQVEIENYKVAHPIDGPDAEAFRASKQAQQAKSQRLKSPFTLSYMQQIQLCLWRGWLRLKGDPAITVGSLIGNFVMALIIGSVFYNLSETSSSFFQRGALLFFAVLMNAFASALEILVLYAQRPIVEKHSRYALYHPSAEAIASMLCDLPYKVANTIVFNLTLYFMTNLKREPGAFFFFILMSFVVVLVMSMIFRTIASASRSLFQALVPAAILILDLVIFTGFVIPKRYMLGWCKWLYYIDPIAYAFEAVVVNEFHNRDYECDQFIPNPGVTGYADVPSDSRVCSAVGAQPGRSAVNGDRYAEMQFGYKWENRWRNFGIVIAWIVLFTITYMTAAELVSEKKSKGEVLVYRRGHKPAAVANAEKKHSDPEAAMAHIGPMVTAERTRSRASGTKQAGGMLQEQTSVFQWQDVCYEVKIKDETRRILDHVDGWVKPGTLTALMGVSGAGKTTLLDCLADRTSMGVITGEMLVDGKPRDMSFQRKTGYVQQQDLHLQTSTVREALNFSALLRQPAHVPKQEKLDYVEQVIKLLDMEEYADAVVGVPGEGLNVEQRKRLTIGVELAAKPPLLLFVDEPTSGLDSQTSWAILDLLEKLTNAGQAILCTIHQPSAMLFQRFDRLLFLAKGGKTVYFGDIGENSHIMTSYFERMSGHTCPPEANPAEWMLEVIGAAPGSHTELDWFQTWRDSPECQEVKAELERIKREKEGVEDTDVDDGSYREFAAPFMVQFKEVLYRVFQQYWRTPVYIYSKAALCSLVALFIGFVFFKAPNTIQGLQNQMFAIFNLLTIFGQLVQQSMPQFVIQRSLYEVRERPSKVYSWKIFMLSQLIVELPWNSLMAVIMFFGWYYPVGLYQNASDAGQTTERGALMFLLLLAFLIFTATFSTMIIAGFETAEGGANVANLLFMLCLIFCGVLAGKDTLPGFWKFMYYVSPFTYLVGGMLATGVANTDVKCASNELVPIVPPNGSTCVEYMGDYISAVGGYFVDPDATQNCEFCTIDKTNTFLAGVNIDYADRWRNFGLLWVYIAFNMAFALFIYWLARMPKKSFKKAEKKKAAAKA

SEQ ID NO: 5312 - protein, 493 aa, Oryza sativa (indica cultivar-group)
MAFFLPLAFSLFLAVISAYVLQLLADARRRLPPGPWPLPLIGNLHQLDHLPHRSLARLAARHGPLMSLRLGTVRAVVASSPEMAREVLQRHNADIAARSFGDSMRAGGHCENSVVCLPPRLSWRALRRLSTVGLFSPRRLDAMRALLEEKVAELVRRVSGHAARGEAVDVGHAAHVAALGVLSRTMFSVDLDPEAAREVSDIVDEASVLGTGPNVSDFFPAIAPADLQGVRRRMARLVKRMYAIIDEQIERRMHGRTAGEPRKNDLLDVMLEEGESKEDSNEINRDAIRGLFTDLFTGGETTSHTMECAMAELLQCPNSMRRVQEELKSVIGTKQQMDEHDITKLPYLQAVIKETLRLHPPVPLPPYEAEATVEIQGYTIPKGAKVLINLWAINRCANAWTEPDKFMPERFYDSDITFMGRDFQLIPFGAGRRICLGLPLAHRMVHLMLGSLLHRFTWTLPAEAGKNGVDMRERFGLTLSFVVPLYVIAQEIQ

SEQ ID NO: 5313 - protein, 498 aa, Mentha x piperita
MELLQLWSALIILVVTYTISLLINQWRKPKPQGKFPPGPPKLPLIGHLHLLWGKLPQHALASVAKEYGPVAHVQLGEVFSVVLSSREATKEAMKLVDPACANRFESIGTRIMWYDNEDIIFSPYSEHWRQMRKICVSELLSSRNVRSFGFIRQDEVSRLLRHLRSSAGAAVDMTERIETLTCSIICRAAFGSVIRDNAELVGLVKDALSMASGFELADMFPSSKLLNLLCWNKSKLWRMRRRVDTILEAIVDEHKFKKSGEFGGEDIIDVLFRMQKDTQIKVPITTNSIKAFIFDTFSAGTETSSTTTLWVLAELMRNPAVMAKAQAEVRAALKEKTNWDVDDVQELKYMKSVVKETMRMHPPIPLIPRSCREECVVNGYTIPNKARIMINVWSMGRNPLYWEKPDTFWPERFDQVSKDFMGNDFEFVPFGAGRRICPGLNFGLANVEVPLAQLLYHFDWKLAEGMKPSDMDMSEAEGLTGILKNNLLLVPTPYDPSS

SEQ ID NO: 5314 - protein, 422 aa, Pseudomonas putida KT2440
MSDLKTAALEYHAQPRPGKLSVELSKPTATARDLALAYSPGVAEPVREIGRDPELAYKYTGKGNLVAVISDGTAILGLGDLGPLASKPVMEGKGVLFKRFAGIDVFDIEVESESPQAFIDTVRRISITFGGINLEDIKAPECFEIERTLIEQCDIPVFHDDQHGTAIVTAAGMINALEIAGKKLEEAKIVCLGAGAAAISCMKLLVSMGAKVENIFMIDRSGVIHAGRDDLNQYKAQFAHATDKRTLADALDGADVFVGLSGPNLLSPEGLKSMAANPIVFACSNPDPEISPELAHATRNDVIMATGRSDYPNQVNNVLGFPFIFRGALDVRAKRINEEMKIAAAIALKDLAKLPVPKEVCEAYGVEGLEFGREYIIPKPLDARLITVVSDAVAKAAIESGVATLPYPKHYPLTSVDEVFNG

SEQ ID NO: 5315 - protein, 416 aa, Idiomarina loihiensis L2TR
MSTEQNPSSFQSLGLSDDILRAVTECGYTTPTPIQQQAIPTVMAGHDLLAAAQTGTGKTAGFTLPLLHKLSQTKTDGKPVIKALILTPTRELAAQVEDNLNTYAKYTGLKSLVIFGGVGINPQISALRRGVDILVATPGRLLDHSRQGTVDLSKIDVLILDEADRMLDMGFIHDIKKVMKLIPEKRQTLLFSATFSSEIKALSQQFMQQPKLIEVARQNAAADTIEQRVYPVDKKRKRELLSYLIGSRNWRQVLVFTRTKHGANRLATQLTDDGLPAMAIHGNKSQGARTKALAQFKAGKLRVLVATDIAARGIDIDELPHVINFELPQVAEDYVHRIGRTGRAGSEGEAASLVCVDEHKLLRDIEKLTKNEIPREVIPGFEPDPSIKPEPIQKPRTGRPQNSRRAPRQKRPDTRR

SEQ ID NO: 5316 - protein, 338 aa, Xanthobacter autotrophicus Py2
MMRSPANKVPADDGPHVHPASVVSALATLDAEKAGLAALAEAMAGPLGAAFDVAVATIQNSHGRVIVTGMGKSGHVARKIAATLASTGTPAHYVHPAEASHGDLGMITTDDVIVALSWSGETVELHDIVDYSRRFDVPLIAFTSNTESALASSASVVLSLPVAQEACPHGLAPTTSTLMQLALGDALAVALLQSRGFTALDFRQFHPGGKLGASLKFVRDVMRQGDAVPVVAAGTLMGAALVEMSTKGLGCVGVVGPDGALTGIVTDGDLRRHMANDLPTRTVDEIMTAAPKTVRPDQLASEALNILNSRKITALMVVEGQAPVGVLHIHDLLLTGIA

SEQ ID NO: 5317 - protein, 378 aa, Dechloromonas aromatica RCB
MSKRDFYEILGVNRDASDDEIKKAYRKLAMKHHPDRNPDNPGAEEKFKEAKEAYEILSDSQKRAAYDQFGHAGVEQGGMGGGGFGGGGGGFADAFGGIFDEIFGGRAGGSGGGRSNIYRGADLRYNLEITLEQAAHGTETKIRIPTMEVCEPCNGSGAKAGTQPKTCPTCGGSGQVRLQQGFFSIQQTCHKCHGTGRFIADPCKSCDGAGRIKQHKTLAVKIPAGVDEGDRIRLSGEGEHGVNGGPPGDLYVQIHLKPHAVFTRDHNDLHCEMPISFTAAALGGEIEIPTLDGAAAIKIPAETQSGRVFRLRGKGIKGVRSHTHGDLMCHVVVETPVNLTERQKELLRELEESSKDNSGKHNPRSKSWMDKVKDFFAE

SEQ ID NO: 5318 - protein, 658 aa, Geobacillus stearothermophilus
MKYECIIDIPIEIGKRYLVYDHQGAVTDLQIGAVVRTAPFDDRFFYDGDLGVAYTREKTIFKVWAPTATEVKVKLIDPKTEKAEYIALERLEKGVWTTTVFGDMEGRYYTYVVCVNAVWREAVDPYAVAVSVNGEYGVIIDLAKTRTEKPPIPPITSPADAVIYEMHIRDFTIHPESGVTHKGKYLGLTEPETKGPNNTPTGLSYLKELGVTHVELLPFNDFAGVDERNPLQQYNWGYNPLHYNAPEGSYATDPNDPYARIRELKRAIHTLQSNGIRVIMDVVYNHVYIRDQSSFEKIVPGYYFRYDAYGNPSNGTGVGNDIASERKMVRKWIIDSVRFWVEEYHVNGFRFDLMGILDVETMKAVREMLDTLDPSILVFGEGWDLPTPLSSEQKATMQNAEKLPRIGYFNDYFRDSVKGSTFQLPDRGFALGDSDDREKVKVAISGSIGKKNGLFLHPTQTINYVESHDNHTFWDKMEIANGHESEQTRKKRQKLATAIVLLSQGIPFLHSGQEFYRTKQGIDNSYNAPDSINQIDWKRKSEHEDDVRYVQGLIRIRKSHRAFRFTTEAEINNHLFFLEPTPASIIAYHLRDVQQYGPWRDIIVIHHNQEEKQSVFLPDEEEWHVICDGIRSGTVPLFSVHKEINLDGIGTWVLVKQS

SEQ ID NO: 5319 - protein, 271 aa, Haemophilus influenzae R2866
MINKDTQLCMSLSGRPGNFGTTFHNYLYDKLGLNFIYKAFTTQDIERAIKGVRALGIRGCAVSMPFKEACMPFLDEIHSSAQAIESVNTIVNDNGFLRAYNTDYIAIVKLIEKYHLNKNAKVIVHGSGGMAKAVVAAFKNSGFEKLKIYARNVKTGQYLAALYGYAYINSLENQQADILVNVTPIGMKGGKEEIDLAFPKAFIDNASVAFDVVAMPVETPFIRYAQARGKQTISGAEVIVLQAVEQFKLYTHQRPSDELIAEAAAFARAKS

SEQ ID NO: 5320 - protein, 551 aa, Myxococcus xanthus DK 1622
MINAHTRVPPPKNEPVLSYAPGTTERREVQAELKRMAGEQIDIPVIIGGKHIRTGKTDTVRMPHNHQHVLATLHEADASHAEQAIQAALAVKDDWARMPFQSRAAIFLRAAELLASRYRPILNAATMLGQGKTAHQAEIDAACEAIDFIRFNVHFAEQILGWQPEAAYQTWNMTDYRPLDGFVFAVAPFNFTAIALNLATAPAIMGNVVLFKPSSTAALSAWYIMELLREAGLPDGVINMLPGDGPTVGNPVLASPHLGGIHFTGSTPTFNAMWRTVGENISRYKQYPRIVGETGGKDFIVAHPSAADDLEALAVAIVRGGFEYQGQKCSAASRVFIPESLWPKLKPRLQALISEIRMGDVSDFRNFMGAVIDEKSFKKVSSYIDLAKSDSGASIVAGGDVDRKQGWFVKPTLVQLDSPTHRILREEIFAPLVGLHVYPDAKYEETLREVDQAASYALTGAVFARDRKAIDTALRELRHAAGNFYINDKPTGAVVGQQPFGGGRASGTNDKAGSALNLVRWTSPRTIKETFVPPVKVPYPFMDNDPNEGAI

SEQ ID NO: 5321 - protein, 441 aa, Pseudomonas putida GB-1
MIDQATGMKSAERYRVENVERAHQFPGFFQDGKYYLGPELLTAVGWLEGTRFIYDSLDAEGEPVFPNREAGIIEGLTLTLVDGTALGLSRIEASEALADFDTSTSGTKEGALGDSYPIKGPLRGKVVVITGASSGIGRAAAHAFACKGARLVLAARDEEALFDVLDECTDCGTDAIAIMTDVTRNDQVQALAEQAAEFGHGRIDIWVNNAGVGAVGNFEETPLEAHEQVIQTDLIGYLRGAYVALPFFKTQGSGILINTLSLGSWVAQPYAAAYSASKFGLRGLTEALRGELTEFPDIHVCDIYPAVMDTPGFRDGGNYTGHALTPLGPIYDPELVAKAMVACAISPRAHTTVGATARLAHLASFLVPGLPQLSGWLTRWGLSRSPRAEISSGNLFEPPNGRRSVDGGWRSQRSKTPLLVTAAVLGIIAGFVITRSQRRHP

SEQ ID NO: 5322 - protein, 399 aa, Bacillus anthracis str. Sterne
MYWNDGNEGSEYRMISHLFQTYGRRTVEFVKGNGTKVIDNNGKQYLDFTSGIGVCNLGHCHPTVMKAVQEQLNDIWHISNLFTNSLQEEVASLLTENIALDYVFFCNSGAEANEAALKLARKHTGKSLVVTCEQSFHGRTFGTMSATGQNKVKEGFGPLLPSFLHTPFNDIKALKEVMNEEVAAVMVEVVQGEGGVIPADLSFLKEIETLCKKFGSLFIIDEVQTGIGRTGTLFAYEQMGIDPHIVTTAKALGNGIPVGAMIGRKELGTSFTAGSHGSTFGGNYVAMAAAKEVLQVSKRLSFLKEVQEKGEYVLQKLQEELQHVECIQNIRGKGLMVGIECTHEVASFIEQLEKEGLLVLQAGPNVIRLLPPLIVTNEELEQAVYMIKKVVCTKNVSII

SEQ ID NO: 5323 - protein, 147 aa, Salmonella enterica
TFMPKPMFGDNGSGMHCHMSLAKNGTNLFSGDKYAGLSEQALYYIGGVIKHAKAINALANPTTNSYKRLVPGYEAPVMLAYSARNRSASIRIPVVESRKARRIEVRFPDPAGNPYLCFAALLMAGLDGIKNKIHPGEAMDKNLYDLP

SEQ ID NO: 5324 - protein, 105 aa, Zea mays
  misc_feature (36)..(36): Xaa can be any naturally occurring amino acid
  misc_feature (75)..(75): Xaa can be any naturally occurring amino acid
  misc_feature (83)..(83): Xaa can be any naturally occurring amino acid
MSGRGKGGKGLGKGGAKRHRKVLRDNIQGITKPAIXRRLARRGGVKRISGLIYEETRGVLKIFLENVIRDAVTYXEHARRKTXVTAMDVVYALKRQGRTLYGFGG

SEQ ID NO: 5325 - protein, 448 aa, Streptococcus pneumoniae TIGR4
MTSAKEYIQSVFETVKARNGHEAEFLQAVEEFFNTLEPVFEKHPEYIEENILARITEPERVVSFRVPWVDRDGKIQVNRGYRVQFNSAVGPYKGGLRFHPTVNQGILKFLGFEQIFKNVLTGLPIGGGKGGSDFDPKGKTDAEVMRFCQSFMTELQKHIGPSLDVPAGDIGVGGREIGYLYGQYKRLNQFDAGVLTGKPLGFGGSLIRPEATGYGLVYYTEEMLKANGNSFAGKKVVISGSGNVAQYALQKATELGATVISVSDSNGYVIDENGIDFDLLVDVKEKRRARLTEYAAEKATATYHEGTVWTYAGNYDIALPCATQNEINGEAAKRLVAQGVICVSEGANMPSDLDAIKVYKENGIFYGPAKAANAGGVAVSALEMSQNSLRLSWTREEVDGRLKDIMTNIFNTAKTTSETYGLDKDYLAGANIAAFENVANAMIAQGIV

SEQ ID NO: 5326 - protein, 146 aa, Salmonella enterica
FMPKPMFGDNGSGMHCHMSLAKNGTNLFSGDKYAGLSEQALYYIGGVIKHAKAINALANPTTNSYKRLVPGYEAPVMLAYSARNRSASIRIPVVASPKARRMEVRFPDPAANPYLCFAALLMAGLDGIKNKIHPGEAMDKNLYDLP

SEQ ID NO: 5327 - protein, 235 aa, Nostoc punctiforme PCC 73102; identical to SEQ ID NO: 1095

SEQ ID NO: 5328 - protein, 486 aa, Burkholderia xenovorans LB400
MRYSIKLNDQALLRQHAYINGEWQTADNGSTFTITDPSSGDLLAQVPMMGAAEARRAIHAACIAWSVWRKKTAKDRAIVMRRWFNLVLENADDLATILTAEQGKPLAEAKGEIAYAASFIEWFAEEGKRVSGDTPATPDADKRIIVTKEPIGVCAAITPWNFPAAMITRKVAPALAAGCTIVVKPAEATPLTALALAVLAERAGIPSGVLNVITGDPRAIGAELTANPGVRKLSFTGSTAIGRMLMAQSAPTIKKVTLELGGNAPFIVFDDADIDNAVEGAVVSKYRNSGQTCVCPNRFYVHDAVYDAFVEKLSKAVFELKVGSGRDPGVSIGPLISEAAVKKVEAHIADALQKGAKLEVGGARHELGHSFFQPTVLSDVTPDMMLSREETFGPLAAVSRFSSEDEVVRLANDTEYGLAAYFYSRNIARVWRLAEALEYGMVGINTGLISNEVAPFGGVKESGIGREGSRYGIEDYLVIKYLCLAS

SEQ ID NO: 5329 - protein, 457 aa, Ralstonia eutropha JMP134
MPQSQPAKGGVIDVQALIDERPFTGYQWLILILCFLIVAVDGFDTAAIGYIAPALVQDWGIQKSELGPVMSAALFGLAFGAIFAGPLADRVGRKRVLVLSVFFFGLCSVATAFAPSLGWLTALRFLTGLGLGAAMPNAVTLTSEFAPQRRRAVLVNTMFCGFPLGSAVGGFVAAAMIPHYGWHSVLLLGGVLPVVLAVLLVFLLPESVRYMVLRSYPVEQIGKVLQRVTGAATTATGYVIGEQAPATRSPIGTVLSPGYRLGSAMLWSTYFMGLVIFYLLTSWMPTLMKDAGFTIERASFLTALFPLGGGIGTIAAGWFMDRFNPNKVIALTYAATGVLIYAVGQGTGSQVLLGVLIFLAGTAMNGAQSSMPSLAAAFYPTQGRATGVAWMLGIGRFGGITGALLGAELLRLQLGFDMIFTLLAVPAFLAAIALMVKHFGGRPAGTTETGGRPVATH

SEQ ID NO: 5330 - protein, 441 aa, Ralstonia eutropha JMP134
MTTIHKEIPATAVPGHSLADKIRAGFALGKVRWGMLALVFFATTLNYVDRAALGVLQPVLAKAMAWTAQDYANINFWFQVGYAIGFALQGRFIDMVGVKRAFALAVLLWSIACGAHALAASAVGFMICRFFLGLTEAANYPACVKTTRTWFPASERAVATGIFNAGTNVGAMLTPIMLPLILQAWGWQAAFLIVGAMGALWLVFWMIKYHNPDEHPTVTQAELAHVSRDVEPAPQRIPYSKILRMRGTWAFAFAYAITAPVFWFYLYWLPPFLNQQYQLGISVTQMGIPLIVIYLCADIGSVGGGALSSWLISHGMAAVRARLLSMLIFAVCITSIVFAAGASSLWTAVAAISVAIGAHQAWTANIWSMVMDYTPKHVVSSVFGFGGMIGAVGGMFMTQLVGYVLTATHNNYAVLFTMIPCAYFIALTWMFLTAPRKVPEH

SEQ ID NO: 5331 - protein, 433 aa, Prochlorococcus marinus str. NATL1A
MADSLELVIDTIMAREVLDSRGNPTVEAEVLLEGGAIGRSIVPSGASTGAHEAHELRDGGKRYLGKGVLKAVNHIEENIAPALCGLSSLDQATVDSVMKQLDDTDNKSNLGANSILAVSMATARAAANGLGLPLYRYLGGPMSSLLPVPLMNVINGGEHAANNLDFQEFMLVPHGAESFREALRMGAEVFHTLKDLLSQKGLSTAVGDEGGFAPNLESNKAAGDLLMQAIEQAGFKPGEQVSLALDVASTEFYEEGQYCYGGNSYSSEQMVEELAGLVNSFPIVSIEDGLAEDDWDGWSLLTKKLGKSVQLVGDDLFVTNTLRLQRGIDENIANSILIKVNQIGSLTETLEAIELASRSSYTTVISHRSGETEDTTIADLSVATKSGQIKTGSLSRSERVAKYNQLLRIEDELGSQATYAGLVGLGPRGSLKG

SEQ ID NO: 5332 - protein, 377 aa, Ulva pertusa
MGDEGEVSAVVCDNGSGVVKAGFAGDDAPRSIFPSIVGRPRHQGVMVGMGQKDAYVGEEANAKRGILALKYPIEHGIVTDWDDMEKIWHHTFYNELRVAPEEHPILLTEAPMNPKLNREKMTQLMFETFNAPAMYVQIQAVLSLYASGRTTGIVLDCGDGVSHTVPIYEGYAMPHAIQRLDLAGRDLTEYMMRILTDRGYSFTTSAEREIVRDIKEKLCYVALDYEQEMATSMSSSTLEKTYELPDGQVITVGSERFRCPEVLFNPALLGMEAVGVHDTTFNSIMKCDVDIRKDLYGNIVLSGGTTMFAGIADRMSKEVSALAPSSMKIKVVAPPERKFSVWIGGSILASLSTFQQMWISKAEYDESGPSIVHRKCF

SEQ ID NO: 5333 - protein, 375 aa, Mastocarpus papillatus
VATAGGKFSAMVPSGASTGIYEALELRDGDKSSYLGKGVDKAVANVKDKISEAIMGMDASDQGAVDAKMIELDGTEGGFKKNLGANAILGVSMAVARAGANAKGVPLYKHLNNLAGNPKMLLPVPSLNVINGGTHAGNKLAMQEFMILPVGASTFREAMKMGAETYQYLKKVIKKKYGLDATSVGDEGGFAPNIQDNTEGLKLLEEAIEMAGYTGKIKVGMDVAASEFWKEDKEVYDLDFKNDDNDGSQCLTGEKLGEMYKDFISNFPMISIEDPFDQDDWESYAKLTAAVGEGVQIVGDDLLVTNPNRIQTGIDKKACNALLLKVNQIGSITEAIQASKMSRDAGWGVMVSHRSGETEDNFIADLCVGLGTAQI

SEQ ID NO: 5334 - protein, 470 aa, Mycobacterium tuberculosis H37Rv
MTLSSGEPSAVGGRHRVVIIGSGFGGLNAAKALKRADVDITLISKTTTHLFQPLLYQVATGILSEGDIAPTTRLILRRQKNVRVLLGEVNAIDLKAQTVTSKLMDMTTVTPYDSLIVAAGAQQSYFGNDEFATFAPGMKTIDDALELRGRILGAFEAAEVSTDHAERERRLTFVVVGAGPTGVEVAGQIVELAERTLAGAFRTITPSECRVILLDAAPAVLPPMGPKLGLKAQRRLEKMDVEVQLNAMVTAVDYKGITIKEKDGGERRIECACKVWAAGVAASPLGKMIAEGSDGTEIDRAGRVIVEPDLTVKGHPNVFVVGDLMFVPGVPGVAQGAIQGARYATTVIKHMVKGNDDPANRKPFHYFNKGSMATISRHSAVAQVGKLEFAGYFAWLAWLVLHLVYLVGYRNRIAALFAWGISFMGRARGQMAITSQMIYARLVMTLMEQQAQGALAAAEQAEHAEQEAAG

SEQ ID NO: 5335 - protein, 318 aa, Escherichia coli CFT073
MAHFMDIPNMQNAGSLVVLGSINADHILNLQSFPTPGETVTGNHYQVAFGGKGANQAVAAGRSGANIAFIACTGDDSIGESVRQQLATDNIDISPVSVIKGESTGVALIFVNGEGENVIGIHAGANAALSPALVEAQRERIANASALLMQLESPLESVMAAAKIAHQNKTIVALNPAPARELPDELLALVDIITPNETEAEKLTGIRVENDEDAAKAAQVLHEKGIRTVLITLGSRGVWASVNGEGQRVPGFRVQAVDTIAAGDTFNGALITALLEEKPLPEAIRFAHAAAAIAVTRKGAQPSVPWREEIDAFLDRQR

SEQ ID NO: 5336 - protein, 331 aa, Idiomarina loihiensis L2TR
MAAFGTVFMPQMTMATFENSDWSKPELVSSDAIQLHPGAHVLHYASTCFEGLKAFRHEDGSINLFRMNRNIERMQQSSRLLSLPAFDAGLLQKMITDVVKHFSDEVPKPPGSMYIRPTHIGTEAAIGKAASPTSSSMLYVLLSPVGDYFSGGDKTLRLLLEEDGSRCAAHMGMVKSGGNYASALQPILQARESVNADQVLFCPNGDVQETGAANFLLIDGNEIITKALDSSFLHGVTRDSILTIARDMGMTVSERQLSVDELLERASKPDCEAALSGTAAVLAPVGTLIHNGKEFSVGSGKSGATTLKLRKALNDIQWGKAEDKHSWLTKI

SEQ ID NO: 5337 - protein, 400 aa, Pseudomonas putida GB-1
MRALTYHGANDVRVDNVPDPIIEEADDIILRVTATAICGSDLHLYRGKIPETEAGDIFGHEFMGIVEDTGSAVTNLQIGDRVVIPFVIACGSCFFCQHDLFAACETTNTGRGSINNKKGIPPGAALFGYSHLYGGIPGGQADYVRVPKGNVGPFKVPTDLTDDKVLFLSDILPTAWQAVINAEIGQGSSVAIYGAGPVGLLSAACARMLGAQTIFMVDDNDYRLAYAQDAYGVVPINFEQDDDPADSIIRQTPGMRGVDAVIDAVGFEAKGSTAETVMTALKIEGSSGKALRQSIAAVRRGGVVSVPGVYAGFIHGFMFGDAFDKGLTFKMGQTHVQKYLPELLEHIEAGRLRPELIVTHRLALEEAAMGYKMFDQKQDNCRKVILVPGAAAGTLGPDYV

SEQ ID NO: 5338 - protein, 319 aa, Gloeobacter violaceus PCC 7421
MSEPAEQPESVKGWTRLTRRRDVLDDPYIHRYQRRHFFFFDILPAIGTVAAVALSWVWPPGPIEGSLLLGLWLVTGFGVTVGYHRLFTHRSFSAAPWVQALLAVSGSMAGQGSVISWVALHRRHHELSDQPGDPHSPNLHGQDPVGRLRGLLHAHLLWMRQHEYPNVVCYASDLLRDRSLLQVNGLYLWWVLLGLAIPALVGWWLHGHVAGLLLGFLWGGAVRMFVLGNIIWSINSFLHSFGPRLFATREHSRNSGWLALASFGESWHNNHHAFPTSASFGLDWYRLDPGYWLIWLLARLGLAWDVKVPSEEQIRLKRA

SEQ ID NO: 5339 - protein, 169 aa, Oryza sativa (indica cultivar-group)
MAATADNGEKMILLISSDGERFELSEAAASQSKTLSHMIEDDCTDNGVPLPNVTAVVLAKVVEYFKKHAAVTPKTATEAVAADKAKREKELKSFDAEFVDVDRTMLLELILAANFLNAQDLLDLTCQHAADLIKDMSVEEVREVFNITNDFTPEEEAEVRKENAWAFDN

SEQ ID NO: 5340 - protein, 386 aa, Arabidopsis thaliana
MASSSSSSLSFSTSKKNKTFFKKPNSAFSSSRATSLIKRQQTVFKKAKELSILCDIDVCVICYGSNGELKTWPEEREKVKAIARRYGELSETKRRKGSVDLHEFLEKMNKDDPEKEEKKKIKVRRVPKVKYPVWDPRFDNYSVEQLMGLVQSLERNLTRIQHRTCAVVEAQGQRRVQYTNMANQELMMANTMNQLQQHSNQVSMYLWNHGNGAFSQIPVSALASNQTQSLAPIPPELMIYPNSDAGNYSGSLGVQGTGINGLQNMNMLTYNNINSVNDFSKQFDQNSRAESYSSLLGVHEDGNNEFENPNMSSRNNFNVQDCAGLLGMQGAGTNGLQSMNMHDYSNNNSINSNGLSHQYVQFPTYNSQHQDRVFNLDQNGNNTRSL

SEQ ID NO: 5341 - protein, 330 aa, Gloeobacter violaceus PCC 7421
MLYLYLGSTMETDHFPAPSSKYLPGGKVRVTTANAHLQARYRSVGLVTLGIPALGTLAALGLLAFQPLRLLDVALLLGMYVLTVFGLEVGYHRHFAHGAFKASPPVRVTLAVLGGMAASGPLIYWAATHRLHHHFPDEPGDPHSPYLKADRPLERLPGLWHAHTGWMLDSEITNCALLARDLLRDLNVSRLNRRYYLWVLLGLLLPALVGGLASATWMGALQGLLWGGMVRIFLVHQLYIGALNSVCHLLGDRPFATGDLSTNNAWLALPTLGESWHNNHHAFCSSAVTGLEWWQIDPSGWCIRLLAAVGLVWEVKIPNQATIAARRQVR

SEQ ID NO: 5342 - protein, 169 aa, Oryza sativa (indica cultivar-group)
MAATADNGEKMILLISSDGERFELSEAAASQSKTLSHMIEDDCTDNGVPLPNVTAVVLAKVVEYFKKHAAVTPKPATEAVAADKAKREEELKSFDAEFVDVDRTMLFELILAANFLNAQDLLDLTCQHAADLIKDMSVEEVREVFNITNDFTPEEEAEVRKENAWAFDN

SEQ ID NO: 5343 - protein, 344 aa, Cryptococcus neoformans var. neoformans B-3501A
MTSPQKNVQIILNERPQKGPVTDTTFKSKTVDVPELKDGEILARVDYASVDPTMRGWINEGRSYMPPVEIGAAMRANGLGTVIASKAKDFKAGDKVLGLLNWQEYYVGPTEGLTKRETPEGARDVDHLGLFGMTGLTAYFGMIEVGKIKDGDHVVISGAAGAVGLVATQIALAHPNCKVTVIAGSKEKLDYLKKLGAHNALNYKDDDFKEQFKKVGLIDVYFDNVGGKILDMALAQLNPFARIVACGAISQYNATVPDPIYNYFNIISMKATMRGFIVFQFADRFPEGIKYLSDLVKKGKMEFNYHIIDGLDSCVQALREMFEGKNLGKTVVRVSNEAAKGSKL

SEQ ID NO: 5344 - protein, 269 aa, Arabidopsis thaliana; identical to SEQ ID NO: 890

SEQ ID NO: 5345 - protein, 1068 aa, Dechloromonas aromatica RCB
MPKRTDIKSVLIIGAGPIIIGQACEFDYSGAQACKALREEGYKVILVNSNPATIMTDPEMADVTYIEPITWQVVAKIIEKERPDALLPTMGGQTALNCALDLDREGVLAKFNVELIGASKEAIDKAEDRQKFKDAMTKIGLGSAKSATAHSMEEAYQVQAVIGFPTIIRPSFTLGGTGGGIAYNMEEFEIICKRGLEASPTNELLIEESLLGWKEYEMEVVRDKADNCIIICSIENLDPMGVHTGDSITVAPAQTLTDKEYQILRNASIAVLREIGVDTGGSNVQFSINPKDGRMIVIEMNPRVSRSSALASKATGFPIAKIAAKLSVGYTLDELSNDITGGKTPASFEPSIDYVVTKVPRFAFEKFPQADSTLTTQMKSVGEVMAIGRTFQESLQKALRGLEVGVDGFNLKTVDPETIDEQLARPTPDRLWYVADAFGIGMSVEKVFDLTKIDPWFLVQIKEIVDLELAVEKREFSSLTAEELRYLKRKGFADRRLAHLTKTSETAVRERRHELKVRPVYKRVDTCAAEFSTGTAYMYSTYEDECEAMPTDKKKIMVLGGGPNRIGQGIEFDYCCVHAAMAMREDGYETIMVNCNPETVSTDYDTSDRLYFEPLTLEDVLEICAIEKPVGVIVQYGGQTPLKLALALEANGVPIIGTTPESIDIAEDRERFQKLLHDLGLKQPPNRTARTEEDALRLAQEIGYPLVVRPSYVLGGRAMEIVHEQKDLERYMREAVKVSNDSPVLLDRFLNDAVECDVDALSDGEEVIIGGVMEHIEQAGVHSGDSACSLPPYSLSAAVQDELRRQTKLMAKALNVCGLMNVQFAIKDNDVYVLEVNPRASRTVPFVSKATGLQLAKIAARCMAGRSLKDQGITKEIIPPYYSVKEAVFPFVKFPGVDTILGPEMKSTGEVMGVGVTFAEAFVKSQLAAGVKLPKSGKVFLSVKDSDKAKAIEIARHLHDAGFHLAATRGTAHAIEAAGLPVQSVNKVTEGRPHIVDMIKNNEIALIINTVEEKRGAINDSRSIRTSGLQARVTMYTTIWGAEAAAEGIRHLGELVVYPIQALHEQLH

SEQ ID NO: 5346 - protein, 980 aa, Oryza sativa (indica cultivar-group)
MTPLLLLLLALAAGAGAASFPADFANLFAAKAALSDPSSALAAWDPGLSPSLSPCRWPHLLCSNPSSSSSAAIAAVLLSNLSLAGEFPAPLCELRSLARLDLSYNDLTGPLPGCLAAMPSLRHLDLAGNGFSGEVPRSYGAGFPSLLTLSLAGNELSGELPAFLANVSALEELLLAYNQFAPSPLPETFTGIRRLQVLWLAGCNLVGDIPPSIGSLKSLVNLDLSTNNLTGEIPSSIGGLESVVQLELYSNQLTGSLPEGMSALKKLRFFDAAMNQLSGEIPADLFLAPRLESLHLYQNELTGRVPATVADAAALNDLRLFTNRLVGELPPEFGKKSPLEFLDLSDNRISGEIPATLCSAGKLEQLLMLNNELVGPIPAELGQCRTLTRVRLPNNRLSGAVPPDMWGLPHLYLLELAGNALSGAVAPAIATARNLSQLLISDNRFAGALPPELGSLPNLFELSASNNVFSGPLPASLTVVTTLGRLDLRNNSLSGELPRGVRRWQKLTQLDLADNRLTGNIPAELGDLPVLNSLDLSNNELTGGVPVQLENLKLSLLNLSNNRLAGVLPPLFAGEMYKDSFLGNPGLCTGGSCSSGRRARAGRRGLVGSVTVAVAGVILLLGAAWFAHRYRSQRRWSTEDAAGEKSRWVVTSFHKAEFDEEDILSCLDDEDNVVGTGAAGKVYKAVLGNGARGGDDGAVVAVKKLWANGGAAKKAAAMEAGGGGGGGGGGGKDTFEAEVATLGRIRHKNIVKLWCSLSSGDRRLLVYEYMPNGSLGDLLHGGKGGLLDWPARHRIMVDAAEGLSYLHHDCAPPIVHRDVKSNNILLDADLRAKVADFGVARAVSAAPPTAVSAIAGSCGYIAPEYSYTLRITEKSDVYSFGVVMLELLTGKAPAGPELGEKDLVRWVCGGVERDGVDRVLDARLAGAPRDETRRALNVALLCASSLPINRPSMRSVVKLLLELRPESKEKAMAEEKPLLV

SEQ ID NO: 5347 - protein, 335 aa, Triticum aestivum
  misc_feature (55)..(55): Xaa can be any naturally occurring amino acid
MSSSGAGEEGAAAPQGPLPVEHRKGANGLDKVVLREARRISAEVYLYGGHVTSWXKDEHGEELLFVSNKAIFKPPKAIRGGIPICFPQFSNFGQLEAHGFARNKIWSVDTDPPPFPVPISSRAYIDLILKPTDEDLKIWPHSFEYRLRVALGPGGDLMLTSRIRNTNADGKPFSFTFAYHTYFSISDISEIRVEGLETLDYLDNLQDRARFTEQGDAIVFESELDRIYLGTPSKIAIIDHEKKRTFVVRKGGLPDAVVWNPWDKKAKAMADFGDDEYKRMVCVEAAAIEKAITLKPGEEWTGKLELSAVPSSYYSGQLDPDRVIQDSVVPEDSVS

SEQ ID NO: 5348 - protein, 144 aa, Salmonella enterica
ATFMPKPMFGDNGSGMHCHMSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGIKNKIHPGEAMDKNL

SEQ ID NO: 5349 - protein, 279 aa, Rhodococcus sp. RHA1
MQHRESSFAGVGGIPIVYDVWLPERRPRGVLVLCHGFGEHARRYDHVIERLGELDLAIYAPDHRGHGRSGGKRVHLKDWTEFTDDLHQLFGIASTDWPGTDRFLLGHSMGGSIALTYALDHQQDLKALMLSGPAVDVTSGTPRIVVEIGKLVGRFLPGVPVESLDAKLVSRDPAVVSAYEEDPLVHHGKVPAGIARGMILAAERLPERLPSLTIPLLLQHGQDDGLASVHGTELIAEYVGSEDLTVEIYENLFHEVFNEPENEEVLDDLVEWLRPRVQA

SEQ ID NO: 5350 - protein, 249 aa, Fragaria x ananassa
MGRGRVELKRIENKINRQVTFAKRRNGLLKKAYELSILCDAEVALIIFSNRGKLYEFCSSSSMLKTLERYQKCSYGAMEVQKPAKELEESSYREYLKLKTRCESLQQTQRNLLGEDLGPLNTKELEQLERQLESSLKHVRSTKTQHMIDLLSDLQSKEHMLIEANRDLKTKLDEIDSRTQLRQTWEHGHDHQTMLYGTQHAQTQGLMFQPLDCNPTLQIGYNAVVSQEMPAATPAHAQPVNGFIPGWML

SEQ ID NO: 5351 - protein, 515 aa, Salmonella enterica subsp. enterica serovar Paratyphi A str.
MMDHNMKKNPVSIPHSIWLADDIKRLERDAADAFGLTLYELMLRAGDAAFRVARDSYPDTRHWLVLCGHGNNGGDGYVVARLAQAAGISVTLLAQESDKPLPEEAAQARDAWLNAGGIIHAADIIWPEATDLIIDTLLGTGIAQAPRDPVAGLIEQANAHPAPVVAVDIPSGLLAQTGATPGAVISAAHTVTFIALKPGLLTGKARDVTGILHYDALGLEGWLASQTPPLRRFDATQLGQWLTPRRPTSHKGDHGRLAIIGGDQGTAGAIRMAGEAALRTGAGLVRVLTRGENIAPLLTARPELIVHELTPQSLEESLTWADVVVIGPGLGQQEWGKKALQKVENVRKPMLWDADALNLLAINPDKRHNRVITPHPGEAARLLGCSVAEIESDRLLSAQRLVKRYGGVVVLKGAGTIIAAEHHPLAIIDAGNAGMASGGMGDVLSGIIGALLGQKFTPYDAACVGCVAHGAAADLLAARYGARGMLATDLFTTLRRIVNPDVIDVNHDESSNSAT

SEQ ID NO: 5352 - protein, 331 aa, Glycine max
MASSTNALPPTGNGLIVSFGEMLIDFVPTVSGVSLAEAPGFLKAPGGAPANVAIAVARLGGKAAFVGKLGDDEFGHMLAGILKENDVRSDGINFDQGARTALAFVTLRADGEREFMFYRNPSADMLLTPEDLNLELIRSAKVFHYGSISLIVEPCRSAHLKAMEVAREAGCLLSYDPNLRLPLWPSAEEARQQILSIWDKADVIKVSDVELEFLTGSDKIDDASALSLWHPNLKLLLVTLGEHGSRYYTKNFHGSVEAFHVSTVDTTGAGDSFVGALLSKIVDDQSVLEDEARLREVLKFANACGAITTTKKGAIPALPTEADALNLIKEA

SEQ ID NO: 5353 - protein, 491 aa, Ralstonia solanacearum GMI1000
MGTVSVEPGSYRAEPPRNPGEVIDLIRQRAVQVVDLRFTDLPGLWQHFSITLPEVNDELFEAGIGFDGSSIRGFQEIHESDMLVRPDPATAFIDPFCETTTLALICDVIDPVLHQPYSRDPRHIAKKAERHLQHSGIATTCYFGPELEFFIFDSIRFGQDQHSGYYHVESAEGEWTSGRDEGAYGGGNLGYKQRYKEGYFPVPPHDTLQDIRSEIVLALMQAGIRVEVHHHEVATAGQNEIDMRFAPLTRMADNVMMYKFICKNVARRHGKVATFMPKPLFADNASGMHCHQSLWKDGENLFYDAGGWALTSQLCRWYIGGLLKHAPALMAFCAPSTNSYKRLVPGYEAPVNLAMSQRNRSAAARIPMYSDAPAARRVEFRCPDPSANAYLAFAAMLMAGLDGIAHQTDPGEPLDRNIYELPPEEAEKIRQVPGSLEESLEALEADSYFLRKGDVFTDDVIRTWIDYKRTREIDTLKLRPHPWEFYLYFDI

SEQ ID NO: 5354 - protein, 487 aa, Oceanobacter sp. RED65
MSQPVYQSFVNGEFLGNANGETFDVIYPATGEVIYKVEQADDNVMAKAVESAIAGQKQWAAMTGIERSRILLKAVQLLRERNDELAEFEVKDTGKPWQEAVEVDVVTGADAIEFFAGLAPSIEGNQQDLGGDFYYTRREPLGVCAGIGAWNYPIQIACWKSAPALAAGNSMIFKPSEETPMGAIQLAKIFIEAGVPKGVFNVIQGDYRVGQMLTSHPDIAKVSFTGEVGTGKKVMADSASSLKEVTMELGGKSPLIVFDDADIEQAVSAAMLGNFYTQGEICTNGTRVFVHRSILNEFLEQLAERTKNNIVAGDPMNPETNFGALISEKHHKLVLDYIEKGKAENATLLAGGEAMKIEGFENGYFVAPTIFTDCTDDMTIVKEEIFGPVMSVLVFDDEEEVIKRANDTHLGLAAGVFTQNIQRAHRVIHQIEAGICWINAYGASPAEMPVGGYKQSGIGRENGTITLNHYTQVKSVYMGMNKIESPF

SEQ ID NO: 5355 - protein, 590 aa, Pseudomonas syringae pv. tagetis
MCGLAGELRFDHQPADLAAVERITHELAPRGPDAWGFHSQGPVALGHRRLKIMDLSDGSAQPMIDSHLGLSMAFNGAIYNFPELRAELESLGYQFHSGGDTEVLLKGYHAWGADMLPKLNGMFAFAIWERDSKQLFIARDRLGVKPLYLSKTDKRLRFASSLPALLKGGDISGMLDPVALNHYLNFHAVVPAPRTLLAGVEKLPPASWMRIDASGKVEQKVWWTLPYGPHDDEKNLTLEDWRDRVLDSTREAVAIRQRAAVDVGVLLSGGVDSSMLVGLLREVGVEDLSTFSIGFQDAGGERGDEFQYSDLIAKHYGTRHHQLRIQESEIIEQLPAAFRAMSEPMVSHDCIAFYLLSREVSKHCKVVQSGQGADELFAGYHWYPQVDGASDPVAAYRDAFVDRSYAEYAETVQPKWRTPNDAAGDFVRDHFAQPGASAAVDKALRLDSTVMLVDDPVKRVDNMTMAWGLEARTPFLDYRLVELSARIPGKFKLPDGGKQVLKEAARLVIPSEVIDRKKGYFPVPGLKHLQGDTLNWVRELLTDSSQDRGLFNPAMVDKLLTNPEGQLTPLRGSKLWQLAALNLWLSEQGL

SEQ ID NO: 5356 - protein, 127 aa, Salmonella enterica
GSGMHCHMSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGIKNKIHPGEA

SEQ ID NO: 5357 - protein, 275 aa, Francisella tularensis subsp. tularensis SCHU S4
METQSNKLTIVAFAIMHLACLAIFFVNYNITALVVFVVTFSARTFALTAGYHRYFAHKAFQTSRVFQFILALVGTWASQKGPLWWSGHHRYHHIHSDKDTDLHSPKNGIFQSHVGWVFESRSDHVDPKFTKDWVKYPELVWIDKYAHVSFALYLVGLFALGSLISHFYPSLETSGLAFVFWGGILSTVLLYHTTFSVNSICHIFGSKDYETDNSCNNWFIALITFGEGWHNNHHKFAYSVRNNLKVWQIDITYMILCVLRKFRIVWDFKQPKKTI

SEQ ID NO: 5358 - protein, 255 aa, Burkholderia xenovorans LB400
MIVPSAGPDFGLASRRALVTGGSSGIGLAAAAALGRAGAHVTVAARRRAELEVACEALRATGVACEALVLDVTDSASVDREVNSRVPFDILVNSAGMNRPKPLTDLTDDDIDAVLRLNVKAAFYLARAVSRRLVDANLGGSIINISSQMGHVGSARRSLYCASKHAVEGMTKALAWELGAARIRVNSLCPTFIETPMTAPMFVQPGFREWVCERIALGRVGEMHEIMGPVVFLASDASSLMTGSALMLDGGWTAA

SEQ ID NO: 5359 - protein, 126 aa, Salmonella enterica
GSGMHCHMSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGIKNKIHPGE

SEQ ID NO: 5360 - protein, 656 aa, Burkholderia xenovorans LB400
MHNNGLQSATGSAGSASGATPFHQGAMTLEEIKDAVAIANVPALLMVLHQFTGDDRWLETPYLPTRGKGLLDHDSGGLPEEIQLQIRHSAIDVIWKLQSGIAPKIVAPSPEKLIRMMSVYMGEEVDAIYGQMLSSEFARRVGAPVPGEDNTHVEPPEGFNVIVIGTGVAGVAAAERLEAMGVSYVILEKQKAAGGNWWQNTYPGCGVDTPSHLYSFSFAQVDWKKHFALRDDVQSYIAGSLRKVGAENRVRFDTEAVAAIYDEEKKIWQVHVKNQAGVSETLTANVVLSAVGVLNRPTLPKVAGLEKFQGTMFHSAEWNNAIDLKGKRVAVVGTGASSMQIVSAIGDRVGHLTVFQRSPQWVAPFDKFGLAILDPLRMLIQSCPLYRTWYWLRLFWQFGDKVIEALRKDPLWPHPERSVNARNDAHRDYFTRYLKEELDGRPDLFDKCLPTYPPFGKRILLDNGWFRTLRRDNVTLVTEAVTEVREHSLVSASGDEYAADVVIWATGFDVARFVSSMDVRGIGGVSLRTAWNDDDPRAYLGISVPGFPNFLMLGGPHSFPGSGSFMFFMEVQMRYISRLLKQMFKKGIVAVDAREDANNRYNELVDELHAKTVWTHPGMSTYYKNSKGRVVFVMPFLNVEYWEMVKNVNLEDYTVR

SEQ ID NO: 5361 - protein, 137 aa, Arabidopsis thaliana
MGEVWTWIISFLILITLLGLIVYQLISLADLEFDYINPYDSASRINFVVLPESILQGFLCVFYLVTGHWFMALLCVPYLYYNFHLYSRKQHLIDVTEIFNLLDWEKKKRLFKLAYIILTLFLTIFWLIYSTLDDYED

SEQ ID NO: 5362 - protein, 338 aa, Oryza sativa
  misc_feature (114)..(114): Xaa can be any naturally occurring amino acid
  misc_feature (186)..(186): Xaa can be any naturally occurring amino acid
  misc_feature (203)..(203): Xaa can be any naturally occurring amino acid
  misc_feature (260)..(260): Xaa can be any naturally occurring amino acid
  misc_feature (275)..(275): Xaa can be any naturally occurring amino acid
  misc_feature (288)..(288): Xaa can be any naturally occurring amino acid
  misc_feature (297)..(297): Xaa can be any naturally occurring amino acid
  misc_feature (319)..(319): Xaa can be any naturally occurring amino acid
MAASLQAAATLMQPAKLGGRASSAALPSRPSSHVARAFGVDTGAAGRITCSLQSDIREVANKCADAAKLAGFALATSALLVSGASAEGVPRRLTFDEIQSKTYMEVKGTGTANXCPTVEGGVDSFAFKAGKYNMKKFCLEPTSFTVKAEGVAKNAPPEFQKTKLMTRLTYTLDEIEGPLEVSSDRXTIKFEEKDGIDYAAVTXVQLPGRRSACPFLFTIKNLVATGKPGEPSAGPFRRCPSYRGSSFLDPKGRGGSTGLXDTAVALPAGGRGDRXESSSKENVKNASXSTGNMHVEXVTKSKPETGEVIGVFESVAVPXDTDLRRQGGPRMSRSQGVW

SEQ ID NO: 5363 - protein, 904 aa, Candida albicans
MEDKNAATQLNLPNVQSIGSHLSIQDHEIALQQVIDNPLSIGEVATTLTESQKWFVLKRLHFDALVSLEELPPQASFIFEKIEQMTTEEAVEILEKNIEEHETDVNIPENDLVLWKELVENSHKFTKVQLQEKLGSNSSSSVEGEKTADVEKGHEIVDWDLQVRLEAVLVAYWSPYPEVRAVTFPYDDPTIPVETFRVYLIGIIWTAIGAVINQFFTERQPAITLAMAVVQVFLYPSGLLCEWFLPKWKFKIWKYTIDLNPGPYTYKEQMLATIFCGVTGGSTSYVSSNILMQKSEIFYDNKWVDFGYQVLLILSTNFLGVGFAGIMRKFAVYPTKAVWPSILPGLALNKTLLTPAKKEVINGWKISGYNFFFITFVASFLYFWIPDYLFQALSTFNWMTWIKPDNQNLAVITGSVGGLGLNPITTFDWNYFSSMLQPLQVPFFYPLNNIIGMFFAFFCIIGVWYSNYKWTGYLPINDNGLFTNTGERYSVASVVNKDSLFDNAKYQEIGPPFYSAANLVVYGAFFAIYPFHFVYEIGMNYDQMWDACTSFWRVIKDFRKSTYDGFDDPHSTMMRAYPEVPEWAYLIIVVISLVLAILCVKLYPAQTPVWGIFFALGINFVFLIPLTTIYARTGFAFGLNVLVELIVGYAIPGNGLALAFIKALGYNIDAQAQNFVNDLKQGHYAKLPPRAVYRVQLLSIFVSSFIQLGILNFQINGIKDYCKPGNTQKFTCPGGRTFFSASVLWGVIGPKKVFNGLYPVLAWCFLIGFLLAFPCIAIKKYAPRKYVKYFEPSIVIGGFLKYAPYNLSYYIPGVYVSYAFMSYIKRKYEAWWQKYTYVLSTGLNAGIAFSSIIIFFAVMYHEKDINWWGNTVMYSGVDYAMTGWLNATVDAPDGYFGPRRGNFP

SEQ ID NO: 5364 - protein, 610 aa, Candida glabrata CBS 138
MLVLEGSIVPVPQGTRNFSARLAYDERSDSVAYGSGKSAYVTGVGAGAGGSEGGAGGNDVVQFTGHGANVSVVRFAPVGAYMCSGDESGKVIVWSWNRDGDGGVECVVKAEFQVLAGPVTDISWDFEGKRLCVVGEGRDKFGVFISWDTGNSLGEVTAHSSRVNAVHIKQSRPMRCITVGDDGTVVFYQGPPFKFVSSDRTHHDKGKFVRDVEFSKGAGEFAVTVGSDRKIACFDGKSGEFVKYIEDADEPITGGLFAVSWLDETRFVTASADQKVRVWDVRESKCLHSWTIGEPNTLQQQQIGVVAAKDDQIISLSLDGTLNFLKIGEDKPVRTMHGHNKSITALAVNPLVTGSYDGRIMQWVPEKICDSKMQTGHTNLVVSIGSKESGYSSVAWDDTLRVNNEVKYKFESQPKCASMDPAGKIAVVTTEDKLLVLDSSTGEKLVETALDVPASAVHLSGDLVAIGSEQTNTVSVYNSGDLSLLYKLPDPLRATPSCISIAPSHKLLAVGDVMGKIILYDLETKTVKTSRWAFHTSKINAISWRPEEEDLVATGSLDTHIIVYSVSKPMRTVKVLNAHKDGVNAVQWKDRDHIVSAGADACIHTWKFTQ

SEQ ID NO: 5365 - protein, 904 aa, Candida albicans
MEDKNAATQLNLPNVQSIGSHLSIQDHEIALQQVIDNPLSIGEVATTLTESQKWFVLKRLHFDALVSLEELPPQATFMFEKIEQMTIEEAVEILEKNIKEHETDVNIPENDLILWKELVEMSHKHTKAELQEKLGNNSSSSVEGEKTADVEQGHEIVDWGLQVRLEAVLVAYWSPYPEVRAVTFPYDDPTIPVETFRVYLIGIIWTAIGAVINQFFTERQPAITLAMAVVQVFLYPSGLLCEWFLPKWKFKIWKYTIDLNPGPYTYKEQMLATIFCGVTGGSTSYVSSNILMQKSEIFYDNKWVDFGYQVLLILSTNFLGVGFAGIMRKFAVYPTKAVWPSILPGLALNKTLLTPAKKEVINGWKISGYNFFFITFVASFLYFWIPDYLFQALSTFNWMTWIKPDNQNLAVITGSVGGLGLNPITTFDWNYFSSMLQPLQVPFFYPLNNIIGMFFAFFCIIGVWYSNYKWTGYLPINDNGLFTNTGERYSVASVVNKDSLFDNAKYQEIGPPFYSAANLVVYGAFFAIYPFHFVYEIGMNYDQMWDACTSFWRVIKDFRKSTYDGFDDPHSTMMRAYPEVPEWAYLIIVVISLVLAILCVKLYPAQTPVWGIFFALGINFVFLIPLTTIYARTGFAFGLNVLVELIVGYAIPGNGLALAFIKALGYNIDAQAQNFVNDLKQGHYAKLPPRAVYRVQLLSIFVSSFIQLGILNFQINGIKDYCKPGNTQKFTCPGGRTFFSASVLWGVIGPKKVFNGLYPVLAWCFLIGFLLAFPCIAIKKYAPRKYVKYFEPSIVIGGFLKYAPYNLSYYIPGVYVSYAFMSYIKRKYEAWWQKYTYVLSTGLNAGIAFSSIIIFFAVMYHEKDINWWGNTVMYSGVDYAMTGWLDATVDAPDGYFGPRRGNFP

SEQ ID NO: 5366 - protein, 317 aa, Gloeobacter violaceus PCC 7421
MDAKPIFSQATSKGPRKTLDSARLKNHQRLHAVAVSSLSLLGCLAALALVCLGRPPGAVEVGLFLGGFLCTGFGVNIGLHRHFTHRSFQAVTPVRVALAILGSMAAQGPVIFWVALHRLHHEFSDQPGDIHSPHFHGEGWWGSVRGLWHAHVGWTFDHAVPNAAYYAGDLLRDRAIAPISRTYFFWVFLGLLIAAVLGGVLTGTWMGVLTGFLWGGPVRIFCWHNMIWSITSCAHFFGERPFDADDRSTNNFWFAIPTLGESWHNNHHAFPNAAMAGLEWWQIDPSGWVIRALEKLGLVWDVKIPTQAMRRAKARAI

SEQ ID NO: 5367 - protein, 332 aa, Gloeobacter violaceus PCC 7421
MSSPFERAMQSNPPASPLPWQKTIIKSTAAVRNAQRMHALAILSLPAVATAAAAAIALRSGLGLLELGLFLGMYTLTMVGGITVGFHRHFTHCAFQAHPVIRVLLAVLGSMACEGPLIYWVSNHRRHHQYSDRPGDVHSPYIRAQTPLGGLRGFWHAHIGWTFDHDLTNATIFARDLIRDPLIARVSRLYYLWAALGLLLPALLGAWWTRDTNGALLGLLWGGGVRLFCSYHFTNSINSVTHLFGSRPFETGERSTNNPWLALPTGGESWHNNHHAFPNSAVFGLQPWQPDPGAWLIRLLEKLGLAREVKVPSQALIAAKAVRPQPTRSHAG

SEQ ID NO: 5368 - protein, 185 aa, Oryza sativa (indica cultivar-group)
MAVKYFGHRTPVIVVTKSHMYERGQIHQSLYIVWYIKIIKYTVTSDTVHFPQQQFKVTLHQKFAMSSPHVLVVDDTHVDRHVVSMALMRHNVRVTAVESVMQALMFLDSEHDVDMIVSDYCMPDMTGYNLLMEVKKSPTLAHLPVVIAFSDNIPERIRKCLDGGAKDYILKPVKIVDVPRIMNYI

SEQ ID NO: 5369 - protein, 327 aa, Ralstonia eutropha JMP134
MIANFDADRALRLAQSTLQIEAEAVAALSGRLTPDFSHAVQLVLQCTGRVVVSGIGKSGHIGRKVAATLASTGTPAFFVHPAEASHGDLGMVTRDDVLIAFSNSGETGELLSIIPIVKRIGARLISVTGNPESNLAKLADAHLDAGVEKEACPLNLAPTASTTAALALGDALAVAVLDARGFGEEDFARSHPGGALGRKLLTHVRDVMRSGNAVPEVRENTPLAQALMEITRKGMAMTAVVDSDGKAIGVFTDGDLRRLLETPRDWKTVPIGDVMHHNPHVVHEDQLAVEAVQVMEANRINQLLVVDHDGRLVGALHIHDLTRAKVI

SEQ ID NO: 5370 - protein, 450 aa, Dechloromonas aromatica RCB
MTRKYFGTDGVRGRVGQSPITPDFVMRLGYSAGKALLGRSEMPAGDRPAVLIGKDTRLSGYMLESALEAGFSAAGVEVCLVGPLPTPAVAYLTRALRLQAGIVISASHNPYYDNGIKFFSAQGTKLPDEVERAIEAGIDQPMVCAPPADLGRVRRIEDARGRYIEFCKSTFPNDLDLRGLKIVIDCAHGAAYHIAPSVFHELGADVVSIGVQPNGLNINDAVGATAPKALCEAVLANRADLGIALDGDADRLQMVDAEGNLYDGDQLLYAIVRSRARSAPVKGVAGTLMSNLALEHALAKLNIPFARAAVGDRYVVEMLSEKGWLFGGENSGHILALDRHTTGDGIVAALQVLAALRELGGSLKELLGGLVLYPQKLINVPVMRGFPWKEHPAITSALADTEVSLQGRGRVLLRASGTEPLLRVMVEGEDAVEVTYAAEKLAAVVRESAQ

SEQ ID NO: 5371 - protein, 249 aa, Dechloromonas aromatica RCB
MRKKLVAGNWKMHGSLQQNAALLELIKAGVSSLPCEVAVCPPYPYLGQVQSILSGSALAWGAQSVSEHQSGAFTGEVAASMLLEFGCRYVLVGHSERRALYGETDTVVSAKFEAVQRAGLVPVLCVGETLAERESGMTSVVVARQLSAVLGRVGVAAMASAVVAYEPVWAIGTGVTASPAQAQEVHAAIRAKVAELDLGVANGLRILYGGSVKPQNAMELFGQDDIDGGLIGGAALVADDFLAICRAAN

SEQ ID NO: 5372 - protein, 167 aa, Oryza sativa (indica cultivar-group)
MGEKTEYRDRLVENAFMGLFARKIKKYAIISSSGGKEKKKSSSRSSSCRHVGQLGLRVQRRPHRSLFPLARRSIRVTAVESVMQALMFLDSEHDVNMIVSDYCMPDMTGYDLLMEVKKSPKLAHLPVVIASSDNIPERIRKCLDGGAKDYILKPVKIVDLPRILNYI

SEQ ID NO: 5373 - protein, 205 aa, Ralstonia eutropha JMP134
MRCAGAWRNLHFKISMADSLIQSPDLGDVTGYLRDRIRTVPDWPMPGVQFRDITPLLQNPKTLRVLIDVFVHRYMDAQLDLVAGIDARGFILGAIVAYELNLGFVPIRKKGKLPFQTVAEEYELEYGSATVEIHADACKPGDRVLLIDDLIATGGTMMAGRKLLERLGATVVEGAAIVDLPELGGSKLLQNAGLPLFTVCRFDGH

SEQ ID NO: 5374 - protein, 183 aa, Rhodococcus sp. RHA1
MHVSTREPAGRTPQTVDPVLVLMGVSGSGKSTVAGIIAGAMGWDLQEGDALHPPANVAKMASGQPLTDEDRWPWLDVVAGWIREHTENGLPGVITCSALKRSYRDVLRGDNVVFVHLAGSRAQIGERLTARLDHFMPPSLLDTQISTLEPIEPDEDAIVVDVGGSPTQVATEIIARLEQRLGR

SEQ ID NO: 5375 - protein, 488 aa, Ralstonia solanacearum GMI1000
MIQNFINGAYREGRAGKRFRDLDPCTGRLVAEVSEAGKEDVDDAVQAARAALNGPWGKLTLAQRCDLLYAVADEIDRRKEDFLAAEVADTGKPRALASHLDIPRGAANFRVFADAVRNVATECFTGTAPDGKPSLNYALRRPKGVIAVVCPWNLPLLLMTWKVGPALACGNTVVVKPSEETPATAALLGEVMNAVGVPAGVYNVVHGFGPDSAGEFLTRHPDVDAITFTGETRTGAAIIKASADGIKPVSMELGGKNPALVFADADLDAVIAGLKRSVFENTGQVCLGTERVYVERPMFDKVVRALAEIAGTLRPGLPGDPHANFGPLISGEHQRKVLGYYALARDEGATVHYGGGVPDMPPDLREGAWIEPTVWTGLPRDSRVLTEEIFGPCCHVEPFDSEEEAVRLANGTPYGLATSLYTGDVNRAHRVSAKLKVGVVWVNTWFLRDLRTAFGGSGKSGIGREGGVHSLEFYTELSNVCLKLEPQA

SEQ ID NO: 5376 - protein, 128 aa, Salmonella enterica
HMSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGIKNKIHPGEAMDKNLYD

SEQ ID NO: 5377 - protein, 483 aa, Rhodococcus sp. RHA1
MTENVLLPGAESPGDTAEGTSVPVRIAVVAALGGLLFGYDSAVINGAVSAIEGKFQVDSALLGFAIASALLGAAAGAMLAGRIADRYGRLVTMRAAAVMFLLSAIGTGFAANVEMLVTFRIVGGIGVGLASVIAPAYIAEISPARVRGRLGSLQQLAIVTGIFVSLLVDYALAAIAGGSQEELWFGLEAWRWMFLAMCVPALAYGLLSLTIPESPRYLIAQGRLGEARGILAVLLGEKGLDLKIESIRSTLARETQPSIRDLKGSAFGLMPIVWIGIGLSVFQQFVGINVIFYYSSVLWQAVGFDEGSSLQITVITSVVNIATTLIAIAYIDRVGRRPLLIIGSAGMAVTLATMAFIFGTASTTVVDGVTTPQLTGLQGPIALVAANLFVVAFGMSWGPVVWVLLGEAFPNRIRAAALSLAAGAQWAANWLITVTFPSMKDFSLGISYGFYAVCAVLSLVFVLRWVKETKGVELEAMHSDSVA

SEQ ID NO: 5378 - protein, 454 aa, Streptomyces parvulus
MEKTDVDRLRTLDREHMWYPWTPMTEWMARDQLVVERAEGCWLIDADGKRYLDGRSSMGMNLHGHGRSEIVEALVAQARKAGETTLYRVSHPAAVELAARLASMAPAGLQRVFFAESGSTAVETALKAAYAYWVAKGEPQRSTFVSMEGGYHGETLGTVSLRGTNGEQVDMIRKTYEPLLFPSLSFHQPHCYRCPVGQSSDSDCGLECTDSLENLLTREKGRIAAVIVEPRVQALAGVITAPEGHLAKVAEITRRHGVLLIVDEVLTGWARTGPTFSCEAEGVTPDLMTVGKALTGGYLPLSATLATEEIFGAFRESVFLSGSTYSGYALGAAVALASLDLFEKEDVPARAKALADVLTTALEPFRALTHVGDVRQLGLIAGVELVADRETRAPYPPQERVVDRICTLARDNGVLVNAVPGDVITMLPSPSMSPDDLRFLTGTLYTAVREVTEE

SEQ ID NO: 5379 - protein, 117 aa, Salmonella enterica
SLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGIKNKIHPG

SEQ ID NO: 5380 - protein, 437 aa, Zea mays
MATRSLTSALPLSRTPRVPSHRPSLRRLQTLTRALTSSSPQAMASSPTPKKVLVPIANGTEPMEAVITIDVLRRAGADVAVASVEPGATSVAASWGIKLTADALLADLADDEFDLISLPGGMPGSSTFGECKVLEKMVKKHVEKGKLYAAICAAPAMTLGTWGLLNGLKATCYPSFIDKLPSEVHAVESRVQIDGKCMTSRGPGTAMEYSVILVEQLYGKEKAKEVAGPMVMRPQHGVEFSMKEVNSTSWNVGETPNILVPIANGTEEMEATMIIDILRRAKANVVVASLEDKLEIVASRKVKMIADVLLDDALKEQYDLILLPGGLGGAEAYAKSDKLMDLIKKQAEANRLYGAICASPAIALEPHGLLKGKKVTSYPAMWNKLADQSECNNRVIVDGNLITSQGPGTSMEFSLAIVEKLFGRERALELAKSMVFI

SEQ ID NO: 5381 - protein, 258 aa, Oryza sativa (japonica cultivar-group)
MAAATVSVRFHPAASAARSAAAAALTQDDLKRLAAVRAVEQVESGMVLGLGTGSTAAFAVAEIGALLASGKLSGIVGVPTSKRTFEQAQSLGIPLSTLDDHPRIDLAIDGADEVDPDLNLVKGRGGALLREKMVEAASDKFIVVVDETKLVTGLGGSGLAMPVEVVQFCWKYNQVRLQDLFNDEGCEAKLRLDEGGKPYVTDNSNYIVDLYFKTPIKDALAAGKEISALEGVVEHGLFLDMATSVIIAGTDGVSVKTK

SEQ ID NO: 5382 - protein, 945 aa, Candida albicans
MTKKGHEYIQLSTFSEHENEHEPESSSTTSSPPPPGIRQYEKQHEWNFTDLQLQFVLLRLGVISDEVYHNQNFSLSDPDIHISKEVEYMINKIDQLSISEAIEIIRDALADHNGDVNFLIEDYQLLERLISQIPNNIESQKSNQNVETNLDELPEMKYPMQSTFKNKTYLTIIDWSLQIRLEAALIHYHSPYPEIRAITDPFDDPNTPVETFRAYFIALFWTFIGSLINSFFYHRMPGISLGTHTIQILLLPSGKLWEKLIPLNKTITINNTKINLNPGPWNFKEMMLSTIIYSCSASTPYSINNIFVMKLDRFYGLKWVNWIFQILFTVSTQLLGFSFAMIMKKVCVYPSKAIWPTILPTIALNRALMNQDNASNNSIVHGWKISPYSFFLVTFTLSFIYNWIPSYFFKALSLFNWPTWFNPNSIHLVNITGSNIGLGFNPIPSFDWNVIGGSSMVIPFYTFVNRYLGTFLGFIIILIVYYTNNNWTAYLPINSNRLFNKKAQLYNVHDILNDDNKLFDNEKYQQIGPPYFSAANLVIYGAYFCLYPFAILYHGLTEWNSMKTSFINVWTSIIDAFKSESEMGVGVESNNDNNLSSHRQYGRYANDPHCKMMAHYPDVPDWWFITILVVSTSFAIAAVWFYPVETPIWGIFFTIAINFIFLIPLTSIASVTGFSFGLNVLVELIVGYAIPNSGIALITLKAYGYNIDSQASNYITDQKLAHYAKIPPRAIFKGQLLSTLLNIIISLSVANWQLNNVENICDPHQKDNFKCPGANTYFYSSIQYGEIGPAKVFGGLYPILKWCFLLGVLLVFPCVWLKRNGPTKIFQRYFQPTIIIGGMLDFAPYNLSYFTGGLYISYIFMFYIKKNYLLWWEKYNYILTSALSAGVAFSALIIFFTVQYHPHPLHWWGNSIGQQGIEGGEISPIWKNIDTAPDGYIGLRKGHFP

SEQ ID NO: 5383 - protein, 945 aa, Candida albicans
MTKKGHEYIQLSTFSEHENEHEPESSSTTSSPPPPGIRQYEKQHEWNFTDLQLQFVLLRLGVISDEVYHNQNFSLSDPDIHISKEVEYMINKIDQLSISEAIEIIRDALADHNGDVNFLIEDYQLLERLISQIPNNIESQENNQNVETNLDELPEMKYPMQSTFKNKTYLTIIDWSLQIRLEAALIHYHSPYPEIRAITDPFDDPNTPVETFRAYFIALFWTFIGSLINSFFYHRMPGISLGTHTIQILLLPSGKLWEKLIPLNKTITINNTKINLNPGPWNFKEMMLSTIIYSCSASTPYSINNIFVMKLDRFYGLKWVNWIFQILFTVSTQLLGFSFAMIMKKVCVYPSKAIWPTILPTIALNRALMNQDNASNNSIVHGWKISPYSFFLVTFTLSFIYNWIPSYFFKALSLFNWPTWFNPNSIHLVNITGSNVGLGFNPIPSFDWNVIGGSSMVIPFYTFVNRYLGTFLGFIIILIVYYTNNNWTAYLPINSNRLFNNKAQLYNVHDILNDDNKLFDNEKYQQIGPPYFSAANLVIYGAYFCLYPFAILYHGLTEWNSMKTSFINVWTSIVDAFKSESEMGVSVESNDDNNLSLHRQYGRYANDPHCKMMAHYPDVPDWWFITILVVSTSFAIAAVWFYPVETPIWGIFFTIAINFIFLIPLTSIASVTGFSFGLNVLVELIVGYAIPNSGIALITLKAYGYNIDSQASNYITDQKLAHYAKIPPRAIFKGQLLSTLLNIIISLSVANWQLNNVENICDPHQKDNFKCPGANTYFYSSIQYGEIGPAKVFGGLYPILKWCFLLGVLLVFPCVWLKRNGPTKIFQRYFQPTIIIGGMLDFAPYNLSYFTGGLYISYIFMFYIKKNYLLWWEKYNYILTSALSAGVAFSALIIFFTVQYHPHPLHWWGNSIGQQGIEGGEISPIWKNIDTAPDGYIGLRKGHFP

SEQ ID NO: 5384 - protein, 360 aa, Gibberella zeae PH-1
MFDLFPMLLSSVASFLFPIFASYKALKTSDPTQLTPWLMYWVVLSCCLLVESWVWFIISWIPFYGYFRLMFLLYLILPQTQGAAFLYDEYVHPYLEKNETQIDDFIASAHERLTAAGISYLKLAIEQFRVKVLGLPPSEPEAPPPETNQGYTQSLLSRFNVPAARWAGNNNNNNGGTGTDFYSLLSSAVAAATNAGAAQSAGTRTVGGEPTNPGALIPPHLRESGARMDFISTQRDRLNVLLSALDREAQDLRSDAQRAQANTGPQRDPMAYGGYDNTRNDDEEPTQRPPSGLSGWSGISKSRSETDFERIDADVSSDEDHKMRRRNMGAGTRNTSGSWVPWSWGGDAAQGGASASGRER

SEQ ID NO: 5385 - protein, 747 aa, Candida albicans
MSKEAEFVKTISKEGDPQVDVLERDAESNSENALEPDVEELPKVVREIVPLEDDPTIPVLTFRYFILSIIFIIPGAFIDTMNSFRTTSAAYSIFFVQIASHWCGKWLARILPKKQVGFGRLSFNLNPGPWSIKETALITITANSGATGSMGTNPLALAELFYGETVNPAVAIFFMWMIVFIGYSFAGIARNFLLYDPQFTWPQALMQTTLFQTQSKSDKDAKQASKQMKVFFFVLIGLCIWQFFPEYIFPMTSSLAFLCWVAPENYTANFIGSGLGGMGFLNLSLDWSNITSSIMLYPYWVQVVQFAAFVLGAWILIPAAKWGDLSSYPYGLMSNSLFLGNGTKYPTTELLTPNLRLNETRYEELGPVHLGAQRAWNMFFDYAAYVSGFMWVVAFGYKSLSGSLKRLVKSRKQKGSINLQYTDRLNKLQAAYEEVPLYWYAILFLCAFVTLLVIFATDSLFMPWWCLLVGVAFGAVIVTPLVWLYALSNFQLPIGTFNELLYGYMIQNKTSRHPAGAMVYGAVGGDLFYRAQYILNDQKIAHYMHISQRAVFFSQIFGELIGVPINYAALRWVISSKRDFLDGTKVDKLHQWTGQTIVSYNTNAVQYVILGPDRLFKNYPVLPYGFLLGAGAPLVLYLLHRLFPKSKLKFHLWNTTVFFSTMSTFYGNLSTGYFSRFIGGTITMFWAFRYKHSLWKKYNYLLAAALDTGLNLSILLIFLFFSAGKTVNFPEWWGNNGKSVERCFAMS

SEQ ID NO: 5386 - protein, 345 aa, Aspergillus nidulans FGSC A4
MRIRIRGPSGQFAITLAEDATVGDLRNTIIEKTGLTAYDAKYGYPPKPISLEHAETDQKLVELGIQLDREQLIISAKDGPPGPSGKKEDTSSYAGQSSPKLSLSRKQNPVAEDTPKVPSPEHGGLFVLRVMPDDNSCLFRAISTALLPGEDTMVELRSAVAETIQNNPDEYSSAVLEQPPDDYCRWIKNETSWGGAIEISILSKHFDVEICSIDLGNLRVDRFNEGQSRRCFLVYSGIHYDTITLSPGENVPPEFDTTVFNASDSLALEKALAVCKLLQERNYYTDVAAFRLHCNDCGAILVGQQGAKGHTTQTGHRDFSQRYALSPFLYQILAGIHRYKKAVRG

SEQ ID NO: 5387 - protein, 226 aa, Arabidopsis thaliana
MGVEIQSPQEQSSYTVEQLVALNPFNPEILPDLENYVNVTSQTYSLEVNLCLLRLYQFEPERMNTHIVARILVKALMAMPTPDFSLCLFLIPERVQMEEQFKSLIVLSHYLETGRFQQFWDEAAKNRHILEAVPGFEQAIQAYASHLLSLSYQKVPRSVLAEAVNMDGASLDKFIEQQVTNSGWIVEKEGGSIVLPQNEFNHPELKKNTGENVPLEHIARIFPILG

SEQ ID NO: 5388 - protein, 372 aa, Zea mays
  misc_feature (51)..(51): Xaa can be any naturally occurring amino acid
MVHQAQGQMVQEVAAAGLPALPSRYVLREEDRPTGDVAAPELAFPTVDVNXLADPGDVEEASKLRSALESWGLFKVTGHGMPVSLLDGIRDAGLEFFHLPAAEKLKHANRDDAGEFQPEGYGIDRVDTDGQVLDWCDRLYLTVQPEEERRMQFWPARPASLVGLLHEYALGSEQVARRVLRAMARVLGFGEGFFLGHVGEKGGTYARFTYYPPCPRPDLVYGLKPHTDNSVVTVLLLDRDVGGLQVLLRGPGPGRWVDVPVLARDELLVVVGEEMEIMSNAVFRAPTHRVVTSGRERMSLVLFYQPEPHKDLQPAEELVSEDRPAIYRRLKAKTFGDGFWDAFALGERTIDFLNIKVDDKEHGGGLVTSAPA

SEQ ID NO: 5389 - protein, 417 aa, Dechloromonas aromatica RCB
MADIRNFTLNFGPQHPAAHGVLRLVLELDGEVVQRADPHIGLLHRATEKLAETRTWVQSVPYMDRLDYVSMMCNEHAYCLATEKLLGIEVPERGKYIRVMFDEVTRILNHLLWIGCHALDVGAMTMALYTFREREDLMDVYEAVSGARMHAAYYRPGGVYRDLPDRMPQYQESTWTNAKKAAEKNENRSGSVLDFLEDFTNRFPTYHSEYHTLLTDNRIWKQRLVNVGVVTPERALQMGFTGAMLRGSGIAWDLRKKQPYAAYDKINFDVPVGVNGDSYDRYLVRMEEMIQSNNIIKQCIAWLRKNPGPVITDNNKVAPPPRENMKTNMEELIHHFKLFTEGIHVPAGEAYAAVEHPKGEFGIYFVSDGANKPYRMKIRAPGFVHLAGLDEMSRGHMIADVVTIIGSQDIVFGEIDR

SEQ ID NO: 5390 - protein, 485 aa, Triticum aestivum
GTAIVCSSCWHSALETFQKQNCEPDRYRRQCSMVNQSVPLMDPLVTLFGSVHVRMPVGGRVGRSTLFPNFGSMLSVADQHPKTEHWDEENVHRDDEEYASDAGGDYEDNVHSPLLSRQTTNTDGKDHGHHGSTLGMRRRSLLEEGGEAVSSTGIGGGWQLAWKWSERQGEDGKKEGGFKRIYLHQEGVADSRRGSVVSLPGGGDATQGGSGFIHAAALVSHSALYSKDLMEERMAAGPAMIHPLEAAPKGSIWKDLFEPGVRRALFVGVGIQMLQQFAGINGVLYYTPQILEQAGVAVLLSNLGLSSASASILISSLTTLLMLPSIGVAMRLMDISGRRFLLLGTIPILIASLIVLVVSNVINLSTVPHAVLSTVSVIVYFCCFVMGFGPIPNILCAEIFPTRVRGVCIAICALTFWICDIIVTYSLPVMLNAIGLAGVFGIYAVVCCIAFVFVYLKVPETKGMPLEVITEFFAVGAKQAQATIA

SEQ ID NO: 5391 - protein, 174 aa, Arabidopsis thaliana
MVYHSSFVDEEGVTKACGCPLLPLKSHIKGPAPVSEQDKTDIVDEAITFFRANVFFTNFDIKSPADKLLIYLTFYINVALKRLEGCRTLAVGTKAIINLGLEDIPVPGETGFPFPGLFSLPQSQDEAELFRNYLKQVREETSGRLLSVAYRANGTPNKWWLAFAKRKFMNVVVL

SEQ ID NO: 5392 - protein, 162 aa, Dechloromonas aromatica RCB
MGSMKEIFNSLFLKELLKGMSVTGKYFFARKITVQYPEEKTPQSFRFRGLHALRRYPNGEERCIACKLCEAICPALAITIEAEPRDDGSRRTTRYDIDLTKCIFCGFCEEACPVDAVVETRIFEYHGEKRGDLYYTKQMLLANGDRYEDQIAKDRELDASYR

SEQ ID NO: 5393 - protein, 444 aa, Haemophilus influenzae R2866
MKNVVIVGGGAGGIELATFLGNKLGRQKQAKVTLVDRNATHLWKPLLHEIATGVMDDGIDSLSYRAHGKNHFFSFEQGSIIRINREQKYVELAPVYGQEGDMLVIARRIPYDYLVIAIGSKSNDFNTKGVADNCIFLDSSKQALRFQHKLLELFLKFSENRALDDIGEEEFKQKLVDENKVNIAIVGGGATGVELTAELYHAAEDLSSYGYGKIDSSCLQVTLVEAGTRLLPALPENLSAAVLDELKEMGANVQLNTMITEAQPNTLITKDGREIKADLIVWAAGVRVSTVTQQFDGLEINRINQLVVKDTLQTTVDDSIFAIGDCAAFIQSNGKLVPPRAQAAHQMAKACAKNIFALFENKPLKSFKYNDKGTLVSLSNFTALGSLTNKFGKNPLTVQGKFAQFAYVSLYRMHQHALHGCIKIGLIILVDKLNRYLKPRLKLH

SEQ ID NO: 5394 - protein, 100 aa, Glycine max
  misc_feature (58)..(58): Xaa can be any naturally occurring amino acid
MVRISVLNDALKSMYNAEKRGKRQVMIRPSSKVIIKFLIVMQKHGYIGEFEYVDDHRXGKIVVELNGRLNKCGVISPRFDVGVKEIEGWTARLLPSRQFG

SEQ ID NO: 5395 - protein, 457 aa, Shigella flexneri 2a str. 301
MMEGQQHGEQLKRGLKNRHIQLIALGGAIGTGLFLGSASVIQSAGPGIILGYAIAGFIAFLIMRQLGEMVVEEPVAGSFSHFAYKYWGSFAGFASGWNYWVLYVLVAMAELTAVGKYIQFWYPEIPTWVSAAVFFVVINAINLTNVKVFGEMEFWFAIIKVIAVVAMIIFGGWLLFSGNGGPQASVSNLWDQGGFLPHGFTGLVMMMAIIMFSFGGLELVGITAAEADNPEQSIPKATNQVIYRILIFYIGSLAVLLSLMPWTRVTADTSPFVLIFHELGDTFVANALNIVVLTAALSVYNSCVYCNSRMLFGLAQQGNAPKALASVDKRGVPVNTILVSALVTALCVLINYLAPESAFGLLMALVVSALVINWAMISLAHMKFRRAKQEQGVVTRFPALLYPLGNWICLLFMAAVLVIMLMTPGMAISVYLIPVWLIVLGIGYLFKEKTAKAVKAH

SEQ ID NO: 5396 - protein, 447 aa, Cryptococcus neoformans var. neoformans B-3501A
MTLLTGSRITQSFLLTVKTRKPQCLCLLQSEQRKRMSTNHAAVHKGKPPPSRSAPAIIDMQSTTEEPPLGESELFLRTRDEALNTPGMKFADGHGLKGPTGKGRQTRKMNLYQAIRDALGTALAKNPKSFVFGEDVETGVFRCTTGLVDEFGKRRVFNTPLTEQGIAGFGIGLASVGGCAIAEIQFGDYIFPAFDQLVNEAAKQRYASGGSYPPVGGSLTIRAPIGSVGHGGLYHSQSPEGFFLGAAGLKIVIPRSPIQAKGLLLAAIRDPSPTLFFEPKILYRAAVEEVPIDDYTIPLGQAEVIRKGADLTVVSYGTPLHICLRAINMLQQPPSSILGSLPPGLRPPQPAPSIELIDLRTINPLPLEDLVSAVRKTGRLVIVHEAGRSGSVGNNIAGEVGRRAFEYLEAPVGVVSGWDTPVPLSFERFYQPDVIRVFDKLVETLSY

SEQ ID NO: 5397 - protein, 887 aa, Shigella flexneri 2a str. 301
MSERFPNDVDPIETRDWLQAIESVIREEGVERAQYLIDQLLAEARKGGVNVAAGTGISNYINTIPVEEQPEYPGNLELERRIRSAIRWNAIMTVLRASKKDLELGGHMASFQSSATIYDVCFNHFFRARNEQDGGDLVYFQGHISPGVYARAFLEGRLTQEQLDNFRQEVHGNGLSSYPHPKLMPEFWQFPTVSMGLGPIGAIYQAKFLKYLEHRGLKDTSKQTVYAFLGDGEMDEPESKGAITIATREKLDNLVFVINCNLQRLDGPVTGNGKIINELEGIFEGAGWNVIKVMWGSRWDELLRKDTSGKLIQLMNETVDGDYQTFKSKDGAYVREHFFGKYPETAALVADWTDEQIWALNRGGHDPKKIYAAFKKAQETKGKATVILAHTIKGYGMGDAAEGKNIAHQVKKMNMDGVRHIRDRFNVPVSDADIEKLPYITFPEGSEEHTYLHAQRQKLHGYLPSRQPNFTEKLELPSLQDFGALLEEQSKELSTTIAFVRALNVMLKNKSIKDRLVPIIADEARTFGMEGLFRQIGIYSPNGQQYTPQDREQVAYYKEDEKGQILQEGINELGAGCSWLAAATSYSTNNLPMIPFYIYYSMFGFQRIGDLCWAAGDQQARGFLIGGTSGRTTLNGEGLQHEDGHSHIQSLTIPNCISYDPAYAYEVAVIMHDGLERMYGEKQENVYYYITTLNENYHMPAMPEGAEEGIRKGIYKLETIEGSKGKVQLLGSGSILRHVREAAEILAKDYGVGSDVYSVTSFTELARDGQDCERWNMLHPLETPRVPYIAQVMNDAPAVASTDYMKLFAEQVRTYVPADDYRVLGTDGFGRSDSRENLRHHFEVDASYVVVAALGELAKRGEIDKKVVADAIAKFNIDADKVNPRLA

SEQ ID NO: 5398 - protein, 410 aa, Pyrococcus abyssi GE5
MFRLGDFNYHNKVVFLRVDLNSPMKDGKIISDARFRAVLPTIKYLLENGARVVVGTHQGKPYSEDYATTEEHARILSNLLNQHVEYVEDIFGRYAREKIQELKPGEIAMLENLRFSAEEVKNKPIEECEKTFFVKKLSKVIDYVVNDAFAAAHRSQPSLVGFARIKPMIMGFLMEREIEALMKAYYSKESPRVYVLGGAKVDDSLKVAENVLRRGFADVILTGGLVANVFTLAKGFDLGRKNIEFMKKKGLLELVKHAEKILDEFYPYVRTPVDFAIDYKGDREEIYLLSEKRELLNDYQIMDIGSRTIEKYRDIIMKAKVVVANGPMGVFEREEFALGTVEVFKAIAESEAFSVLGGGHSIASIQKYGIEGITHISTGGGAMLTFFAGEELPVLRALQISYEKFKEVKA

SEQ ID NO: 5399 - protein, 665 aa, Oryza sativa
MDEKVKMESKLSSAAAFVEGGVQDACDDACSICLEAFCDNDPSTVTSCKHEYHLQCILECQELLEAVEQERNIRANRLNTAAVFHHPVLGDFEVPVGADDAELEERIIQHLAAAAAMRQDEDHEQSSDLGSAHPFAALAAVDQGHMSGGSQLYVGHSDQEGSLADEGAVAAAQAIRAGEKWPQAAAMGAPVCGALVCFFVLLVARAAAETAPVERPTLPSADVAIDGNGNGARAGAGKAAGAGAVGGGIVSNSVLVALLDSRYTEMAELVEKALLLQALEDAVAEHNVTILAPRNEALERDIDPEFKRFLLEPRNLNSLQSLLLFHVLPARLPSGSWPAAATHPTLAGEDVELAAADGGGGMRVAHAAVSRPDAVVRTDGVIHGIDRLLVPRSVQDEFNRRRSLADISAMPPTAAPEVDPRTDRLKKPAPPGDSPVLPISDATVPDPSVALASEPSDHYDGDSQVKDFIQTLLKYGGYNELADIFVNLTSLATELAQLVSEGYALTVLAPNDEAMARLTADQLSEPGSPENILYYHMIPEYQTEESMYNAVRRFGKVRYDTLRLPHKVVAREADGSVKFGHGEGSAYLFDPDIFADGRISVQGIDAVLFPPAETKTKTKPATARIRTAPAITGVSKIKHRRGKLLEAACQMVGILGQRSQFTRCQ

SEQ ID NO: 5400 - protein, 81 aa, Glycine max
  misc_feature (20)..(20): Xaa can be any naturally occurring amino acid
  misc_feature (23)..(23): Xaa can be any naturally occurring amino acid
  misc_feature (51)..(51): Xaa can be any naturally occurring amino acid
TAKNTAPAETTDNRAGAGRXAPXTGRKAKAGHPTRKTNNDSTTRASNGGRXQGMHFLPPVGKKKGETLSYPPDLDDAQLSK

SEQ ID NO: 5401 - protein, 145 aa, Myxococcus xanthus DK 1622
MAIERTLSIIKPDGLEKGVIGKIISRFEEKGLKPVAIRLQHLSQAQAEGFYAVHKARPFFKDLVQFMISGPVVLMVLEGENAVLANRDIMGATNPAQAAEGTIRKDFATSIDKNTVHGSDSLENAKIEIAYFFRETEIHSYPYQK

SEQ ID NO: 5402 - protein, 115 aa, Yersinia pestis CO92
MSNIIKQIEQEQMKQDVPAFRPGDSVEVKVWVVEGSKKRLQAFEGVVIAIRNRGLHSAFTVRKISNGEGVERVFQTHSPVIDSITVKRRGAVRQAKLYYLRERTGKSARIKERLG

SEQ ID NO: 5403 - protein, 138 aa, Rickettsia typhi str. Wilmington
MNIIDNFEQENISKLTANKKIPDFEAGDTVKVTVKIIDKAIEKDGKEKLTERFQAYEGVVIAKRNRGITSSFLVRKISHGEGVERRFMTYSPIVHSIDVVKYGVVRRAKLYYLRHRNGKAARIRERHITSAKPKAVKS

SEQ ID NO: 5404 - protein, 547 aa, Mycobacterium tuberculosis H37Rv
MTITVEPSVTTGPIAGSAKAYREIEAPGSGATLQVPFRRVHLSTGDHFDLYDTSGPYTDTDTVIDLTAGLPHRPGVVRDRGTQLQRARAGEITAEMAFIAAREDMSAELVRDEVARGRAVIPANHHHPESEPMIIGKAFAVKVNANIGNSAVTSSIAEEVDKMVWATRWGADTIMDLSTGKNIHETREWILRNSPVPVGTVPIYQALEKVKGDPTELTWEIYRDTVIEQCEQGVDYMTVHAGVLLRYVPLTAKRVTGIVSRGGSIMAAWCLAHHRESFLYTNFEELCDIFARYDVTFSLGDGLRPGSIADANDAAQFAELRTLGELTKIAKAHGAQVMIEGPGHIPMHKIVENVRLEEELCEEAPFYTLGPLATDIAPAYDHITSAIGAAIIAQAGTAMLCYVTPKEHLGLPDRKDVKDGVIAYKIAAHAADLAKGHPRAQERDDALSTARFEFRWNDQFALSLDPDTAREFHDETLPAEPAKTAHFCSMCGPKFCSMRITQDVREYAAEHGLETEADIEAVLAAGMAEKSREFAEHGNRVYLPITQ

SEQ ID NO: 5405 - protein, 478 aa, Xanthobacter autotrophicus Py2
MVPPFSSLIVSPVTPAARLQATLELMHEVDSVARPADAVVSAWFRARRQIGDRDRGQIYDLLYALLRHHARIVWWLAKHGRPDVPRNRLLAWLALDGGTALGGKTSGNKTSGNKTSGNKTSGNKTSGSKTPDQIHGLFSGGKFAPAVLTDHERALLLKLQGCTIDHPAMPDEVRFECPSWAVEPLRRRFDDTFEREMAALLTPPPLDLRVNPVKSTREAMLRALRDLGLKAEPSRLAPFGIRVKERPSLASLPMLKSGEVEIQDEGSQLVAMLVDARPGERVVDFCAGAGGKTLAIAAQMANKGHVIACDVSDGRLKRAAERFRRAGLHNIETRPLASETDRWVKRHKGGFDRVLVDAPCSGTGTWRRNPDARWRQQEAGLDHLLPLQARILASAARLVKPGGRLVYATCSMLPEENEAQVAAFLAAYPAFHVMPVREAAPQLTGSAHPDHLSLTPARHETDGFFAAVLQREPAAAPA

SEQ ID NO: 5406 - protein, 586 aa, Oryza sativa (japonica cultivar-group)
MAMDDLAGSSSSSSAMDAVVADPSHGWQKVTYPKRHRKQGAAALPSAAAPDLGFLPNGGGKVNVFEAVDRNAEKRHRALLAARDAADPDAARIAAATASAYSDDDDDSDEAQATRPEGEVKKPKVKKPKKPKVTVAEAAALIDAENLAAHLVQISESYENQQDIQLMRFADYFGRSFASVSAAQFPWAKMFKESLVSKMVDIPLCHIPEPVRNTASDWINQRSPDALGDFVMWCIDSIMSELSGQAVGAKGSKKAAQQTPRAQVAIFVVLALTVRRKPEVLTNVLPKIMGNNKYLGQEKLPIIVWVIAQASQGDLVTGMFCWAHFLFPTLCAKPSGNPQTRDLVLQLLERILSAPKARGILLNGAVRKGERLIPPVTFDLFMRAAFPVSSARVKATERFEAAYPTIKELALAGPPGSKTVKQAAQQLLPLCVKAMQENNADLTGESAGVFIWCLTQNAESYKLWERLHPENVEASVVVLSTIVTKWSELSHKLSAESLKVTLKNLRTKNEAALEAATDSGKQASIKAADKYSKEILGRLSRGGACLKGSLLVITLAVAAGFVLSPNLEIPSDWDKLQAMVASHLSF

SEQ ID NO: 5407 - protein, 143 aa, Myxococcus xanthus DK 1622
MSSDSARVDSQKAPEPVGLYPHARRVGNLLFLSGVGPRERGTKKIPGVELDAEGNIVSYDIEAQCHSVFRNVRYILEDAGASWDKLVDVTVYLTDMKKDFPTFNRLWAEYFKDNPPCRTTLEINRLPTPIAIELKCIATIGGE

SEQ ID NO: 5408 - protein, 288 aa, Shigella flexneri 2a str. 301
MAEKKQWHETLHDQFGQYFAVDNVLYHEKTDHQDLIIFENAAFGRVMALDGVVQTTERDEFIYHEMMTHVPLLAHGHAKHVLIIGGGDGAMLREVTRHKNVESITMVEIDAGVVSFCRQYLPNHNAGSYDDPRFQLVIDDGVNFVNQTSQTFDVIISDCTDPIGPGESLFTSAFYEGCKRCLNPGGIFVAQNGVCFLQQEEAIDSHRKLSHYFSDVGFYQAAIPTYYGGIMTFAWATDNDALRHLSTEIIQARFLASGLKCRYYNPAIHTAAFALPQYLQDALASQPS

SEQ ID NO: 5409 - protein, 195 aa, Zea mays
MAAATSSSAVAVSTPQGVAERRGIPAASFVEDVETYLRQAGLEVNSALAFLQERLQQYKMVEMKLLAQQRELQAKIPDIEKCLDIVATLKAKKALGEALIADFELSEGIYSRAKIEDSDSVCLWLGANVMLEYSCDEANELLKSNLENARASLEVLVGDLHFLRDQQTITQVTIARIFNWDVHQRRSKQSVMKET

SEQ ID NO: 5410 - protein, 181 aa, Oryza officinalis
FGSVYRGILSDGGVSRDVAVKRVAETSRQGWKEFVAEVRIISRLRHRNLVPLIGWCHDGGDELLLVYELMANGSLDAHIYSPENVLPWPVRYGVVLGVGAALLYLHQEAEQRVVHRDIKPSNVMLDASFNARLGDFGLARLIEDGRRSHTTDIAGTMGYIDAECILAGKASVESDVYSYGI

SEQ ID NO: 5411 - protein, 403 aa, Oryza sativa (japonica cultivar-group)
MPATDSSSAAAPLTSFGRSFLSHRRDQIPPPPPDHHSHSHTQHPSSSDLEIDAFHRHAADLLHDLLSDSNSDPSAPDLLSLAWTRRLLDSFLICLEEFRAILFALADSQPLSRPPLDRLLLDFLDRAVKALDLCNALRDGLDLIRQWRKHLAIAAAALATAPAAQRGEAQIRRARKALTDLTILMLDDKDAGGVVGQRNRSFGSASTTRTPFPTATATTAGAAAAGAPGPALAPISGLTVPRANDIAATGGLASAVYAMGAVLFVVTWALVAAIPCQDRGLQAHLTAVPRTFPWAGPLITLFDRILDESKKKDRKHSCGLLKEIHQIERCSRQLMEVTDAAEFPLADDKDSEVQEATQELVQVCGSLKDGLDPLERQVREMFHRVVRTRTEILDYLSRPHNAG

SEQ ID NO: 5412 - protein, 620 aa, Schizosaccharomyces pombe 972h-
GKLTALMGESGAGKTTLLNVLAQRVDTGVVTGDMLVNGRGLDSTFQRRTGYVQQQDVHIGESTVREALRFSAALRQPASVPLSEKYEYVESVIKLLEMESYAEAIIGTPGSGLNVEQRKRATIGVELAAKPALLLFLDEPTSGLDSQSAWSIVCFLRKLADAGQAILCTIHQPSAVLFDQFDRLLLLQKGGKTVYFGDIGEHSKTLLNYFESHGAVHCPDDGNPAEYILDVIGAGATATTNRDWHEVWNNSEERKAISAELDKINASFSNSEDKKTLSKEDRSTYAMPLWFQVKMVMTRNFQSYWREPSILMSKLALDIFAGLFIGFTFYNQGLGVQNIQNKLFAVFMATVLAVPLINGLQPKFIELRNVFEVREKPSNIYSWVAFVFSAIIVEIPFNLVFGTLFFLCWFYPIKFYKHIHHPGDKTGYAWLLYMFFQMYFSTFGQAVASACPNAQTASVVNSLLFTFVITFNGVLQPNSNLVGFWHWMHSLTPFTYLIEGLLSDLVHGLPVECKSHEMLTINPPSGQTCGEYMSAFLTNNTAAGNLLNPNATTSCSYCPYQTADQFLERFSMRYTHRWRNLGIFVGYVFFNIFAVLLLFYVFRVMKLRSTWLGKKITGTG

SEQ ID NO: 5413 - protein, 254 aa, Zea mays
MISFIYRIPHRGMLAKGRKVAGRREEMSANYAFGPQDDDAIIKHRLLTRTTTTRGEPPLKKLQKKFMSFATEIEKDADNISDCERLYKAFLHEINTFELPLLKSKAVVDANIREKESFNELQVEIERQILHAKTDIEDLKKQLEQSKIERQHKEECEAIRKLISLQPPRSETEKLIADLEKEITDLKAENVACIRTLELRKKQFALLLHVVEELQISIEDEQKSIADELRAIAGEQKMSMEEGSVGASDSMVVD

SEQ ID NO: 5414 - protein, 599 aa, Oryza sativa (japonica cultivar-group)
MRKCTGVLLILTLAVLLLLLSPSPSTAPPPAATAAGGPAARLLPTLPGLSRLYPPPANSTAHHSWRLLRPLLLRSDALPGTAAGVLEAADAWRNLTLAVAASAAGGKDGRRQGDLDVSCRSSVEGDLGGVGARGVKIPCGLAEGSAVTVVGVPKPGAAWFRVEMVGGGGEVVVSVNVSLGVAEMVVEQSSWTREEGWGLSERCPPVGDADRNSSSLLSLVDGLVRCNQQAGVSGLQGRNNTMANVTANEHENEKRPKGRANFGGSFSIIEGEPFTATLWAGAEGFHMTVNGRHDTSFAYRERLEPWSVAEVKVSGDLELLSVLANGLPVSEEVDMASVELMKAPPLSKKRIFLLIGVFSTGNNFKRRMALRRTWMQYEAVRLGEVAVRFFTGLHKNEQVNMEILKEAQMYGDIQFMPFVDYYTLITLKTIAICMFGTKVVPAKYIMKTDDDAFVRIDEVISSLKKSDPHGLLYGLISFQSSPHRNKDSKWFISPKEWPVEAYPPWAHGPGYIVSRDIAKFIVHGHQERTLQLFKLEDVAMGIWIQQYKNSGQKVNYVNDDRFYSEGCDSDYVLAHYQSPRLMMCLWEKLQKEYQPVCCE

SEQ ID NO: 5415 - protein, 777 aa, Schizosaccharomyces pombe 972h-
MAPIGEKKRFELEKSIEPIYTGGPVAFDSNEKILVTALTDRIIGTRSETGERLFSIKKDEDDYVTALAITSDSKKLIAAFRSRLLTIYEIPSGRRIKSMKAHETPVITMTIDPTNTLLATGGAEGLVKVWDIAGAYVTHSFRGHGGVISALCFGKHQNTWVLASGADDSRVRLWDLNSSRSMAVFEGHSSVIRGLTFEPTGSFLLSGSRDKTVQVWNIKKRSAVRTIPVFHSVEAIGWVNGQPEEKILYTAGEGNLILAWDWKSGSRLDPGVDTTHSETNAIIQVVPFSENTLLSVHSDLSLLLRKRVPGEGFITIKKLNGSFDEVIDCAWIGDDHLAVCSNTEFIDVISTDGTQVFGVLEGHTDIVLTLDSSEDGVWLATGAKDNTVRLWNLNIEDNVYKCIHVFTGHTASVTAVALGPLDVNGYPTFLASSSQDRTLKRFNLGSQLNKSDFSNRAVWTIKAHDRDVNAIQVSKDGRIIASASQDKTIKLWDSSTGEVVGVLRGHRRGVWACSFNPFSRQLASGSGDRTIRIWNVDTQQCVQTLEGHTGAILKLIYISQGTQVVSAAADGLVKVWSLSSGECVATLDNHEDRVWALASRFDGSLLVSGGADAVVSVWKDVTEEYIAKQAEELERRVEAEQLLSNFEQTEDWQQAIALALSLDRPHGLLRLFERVMTAPHQPNSITGNKDVDNVLVQLPDHQLIILFQRIRDWNTNSKTSMVAQRLLRLLLHSYSPEHLLKLSGIKDILDSMIPYTDRHLARVNDLIEDSYIVDYVI

SEQ ID NO: 5416 - protein, 397 aa, Bordetella parapertussis
MSNVNTLSALAKSGALSGKRVFIRADLNVPFDDAGRISEDTRIRASVPGIRLALDAGEAVMVTSHLGRPKEGALTEADSLAPVAQRLSELLGMQVRLVPDWVDGVSVEPGEVVLLENCRGNVGEKKDDEGLSRKMAALCDVYVNDAFGTAHRAEATTHGIARFAPVACAGPLLEAELEALGRALHDPKRPLVAIVGGSKVSTKLSILQSLADKVDQLVVGGGIANTFMLAAGLPIGKSLAEPEQVEQARAVIEIMKRRGAEVPIPTDVVCAKSFGADAAATVKAAADVAEDDMILDIGPQTAQRLADILKAAGTIVWNGPVGVFEFDQFAHGTEVVARAIADSAGFSIAGGGDTLAAIAKYGIADQTGYISTGGGAFLEFLEGKALPAVAVLQARAA

SEQ ID NO: 5417 - protein, 188 aa, Yersinia pestis CO92
MYDLYEGLIFDMDGTLLDTESTHRQAWRQVLAPYGMHFDEQAMVALNGAPTWKIAGVIIAHNQSDLDPHFLAAQKTSLVNTMLLDNVKPLPLIDVVKSYYGRLPMAVGTGSEHSMAEMLLRHLGLRDYFDAIVGADDVTKHKPEPETFLRCAELLGVRPDKCIVFEDADFGVEAAKRANMAIVDVRLL

SEQ ID NO: 5418 - protein, 389 aa, Coprinopsis cinerea okayama7#130
MPALLTPSLNNAPDSITTGLDYVRRSGILIASDGAEYNRIAEFDPLDATSNPSLVLAAVSKPEYAHLIDEAVDYSVKKGGDLNEEERTTLALLKLLVLVGVQILSIIPGRVSASVDPRTGYSIPAILSQARTIISLFEENSIPRSRILVKIPGTPEGISAAHTLEHPTDGSEPIYTNITLIFGRAQALACAQAGLSVISPFVGRVKDWWDAQGFSLTERDPHPGMALVSSIQRAYARYGYKGKTEVMAAGFRKPEEVLAMAAGLGRPDEAFEVVPDSMKGWKRGTFLAADLVTIPPELLAGLRSWTFPAKSPTVPKMRSQETEVDEDTEPIYFEARLGSTTSLYESTLKNSKTERIVLDKVSEGLEKFSADAVKLEDIVRDKVLAALRR

SEQ ID NO: 5419 - protein, 114 aa, Gloeobacter violaceus PCC 7421
MKQLVGGLLLSAVGIVFAASSLQAAADLAQGEKVFKANCAMCHAGGRNTVNPAKTLKIEDLKKYKMDTAAAISAQLYNGKGAMPAFGKNGKLKQDQIDSVTAYVLDQANKGWKK

SEQ ID NO: 5420 - protein, 283 aa, Glycine max
MYRFSNTVIGFLNLFTLLASIPIIGAGLWMARSSTTCENFLQTPLLVIGFVVLVVSLAGFIGACFHVACALWLYLVVMLFLIAALMGFTIFGFGVTSKGGGVEVPGRVYKEYQLQDYSPWLRKRIQDPRYWNTIRGCILGSKTCEKLASWTPLDYMQRDMSPIQSGCCKPPTACTYNVATMMMTQDPDCYRWNNAPNLLCYECDSCKAGVLEDIRGNWHKLSVLTVTMLVLLIGIYSIGCCAFRNTRRAETDYPYGENRMTKVRPRWDYHCWRWLHDRREQLY

SEQ ID NO: 5421 - protein, 389 aa, Azoarcus sp. EbN1
MKALCWHGKKDVRYDTVPDPRIEDPRDAIVKVTSCAICGSDLHLYDGFMMGMESGDILGHEFMGEVVEVGAADHRLKVGDRVVVPFTICCGECEQCRRGNFSVCERSNRNKALADKTFGHSTAGLFGYTHLTGGYAGGQAEYVRVPYADVAPVKITSGLSDDQVLFLGDILPTGWQAAVQCDIQPTDTVAIWGAGPVGQFAIRSAVLLGAKQVIAIDRVPERLGMAQAGGATTINCEDESVIERLNELTGGKGPEKCIDAVGMEAHATQSLDSLYDRAKQAIMLETDRPHVLREMIYVCRPAGTLSVPGVYGGLIDKLPFGALMNKGLTLRTGQTHVNRWTADLLRRIEEGQIDPTFVVTHVAALEDGPEMYKTFRDKKDGCIKVVLKP

SEQ ID NO: 5422 - protein, 439 aa, Aster tripolium
MKILLGVGINGGLFGSCVSSRSKVDSSTSGISSHFEIKSTNNVSKDQPTTSNSEHNLPTLTPEDELKVASRLRKFGFNDLKMATRNFRPESLLGEGGFGCVFKGWIEENGTAPVKPGTGLTVAVKTLNHDGLQGHKEWLAEVNFLGDLGNPNLVKLIGYCIEDDQRLLVYEFLPRGSLENHLFRRSLPLPWSIRMKIALGAAKGLAFLHEEAKRPVIYRDFKTSNILLDAEYNAKLSDFGLAKDGPEGDKTHISTRVMGTYGYAAPEYVMTGHLSSKSDVYSFGVVLLEMLTGRRSMDKKRPNGEHNLVEWARPHLGERRRFYRLIDPRLEGHFSIKGAQKAAQLASRCLSRDPKARPLMSEVVDCLKPLPALKDMAGPSYYLQTVQPERAGSSPDPNRTRVGSFSRNGSQHPRTLSIPNASPRHNQFLQDSPNPNGKQ

SEQ ID NO: 5423 - protein, 134 aa, Triticum aestivum
  misc_feature (36)..(36): Xaa can be any naturally occurring amino acid
  misc_feature (55)..(55): Xaa can be any naturally occurring amino acid
  misc_feature (65)..(65): Xaa can be any naturally occurring amino acid
  misc_feature (84)..(84): Xaa can be any naturally occurring amino acid
  misc_feature (88)..(88): Xaa can be any naturally occurring amino acid
  misc_feature (90)..(90): Xaa can be any naturally occurring amino acid
  misc_feature (97)..(97): Xaa can be any naturally occurring amino acid
  misc_feature (105)..(105): Xaa can be any naturally occurring amino acid
  misc_feature (115)..(115): Xaa can be any naturally occurring amino acid
  misc_feature (125)..(125): Xaa can be any naturally occurring amino acid
  misc_feature (128)..(130): Xaa can be any naturally occurring amino acid
MAPTVMASSATSVAPFQGLKSTAGLPVSRRSNGASXSAASSNGGRIRCMQVWPIXGIKKFETLSXWPTAQQRRASSKQVDYLIXRLQXWXACLEFKXRLGSTFRXEQQRHLPGYXRMGRYWDNVXKLXXXSGCN

SEQ ID NO: 5424 - protein, 157 aa, Arabidopsis thaliana
MTMRSSLPSSSSSYSLASTSLSNRLETQEKRYSSWVQNKKKKKKNKGLKNPNKKRKTSLKKNKGLKNPKRKTSLNNVLKYPLADHYSPDQISQLIQSLEPHVSKTQSLNPSQFSLFMYNHGDNTLSQIPVTASNFNQDFSALLQESGLMKQELYGYD

SEQ ID NO: 5425 - protein, 334 aa, Burkholderia sp. 383
MARKITYSQAINEALAQEMARDESVIVMGEDNAGGAGAPGEDDAWGGVLGVTKGLFHKFPGRVLDTPLSEGGYIGAAVGAAACGMRPVAELMFIDFMGVCFDQIFNQAAKFRYMFGGKAVTPVVIRAMYGAGLRAAAQHSQMLTSLFTHIPGLKVVCPSTPYDAKGLLIQAIRDNDPVIFLEHKLLYTREGDVPEESYAIPFGEANVMRDGDDATIVTYGRMVHLAMDAAAKLAKDGIQVDVIDLRTTSPLDEETILESAERTGRVVVVDEANPRCSIATDIAALVAQRAFHALKAPIELVTAPHTPAPFASVLEDLYIPSADAIAQAVLKTRS

SEQ ID NO: 5426 - protein, 327 aa, Burkholderia sp. 383
MTASTQLSRDKLLDAYRLMRTIREFEERLHVEFATGEIPGFVHLYAGEEASAVGTILHLGLDDYVATTHRGHGHCIAKGVDVHGMMAEIYGKKTGVCHGKGGSMHIADLAMGMLGANGIVGAGGPLVCGAALAAKHKKTGGVGVCFFGDGASNQGVIFESMNLASVWRLPAIFVAENNGYAEATSSSWSVATDNIADRANGFGMPGVIVDGFDFFAVHEALGEAVERARNGGGPTLVEVKFTRYFGHFEGDAQTYRAPGEVQKLRDEKDCLKHFETRVVRAEALTTADLRAVDAQVKALIDDAVAQAKAAPVPDAADLLTDVYVSYP

SEQ ID NO: 5427 - protein, 648 aa, Methanococcus voltae
  misc_feature (133)..(133): Xaa can be any naturally occurring amino acid
MTEFKVVHTVCPYCGTGCGIDLVVKDGKLVDTHPFKRHPVNQGKVCIKGNYCYEFVHSEDRLTVPLIRKNGELVESTWEEALDLIASKLKGYNPDEVGFFSCARGANEESYALQKFARVVMKTNNVDHCARIXHAPTVTGLGECFGSGAMTNSIGDLAEADVLFIYGSNTFEAHPLVARSIVKAKDNGTKIIAIDPRKTHTSKMADIHMKLIPGSNIDLMNAIMNVIITEGLTDDEFIKNRTENFDELKEVVSKYTPEEVAKISGIPAETIREAARLYANADKAAIMYCLGVTEYTFGVDNVKSCCNLAMITGNLGERGAGVNPLRGQNNVQGACDMGALPNVYPGYQKVGEMTSKLEELWGVEGLSPEVGLMGEEKMVADADIKKVKNALGKLDFLVVKDIFLNDKGKLADVVLPAACWAEKDGPFTNTERRVQRIRKAVEAPGEAVPDWVVVKELAQRMGYGDKFAFESASDIFDEMAKVIPQYAGMSFERLGIDGLQWPCKTPDHPGTVFLHEGKFLRPNGLGKICPVEHKAPAEMASEEYPLILTTGRIIFHYNSGTMTRRCESITNEIDENFIEMNIEDANNLGIKAGETVKVSSKRGDVKAIARVSDDIVKGVVYMSFHFNEEPTNKLTNSAYDPVSKTRRT

SEQ ID NO: 5428 - protein, 415 aa, Schizosaccharomyces pombe 972h-
MDVSTQTRHATYFQDENQLQKDHIYVKKKSHIKLNTGVRAPFKAVDNINQQDEPTLIEGNNESSISSSTGDTFEEDFAYQDKVEIEERSIRSTPKSIGDDDLENREGSFDAPEGILTHGKHRLPTIPEWTKEDLAALSEAAARLQANPSPEDIETDPSMVPDYDPEIFHYMQSLERKLAPPPNYMSVQQEIDWVTRHMLVDWIVQVQIHFRLLPETLFLAVNLIDRFLSIKVVSLQKVQLVGLSALLIACKYEEIHPPSIYNFAHVVQGIFTVDEIIRAERYMLMLLDFDISWPGPMSFLRRISRADSYDHDIRMLAKYLQEVTLMDEIFIGAHISFIAATAYYLSMQMLGHLDWTPCHVYYSGYTARQLKPCAIIIMECLVDAPNHHNAIYRKYSENRMKRVSAFAHNWVLSVI

SEQ ID NO: 5429 - protein, 539 aa, Coccidioides immitis RS
MDSEQPPHSVFDTILVLDFGSQYSHLIIRRLRELNVYSEMVPCTQRLADLTWKPKGVILSGGPYSVYEQDAPHVDPAFLDLGVPILGICYGIQELAYRLDKANVTAGIAREYGHADLSAKRLDDQGHVDRLFSGIKDNTKVWMSHGDKLVKLPEGFHTIATTANSEYAGIAHETKPIYGIQFHPEVTHTPDGTHLLKNFAVDICGAAQNWTMAKFVDQEITRIRKLVGETDHVLGAVSGGVDSTVASKLMKEAIGDRFHAVLVNNGCMRLNECEQVHETLGKHLGINLTVVDASKQFLDALKGVTDPERKRKIIGGKFIDVFEAEALKIEAGVKHTGAKVKWFLQGTLYPDVIESLSFKGPSATIKTHHNVGGLPKRMQEGAGLKLIEPLRELFKDEVRQLGRELGIHNDLVMRHPFPGPGIAIRVLGEVTPERVEIARRADHIFISMIREAGLYDKIAQAYAALDPTKAVGVMGDKRVHAEMIVLRAVETSDFMTCTAYPFPHEFLSRVSTRIINEVHGVSRVLYDISSKPPATIEME

SEQ ID NO: 5430 - protein, 412 aa, Spiroplasma citri
MTNKKELKDVQVKGKKVLVRVDFNVPMKDGQVTDDNRIIAALPTIKYLIAQEAKVILFSHLGKVKTADDLEKRDMAPVAKVLEQKLGQPVKFINAFEGKQLEEAINEMHNKEVILFQNTRFADIINSNGQISVDSEGKAAAKRESKNDSALGKYWASLGDVFVNDAFGTAHRAHASNVGIAENITESCLGFLVEKEVKMLSQCVDNPVKPFVAIIGGAKVSDKIGVIEHLLTKADKILIGGGMAYTFFAAQGHKIGNSLLEVDKVEIAKTFLAKGQGKIILPIDALEAPEFADVPAKVTTGFDIDDGYMGLDIGPKTIELFKKELADAKTVTWNGPMGVFEFKNYSIGTKAVCEAIAELKGAFTLIGGGDSAAAAIQLGYKDKFTHISTGGGASLEYMEGKPLPGIEAVQSK

SEQ ID NO: 5431 - protein, 237 aa, Brassica napus
GIRTRKAYKALSLSLLLFPLSSASAMFSQSSALLVRPNLVGFTLSPPGKASIASSSLPRFLRMESQSQPLQSISCASSPSNNLSQATPSSSLIESARIGEVKRVTKETNVSVKINLDGTGVADSSTGIPFLDHMLDQLASHGLFDVHVRATGDVHIDDHHTNEDIALAIGTALLKALGERKGINRFGDFTAPLDEALIHVSLDLSGRPYLGFNVKIPTQRVGNYETQLVEHFFQSLV

SEQ ID NO: 5432 - protein, 399 aa, Rickettsia typhi str. Wilmington
MSIISTRLNSIKPSPTLAVVKKTLELKKAGVNIIALGAGEPDFDTPDNIKEVAITSIKDGFTKYTNVDGIPLLKQAIKNKFKRENNIDYELDEIIVSTGGKQVIYNLFMASLDKGDEVIIPVPYWVSYPDMVALSTGTPIFVNCGIENNFKLTVEALERSITDKTKWLIINSPSNPTGAGYNCKELENIAKTLRKYPNVNIMSDDIYEHITFDDFKFYTLAQIAPDLKERIFTVNGVSKAYSMTGWRIGYGAGSKALIKAMTVIQSQSTSNPCSISQMAAIEALNGTQDYIKPNALNFQKKRDLALSILEKVIYFECYKPEGAFYLFVKCDKIFGTKTKSGKIIANSNHFSEYLLEEAKVAVVPGVAFGLDGYFRISYATSMQELKEACIRIKQACNTL

SEQ ID NO: 5433 - protein, 813 aa, Gloeobacter violaceus PCC 7421
MLQVERHDSQRRLHRDRALVLRLGEVGLADIDKVGGKNASLGELLRQLSAEGIRVPEGFAVTAFAYREFIAHNGLEAKLRALFAGLDTEDIEQLRRVGEQARGLVLASSLPERLQERIREGYGELCGRYGADTDVAVRSSATAEDLPEASFAGQQETYLGVQGEEAVLEACKRCYASLFTDRAISYRQLMGFDHFEVALSVCIQKMVRSDLAGAGVMFSIDPETGFANVVHIAAGWGLGELVVQGAVNPDEYVVFKPTLERGFFPILAKRPGSKERKLVYSETGPITVETSPAERSGFVLEEAEILELARWAVLIERHYSRVRGVNTPMDIEWAKDGRTGELFIVQARPETVQSHKSAQTLVHWRLKGSAPVLATGRAVGEGVGQGRARVIRDPSQLEAFEKGEVLVTDRTDPDWEPIMKKAGAIVTNQGGRTCHAAIIARELGIPAIVGTGEATRRIETGDPVTVACCEGEEGRVYAGEVPYERTEVAIDALPRPHTRILLNVGNPAEAFRLAAIPNDGVGLARLEFIIANHIQVHPLALLHFEQLPEGDEKARLSALTEGYPDRAEYFVEHLARGVATIAAAFYPQPVIVRLSDFKSNEYANLLGGRHFEPLEENPMLGWRGASRYYDERYRAAFALECRALRWVRDQMGFTNVVVMVPFCRTPEEGRRVIAEMASHGLVRGENGLEVYVMCELPSNVVLAGEFAQVFDGFSIGSNDLTQLTLGLDRDSAGVAGLFDERHPAVRKMVAMAIEGAHAARRKIGICGQAPSDYPEFARFLVERGIDSLSLNPDAALKTRLLVARVEEELSRPS

SEQ ID NO: 5434 - protein, 137 aa, Oryza sativa (japonica cultivar-group)
MATPAPVVTHGDHHHDTAVPVEKIEGDHAKTEATLPRAPEEEKKGFLDKIKEKLPGGHKKPEDATAVPPPAASPAAPATTPAPAHPPPATEEVSSPDGKEKKGILGKIMEKLPGYHKGSGEEDKTAAAATGEHKSSA

SEQ ID NO: 5435 - protein, 535 aa, Triticum aestivum
MVHPLHALHELLLQARSPHAALGLVFVLLVCPLLALLVVRRLATPSTAAATARAREELLGRLPSPPSRLPIIGHMHLVGSLPHISLRDLAAKHGRDGLMLLRLGAVPTLVVSSPSAAEAVLRTHDHVFASRPYSAVTEILFYGPTDAAFSPYGEHWRQVKKIATTHLLTNRKVRSYRHAREHEVRLVVAKIRDAASKCTVIDLTDLLNAFTNDIVCEAVSGRLFRERGHKKLFRELVEANSLLLGGFNLEDYFPMLVKMDIIKRIVCAKAQKVNKMWDNLLNNIIDEHARKSVPEHNNEDSDFTDVLLSIQQEYKLTRDHIKAQLEIMFEAGTDTSFIVLEYAMVQLMRKPHLMNKLQAEVRSTITKGKEIVTEDDLDSLAYLKAVIKETLRLHMPGPLLIPHLSMADCNIKGYTIPSGIRVIINSWALARDPSSWEHADEFMPERFMECGSAATMDYKGNDFQYLPFGAGRRICPGMNYATASIEIMLANLMYHFNWKLPVELMDEGGISMTEFFGMTVHRKEKLLLVPVVPED

SEQ ID NO: 5436 - protein, 1031 aa, Arabidopsis thaliana
MDKARHQQLFQHSMEPGYRNETVPQPFMPDQTGSASANMRPPNSNGSDVKAVHNFSIQTGEEFSLEFMRDRVIPQRSSNPNGAGDMNYNTGYMELRGLIGISHTGSECASDVSRFSTVENGTSDIERTNSSLHEFGNKLNHVQSAPPALLSKDSSVGNLHGYKNTSSSASGSVTAKVKILCSFGGKILPRPGDSKLRYVGGETHIISIRKDISWQELRQKILEIYYQTRVVKYQLPGEDLDALVSVSSEEDLQNMLEEYNEMENRGGSQKLRMFLFSISDMDDALLGVNKNDGDSEFQYVVAVNGMDIGSGKNSTLLGLDSSSANNLAELDVRNTEGINTIAGDVVGVGASQLMVNGFQQTSAQQSESIPPSSSLHYSQSIPLNAAYQLQQSVPPSSALHYPQSITPGSSLQYPQSITPGSSYQYPQSIIPGSASSYGIYPQYYGHVVQHGERERFPLYPDHSSNYSAIGETTSSIPIQGHVSQQGGWAEGYPYPGSTPKSTQALAEEQKVSSDMKIREEVEPENRKTPGNDHQNPPQIDDVEVRNHNQVREMAVATTPPSQDAHLLPPSRDPRQNTTAKPATYRDAVITGQVPLSGIEDQLSTSSSTYAPVHSDSESNLIDLNYPEPEQSSQRVYCSERIPREQLELLNRLSKSDNSLSSQFVTSESPANTAQQDSGKEAVGKSHDEFKTVNDDANHHTHKDVETIFEKVGVSDETLESEPLHKIVNPDDANKNRVVNGADTEIGVSNLSHVNAAMSHVIPEEQASLQGDILIDINDRFPRDFLSEIFSQAISEDTSTVRPYPHDGAAVSMNVQNHDRKNWSYFQQLAEDQFIQRDVVLDQADSRIPSDRKDGGESSRLPYVSPLSRDGISTNLANPQLTLGQDYGGNFSEKDGGGTGSIPPALENEQMKVTESEEFGAMVENLRTPDSEPKDEKTETRHAALPPLGSEFDYSGLLIIKNEDLEELRELGSGTFGTVYHGKWRGSDVAIKRIKKSCFAGRSSEQERLVSCLQIMSNASPFLPCLKFMHLC

SEQ ID NO: 5437 - protein, 638 aa, Azoarcus sp. EbN1
MNASEKFIAAKAHVDEAAVAPLPNSRKIHVEGSRPDIRVPMREISQADTPASMGAEPNPPIFVYDCSGPYTDPTAKIDIRSGLVALRQQWIEERGDTEVLADLSSEFGRSRAADKALDELRFPGLHRHPRRAKAGMNVSQMHYARRGLITPEMEYVAIRENMNRAAYVESLRTAGPTGEKMAKLLTRQHPGQSFGASIPEEITPEFVRSEVARGRAIIPNNINHPESEPMIIGRNFLVKINANIGNSALGSSISEEVDKMTWAIRWGGDTVMDLSTGKNIHETREWIIRNSPVPIGTVPIYQALEKVDGKAEELTWEIFRDTLIEQAEQGVDYFTIHAGVLLRYVPMTANRMTGIVSRGGSIMAKWCLAHHKESFLYTHFEDICDIMKAYDVAFSLGDGLRPGSIYDANDDAQLGELKTLGELTDIAWKHDVQTIIEGPGHVPMHLIKENMDLQLEHCKEAPFYTLGPLTTDIAPGYDHITSGIGAAQIGWYGTAMLCYVTPKEHLGLPNKQDVKEGIITYKLAAHAADLAKGHPGAQIRDNALSKARFEFRWEDQFNLGLDPDKAKEFHDETLPKDSAKVAHFCSMCGPHFCSMKITQDVRDFAAKEGLKEDEALAKGMEVKAVEFVKSGAEVYRQV

SEQ ID NO: 5438 - protein, 297 aa, Aster tripolium
MLPYSSLQEAEAAMGRSLTFAETLWFNYSANKSDYVLYCHNIPLIFFLTTFLPIVYVVIEFLFPDYAASYKIQPKIKVSLYENFKVYLGVMRTFFLLVAPILLASHPSVQMIGIRTSLPLPSLLEIASQLLVYFLIEDYTNYWIHRFFHCKWMYNNIHVVHHEYTAPTGFATQHAHWFRYWCLGIPSFLGPSIAPGHMVTFLLWLALRQFEAIENHSGYDFPWTYKKFIPFSAGAEYHDYHHYVGEKSQSNFWHPIFTYCDYLYGTDKGYRNRKKLLAQQERWSKSEGKRAKGEHMR

SEQ ID NO: 5439 - protein, 388 aa, Triticum aestivum
MLHLQMHPLPLPRAAPHPTTATLSYSLHRRLALSASASTTPFSTEEYLVATCGLTRAQALKASKKLCHLKSASNPDAVLALLSGVGLSRPDIAAVVAADPLLLRSRVDNVAPRLSALRDRLGLSAPEIASFLLVGATALRSCDITPKLEFWIPFFGSLGKLLQTMKRNRSILTTDLEKVAKPNIALLEQCGLSVCDIVKLSTPCSRLLVFNPERVKAFVLRAKKLGVPRSSYIFKYAVGVACSITEDKVAARMEFLRSTLGCSMDKVRVAVRNKPHILGISEEKLRLKIEFMVDEVGLDPDYIVERPMLFTYSLEKRMKPRYYVAKILQAKGLMKKSVGFRRVVGYGEDNFIPTYIDSHQNNVPGLANAYAAACAGEMLLMSSFECRH

SEQ ID NO: 5440 - protein, 155 aa, Aster tripolium
MGSGGGYEKGKHGGIQNPLRSTDHEMGNKGTNIHSTTGGHGIGSTGTTMGSGGGQGYEEGKHGATGGILHRSGSGSSSSSEDDGEGGRRKKKGVIGKIKEKLPGGQQGSDEQSRLQAPATHVGAGGGGHGYQGEEVPEMMGLMNKIKDKLPGGNH

SEQ ID NO: 5441 - protein, 479 aa, Fragaria x ananassa
MKKASELIFIPIPGIGHIVSTVEIAKLLLCRDDNLFITILIMKFPFTADGSDVYIKSLAVDPSLKTQRIRFVNLPQEHFQGTGATGFFTFIDSHKSHVKDAVTRLMETKSETTRIAGFVIDMFCTGMIDLANEFGLPSYVFYTSGAADLGLMFHLQALRDEENKDCTEFKDSDAELVVSSFVNPLPAARVLPSVVFEKEGGNFFLNFAKRYRETKGILVNTFLELEPHAIQSLSSDGKILPVYPVGPILNVKSEGNQVSSEKSKQKSDILEWLDDQPPSSVVFLCFGSMGCFGEDQVKEIAHALEQGGIRFLWSLRQPSKEKIGFPSDYTDYKAVLPEGFLDRTTDLGKVIGWAPQLAILAHPAVGGFVSHCGWNSTLESIWYGVPIATWPFYAEQQVNAFELVKELKLAVEIDMGYRKDSGVIVSRENIEKGIKEVMEQESELRKRVKEMSQMSRKALEEDGSSYSSLGRFLDQIQTS

SEQ ID NO: 5442 - protein, 332 aa, Bacillus cereus ATCC 14579
MLKTTESKGNEITKEQARWMYEKMLEIRKFEDKVHELFAQGVLPGFVHLYAGEEAVAVGVCAHLTDSDSITSTHRGHGHCIAKGCDLNGMMAELFGKATGLCKGKGGSMHIADLDKGMLGANGIVGGGFPLACGSALTAKYKGTKDVSVCFFGDGANNEGTFHEGVNLAAIWKLPVIFIAENNGYGEATTFEYASSCDSIADRAKAYNIPGVQVDGKDLLAVYKAAAEAVERARNGDGPTIIECMTYRNYGHFEGEAQTYKTSEEKEEHLNEKDAIVNFRKHLIHEALLTESELVDMEKPVDEAVQRSIEFSENSPYPDDEELLKDVYVSYK

SEQ ID NO: 5443 - protein, 1213 aa, Oryza sativa
MPEPEVGVLGGRGLHRDGLKGWPDLRSLSGKKMTTPPPPPVEKQQQQARPAAVAPPDQTLEFSDGLLLRVLACLPEPHLTGAASLVCRRWMRLAGRLRRRLVVRDWAFVTHRLHHRFPELADLDLFPASIVAPAVPSPTSPLLTCAEVSLTLDTGADPPLVACRFLADDVLDRGLVAVAASFPNLRRLSATAASESGGLMDIAGGCATLQELELHRCTDLALRPVSAFAHLQILRLVAASSALYGTSEDGGVTDIGLTILAHGCKRLVKLELVGCEGSYDGIAAVGRCCAMLEELTIANHKMDNGWLAALAFCGNLKTLRLQGCCRIDDDPGPAEHLGACLTLESLQLQQCQLRDRRALHALLLVCEGARELLVQNCWGLEDDMFAMAGLCSVRRYNACKLQCMDPSMFGVSMPLLLLWRVKFLSLEGCSQLTTRGLESVITSWSDLQSLKVVSCDKIKDEEISPALSELFSTFKELKWRPDNKSRLAASLAGTGMGKKGRVLCKRLREREMKGKGQRTDAGAQLSTNRARMSVKGRAPPPEEGKKNGEKMAAAAAIPIPIPCVAEPTAASRVSPGSSPARSDASEGAAFYAADTEAEPEASVGRSTQMLLAMAAMGGRGGPYGRRPASSYGSCAAWSAGSLTDHRPASPSPICSPVSSNGGEGCRDVERTNPVPPRFIHKATPARLMRRARSSHNYRRRLGAMDAINEWRLPKVSEEEDEAVDQTDWQADTLSSRISSARDWNFEAGGAYEGSDHNGVQRMGRWPQGSAVKHKENFVHAKLVAWKNAEIEKLIDKLRRKEADIDEWQMNQVTQAKEKMKRIEIKLEKKRARAAEKMQKAIKDAQKKADKKKIKEHAATDNQIASVERAMVKMSRTGKLPWFLEVFVCPSNCNQNNSSALSTIPMRSGEGRDCEVPGSTAVQGTNVPTISQEQDRSVYKELRSQNEEFFELFMLKVSLKRQIDRVNHHLALCRKLWRQANESAGGHRCGNSSCSGGHRHRAVAVPVPHAEATPRAMPSTPLAVPLPATAMAQRTQCNLARMPRPQQPNCGGRPGSSRGGAVGLSAAGRMLETPGQPHVAPNGWPAGHGHPASGTLAAAMACSSRPVARQQGNRREQGWDAHQAQVGAQHQNLPRFPPQQGGGNIGERQGQGQFRPGTPSYVQEQRPPPQSSSSHEALQAGERQQANNNSSGSSRQQRQTDTATVASRREPMSK

SEQ ID NO: 5444 - protein, 514 aa, Oryza sativa (japonica cultivar-group)
RNHTRVNDDTRAGAMGLPGRRNPLLSARRAAASLRRSRRLPVYVAAVFFVASVLLMFRDEILYLTTARSPSSSLPTTGGSAGGAGLARKEELVSVNKPVLLGHGGKPEKHHSVTERHRPKVSAKRRPNKKAAKAARKKFMASPSVAAGAEVNVPETCNLSKGKWVFDNATYPLYREQECEYLTAQVTCTRNGRRDDGYQKWRWQPRDCDLPLAFDARLFMERLRGKRLMFVGDSLNRNQWESMVCLVRPALSPGKSYVTWWDGQRVVLHAWEYNATVEFYWAPFLVESNSDDPKAHSIRDRVIKPEAIAAHAGDWVGVDYLVFNTYIWWMNTVNMKVVRPTGKTWEEYDEVGRIEAYRRVLDTWATWVNDNVDPARTSVFFMSVSPLHISPEAWGNPGGVRCAKEDAPVQNWHGPLWLGTDWDMFRAARNASRAAGRVPVTFVDVTAMSELRKDGHTSVHTIRQGRVLTPEQQADPATYADCIHWCLPGVPDVWNLMLYARILSRPPAAAGHVA

SEQ ID NO: 5445 - protein, 362 aa, Arabidopsis thaliana
LHSTETETGKFETFKMSETEFKVLLETFTFPADSAPFKSCHASTIVEVVKDHFLAAYFGGTREGAPDVKIWLQHFKDGQWDSPVIVDEEPGVPMYNPVLFKLPSHELLLFYKIGQEVQKWSGCMKRSYDKGITWTEREQLPPGILGPIKNKPILLEGGTLLCGSSVESWNSWGAWMEVTSDAGRTWRKKGPIYIQGKSLSVIQPVPYQTAAGNLRILLRSFTGIDRICISESLDGGENWSFAVPTVLPNPNSGIDGVKLKDGRLVLAYNTDSRGVLKLGVSLDDGDSWTDILTLEESPGMEYSYPAVIQAGDGNVHVTYTYNRTQIKHVVLKTATDIDSKPYRHGEAGGGHVNLDLYEPNIN

SEQ ID NO: 5446 - protein, 381 aa, Fulvimarina pelagi HTCC2506
MKADYYETLGVSRNVDDRELKSAFRKLAMKYHPDRNPGDTDAEARFKELGEAYEVLKDPQKRSAYDRFGHAAFQNGGGGGAGGFRGDFSSSMADIFDDIFGEMMGGRGRARQSGGTSGRERGSDLRYNMEISLAEAFSGKTAEISVPTTIQCDVCTGSGAKPGTTPSSCPTCGGVGRVRAAQGFFSIERACPTCQGRGSVITDPCNKCGGDGRLPEERTLQVNIPEGIEDGTRIRLAGEGEAGLRGGPAGDLYIFLSIAPHEFFQREGADLYCSVPVSMTKAALGGAFEVQTIDNGTARVKLPEGTQTGKQFRLKGKGMPVLRSPQTGDLFIQVMVETPQNLSKRQRELLEEFDEIGSKDNSPQSNGFFSRMKDFFENLSD

SEQ ID NO: 5447 - protein, 426 aa, Shigella flexneri 2a str. 301
MSKSENLYSAARELIPGGVNSPVRAFTGVGGTPLFIEKADGAYLYDVDGKAYIDYVGSWGPMVLGHNHPAIRNAVIEAAERGLSFGAPTEMEVKMAQLVTELVPTMDMVRMVNSGTEATMSAIRLARGFTGRDKIIKFEGCYHGHADCLLVKAGSGALTLGQPNSPGVPADFAKHTLTCTYNDLASVRAAFEQYPQEIACIIVEPVAGNMNCVPPLPEFLPGLRALCDEFGALLIIDEVMTGFRVALAGAQDYFAVVPDLTCLGKIIGGGMPVGAFGGRRDVMDALAPTGPVYQAGTLSGNPIAMAAGFACLNEVAQPGIHETLDELTTRLAEGLLEAAEEAGIPLVVNHVGGMFGIFFTDAESVTCYQDVMACDVERFKRFFHMMLDEGVYLAPSAFEAGFMSVAHSMEDINNTIDAARRVFAKL

SEQ ID NO: 5448 - protein, 279 aa, Azoarcus sp. EbN1
MTIDRYAVIGNPISHSRSPAIHAEFARQTGQQLSYEALLAPLDGFRDAVERFRRAGGRGMNVTVPFKLEAFALTDRCAPRASAAGAVNTLAFGPDGIFGDNTDGAGLIRDIVHNLDRPLERQRVLLLGAGGAARGVLLPLLAARPASLTLANRSVDKAHALAAAFRSHAPDVALDACSFVDLAGRVFDVVINATAASLANEAPQLPPGLYAANALAYDMMYGCGDTPFLAAARSDGATQRADGLGMLVEQAAESFLLWRGVRPDTAAVLAALRRQLDGG

SEQ ID NO: 5449 - protein, 182 aa, Zea mays
MALRLPISSSHGLASTPAPISTTTCRPAVLATAAAQKRSLLLATASETRGVAPVRSSGIETSTVGLGCEAVTGQVTEVNKDTFWPIVEAAGDKVVVLDMYTEWCGPCKVMAPKFQEMSEKNLDVVFLKLDCNQDNKPLAKELGIKVVPTFKILKGGKVVKEVTGAKIDELAEAIEIANKKSG

SEQ ID NO: 5450 - protein, 427 aa, Azoarcus sp. EbN1
MTSRNETLFQRAQKSIPGGVNSPVRAFRSVGGTPRFISRAEGARVWDADGKAYVDYVGSWGPAIAGHAHPAIVEAVREAALAGLSFGAPSEAEVDIAELICELMPSIEMVRLVSSGTEATMSAIRLARGFTGRDAIVKFEGCYHGHADSLLVKAGSGLLTFGNPSSGGVPADFAKHTIVLDYNDLQQVEDAFRARGGEIAAVIVEAIAGNMNLVKPLPGFLEGLRRLCTEYGVVLIFDEVMTGFRVGPQGVQGLYGIMPDLTTLGKVIGGGMPVGAFGGRRDIMEKIAPLGSVYQAGTLSGSPVAVAAGLASLKLLREPGFYENLGARTTQLVTGLAAAANDAGVTFSADSVGGMFGVYFSAAVPKSFADVMASDRDAFNRFFHAMLDAGHYFAPSAFEAGFVSAAHTAADIDETIAAAREVFARLG

SEQ ID NO: 5451 - protein, 303 aa, Mycobacterium sp. JLS
MSPVSISGFDVTARLGTVLTAMVTPFKPDGTLDTDAAARLANHLVDSGCDGLVLSGTTGESPTTTDDEKLALLRTVLEAVGDRARVVAGAGTYDTAHSVHLAKSCAAEGAHGLLVVTPYYSRPPQAGLLAHFTAVADATDLPVVLYDIPPRSVVPIAWDTIRTLAEHPNIVAIKDAKGDLHGGGQIIAETGLAYYSGDDALNLPWLAMGAVGFISVWGHFAASQLREMLSAFNSGDIATARKISVALGPLSDAQARLGGVTMSKAGLGLLGFDVGLPRLPQIPPTPDELTALAEDMRAAAVLR

SEQ ID NO: 5452 - protein, 640 aa, Photobacterium profundum SS9
MSIRKQARLEAKQFIDSLTVQPFPNSQKVYVQGSRADIQVPMREISLADSLVGGSKKAPILEPNEPIRVYDTSGFYTDPNQPVNIYDGLEKVRSGWIEERGDTVLLEQSNSVYTKERLSDETLDELRFDARIQARQAVEGHCVTQLHYARKGIVTPEMEYIAIRENMGRAKYADEELNQQHPGINFGANLPPEITPEFVRKEVAEGRAIIPANINHPESEPMIIGRNFLVKVNANIGNSAVSSSIEEEVEKLVWSIRWGGDTVMDLSTGRNIHETREWIIRNSPVPIGTVPMYQALEKVNGVAENLNWDVFRDTLLEQAEQGVDYFTIHAGVLLRYVPMTAKRVTGIVSRGGSIMAKWCLAHHEESFLYMHFREICEICAQYDISLSLGDGLRPGSVADANDEAQFSELRTLGELTKIAWEYDVQVMIEGPGHVPMHMIKENMDEQLKHCHEAPFYTLGPLTTDIAPGYDHITSGIGAAIIGWYGCAMLCYVTPKEHLGLPNKDDVKVGLITYKLCAHAADLAKGHPGAQVRDNALSKARFEFRWEDQFNLGLDPDTARAYHDETLPQESGKVAHFCSMCGPKFCSMKISQEVRDYAKGLEENGDIAIKLLDNPLEGMQQKSDEFRSRGSELYHPVQEEI

SEQ ID NO: 5453 - protein, 220 aa, Bacillus cereus ATCC 14579
MNLKQLAGEYAANFVNDGMKIGLGTGSTVYWTIQKLGERVKEGLSFQAVPTSKETEALAQQLNIPLISLNDVQSLDLTIDGADEIDSNLQLIKGGGGALLREKIVASSSKKLIIIADESKLVTHLGTFPLPIEIIPFSWKQTENKIQSLGCQTTLRLKNNETYITDNNNMIIDCIFPNHISNPVHLHTQLKMITGVVETGLFISMTSTAIIGTKNGIKKL

SEQ ID NO: 5454 - protein, 344 aa, Ralstonia solanacearum GMI1000
MDALVIHAANDLRIEDIDTPEVQPDQLRVQVRFGGICGSDLHYYNHGGFGTVRVKEPMVLGHEVAGRVEEIGPGVHRHAKGDRVAISPSRPCGQCHYCQQGLQNHCLDMRYYGSAMRTPHVQGAFRREIVIDESQAHRLADTLSDQEGAMAEPLSVALHAVRRAGPLLGKRVLVTGCGPIGALIVVAARRAGAAEIIVTDMGAYPLKAAVAVGADVTINVAEQPDGLKPYTTDKGQIDVLFEASGNERALRGAIDALRPRGIIVQVGLGGEMTLPLNAIVAKELELRGAFRFHEEFAMAVELLNKGLVDVKPLISATVPYRNAAHAFALAGDRTQAMKVLLDFQ

SEQ ID NO: 5455 - protein, 624 aa, Oryza sativa (japonica cultivar-group)
MGTRRRRNPVIFLFLWFVMAFELCASLNHEGVALMRFKEMIDADPFDALLDWDEGNASPCSWFGVECSDDGRVVALNLPNLGLKGMLPQEIGTLAHMRSIILHNNSFYGIIPTEMKYLHELKVLDLGYNTFSGPFPSELRNILSLKFLFLEGNKLSGSLPIEYELASMDQTSLNKISTERNEENATRRKLLASKQKRSQKNRMLLSGTSESPLENVTMPKSHPDNITVPHRPVAPRSSSPQPPLPSEPIPSPAPSMPSPAPSVSTTTNGTSGQENKSKTAIYASIGGVACLVVVAMSAALILCYRHRKTSTVVPFSPTASGQLHTATLGGITKFKRSELETACEGFSNIIDTLPRFTLYKGTLPCGAEIAAVSTLVTYASGWTTVAEAQFKDKVEVLSKVSHKNLMNLVGYCEDEEPFTRMMVFEYVSNGTLFEHLHVKEADQLDWQSCLRIAMGVMYCLNYMQQLNPPVLLRDLSTSCIYLTEDNAAKVSDISFWGDKKEDEKSEASDEHITVYKFALLLLETISGRRPYSDDYGLLILWAHRYLIGDKPLMDMVDPTLKSVPEEQVRELTKLVKLCLSEDPMERPTVAEVTAWMQEITGISEEEAIPKNSPLWWAELEIITS

SEQ ID NO: 5456 - protein, 204 aa, Oryza sativa
  misc_feature (28)..(28): Xaa can be any naturally occurring amino acid
  misc_feature (160)..(160): Xaa can be any naturally occurring amino acid
  misc_feature (166)..(166): Xaa can be any naturally occurring amino acid
  misc_feature (171)..(171): Xaa can be any naturally occurring amino acid
  misc_feature (179)..(179): Xaa can be any naturally occurring amino acid
  misc_feature (183)..(184): Xaa can be any naturally occurring amino acid
  misc_feature (190)..(190): Xaa can be any naturally occurring amino acid
  misc_feature (196)..(196): Xaa can be any naturally occurring amino acid
  misc_feature (199)..(200): Xaa can be any naturally occurring amino acid
WIPRAAGRHEGSVLLFRPDENALRMRVXADRLCMPAPSVEQFLEAIKLTILANKRWVPPTGKGSLYIRPLLIGSGAILGVAPAPEYTFVVFACPVGHYFKDGLSPISLLTEEEYQCAAPGGTGDIKTIGNYASAVYAKERAKERGHSDVLYLDPVHKKFXEELSSXNIFMXKDNIISTXLLTXXTVLPGXPRKSIXEYXXTLDS

SEQ ID NO: 5457 - protein, 446 aa, Aeropyrum pernix K1
MAGDSSSDDIGGARIIEIYRRYGGKIEVMPKVPVSGVEDFAIWYTPGVAEASIRINKDPDESFELTSRWNMVAIVTDATRVLGLGKLLPEAAYPVMEGKALIFKLFGGVDAVPIVHRRREPGAFASLVKDLEPSFGGVNLEDIESPKCFYLLDFLRMELEIPVWHDDQQGTAAASLAGLINAFKIVGKNLRESRIVLLGAGAANIALYRFLKAYGVNPRNIVVVDSKGVLHPEREDMDRLLFSNRYKYEIALETEGGGLAPGSSLEEALRGADALVAASRPGPGVVKKEWIRGMSRDPIVFALANPTPEIWPWEARDAGARVVATGRSDLPNQVNNALVFPGVFRGALDVRSRAITDGMAIAAAEEIARYTEEEIGIEEDRILPPITDWQVHYRVAAAVAWAASREKVARKPRTYAEELENARAIIETTRRKYGALLSAGLIERLV

SEQ ID NO: 5458 - protein, 213 aa, Mannheimia succiniciproducens MBEL55E
MQNKINWQKVDNLLPVIIQHFQTCEVLMLGYMNQEALAKTCDEKVVTFFSRTKQRLWTKGETSGNFLNAVDMSLDCDNDTLLILADPIGPTCHTGEESCFHQFATQSEGDWTWFAKLERVLAERKFADPESSYTATLYAKGTKKIAQKVGEEGVETALAALSKDKGEIVSETADLIYHLTVMLHEQNLEWGDVIDKLKERHQGIGLHPEGSNK

SEQ ID NO: 5459 - protein, 144 aa, Glycine max
  misc_feature (58)..(58): Xaa can be any naturally occurring amino acid
  misc_feature (86)..(86): Xaa can be any naturally occurring amino acid
LKVLRPDKVLNHGLFILNDRKHRSSGGSDEWTLSEQAADAAMDRQCLDAAMDCSKVLXMTSPASKRVGWLHAMLLEANRSWDLADXAYTGLPEVIPIDQPIHARMEDLLMAHSYIRVSIDRLNKYLATYMEHHDACRALTGCYI

SEQ ID NO: 5460 - protein, 290 aa, Gloeobacter violaceus PCC 7421
METEEFRPTAAEIPGQQLPYPASQEDMTPAPDTDLANYKPAGKLEGKAALVTGGDSGIGRAVALAFAMEGAHVAIFYNENDDDAKLTAGLVEAQGRQCLLIKGDVRDPQQCRSAIEQTVVKLGGLNILVNNAAYQKAQENFEDITEEQFRRTLETNIFGYFHMAQAALPYLNAEDAIINTGSIVGLVGNEILIDYCASKGAIHAFTKALALNLAKRKIRVNAVAPGPVWTPNIPATMPPEEVDNFGHEVAMERPGQPEELAPVYVFLASKDASFVTGSIFEVTGGKLSSG

SEQ ID NO: 5461 - protein, 406 aa, Arabidopsis thaliana
MMTSCRNIDLGTMMMACGCGRRQFPSLAKTVCKFTSSNRSYGGLVGSCKAVPTKSKEISLLNGIGQSQTVSFDLKQESKQPISLVTLFELVAVDLQTLNDNLLSIVGAENPVLISAAEQIFGAGGKRMRPGLVFLVSHATAELAGLKELTTEHRRLAEIIEMIHTASLIHDDVLDESDMRRGKETVHELFGTRVAVLAGDFMFAQASWYLANLENLEVIKLISQVIKDFASGEIKQASSLFDCDTKLDEYLLKSFYKTASLVAASTKGAAIFSRVEPDVTEQMYEFGKNLGLSFQIVDDILDFTQSTEQLGKPAGSDLAKGNLTAPVIFALEREPRLREIIESEFCEAGSLEEAIEAVTKGGGIKRAQELAREKADDAIKNLQCLPRGGFRSALEDMVLYNLERID

SEQ ID NO: 5462 - protein, 225 aa, Zea mays
MGSAAASPPPSGKLTQDELKRVAAHRAVEFVEPGMTLGLGTGSTAAHALDRLGDLLRAGALPGVDPDLNLVKGRGGSLLREKMIEGAGARFVVIVDESKLVPRLGCTGAVPVEVIPFGAPHTLGLIRGLFHGLPGFHARLRTVPAAPAKGGEDSDSESEQPFVTDNGNYIVEMFFEDGIRGDLRDISDRLLRITGVVEHGMFLGMATTVIVANKDGTVTVINKKK

SEQ ID NO: 5463 - protein, 137 aa, Triticum aestivum
  misc_feature (99)..(99): Xaa can be any naturally occurring amino acid
MARTKQTARKSTGGKAPRKQLATKAARKSAPTTGGVKKPHRYRPGTVALREIRKYQKSTELLIRKLPFQRLVREIAQDFKTDLRFQSHAVLALQEAAEXAYLVGLFEDTNLCAIHAKRVTIMPKDIQLARRIRGERA

SEQ ID NO: 5464 - protein, 469 aa, Zea mays
MLEFYHVIGYKQTQDEVWSMHVKSLIDLRQPQLLTERSPCQLPLRRESTTDPTRRAMAASNAGPEAAATAAGHRFNFDVIVVGAGIMGSCTAHAAASRGARVLLLERFDLLHHLGSSHGESRTIRDAYPKAQYPPMVRLARRLWAEAEAESGYSVLTPAPQLSLGPRSNASLLAAVRSAGAEEADLTRRWGGAFRVPDGWVAAVSERGGGVLNATKAVAMFQALAVRKGVVVRDKTEVLGVRKALEEGGVVVTTSTGAEFRGAKCVVTVGAWASKMVRSIAGLELPIQPLHTMVLYWRIKPGHERELAAESGFPTFSSYGDPHVYSTPSLELPGLIKINYDGGPPCDPDARDWADGGGGVAERVARWIEEFLPDHVDTAGGPVSRLSCMYSMTPDKDFVIDFLGGEFGKDVVVGAGFSGHGFKMAPAVGRILAEMAMYGKESTATEAGVELGHFRINRFEGNPLGNAAN

SEQ ID NO: 5465 - protein, 493 aa, Triticum aestivum
  misc_feature (473)..(473): Xaa can be any naturally occurring amino acid
MEDRQATGGAGAATKVRVNGTTAEATLSTTGGCPELRWRCARATAERSLSLEADVLGAEASGKEVVVRAFVAEDAARPPSRAKARGKRRRREYVFEMADGEGAAAAWGETLRGCLDSIGRPKRLFVLINPYGGKRRASKIYEAEIKPLFEAAGVEVTMQETRYRGHAREVASSLDLARYDGIVCVSGDGVLVELVNGILQRSDWEEAIKMPIGIVPAGTGNGMAKSLLHAASETCSVSDAVFAIITGHKQALDVCTIVQGEKTVFSVLSTTWGLVADVDIESEKYRWMGSARFDFYALVRIMNLRRYRGSVHFVPAPGYEAYGDPVKQAETPIVERNGESQVCSYQGPTAEFQCSDWRSIDGPFVGVCVYNVPWAAENAMAAPEAKFSDGYMDAVILKDCPKADLLALLLKMSDGSYVKSPHVTYFKVKSFRLSPGQLMEDPKRGGIVDVDGEVVARGEGTYGMNQDQDLMGXYGPSVQLTVHQGLATVYCPK

SEQ ID NO: 5466 - protein, 791 aa, Schizosaccharomyces pombe 972h-
MKTPKFITYVTRGFKGLESKSVENNKDHIVENSSPIASKFHEFDEQKKSFEIINYAGHEKFVDDITERESSVPGNAVYDITVRDIDAIVPVTDDVDIPASTFRMWILAFGLATVIAGVDAFFLMRYPSVSIAAIVALLVAYPLGQLWYYIIPQWEIKLPRGIRVSLNPGRFNRKEHACLYIFVNICVSAKLVNTLIIEQIKFFGVNIGIGRAILFNLCSYLSSFGWSGLALPILVYPPTLIWPSVLSSCALFKIFHDNDNTKACNWTISRLRYFFIVFVASFIWYWFPDLIFPALSSLGAWISWCKPSSAVLSQIFGVKTGLGLFPLTLDWAQISSLSNPLITPWWATCCIFTSFVFWIWIVLPGLYYQNYWQVAHFPIMTNSIYTVSGKSYDAQKVVDSKWELVTQKYQEYSPVMLPIAFIINIALSLGAFSSMMISFFLRFPTDVIQPICHVFKYSDIHTKLLKKYKRVHWGFYLASIIVSLGLGFAFTEGWHDIQIRSYGFVVSMVIGAALYIPLSLIESRSSFTISMQAFFEIVAAFWFNGQPMALLYFYSFGFGTLQHAMHMTQSAKIGHYMKVPPRLVAALLFTSGIWSSLVNSAVTGWIMYHVRDVCTSNAENNMTCRSPKTQFNSHLIWGLVGNHIFSSDGRYSFVMWFFLVGAVVSVVVYLLQISFPKSSWKHVNPALLLGGAAQIPSVTGINYSTWAAVAFCFNYLIRRGYYSWWKKYNLITAAAMDCGVAIAGLFIYFCVVYTGGSSNFSWWGTTVSSAGCDKKGCAHLSVSDISKPSGW

SEQ ID NO: 5467 - protein, 321 aa, Schizosaccharomyces pombe 972h-
MGSLEVPCIDLSENDTSIVVKELLDACKNWGFVSLKNHGIPLDEIDRTFKLADKFFDIPVEEKQKYLFKGGRLHSGYTGHFGEKLDMEHQSRGDLKESYDLAGFPDPKLENLCPFIAEHMDEFLQFQRHCYKLTLRLLDFFAIGFGIPPDFFSKSHSSEEDVLRLLKYSIPEGVERREDDEDAGAHSDYGSITLLFQRDAAGLEIRPPNFVKDMDWIKVNVQPDVVLVNIADMLQFWTSGKLRSTVHRVRIDPGVKTRQTIAYFVTPDPETPLSPLFEEKTGKDIETVTAGEWIDGRINFTYGYSAPPKGYLGSQNDGIVA

SEQ ID NO: 5468 - protein, 216 aa, Oryza sativa (japonica cultivar-group)
MPYTAPRPSPPQHSRIGGCGGGGVLKAAGAAGHAASCVAVPAEVARHHEHAAGVGQCCSAVVQAIAAPVDAVWSVVRRFDRPQAYKHFIRSCRLLDGDGDGGAVAVGSVREVRVVSGLPATSSRERLEILDDERRVLSFRVVGGEHRLSNYRSVTTVHETAAGAAAAVVVESYVVDVPHGNTADETRMFVDTIVRCNLQSLARTAEQLALAAPRAA

SEQ ID NO: 5469 - protein, 140 aa, Rickettsia typhi str. Wilmington
MTIQYTFSMIKPDVIKRNKIGQVNTYLENAGLKIVAQKMKFLTKYEAECFYDEHRARPFFNSLVEYITSGAVVLQVLKGEDAITLNRIIMGATNPAEAKEGTIRKDLGESIEANSIHGSDSENSAKREIKFFFSKSEIIE

SEQ ID NO: 5470 - protein, 365 aa, Mannheimia succiniciproducens MBEL55E
MTQQPTLFIDRDGTLIDEPKTDFQIDSLEKLKFERNVIPALLKLKNRYRFVMVSNQDGLGTDSFPQEDFDKPHNAMLAVFRSQGIEFDDILICPHKPEDNCDCRKPKIKLLKKYIDKKLFDPADSFVIGDRPTDVQLAENLGIRALQYHPENLDWDMIAEKLLREPVADPKGLGQPRHAVVARKTKETDIKVEVWLDEAGVNQINTGIGFFDHMLDQIATHGGFRMNVSCKGDLHIDDHHTIEDVALALGAALKEAIGNKRGIQRFGFVLPMDECKAECALDLSGRPYFKFKAKFNRDKVGDFSTEMTEHFFQSIAYTLLATLHLSVKGDNAHHQIEALFKAFGRTLRQAIKIEGNEMPSSKGVL

SEQ ID NO: 5471 - protein, 429 aa, Rickettsia typhi str. Wilmington
MTNIESKIKTPRSPYAKKYNSWRIRILYSIVIGYATFYFCRQNFNIATPAIREYFGVTKTQIGWILTAASIMYGVSKACNGFISDKVNARVFMVLGLLFVGIITILIGFSDFLWLIGILWIASNWFQSMGWPPATKMLTHWFAAKELGTKWAIGATSNQLGGALAMISCGYLIDKFDWRAAFFVPGLVACVASLFLYNRLRNSPKEVGLSTVEEYKEYPPEAIGNYERLLTTQLLKMVFCNKLIWYVCLANMFVYIIRSGVIYWAPTFLRDLCNISFVNAGLQIGLYEMIGIPGALIAGILSDKLFQGRRGPIASICMILLTLLLVLFWKVPIQSELLSIVILSLIGFFVSGPQLLVGIAAADFSTRQAVGTANGLSGLFGYLGAAIAGVGVGWISDNYGWNGVFIFFSISALLGGGLFALTWNHSAKK

SEQ ID NO: 5472 - protein, 1065 aa, Nitrosomonas europaea ATCC 19718
MPKRTDLKSILIIGAGPIVIGQACEFDYSGVQACRALREEGYRVILINSNPATIMTDPELTDATYIEPITWQAVEKIIEIERPDALLPTMGGQTALNCALDLVRHGVLEKYGVVLIGASREAIDKAEDREKFKQAMTRIGLQSARSAMAHSMEEAMQAQAMIGYPAIIRPSFTLGGSGGGIAYNREEFIEICERGLEASPTRELLIEESVIGWKEYEMEVIRDKQDNCIIVCAIENVDPMGVHTGDSITVAPAQTLTDKEYQRMRDASIAVLREIGVETGGSNVQFAINPENGNMLVIEMNPRVSRSSALASKATGFPIAKVAAKLAIGYTLNELGNDIAGGIIPASFEPTIDYVVTKVPRFAFEKFPQANDRLTTQMKSVGEVMAIGRTFQESLQKALRGLESGVDGLDEKTTDIEIIKAELGHPGPERLWYIADAFRCNIPFDEIHALTRIDSWFLVQIEDLIRQEQALSERRLEILDRRELYHLKRCGFSDQRLAALLGTSQDKVRARRHEQGVRPVYKRVDTCAAEFDTHTAYMYSTYEEECESRPTDNKKIMVLGGGPNRIGQGIEFDYCCVHAALALREDGYETIMVNCNPETVSTDYDVSDRLYFEPLTLEDVLEIAAVEKPAGVIVQYGGQTPLKLARALETNGVPIIGTSPDMIDCAEDRERFQAMLQGLGLKQPSNFTARTAETALAAADKIGYPLVVRPSYVLGGRAMEIVHEARDLERYIQEAVKVSNDSPVLLDHYLNNAIEVDVDAISDGKAVLIGGIMEHIEQAGVHSGDSACSLPPFSLSASLQEELRRQTEAMAYALNVNGLMNIQFAIQDDTVYVLEVNPRASRTAPFVSKATGLQLAKIAARCMVGRTLADQGVTKEVYPSHFSVKEAVFPFAKFSGVDTILGPEMKSTGEVMGVGKNFAEAFVKSQLAAGVQLPVSGNVLISVRDSDKLEAVSIAIKLVELGFSLYATRGTARTLQQAGLPVIAVNKVAEGRPHIVDMIKNGEIVLIINTVANKRSAVRDSYSIRRVALQARITYYTTIAGARAACAGMASRQELQVYRLQNLAI

SEQ ID NO: 5473 - protein, 133 aa, Triticum aestivum
  misc_feature (2)..(2): Xaa can be any naturally occurring amino acid
  misc_feature (7)..(7): Xaa can be any naturally occurring amino acid
  misc_feature (28)..(28): Xaa can be any naturally occurring amino acid
  misc_feature (33)..(33): Xaa can be any naturally occurring amino acid
  misc_feature (63)..(63): Xaa can be any naturally occurring amino acid
  misc_feature (69)..(70): Xaa can be any naturally occurring amino acid
  misc_feature (72)..(72): Xaa can be any naturally occurring amino acid
  misc_feature (75)..(77): Xaa can be any naturally occurring amino acid
  misc_feature (82)..(82): Xaa can be any naturally occurring amino acid
  misc_feature (85)..(86): Xaa can be any naturally occurring amino acid
  misc_feature (91)..(91): Xaa can be any naturally occurring amino acid
  misc_feature (95)..(96): Xaa can be any naturally occurring amino acid
  misc_feature (99)..(99): Xaa can be any naturally occurring amino acid
  misc_feature (103)..(103): Xaa can be any naturally occurring amino acid
  misc_feature (110)..(110): Xaa can be any naturally occurring amino acid
MXPTVMXSSATSVAPFQGLKSTAGLPVXRRSNXASLGSVSNGGRIRCMQVWSIEGIKKFETLXYLPPLXXEXLLXXXDYLIXSEXXPCLEXSKVXXIFXEHNXSPGYYDXRNWTMWKLPMFGCTDATQVINEV

SEQ ID NO: 5474 - protein, 450 aa, Oryza sativa
  misc_feature (193)..(193): Xaa can be any naturally occurring amino acid
MKVDDGPGVNGSRWAKMMSTDSWRWCLGLIYIVAVASIWIAASYIVQSVVDEGVSPFLITYICNSLFVIYIPIVEAARYFEDSINNFWTKLKGKDVADLEQSADLESINLLHGSEQEGNTHEATRLPEDILASEAVFPVQAERNVADGSKGLDAKGRWTRARVARVSMVVCPFWFLAQLTFNLSLRYTTVTSXTILSSTSSLFTFLVALVFLGETFTWLKLISVLLCMGGTIIVSLADSGSTANTIATNPLLGDVLSIVSAGLYAVYITLIRKKLPDEKEGQGEVSMAQFLGFLGLFNMLFFFPFALFLNFTKLEPFHRLTWEQVGLIVGKGLLDNVLSDYLWAKAILLTTTTVATAGLTIQVPIAAIVDTLTGHAPHLLDYIGAAAVLVGFAGINIPVGTPQGSQQEQETPIVSMVDDPVHLPSDRNATSMVDDPVYLPSDRNATGAVQ

SEQ ID NO: 5475 - protein, 420 aa, Saccharomyces cerevisiae
MLAASFKRQPSQLVRGLGAVLRTPTRIGHVRTMATLKTTDKKAPEDIEGSDTVQIELPESSFESYMLEPPDLSYESSKATLLQMYKDMVIIRRMEMACDALYKAKKIRGFCHLSVGQEAIAVGIENAITKLDSIITSYRCHGFTFMRGASVKAVLAELMGRRAGVSYGKGGSMHLYAPGFYGGNGIVGAQVPLGAGLAFAHQYKNEDACSFTLYGDGASNQGQVFESFNMAKLWNLPVVFCCENNKYGMGTAASRSSAMTEYFKRGQYIPGLKVNGMDILAVYQASKFAKDWCLSGKGPLVLEYETYRYGGHSMSDPGTTYRTRDEIQHMRSKNDPIAGLKMHLIDLGIATEAEVKAYDKSARKYVDEQVELADAAPPPEAKLSILFEDVYVKGTETPTLRGRIPEDTWDFKKQGFASRD

SEQ ID NO: 5476 - protein, 119 aa, Zea mays
MQVAMATTTSSSLVTGLRCRTGAAVALIRPTSAAGDRRGWRTTASGRGARRGKVTVAAACKTCKGKGAVECPGCKGTGKNKKNGNIFERWKCFDCQGFGLKSCPTCGKGGLTPEQRGER

SEQ ID NO: 5477 - protein, 630 aa, Candida albicans SC5314
MSTNPEKPTRNEDLFENSSSSSSVPHNKEASELESVNSTAEREGGEHGNILAQYTEEQVMQMGRNYAHKYDLDPDLFGRAAALARAPSAFNSMPFLTDEEKQGLYLEATKKWHIPRKLIEVIAVGAIAAATQGMDESTISGATLFYPKAFGVTEMKNADLIEGLVNSAPYLCCSVIACWTSDYWNRHLGRKWTIFWTCLISAVTCIWQGFVNNWWHLFIARFFLGFGIGVKSATVPAYAAECTPKHVRGALVMLWQFFTAVGIMFGFVSALAFYYVPHKSFGTGLNWRLMLGSACIPPIIVLFQIPFVPESPRWLMGKERHKEAFESLKALRFEEIAAARDCFYQYVLLKEEGTYDIPTWKRLIQMFTIRRNRNGAIGSWIVMFMQQFCGINVIAYYASSIFIKARYSEISALLASWGFGMINFVFAIPAFLTIDKFGRRNLLLFSFPLMGVFLLIAGFGFLIHDRQGQLAMVTTGIYIFSAIYSSSEGPVPFTYSAEAFPLYIRDLGMSWATATCWFFNFILAFTWPRLQNAFTPTGAFGWYAAWNVIGFFLVLWFLPETKGLTLEELDDVFAVPMYEHAVYRTKELLNGFQRVILRRNIPPMPPLYHHQRMAVTNPEWNDKTEVDHIE

SEQ ID NO: 5478 - protein, 506 aa, Sulfolobus tokodaii str. 7
MVTLKELTGFKDIYTIDSDGIPVFKTYLVGEWVGSKEIENIKSPIDLTVYARVPKLNYEMVDNTLSILYSKGRWAIRDLPGEKRLKIYHTLADLIEKYREDFVEVLMIGNGKTKSAAQGEVNAAIERLIRADLDVRKLYGEYVPGDWSSESLEAEAIIRREPLGVVLAITPFNYPLFDIVNKLVYSTVAGNAFMLKPASSTPLPAIMLAKLLEIAGFPKEALAIIAVPGSEMDKIVADKRISVISLTGSSETGEHVMKVAGLKQYVMELGGGDPAIVLDDSDPKTTAQKIVTGITSYSGQRCDSIKFIFAEPKVYEELKNYIVEELKKVKVGDPREADTVMGPIIDTRTVDEFEYAVKDAVEKGGNILYGGKRLGPTYIEPTLIEIDKEKIKDLYLYKKEVFLSIAVITKVNNIDEAIELSNGRRYGLDAAIFGNDITKIRKLIRMLEVGAVYVNEYPKHGIGYFPFGGRKDSGIGREGIGYTIENVTAYKTIVYNYRGKGVWEYL

SEQ ID NO: 5479 - protein, 523 aa, Fulvimarina pelagi HTCC2506
MQHDVLGLDELGPDELKEVEVGETKLLLARDGERVFATGAKCTHKGAPLKNGTRVANTVICPWHHAIFDLDSGDHIEPPGQGCLTRFVVSVQNGRIMVEVPEGAHIHRPEVAQSERKTGGDAVFAIIGTGAAGLACAQELVKRGFDGRIVMIGQEDTPPYDRTDLSKAYLKGGTTPEKMTLASRDELHDLGIERVHARVTKIDAEARHLTLEGKGAPSELTYDACFAAPGSGSAQLPIENADMPNVFTLRSLNDGKALLGAAEVETEIVIVGSGFIGMEAAAALAGDGRNITVVTPEELPFASKWGDAVARQITEQHKSKGVTMKLGARVEKIEASDGMATGVTTEGGETIRAGLIILAVGAKPNLDAFGDLAKDGKVSVDANLRAADRLWVGGDVADFPLYKRGYSTRIEHWRVAEQHGRHAARAMLGDEGAFAGVPFFWSAQYGPIHYVGHAESYDDVHIEGDIENGSYTAFYIKNGKVIAGIGRGKADVTAELHAAMLSDPAPSAEKLKAAEWKPQSLIV

SEQ ID NO: 5480 - protein, 132 aa, Nitrosomonas europaea ATCC 19718
MNLIEQLEREEIERLGKTIPDFSPGDTLVVNVNVVEGDRKRVQAFEGVVIAKRNRGLNSSFIVRKISSGEAVERTFQTYSPLIASMEVKRRGAVRRAKLYYLRDRSGKAARIREKLPARSVQQENVAEALQP

SEQ ID NO: 5481 - protein, 334 aa, Fulvimarina pelagi HTCC2506
MKRASESFDPEGKPSTAILSALRTIATEAEGLKALSESLVGDRANAFERTIARILEMRGRIVVTGVGKSGHIGTKMAATFASTGTPAFFVHAAEANHGDLGMIGQDDIILALSWSGETSELKGILDYSRRFGITLIAMTSKPDSALGRSADEILQLPQATEACPHGLAPTTSTALQMALGDALAVALLEQRRFTPQDFRIYHPGGKLGASLVKVGDVMHSGDEMPLVTSNTLMSEAILVMSRKSFGCVAITDEAGRLSGIITDGDLRRHISSDLLAKTVDDVMTRNPKTVEPDTLAMAALETINASNITSLMVVREAQPVGIVHLHDLLRIGVA

SEQ ID NO: 5482 - protein, 754 aa, Symbiobacterium thermophilum IAM 14863
MKFTRRSFVKASALATAMVAAGCSPQPVAPKQNPETEGATWYKTVCRYCGVGCGVMVAAKDNRVVAVKGDTENPVNKGLLCVKGYYLDRIMNTEEGRILKPLIRKNGQLTEASWDEALDLVAARFREAIDQHGPDSVGFYGSGQNLAEETYIANKLFKGCIGTNNVEGNPRTCMASAVAGFLSTFGKDEPMGNLDDIEHADTFFIIGSNTAEAHPIIYSRITTRKQTGKDVKVILADPRRHRVADIADIFLPFRPGTDLALLNAFAQVIIEEGLHDPDFIERHTTFQDGNGAITFEQYVAFLQDYTPEKVAPITGLSPDDIRAAAREIGARGRKTMTLWCMGINQRTVGTWLNNAIYNLHLLTGKICQPGNSPFSLTGQPSACGSVREGGGLSHLLPCGRQVTNEQHRKEVAAVWGVDYTRMSDKVGYHTMEMFRAAGDGRIKALLISCTNPGHSLPNLNSVRASLEKTFLVVMDAFHNRTTELADVVLPSALWCEKEGIYGNTERRTQHLAKAVEPKGEARPDVWILLEIAKRLGYGEYFSHYTSNEVIWEEFRKMGGGGTGYDYAPYERYKQERGLRWPVNDKQPAGTTLRYVEGDDPFVPEGAGIYFYGKPDGKAVIYARPHRDPAEVPDAEYPFYLSTGRILEHWHTITMTKRVPEIMKGAGEFYCEIHEEDAARLGIQNGDLVKLTSRRGQVVATARVGGRAVPQKGLVFLLMHDDRTERLANFLTNDAVDETSKQMEYKVCAVRVEKA

SEQ ID NO: 5483 - protein, 146 aa, Triticum aestivum
  misc_feature (50)..(50): Xaa can be any naturally occurring amino acid
  misc_feature (69)..(69): Xaa can be any naturally occurring amino acid
MVFGNTGSWAAQLITEAGGKVVSIRDVTGTVKNSNGIDIAKLMKHLAENXGIKGFDGGDAVDPTSLLTXEECDVLIPAALGGVINKDNADAIKAKYIIEAVNHPTDPEADEILAKKGVLVLPDIMANSGGVMVSCFEWAAGRPRGT

SEQ ID NO: 5484 - protein, 740 aa, Coffea canephora
MESCNCIEPQWPADELLMRYQYISDFFIALAYFSIPLELIYFVKKSAVFPYRWVLVQFGAFIVLCGATHLINLWTFTMHSRTVAVVMTAAKVLTAAVSCATALMLVHIIPDLLSVKTRELFLKNKAAELDREMGLIRTQEETGRHVRMLTHEIRSTLDRHTILKTTLVELGRTLGLEECALWMPTRSGVELQLSYTLHHQNPVGFTVPIQLPVINQVFSTNRAVKISPNSPVAKLRPSGKYMQGEVVAVRVPLLHLSNFQINDWPELSTKRYALMVLMLPSDSARQWHVHELELVEVVADQVAVALSHAAILEESMRARDLLMDQNVALDLARREAETAVRARNDFLAVMNHEMRTPMHAIVALSSLLQETELTPEQRLMVETILKSSNLLATLINDVLDLSRLEDGSLQLDIEPFDLHGLFKEVINLIKPIASVKKLFVTLSMSSDLPEYAIGGEKRLMQIMLNVVGNAVKFSREGGISISASVAKSDSLRDPRAPDFFPGLSDNHFYLRVQVKDTGSGISPQDIPKLFTKFAQSQSLAAKNSGGSGLGLAICKRFVNLMDGHIWLESEGLGKGCTAIFMVKLGLRGRSNEAKLQYVSRAPVNHVRTNFTGLKVIVMDDNGVSRMVTKGLLVHLGCDVATVSSGDECLKVVNNEHKVVFMDVSIPGIDIYAVAVRIHEKFARRRDRPLIVALTGNTDRVTKESCMRVGMDGVILKPVSVDKMRSVLSELLDHGVLLEAQ

SEQ ID NO: 5485 - protein, 311 aa, Sulfolobus tokodaii str. 7
MAKLITLGEILIEFNALSPGPLRHVSYFEKHVAGSEANYCVAFIKQGNECGIIAKVGDDEFGYNAIEWLRGQGVDVSHMKIDPSAPTGIFFIQRHYPVPLKSESIYYRKGSAGSKLSPEDVDEEYVKSADLVHSSGITLAISSTAKEAVYKAFEIASNRSFDTNIRLKLWSAEEAKREILKLLSKFHLKFLITDTDDSKIILGESDPDKAAKAFSDYAEIIVMKLGPKGAIVYYDGKKYYSSGYQVPVEDVTGAGDALGGTFLSLYYKGFEMEKALDYAIVASTLNVMIRGDQENLPTTKDIETFLREMKK

SEQ ID NO: 5486 - protein, 334 aa, Photobacterium profundum SS9
MTAQPLHYFDFSQEDRYAETMSGPVAEMWKQRQEGTFKGVDDLNIGWVSLTGYNHDKAIIVVNGRIESYWKYQELFYDLVKQGYDVYAIDHRGQGISDRLAKDNELGHVEEFDDYVTDLKTFFDTVVTPKKYQQHFLLGHSMGGTISTLFLAKYPSLIKRAVLSAPMHGIQLSNWMKPIASPFARVVEQLQRQPNYAPGQVPYYPKPFLNNKLCQSQIRYQWFRDLYEHKPALKIGGPSARWVWQGMAAANRCITQAANIATPILLIQGSDDNIVDNQAHHRFCQAMNQANRSCELKTINGARHELLFEKDAYRNTVLAATFSHLNQDNSTPST

SEQ ID NO: 5487 - protein, 740 aa, Coffea liberica var. dewevrei
MESCNCIEPQWPADELLMRYQYISDFFIALAYFSIPLELIYFVKKSAVFPYRWVLVQFGAFIVLCGATHLINLWTFTMHSRTVAVVMTAAKVLTAAVSCATALMLVHIIPDLLSVKTRELFLKNKAAELDREMGLIRTQEETGRHVRMLTHEIRSTLDRHTILKTTLVELGRTLALEECALWMPTRSGVELQLSYTLRHQNPVGFTVPIQLPVINQVFSTNRAVKISPNSPVAKLRPSGKYMQGEVVAVRVPLLHLSNFQINDWPELSTKRYALMVLMLPSDSARQWRVHELELVEVVADQVAVALSHAAILEESMRARDLLMEQNVALDRARREAETAVRARNDFLAVMNHEMRTPMHAIIALSSLLQETELTPEQRLMVETILKSSNLLATLINDVLDLSRLEDGSLQLDIEPFDLHGLFKEVLNLIKPIASVKKLFVTLSMSSDLPEYAIGDEKRLMQIMLNVVGNAVKFSREGGISISASVAKSDSLRDPRAPDFFPVLSDNHFYLRVQVKDTGSGISPQDIPKLFTKFAQSQSLAAKNSGGSGLGLAICKRFVNRMDGHIWLESEGLGKGCTAIFMVKLGLRGRSNEAKLQYVSRAPVNHVRTNFTGLKVIVMDDNGVSRMVTKGLLVHLGCDVATVSSGDECLKVVNNEHKVVFMDVSIPGIDIYAVAVRIHEKFARRRDRPLIVALTGNTDRVTKESCMRVGMDGVILKPVSVDKMRSVLSELLDHGVLLEAQ

SEQ ID NO: 5488 - protein, 740 aa, Coffea pseudozanguebariae
MESCNCIEPQWPADELLMRYQYISDFFIALAYFSIPLELIYFVKKSAVFPYRWVLVQFGAFIVLCGATHLINLWTFTMHSRTVAIVMTAAKVLTAAVSCATALMLVHIIPDLLSVKTRELFLKNKAAELDREMGLIRTQEETGRHVRMLTHEIRSTLDRHTILKTTLVELGRTLGLEECALWMPTRSGVELQLSYTLHHQNPFGFTVPIQLPVINQVFSTNCAVKISPNSPVAKLRPSGKYMQGEVVAVRVPLLHLSNFQINDWPELSTKRYALMVLMLPSDSARQWHVHELELVEVVADQVAVALSHAAILEESTRAGDLLMEQNVALDLARREAETAVRARNDFLAVMNHEMRTPMHAIIALSSLLQETELTPEQRLMVETILKSSNLLATLINDVLDLSRLEDGSLQLDIEPFDLHGLFKEVLNLIKPIASVKKLFVTLSMSSDLPEYAIGDEKRLMQIMLNVVGNAVKFSREGGISISASVAKSDSLRDPRAPDFSPMHSDNHFYLRVQVKDTGSGIMPQDIPKLFTKFAQSQSLAAKNSGGSGLGLAICKRFVNLMDGHIWLESEGLGKGCTAIFMVKLGLRGRSNEAKLQYVSRAPVNHVRTNFTGLKVIVMDDNGVSRMVTRGLLVHLGCDVATVSSGDECLKVVNNEHKVVFMDVSIPGIDIYAVAVRIHEKFAKRRDRPLIVALTGNTDRVTKESCMRVGMDGVILKPVSVDKMRSVLTELLDHGVLLEAQ

SEQ ID NO: 5489 - protein, 946 aa, Candida albicans
MISIVNGTSTLSLVAGSVETLNQAINFYTNILGLSVHSEQNDWTYLSNDDNKMIVKIQLDTKSGLSLDQVNDRRTEIIAKLNVTDWRSLDTTSVLKVQNLVALIETLTTFNYTLQITPNELYPNEVYCVGPIGYIIGFTACDEPLTLVPPLQKSHPKPGLVSNLMSKSGSQSRNIEETKAVRRNIAVMTSGGDSQGMNAAVRAVVRATIFHGSKAFAVQEGYAGLVKGGPEYIKEMKWQDVRGFLSEGGTNIGTARCMEFKERWGRLKGCKNLIDAGIDGLIVCGGDGSLTGADLFRHEWPSLIQELKDKGEITNEQFERHKHLYICGMVGSIDNDMAMTDATIGGYSALERICRAIDYIDATANSHSRAFVVEVMGRHCGWLALMAGIATSADYIFIPEKPASSKDWQDQMCDIVGKHRAQGKRKTIVIVAEGAITSDLKPITSDEVKDVLVDRLGLDTRITVLGHVQRGGTAVAFDRTLATLQGVEAVKAILELTPDVPSPLIAIDENKICRRPLVEAVRITKSVASAIEAKDFEKAMSLRDHEFKEHLANFMAMNTANHEKPTLPREKRKKIAIINIGAPAGGMNSAVYAMATYCMSRGHTPYAIHNGFAGLSRHESVKSIEWIDIEGWNSIGGSEIGTNRQTPEETDIGMIAHYFEKYQFDGLIIVGGFEAFVSLEQLERSRAMYPSFRIPMVLIPATISNNVPGTEYSLGADTCLNSLMEYCDIVKQSASATRGTAFIIDVQGGNSGYIATFASLISGAQASYVPEEGISLQQLEMDINSLREAFAVEQGMTKSGKLIIKSSNASKVLTPHTLADIFNDECHGDFDTKTAIPGHVQQGGLPSPIDRSRGDRFAIRAVQFIEDHCDVLAPYRYELDFPIDDKKILNTAAVLGIKSSRLRFTSIRHLFDFETELGRRMPKTIYWNTIRDISDQLVGRTRLDKP

SEQ ID NO: 5490 - protein, 740 aa, Coffea canephora
MESCNCIEPQWPADELLMRYQYISDFFIALAYFSIPLELIYFVKKSAVFPYRWVLVQFGAFIVLCGATHLINLWTFTMHSRTVAVVMTAAKVLTAAVSCATALMLVHIIPDLLSVKTRELFLKNKAAELDREMGLIRTQEETGRHVRMLTHEIRSTLDRHTILKTTLVELGRTLGLEECALWMPTRSGVELQLSYTLHHQNPVGFTVPIQLPVINQVFSTNRAVKISPNSPVAKLRPSGKYMQGEVVAVRVPLLHLSNFQINDWPELSTKRYALMVLMLPSDSARQWHVHELELVEVVADQVAVALSHAAILEESMRARDLLMDQNVALDLARREAETAVRARNDFLAVMNHEMRTPMHAIIALSSLLQETELTPEQRLMVETILKSSNLLATLINDVLDLSRLEDGSLQLDIEPFDLHGLFKEVINLIKPIASVKKLFVTLSMSSDLPEYAIGDEKRLMQIMLNVVGNAVKFSREGGISISASVAKSDSLRDPRAPDFFPVLSDNHFYLRVQVKDTGSGISPQDIPKLFTKFAQSQSLAAKNSGGSGLGLAICKRFVNLMDGHIWLESEGLGKGCTAIFMVKLGLRGRSNEAKLQYVSRAPVNHVRTNFTGLKVIVMDDNGVSRMVTKGLLVHLGCDVATVSSGDECLKVVNNEHKVVFMDVSIPGIDIYAVAVRIHEKFARRRDRPLIVALTGNTDRVTKESCMRVGMDGVILKPVSVDKMRSVLSELLDHGVLLEAQ

SEQ ID NO: 5491 - protein, 425 aa, Thiomicrospira crunogena XCL-2
MTQSKTKLGFNGTWSMAVGGMIGGGIFSTLGVVVAIAGAWAWLSFLAAGLIALAAGYSYVKLATFYNEGGGAFTFLRKIHADGFAGSLAWVLIIGYVLTNAVYAFTFGQYLGNLLELNSWFPRASAVAIIALFIALNLKGVAEASGVEIFLVWFKLVVLVGLSAWGLSHWDIPMLSQGVSVPDAGLGAALFGAAAVFMAYEGFQLLTYDYNDIETPKKILPRAVLSAIIVVILVYILVALGTAMLIGADEIVKHEEVALAIAGEKAFGITGLVVVTIAAAFSTGSAINATLFATARLAHKVAKAHELPADMGHKNAAGIPDRALIWLGSLAALLAAIGNLTSLVEAASLAFLFTFTVVCGLAFKQDAGSRWITGFGALSAAAASIALIVQLIQTDLSALLFLLALIAIAVFGRPTILRYFKNSRF

SEQ ID NO: 5492 - protein, 314 aa, Oryza sativa
MAMAIPKVDLRGLEPGTPGWEAARATVTASMVSHGCVVVAHGELGADLREALFGRAVREAFALPAEAKRRNVSTVGPYRGYIANIPGMDWESLRVHDADDAARVREFAGLLWPEGNPEFCETIVSFATNMRDLERTVERMTLEGLGVGEDHIASHLAAQDYGVRLSHYGPPPDASTAISLQAHRDDSMTTIIVQHEVEGLEVQAGDGSWHAIPPEPDTIAIVAGELFRVVTNGRVPASVHRVRTPSGRERYCVLVGSRSKDGAVLSAMDELVDGEHPLAYRPCKAEEFIQFRYSEEGRKFSDPLKAFCGVNATE

SEQ ID NO: 5493 - protein, 987 aa, Candida albicans
MPSSSDAINRISYISLVTSDNDKFNQTFQFYSQLGFRLTKSFSKVSSYGSGLGANHPEFQLGVSHDSLKEVWLESYPLQNVDSNGNLRPWQEMEVYDGDNCERLNESTVIKVRLLGETPLKSISQKQFVFFTTQLNKIEKILTDANVKYGKVVDNVILAEDPLNNIISFSNTQNELCKTRFQSPEEYVEKTTAEILAKRKKSQLGSKFGSFEEISPSEVGGGNGLRKKKIGVMTSGGDAPGMNPAVRAVVRAGIYYGCDVYAVYEGYEGLVKGGDLLKKMEWSDVRSYMSLGGTSIGTARCKEFRERAGRLQGAYNMIKNGIDALVVCGGDGSLTGADLFRSEWPSLVKELVDTGKLTKEEVSPYEHLTIVGLVGSIDNDMSGTDVTIGAFSALERITEMVDYIGATAASHSRAFVVEVMGRHCGWLALLSGLATGADFVFIPERPPKAGLWKEQLKEVCLRHREYGRRKTTVIVAEGAIDDELNPITSEEVKQVLADLGLDTRNTILGHVQRGGTAVAFDRRLATLQGVEAVKAVLEMTPDTPSPMIGILKHKIVRIPLVDAVKQTKAVAEAISNKDFDKAMSLRDNSFYDDYRYFRDISIYDDGSKQLSEDKRLNIAIVHVGAASAGLNAATRAVALYSLSRGHKLYAVQDGFAGLVKGDLKNLTWMDVEGWHSLGGSEIGTNRSLPSQNIGKVAYNLQKFNIQGLLIVGGFEAFTSLHELSEQKANYPIFEIPMVVVPATVSNNVPGTEYSLGADTCLNQLVSYCDAVQQSASSTRRRVFVVEVQGGHSGYVASYCGLITGALATYTPESNINLRELQGDIDLLQKVFATDRGEDHNGTLIVRNEQASAVYSTQLIADILKENANKRFETRTAIPGHVQQGFTPSANDRVMAVKFSLKAMEFIETRNGCYGKHDRKFSDEEISEHSQVVIGIHGDVVKFTCIKHLYDNEANVALRKGKTVHWTDMIDVANILNGKSLLKKQERY

SEQ ID NO: 5494 - protein, 115 aa, Zea mays
  misc_feature (65)..(65): Xaa can be any naturally occurring amino acid
  misc_feature (81)..(81): Xaa can be any naturally occurring amino acid
MSSRDKGGKGLGKGGAKRHRKELRDNIQGITKPAIRKLARRGGEKRISEIIYDETRGGLKIFLEXVIGDAVTYTEHARRKXDTAMDDRYALKRQGRTLYGFGGYVACHRSPCYRA

SEQ ID NO: 5495 - protein, 559 aa, Oryza sativa
  misc_feature (551)..(551): Xaa can be any naturally occurring amino acid
MAAAAARGAAAARSPLVLHRHPHPAHHRRLRLLPLVAGGGGGSPPRVGRRIRASREKGRRVGIRVFARYSQAQDFSTRLQDRAGELPKLVEDLLQTSISTGPRGAFRFAQGIQAVLGVGGEWLNDFSKTANTSAGIPAQMQLGLLSPLYLRRLFERMGATYIKLGQFVASAPTLFPAEYVEEFQNCFDRAPPVPYSEIESILREELQQPLDSVYEYIDPVPIASASIAQVHGARLKSSQKDVVIKVLKPGIEDTLVADLNFIYVVARILEFLNPELQRTSLVGIVKDIKESMLEEVDFRKEAMNIEAFQRYIDAMGFDRQAKAPFVYRHCSTKRVLTMERLYGVPLTDLDSIRSLVPDPELTLVTALNVWFGSLISCESFHADVHAGNLWLLRDGRVGFLDFGIVGRISPRTWAAMEVFLASFATDDYNAMASALSEMGATGNDINVNEFAKDLEKIFSSIQDLDTEVIVATARTPDATAVSANVVVDDRQMNALFLDLVRVSESYGLKFPREFALLMKQLLYFDRYTRLLAPSMNMLRDERVNISSRQQXARRVDRFQ

SEQ ID NO: 5496 - protein, 556 aa, Streptococcus agalactiae A909
MKTDIEIAQSVALKPIAEIVEQVGIGFDDIELYGKYKAKLSFDKIEAVRSQKVGKLILVTAINPTPAGEGKSTMSIGLADALNKIGKKTMIALREPSLGPVMGIKGGAAGGGYAQVLPMEDINLHFTGDMHAITTANNALSALLDNHIHQGNELDIDQRRVIWKRVVDLNDRALRQVIVGLGSPVNGIPREDGFDITVASEIMAILCLATDLSDLKKRLSNIVVAYSRDRKPIYVKDLKIEGALTLILKDAIKPNLVQTIYGTPALVHGGPFANIAHGCNSVLATSTALRLADYVVTEAGFGADLGAEKFLDIKTPNLPTSPDAIVIVATLRALKMHGGVSKEDLSQENVEAVKRGFTNLERHVNNMRQYGVPVVVAINQFTADTESEIATLKTLCSNIDVAVELASVWEDGADGGLELAQTVANVIETQSSNYKRLYNDADTIEEKIKKIVTKIYGGNKVHFGPKAQIQLKEFSDNGWDKMPICMAKTQYSFSDNPNLLGAPTDFDITVREFVPKTGAGFIVALTGDVLTMPGLPKKPAALNMDVLEDGTAIGLF

SEQ ID NO: 5497 - protein, 482 aa, Clostridium perfringens ATCC 13124
MNTKENIFYNFMGGNFYENKSDKLIDIKSPLDGSLVGRIQSLSKEDVDKIIDNAEKAQKSWNEVPLNERAHVLYKTADLLEEHKEELANIMIREVAKDKKSALSEVSRTADYIRFTADAAKSMDGESIPSDNFPGFNRSKISVVTREPLGVVLAISPFNYPVNLSASKIAPAIVAGNSVVLKPATQGSLSALFLAKMFHDAGLPGGVLNTITGRGSEIGDYCVTHDKIDFINFTGSTEVGRRISEITVMKPLLMELGGKDAAIVLEDADLDLTVNNIIAGGYSYSGQRCTAVKRILVMNSVADKLVEKLKEKISKLKMGNPLEVEDVTIVPLIDNKAADFVMELIDDAKEKGATLVCGGHREGNLIEATLFDNVTTDMRLAWEEPFGPVLPIIRINDKDEAIKIANASKYGLQSSVFTRDINEAFYIANKLEVGTVHVNNKTERGPDHFPFLGVKSSGMGTQGIRYSIEAMSRPKATVITIR

SEQ ID NO: 5498 - protein, 445 aa, Frankia sp. EAN1pec
MDEPLTVDGAELDVRKLGPCRIDSPLLPLLGARPTTQHYIDEGDKVLFDDTVSMISARKVPLDELPGFEPAGPRRKIYFDPSKTRVGIVTCGGLCPGLNNVIRGLVLELTNHYGVNRIFGFRHGYQGFIAKYGHSVVDLTPERVANIDEDGGTILGTSRGQQDPAEIVDCLSRMNINILFVIGGDGTLRGARAIAGIVAERGEKIAVVGIPKTIDNDIPYIDQSFGFQTAFAKAAESIRAAYAEATSAPGGVGIVRLMGRHSGFIACYAVLAKSDADVVLIPELPFTLEGERGLLAYIRQRVEKRGHAVVVVAEGAGQDLVAGLPESSDASGNRKLYDIGPELSRRITEDFAARGAELNLKYIDPSYHIRSVAANPYDNVYTIRLAHAAVHAAMSGRTEMVVGRWRRRFIHIPIALAVSQRNQVDPAGDLWMSVLEATGQPYRFG

SEQ ID NO: 5499 - protein, 159 aa, Triticum turgidum
GTLAPVAIELSSPLIQGDLTTAKSTVYTPQHAGVEGWIWQLAKAYASVNDYGWHQLISHWLDTHAVMEPFVIATNRQLSVTHPVYKLLHPHYRDTMNINARARGLLINAGGVIEMTVFPRKHAMPMSSMVYKNWNFTEQALPDDLIKRGMAVEDPSSPH

SEQ ID NO: 5500 - protein, 263 aa, Brassica napus
  misc_feature (247)..(247): Xaa can be any naturally occurring amino acid
MAALSSTSCLHSLAGHERYFLSCKTSQFSKPSFIKPSLKKPRFSVPFCIKQSDREERQIQKESSREEDKEEEEDYWVVTAVRSKYNEIVIVDTVDARYLLLDSTKNAHSVINKGGDNWTDSYWDEFASLPPIVPDGPIAIYGLGGGTAARLILELYPSVQLEGWEIDDILIEKAREYMELSELEKPTPKGGSLRVLVDDALSPSEDVSGKYAGIIVDLFADGKVLDQLQQVQMWHDLASRLMPNGRXMVNCAGIEEEKVVPNE

SEQ ID NO: 5501 - protein, 274 aa, Oryza sativa (japonica cultivar-group)
MAGGGGEYLRQFVEETAWYNEIFLSHVVPGDWWRALPHPLQSWLRNGLGGYLIYFACGFLWCFVIYYWKRHAYIPKDSIPTIEAMKKQIIVASKAMPLYCALPTLSEYMVENGWTQCYVNISEVGWPMYLVYLALYLIFVEFGIYWMHRELHDIKPLYKYLHTYHHIYNKENTLSPFAGLAFHPLDGILQAIPHVFALYLIPTHFRTHIALLFIEAVWTTNIHDCIHGKVWPVMGAGYHTIHHTTYRHNYGHYTVWMDWMFGTLREPEDILKKD

SEQ ID NO: 5502 - protein, 157 aa, Triticum turgidum
LSSPLIQGDLTTAKSTVYTPHHAGVEGWIWQLAKAYASVNDYGWHQLISHWLNTHAVMEPFVIATNRQLSVTHPVYKLLHPHYRDTMNINARARGLLINAGGVIEMTVFPRKHAMPMSSMVYKNWNFTEQALPDDLIKRGMAVEDPSSPHKVRLLIK

SEQ ID NO: 5503 - protein, 104 aa, Glycine max
  misc_feature (78)..(78): Xaa can be any naturally occurring amino acid
  misc_feature (85)..(85): Xaa can be any naturally occurring amino acid
MSGRGKGGKGLGKGGAKRHRKVLRDNIQGITKPAIRRLARRGGVKRISGLIYEETRGVLKIFLENVIRDAVTYTEHAXRKTVTAXMDVVYALKRQGRTLYGFGG

SEQ ID NO: 5504 - protein, 336 aa, Streptococcus suis 89/1591
MVVKVGINGFGRIGRLAFRRIQNVEGVEVTRINDLTDPVMLAHLLKYDTTQGRFDGTVEVKDGGFEVNGKFVKVSAEREPGNIDWATDGVDIVLEATGFFASKEKAEQHIHANGAKKVVITAPGGNDVKTVVFNTNHDILDGTETVISGASCTTNCLAPMAKALHDAFGVQKGLMTTIHGYTGDQMVLDGPHRGGDLRRARAAAANIVPNSTGAAKAIGLVIPELNGKLDGAAQRVPVPTGSVTELVATLDKKVTAEEVNAAMKAAATESFGYTEDQIVSSDIVGISFGSLFDATQTKVIEVDGEQLVKVVSWYDNEMSYTAQLVRTLEYFAKIAK

SEQ ID NO: 5505 - protein, 399 aa, Streptococcus suis 89/1591
MAKLTVKDVELKGKKVLVRVDFNVPLKDGVITNDNRITAALPTIKYILEQGGRAILFSHLGRVKEEADKEGKSLAPVAADLAAKLGQEVAFIAGATRGAELEAAINALEDGQVLLVENTRFEDVDGKKESKNDEELGKYWASLGDGIFVNDAFGTAHRAHASNVGISANVEKAVAGFLLENEIAYIQEAVETPERPFVAILGGSKVSDKIGVIENLLEKADKVLIGGGMTYTFYKAQGIEIGNSLVEEDKLDVAKALLEKANGKLILPVDSKEANAFAGYTEVRDTEGEAVSEGFLGLDIGPKSIAKFDEALTGAKTVVWNGPMGVFENPDFQAGTIGVMDAIVKQPGVKSIIGGGDSAAAAINLGRADKFSWISTGGGASMELLEGKVLPGLAALTEK

SEQ ID NO: 5506 - protein, 523 aa, Triticum turgidum
MMVERWAGFGSAMATVIFLWSVVQNYVPPTFRLYLTAWAAKVAACFNPYLEITISEYGAERFQRSDFFLAVEAYLSDACARRARKLKAELVKDSKNLRVTVDDHDEVTDDFSGTTIWWYASKRQSRAQVISFYPGEDERRFYKVVFHRRHRDLVVDSYLPFVLGEGRAVTVKNRQRRLFTNNASRNWNPYSSKSVWSHVAFEHPATFDMLAMHPDEKEAIVDDLMAFQESKDYYAKVGKAWKRGYLLYGPPGTGKSTMIAAMANFLDYDVYDLELSAVKNNTELRKLFIETTGKSIIVIEDIDCSIDLTGKRRKDKKASSDKDSDDDGKPKLPMDPEKDDATKVTLSGLLNFIDGLWSACGGERIIIFTTNHKEKLDPALIRRGRMDKHIEMSYCRFEGFKVLAKNYLDVIKHELFGEIQQLLEETDMSPADVAENLMPMSKKKKRDPDLCLSGLVKALKQAKEDAAAAAAKAKEEEEAKEAEAKKAKEKEEAEVKKAKKENKGKDKAAEEANGDIKEGDKVK

SEQ ID NO: 5507 - protein, 494 aa, Bacillus cereus ATCC 14579
MLKTNIELKPKVEAFLNEEIKMFINGEFVAAIGGKTFETYNPATEDVLAVVCEAQEEDIDAAVKAARSAFESGPWAEMTTAERAHLIYKLADLIEEHREELAQLEALDNGKPYQVALDDDISATVENYRYYAGWATKIIGQTIPISKDYLNYTRHEPVGVVGQIIPWNFPLVMSSWKMGAALATGCTIVLKPAEQTPLSLLYTAKLFKEAGFPNGVVNFVPGFGPEAGAAIVNHHDIDKVAFTGSTVTGKYIMRQSAEMIKHVTLELGGKSPNIILEDADLEEAINGAFQGIMYNHGQNCSAGSRVFVHRKHYETVVDALVKMANNVKLGAGMEKGTEMGPLVSKKQQERVLHYIEQGKKEGATVAAGGERALEKGYFVKPTVFTDVTDDMTIVKEEIFGPVVVVLPFDSTEEVIERANNSSYGLAAGVWTQNIKTGHQVANKLKAGTVWINDYNLENAAAPFGGYKQSGIGRELGSYALDNYTEVKSVWVNIK

SEQ ID NO: 5508 - protein, 281 aa, Burkholderia sp. 383
MCLIAFDWQPDAAAGPVFTLTANRDEFFRRTSAPLSWWEDVPGVLAGRDLEAGGTWLGVSRDGRFAALTNYRAPFDIRAGAPTRGKLVSDFLGGPSVAPLDYLRQLAEHAAVYNGFNLLVGDWRRRELAWFCNRAPEGESAVAAPVAIAPGVHALSNARLDTPWPKVVRKRAELGTLLTDNPTPSLDELIALMRDPHVADDDALPHTGIPIERERALSAAFIETPEYGTRGTTALRVTMKEGVRLTVEIKERCDDDGSHRTVRPGTFERAFTFDLDATPPR

SEQ ID NO: 5509 - protein, 298 aa, Bacillus cereus ATCC 14579
MQKIKGAFPVLITPMDEFQEINWDGVKQNVNYFIEQKVAGIIINGSTGEFVSLSKEERFKMVETVLKEIDGRIPVIVGTAAETTKETIEYTKHAEAHGADCALIINSYYCKPKEEEIYFHFKEISNSVNIPIMLYNNPFTSGVDMSTELMLRIGKECENVTHIKESSGDIRKVRDLVRQSEGAFQVFCGSEDLVMESYLVGASGWVSVAGNIVPGLVTKMYEHFQNGELEKAWEINDAILPLCEFLEGSGKYVQIVKRSMELHGQAGGPSRYPRLGLTADEDQKLQMILSNIAAHAAV

SEQ ID NO: 5510 - protein, 319 aa, Burkholderia sp. 383
MPLNPKIAQVLDMIERAKRPSYHHQTPQQARAAYEKSAPILDVASAPMHSVEECVVPTRDGRTIGARLYLPVEPSLAEPLPALVYYHGGGFTVGSVDTHDALCRMFARDAQCAVLSVGYRLAPEHRFPTAVNDADDALQWLHREAATFGIDAARLAVGGDSAGGTLATVCAVLARDAGIRLALQMLIYPGVTGYQDTESHARLANGYLLTQDTIQWFFTQYVRDRADRDDWRFAPLDGTRDAPSFAGVAPAWIATAEYDPLSDEGAAYAEKLRAAGNVVTLVCYPGMIHEFFKMGGYVPEVRAAHADAVAALKAAFDDV

SEQ ID NO: 5511 - protein, 522 aa, Triticum aestivum
MMVERWAGFGSAMATVIFLWSVVQNYVPPTFRLYLTAWAAKVAACFNPYLQITISEYGAERFQRSDFFLAIEAYLSDACARRARKLKAELVKDSKNLRVTVDDHEEVTDDFSGTTIWWYASKRQSKAQVITFYPGEDERRFYKVVFHRRHRDLVVDSYLPFVLGEGRAVTVKNRQRRLFTNNASRNWNPYRSKSVWSHVPFEHPATFDTLAMHPDEKEAIVDDLMAFQESKDYYAKVGKAWKRGYLLYGPPGTGKSTMIAAMANFLDYDVYDLELTAVKNNTELRKLFIETTGKSIIVIEDIDCSIDLTGKRRKDKKASSDKDSDDDDKPKLPMDPEKDDATKVTLSGLLNFIDGLWSACGGERIIIFTTNHKDKLDPALIRRGRMDKHIEMSYCRFEGFKVLTKNYLDVIEHELFGEIQRLLEETDMSPADVAENLMPMSKKKKRDPDLCLSGLVKALKQAKEDAAAAAAAKAKEEEEAKEAEAKKDKEKEEAGLKKANEENKGKDKAPEEANGDIKEGDK

SEQ ID NO: 5512 - protein, 474 aa, Tetragenococcus halophilus
MKSHPLTLTQNIMNNKGLNRYVITITLIATLGGLLFGYDTAVISGAEQSIQNNLVNGVGLGSFAHGLTVSSALIGCVFGGLLSGIFSNNLGRRNSLKLAGSLFLISALGSAYPEFLFFQAGDASVGLLIVFNLYRVLGGIGVGMASGISPTYIGEIAPGKVRGSLVSWYQFAIIFGQLVVYFVNWGIATGQSPEWVNDIGWRFMFASEAIPAILFFALLFYVPETPRYLVLKNNEEKAFDVLSKINNSKEEAKDILTDIKGSLNTTETSGKLFSYGKTVVIVGVLLSIFQQFIGINVALYYAPRIFESMGAGQNASMVQTIIMGIVNVTFTYVAIRTVDKWGRRPLLLVGSIGMAIGMFAVALLAKNGVLGIWTLVFIIVYTASYMMSWGPIVWVLLSEIFPNKIRGQAMAFAVAAQWLSNFFISSTYPAMIDFSGPLTYGFYGLMCVISAIFVWKMVPETKGKTLEQLENTWL

SEQ ID NO: 5513 - protein, 428 aa, Synechococcus sp. CC9605
MNTSHSQAIFGAAQALMPGGVSSPVRAFKSVGGQPIVFDRVKGPYAWDVDGNKYIDYIGSWGPAICGHAHPEVIAALQEAIEKGTSFGAPCALENTLAEMVIDAVPSVEMVRFVNSGTEACMAVLRLIRAYTGRDKVIKFEGCYHGHADMFLVKAGSGVATLGLPDSPGVPRSTTANTLTAPYNDLEAVKALFAENPEAIAGVILEPIVGNAGFIQPEPGFLEGLRELTKEHGALLVFDEVMTGFRISYGGAQAHFGVTPDLTTMGKVIGGGLPVGAYGGRADIMGMVAPAGPMYQAGTLSGNPLAMTAGIKTLELLKQPGTYEKLTATTQKLVAGIKDAAQSAGMSITAASVSAMFGFFLCEGPVRNFEEAKATDSERFGKLHRAMLEHGVYLAPSAFEAGFTSLAHSEADIEATINAFRESFAAVA

SEQ ID NO: 5514 - protein, 336 aa, Pseudomonas aeruginosa PAO1
MSRVTLSRYLIEQTRSHNTPADLRFLIEVVARACKEISHAVSKGALGGVLGSMGTENVQGEVQKKLDVMSNEILLEANEWAGNLAGMASEEMDHPYQIPGRYPKGAYLLVFDPLDGSSNIDVNVSVGTIFSVLRCPNEYLNQNDTLREEAFLQPGTTQVAAGYAIYGPQTMLMLTLGNGVKGFTLDRELGSFVLTHDNISVPESTAEFAINMSNQRHWEAPVKRYVEELLAGKEGPLGKNYNMRWIASMVADVHRILTRGGVFMYPRDAREPEKPGKLRLMYEANPMSFIIEQAGGAATNGTQRILDIKPENLHQRVAVFLGSKQEVERITGYHAE

SEQ ID NO: 5515 - protein, 335 aa, Nitrosomonas europaea ATCC 19718
MDQYLLSGDIGGTKTLLRSAVVRGEEVEFHHEHLYDSHQYDDFDAILADFLERSGCQPVAACLAVAGPIVEQQVHLTNLPWMISAAGIAEKFSIPAVKIINDFEGTAASIEILPQDDLITLQAGKPSSSAMRVVLGAGTGMGVAWLAWRGQYYEPLATEAGHIDFAPTSAIQIELLRYLMVRYHRVSIERLLSGQGLTHIFNFLQTRATEGTHLKSIELNVDDGATVTRLAFEHHYPIALQALDLFVEIYGTYAGNLALAGLCRGGVYIAGGIAPRIIRILQQSGFIEAFCNKGRYSALVRDIPVYVVMNPKAGLLGAGLLAQRMLQHQTVSSRQ

SEQ ID NO: 5516 - protein, 293 aa, Oryza sativa (japonica cultivar-group)
MSDPTAAVIPKPGGIGVGGGGGDDEEPVEIREVWADNLEEEFALIRDVVDEFPFVAMDTEFPGIVCRPVGAFRSPADYNYATLKANVDMLHLIQLGLTFSSPRGELPALGPGRRRCVWQFNFREFDDARDIFASDSIELLRRSGIDFRRNSERGVDARRFAELLMSSGVVLNDSVYWVTFHAGYDFGYLLKILTCSSLPDTQAGFFKLMKIYFPTVYDIKHLMKFCNSLHGGLNKLAELLDVERVGESHQAGSDSLVTSCAFWKLKDSFFAGSTEKYAGVLYGLNAENVVSAH

SEQ ID NO: 5517 - protein, 816 aa, Magnaporthe grisea 70-15
MAYMLDTCSKYKQPSQKHGGVKTEGCCQICSDSSYLLSTKPKTLGKGGACAVDPTGIVDQACPLRSNQAPTFMYSQVGSVDYFAGASPRTPIAEVADQTSRSDAIYPDASDSPVTVRPSSGPARALSSSTALEIAESNVPGLLTLAPTPTFSPSSNPTQQDTIVRNFPEPSQPPSTTPLQTQVLGRRRRGSSSGDEEGEGRAVSSISLAGVSSGSLATTESALQRRQGKRMRRDSMLADDSRILNPGQSSSIASNGNSSLQSRAATTNGTHKMMAGAGPSSTSSYNGRDVVRPPSGDYLGHDREEVTRILIQALSEMGYQDAAESVSRHSGYHLESRAVAEFRTAVLDGDWPEAERLLFSAVQQTSKSGKVSSGNGLILAPGADKALMQFWLRQQKFLELLEQRETGRALAVLRNELTPLYQDTPKLHFLSGLLMCRTPEDLRAKAEWDGTHGKSRHILLSELSRCISPSVMLPEHRLAVLLSQVKDDQILNCIYHTSATSPSLYCDHYCDREKFPSQVIQELSSGAGEIWQIQFSHDGTKLASSGSDESVIIWSLSPPRILHTLGGHQTGVGNIAWSPDDSMLITCGRDRYARFWDTRTGTLIRKLEQFEEPVSSCIWAADGQSVILGSFDRERSLCQWDLDGARVCTWTKKHRTEDVAVSPDGRWLVAMDEQSKIHVYNFITREVEYEFEVKPRPCSIAISQDSRLLLANSNDGAVQLFDLLSGGLRLQQYLGCTGGAFLIRCEFGGANESFVASGSEGHLICRLHAHHPRCNAVRWNPKDPCMFATCGDDGKIKIWGNSEHNLRSHSPNGSAA

SEQ ID NO: 5518 - protein, 448 aa, Streptococcus suis 89/1591
MVVTTADIKRDIKEKNVTFLRLMFTDIMGVMKNVEIPATEEQVEKVLSNKVMFDGSSIEGFVRINESDMYLYPDLNTWTIFPWGDENGRVAGLICDIYTTEGEPFAGDPRGNLKKSLRRMEKEGFSSFNLGPEPEFFLFKMDEQGNPTLEVNDKGGYFDLAPTDLADNTRREIVNVLTEMGFEVEASHHEVAVGQHEIDFKYADVLKACDNIQIFKLVVKTIARKHGLYATFMAKPKFGIAGSGMHCNMSLFDKDGNNAFFDPEDPRGMQLSETAYHFLGGLIKHAYNYTAITNPTVNSYKRLVPGFEAPVYIAWAGKNRSPLVRVPASRGMGTRLELRSVDPTANPYLAMAVLLEVGLDGIEHKIEAPAPVESNIYAMSDEERREAGITDLPSTLHNALKALRKDDVVRSALGDHIYTNFLEAKKIEWASYATYVSQWEIDNYLDMY

SEQ ID NO: 5519 - protein, 353 aa, Oryza sativa
MAKEAFVNGFLSVFMHVGLTLVLLVYLPIAFACRALGRLLVRPFVSGEDLRGKVVLVTGASSGIGEHLVYEYAKKGACVALTARTEIALRAVAKTARDLGAPDVLVVPADITKVDDAKRAVEETVAHFGKLNHLVANAGIWSSCFFEEITNITAFHNVIDLNFWGAVYPTYFALPYLKASRGNIVVTSSVAGRVPTARMSFYNASKGAVIRFYETLRAELGSHVRVTILTPGYVVSNLTMGKGIQKDGHVGIDEEARDINVGPLPVGKTETLAKVVVAAVRRGDYYVTWPGWYWPFHMVMCTAPELVDWFSRTFYVSKSSDHDGDALSKKILEAVGGKKFLYPKTIRSHAIAG

SEQ ID NO: 5520 - protein, 496 aa, Triticum aestivum
MAALVERWAGLGSAMASIIFLWSMVQNHIPVTLRLYLTAWAAKLVACFSPYLQITILENSAERFQQSEFFYAVEAYLSDACAHRASRLKAELGSDSSNLQVSVDDHEEVTDEFSGVTLWWYASKKHSKGNVISFYPGEDERRFYKVVFHRSHRDLIVDSYLPFVLAEGRAVIVKNRQRRLFTNCGGRRRRYLRNSVWDHVKFEHPATFDTLAMDTDQKEAIMDDLIAFKDGKEYYTKVGKPWKRGYLLYGPPGTGKSTMIATMANFLDYDVYDLELTSVKNNTELRKLFIEMTSKSIIVIEDIDCSIDLTGKRRKDKKASSNKDSDNEYEPDPTEPRKDDESKVTLSGLLNFIDGLWSASGGERIFIFTTNHKEKLDPALIRRGRMDKHIEMSYCRFEGFKVLAKNYLDIVEHVLFGEIRQLLEETDMSPADVAENLMPMSKKKKKDPNMCLAGLIAALKQAKKDAVTTAAVAKAKEEEEAEAKKAKEKEEPKEDK

SEQ ID NO: 5521 - protein, 522 aa, Triticum aestivum
MMVERWAGFGSAMATVIFLWSVVQNYVPPTFRLYLTAWAAKVAACFNPYLQITISEYGAERFQRSDFFLAVEAYLSDACARRARKLKAELVKDSKNLRVTVDDHEEVTDDFSGTTIWWYASKRQSKAQVITFYPGEDERRFYKVVFHRRHRDLVVDSYLPFVLGEGRAVTVKNRQRRLFTNNASRNWNPYRSKSVWSHVPFEHPATFDTLAMHPDEKEAIVDDLMAFQESKDYYAKVGKAWKRGYLLYGPPGTGKSTMIAAMANFLDYDVYDLELTAVKNNTELRKLFIETTGKSIIVIEDIDCSIDLTGKRRKDKKASSDKDSDDDDKPKLPMDPEKDDATKVTLSGLLNFIDGLWSACGGERIIIFTTNHKDKLDPALIRRGRMDKHIEMSYCRFEGFKVLAKNYLDVIEHELFGEIQRLLEETDMSPADVAENLMPMSKKKKRDPDLCLSGLVKALKQAKEDAAAAAAAKAKEEEEAKEAEAKKDKEKEEAGLKKANEENKGKDKAPEEANGDIKEGDK

SEQ ID NO: 5522 - protein, 523 aa, Arabidopsis thaliana
VKNPSLICAPVMADSIDKMVIETSKAHELGADLVEIRLDWLKDFNPLEDLKTIIKKSPLPTLFTYRPKWEGGQYEGDENERRDVLRLAMELGADYIDVELQVASEFIKSIDGKKPGKFKVIVSSHNYQNTPSVEDLDGLVARIQQTGADIVKIATTAVDIADVARMFHITSKAQVPTIGLVMGERGLMSRILCSKFGGYLTFGTLDSSKVSAPGQPTIKDLLDLYNFRRIGPDTKVYGIIGKPVSHSKSPIVHNQAFKSVDFNGVYVHLLVDNLVSFLQAYSSSDFAGFSCTIPHKEAALQCCDEVDPLAKSIGAVNTILRRKSDGKLLGYNTDCIGSISAIEDGLRSSGDPSSVPSSSSPLASKTVVVIGAGGAGKALAYGAKEKGAKVVIANRTYERALELAEAIGGKALSLTDLDNYHPEDGMVLANTTSMGMQPNVEETPISKDALKHYALVFDAVYTPRITRLLREAEESGAITVSGSEMFVRQAYEQFEIFTGLPAPKELYWQIMSKYGSRENLYFQ

SEQ ID NO: 5523 - protein, 547 aa, Burkholderia sp. 383
MGKPLLGQMMGMPLLVSSLISHAARHAGDTEIVSKRVEGDLHRYTYRDCERRAKQLAQALTRLGVESGDRVGTLAWNGYRHLEAYYGIGGMGAVCHTINPRLFPEQIAYIVNHAEDRYVFFDINFAPLVEAIAPQCPHVKGWVAMTDAAHLPSGTTPFLCYETLVEAEDGHYDWPRLDEQQASGLCYTSGTTGNPKGVLYSHRSTVLHAYGAALPDAMNLSAMDAVLPVVPMFHVNAWGLPYAVPLTGGKLVLPGKDLDGKSLYELMEAERVTFSAGVPTVWLGLLNYMREAGVRFSTLNRTVIGGSACPPAMLRTFEDEYGVRVIHAWGMTELSPLGTLAKLNWAQSQRPLDAQRKLLEKQGRVICGVDMRIVGDDGHELPWDGVAFGELQVRGPWVIDHYFRGEASPLSDGWFPTGDVATIDPDGFLQITDRSKDVIKSGGEWISSIDIENVAIAHPGVAEAACIACAHPKWTERPLLVVVPREGASLSRDALLAFYEGKVAKWWIPDDVVFVESLPHTATGKLQKLKLRETFRDYVLPTAVCEP

SEQ ID NO: 5524 - protein, 858 aa, Persea americana
MNIIDALMGTSHDEKSVQIKGSVVLMKKNVLDFNDFQASFLDRVHEFLGKGVSFQLVSAEHGDPDNGNRGKVGEAAYLEDWITTLTSIQAGESVFNVTFNWDMSFGTPGAVIVKNFHHSEFFLKTLTLEDFPAKDRIHFVCNSWVYPTSNYKYDRIFFVNKTYLSSDMPEPLRKYREEELVHLRGDGEGELKEWDRVYDYAFYNDLGDPDKGPNYARRVLGGSKDYPYPRRGRTARAPTKTDPKTESRLPLLSLDIYVPRDERFGHLKMSDFLAYALKSLVQFLVPEIKALCDSTPNEFDTFQDDNLYEGGIKLPDSPALDKIRDMIPLEMIKELVRTDGERLLKFPLPQVIKVDKTAWRTHEEFRREMLAGVNPVIISHLQEFPPTSKLDAKLYGNQNSSITAQHIEKNLHGLTVEEALKNNKLFILDHHDALIPINRINATSTKIYASRTLLFLNDDGTLIPLAIELSLPHPEESILVQSTKFSAPAQEGVEGSIWQLQKAYASVDDSGYHQLISHWLHTCEPFVIATNRQLRVVHPIHKLLNPHYRDTMNINALARQILTNAGGVLENTVFPGRYAMEMSAVVYKNWVFPEQGLLSQISSREELQSSTLLQSLHNLRLLIKDYPYSVDGLEIWAAIETWVHDYCSIYYPTDAAVQTDPELQAWWRGRSVGHGDKKDEPWRPKMKTLSDLIQTCTTTIWVASALHAAVNFGQYPYAGYLPNRPTLSRRFMPECTPEYRSLVEPDTVYLRTITAQLQTLLGVSLIEILSRHSSDEVYLGQRSTPEWTTDSAALEAFEKFGKKLVEIENRIIEMNDDDQLKNRVGPVKVPYTLLYPNTSDNSGIGGLTGRGIPNSVSI

SEQ ID NO: 5525 - protein, 562 aa, Zea mays
MATSLSTPSQLRTSHCHARRYGRLLGLHPRVSCARCPAPRRAAALSVRANAASTDGDAAVTVRRFPAAPTKAGRLAGVKKIMILGAGPIVIGQACEFDYSGTQACKALAEEGYEVVLVNSNPATIMTDPGLAHRTYIGPMTPPLVERIIDAERPDALLPTMGGQTALNLAVSLADSGALDRLGVRLIGASLPAIRAAEDRQLFKQAMDRIGLKTPPSGIGTTLEECLAIAEDIGELPLIVRPAFTLGGTGGGIAYNKAEFEDICRAGLAASHTQQVLVEKSLLGWKEYELEVMRDMADNVVIICSIENIDPMGVHTGDSITVAPAQTLTDKEYQRLRDYSVAIIREIGVECGGSNVQFAVNPADGEVMVIEMNPRVSRSSALASKATGFPIAKMAAKLSVGYTLDQIPNDITKKTPASFEPSIDYVVTKIPRFAFEKFPGSEPILTTQMKSVGEAMALGRTFQESFQKAVRSLETGFAGWGCGPIKELDWDWEKIKYSLRVPNPDRIHAIYAAFKKGMRVEDIHEISFIDKWFLTELKGLVDVEQFLLSRSLNQLSKDDFYQ

SEQ ID NO: 5526 - protein, 456 aa, Photobacterium profundum SS9
MFGIFKPAVHTAKLSGGQIDPVYKRLRWQLFMGIFFGYAGYYLVRKNFTLAMPFLIEEYGYSRGDLGVALAAVSIAYGLSKFLMGSVSDRSNPRYFMAAGLTMSALVMLCFGFMPWATGSISAMFILLFLNGWFQGMGWPACGRTMVHWWSRKERGELVSVWNVAHNVGGGLIGPMFLLGLWAFNDDWRTAFYVPAFFALLVAAFTLIAMRDTPQSCGLPAIEEYKNDYPDNYDESHEKEMTGKEIFFKYIFNNKLLWFIAIANAFVYLIRYGVLDWAPVYLSEVKDFSVDKSSWAYFLYEWAGIPGTLLCGWMSDKFFKGRRAPAGILFMSLVTIAVLVYWFNPPGNPMIDMAALVAIGFLIYGPVMLIGLYALELAPKKAAGTAAGLTGLFGYLGGAVVANIVLGYTVDHFGWDGGFMVLVSACGLSIFFLVLALMGENKEHEKRAIERAQQNA

SEQ ID NO: 5527 - protein, 175 aa, Triticum aestivum
MAPTVMASSATSVAPFQGLKSTAGLPVSRRSSSAGLSSVSNGGRIRCMQVWPIEGIKKFETLSYLPPLSTEALLKQVDYLIRSKWVPCLEFSKVGFVSREHNSSPGYYDGRYWTMWKLPMYGCTDATQVLNEVEEVKKEYPDAYVRVIGFDNLRQVQCVSFIAFRPPGCEESGKA

SEQ ID NO: 5528 - protein, 191 aa, Streptomyces coelicolor A3(2)
MFPRALAIGTPAQHKATEAPVTSTSASGLARFNTLEETAALAELHEACAATAWARHLLAARPFATAEDLYAASDAAMAELSAEDLAEAMAGHPPIGRPKPGDATSSREQAGMAGAAEELKAEMLELNLAYQDKFGHVFLICATGRTGEQMRDAALERIGNSPEQEREIVRTELGKINRIRLTRLVEQDARP

SEQ ID NO: 5529 - protein, 133 aa, Streptomyces coelicolor A3(2)
MSTSTTASVSTHILDTSVGRPAGDVAVRLAARAGREADWQALGGSATDADGRCKDLPALPEGTIHVRLDFDTETYFAKKQAAAQQDAPALRDSENGRPVFFPEVTITFAVVPGEHYHVPLLLNPFGYSVYRGS

SEQ ID NO: 5530 - protein, 471 aa, Streptomyces coelicolor A3(2)
MAQPATEPAKGSSSTPSPEHTEDAVTSVHPVDEKLHPSRLVPAALQHIAAMYAGVVTPPLIIGQACGLDIEGRTRLIAASLLIAGVATLLQTLGVKGFVGNRLPFVNAASSAGIAPILAIVETNAKGSQLPAVYGAVMVAGVFCLAVGPFFGRLLRFFPPLVTGVVITLIGVTLMPVPVGWAQGGDKTAADFGSMRNLALAAFTLAVILVIQRFGKGFVKQVALLFGLLIGTLAAIPFGMADFGALRSAPVAALPTPFAFGAPEFQPAAILSLCIVMLVLMTESSAGMLALGEICDRRADARVITRGLRTDGLATLVGPVFGGFPTSAFAQNVGVVSLTRVRSRYVVAVAGATLLVLGAFPVLGAVVSLVPMPVLGGAGIVLFGSIAVSGIRTLSEAGLDDSSNIILVAVALGAGIIPLAAPTFYAEFPAWAQTVLGSGISAGAIVAVALNLFFHHLGTRSRGTVPALKSS

SEQ ID NO: 5531 - protein, 72 aa, Glycine max
  misc_feature (56)..(56): Xaa can be any naturally occurring amino acid
MAIARTGVYVDDYLEYSSTLAGDLQRILSTMHELDERAHGILGQTKGQIKFLLGVXSHGFDRPNVVHDENAS

SEQ ID NO: 5532 - protein, 462 aa, Streptomyces coelicolor A3(2)
MADHPVDEKLPPLKMATTGLQHVAAMYAGVVAPPLIVGAAIGLSATELTFLTGACLFTAGLATFLQTLGIWKIGARLPFVNGVTFAGVAPMTAVVASTDDKSDALPIIFGAVIVAGLLGFVAAPFFSKAIRFFPPVVTGTVITLIGISLLPVAFGWAQGPSPTADDFGSATNLGLAGITLAIVLFLRRFTRGFVKQIAVLLGLVAGTLVAIPFGVTDFGPVADADVVGFPTPFHFGAPQFQIAAIISMCVVMVVSMTESTADMLALGEIVDRPADEKTIAAGLRADTLGSALSPVFNGFMCSAFAQNIGLVAMTKIRSRYVVAVGGGFLVLMGLCPMAASLIAVVPRPVLGGAGVVLFGSVAASGIQTLVRASLDKDNNVLIVAVSLAVGIIPIAAPEFYHSFPENARIILDSGISTGCVAAVLLNLVFNHIGGRGRDAEDVTHPMEAGDEITESSREAAMK

SEQ ID NO: 5533 - protein, 509 aa, Oryza sativa (japonica cultivar-group)
MGSFARKEHQFLAELGLAPRNPGSFACGAWGGSGPVVTSTNPTNNQVIAEVVEASAREYEEGMRACYDAAKTWMAIPAPKRGEIVRQIGDALRAKLHHLGRLVSLEMGKILPEGIGEVQEIIDMCDYAVGLSRQLNGSIIPSERPNHMMMEVWNPLGVVGVITAFNFPCAVLGWNACIALVCGNCVVWKGAPTTPLITIAMTKIVASVLERNNLPGSIFTAFCGGADIGQAISLDTRIPLVSFTGSTKVGLMVQQQVNARFGKCLLELSGNNAIIVMDDADIQLAVRSVLFAAVGTAGQRCTTCRRLLLHESIYRTFLDQLVEVYKQVRIGDPLENGTLLGPLHTPASRDAFLKGIQTIRSQGGKILYGGSAIESEGNFVQPTIVEISPSAPVVREELFGPVLYVMKVQNLKEAVEINNSVPQGLSSSIFTKRPDIIFKWIGPHGSDCGIVNVNIPTNGAEIGGAFGGEKATGGGREAGSDSWKQYMRRATCTINYGSELPLAQGINFG

SEQ ID NO: 5534 - protein, 507 aa, Zoysia tenuifolia
MAAAPRDVPRRGLFIGGGWREPSLGRRLPVVNPATETTIGDVPAATAEDVELAVAAAREAFRRDGGRHWSCASGAVRAKFLRAIAAKIKEKKSDLALLETLDSGKPLDEANADMDDVAACFEYYADLAEAFDGKQRLPISLPMENFKSYALKEPIGVVGLITPWNYPLLMATWKVAPALAAGCTAVLKPSELASLTCLELGAICIEIGLPPGVLNIITGLGPEAGAPLASHPHVDKVAFTGSTETGKRVMTAAAQMVKPVSLELGGKSPLIVFDDIDNIDNAVEWAMFGIFANGGQVCSATSRILVHEKIAKQFLDRLVAWAKHIKISDPLEEGCRLGSVVSEGQYEKIKKFISTARNEGATILYGGARPQHLRRGFFIEPTIITDVSTSMQIWREEVFGPVVCVKEFSTESEAVELANDTHYGLAGGVISNDPEICERLTKAIQAGIIWINCSQPCFVQAPWGGNKRSGFGRELGEWGLDNYMTVKQVTKYCSDEPWGWYQPPSKL

SEQ ID NO: 5535 - protein, 469 aa, Pseudomonas aeruginosa PAO1
MSYKSHQLIKDHDVKWVDLRFTDTKGKQQHVTMPARDALDDEFFEAGKMFDGSSIAGWKGIEASDMILMPDDSTAVLDPFTEEPTLILVCDIIEPSTMQGYERDPRNIAKRAEEYLKSTGIGDTVFVGPEPEFFIFDEVKFKSDISGSMFKIFSEQASWNTDADIESGNKGHRPGVKGGYFPVPPVDHDHEIRTAMCNALEEMGLVVEVHHHEVATAGQNEIGVKFNTLVAKADEVQTLKYCVHNVADAYGKTVTFMPKPLYGDNGSGMHVHMSISKDGKNTFAGEGYAGLSETALYFIGGIIKHGKALNGFTNPSTNSYKRLVPGFEAPVMLAYSARNRSASIRIPYVSSPKARRIEARFPDPAANPYLAFAALLMAGLDGIQNKIHPGDAADKNLYDLPPEEAKEIPQVCGSLKEALEELDKGRAFLTKGGVFTDEFIDAYIELKSEEEIKVRTFVHPLEYDLYYSV

SEQ ID NO: 5536 - protein, 755 aa, Bradyrhizobium japonicum USDA 110
MRSASGGPRVLLRRLRETMAEQVSAQERLDKIVVLIAANMVAEVCSVYVLRIDNTLELYATEGLNREAVHHTVLSAHEGLVGLVASEATPLNLNDAQSHPAFSFRPETGEEIYHSFLGVPILRAGNTLGVLVVQNRAKRTYVEEELEALQTTAMVLAELIASGELSALAQPGLEPAARHSMQKVGAILSEGIALGHVVLHEPRVVIKDYIAEDLPKEIKRLDTALAKLRADLDRMLERGDVAEGGEHREVLEAYRMFANDQGWSHKLHEAVATGLTAEAAVERVQSDTRARMLRSTDPYLRDRLHDLEDLGYRLMRQLVGQDHAPSREQLPDNAIVIARAMGPAALLDYDRKRLRGIVLEEGTANSHVSIVARALGIPAVGEVPNAPGIADPGDAIIVDGTSGSIYVRPSQEIEAAFAERVRFRARRQAQYLALRDRPCVTKDGQKVELMINAGLAIDLPHIEDTGSAGIGLFRTELQFMVGQSLPRTSDQLALYRTVLDAAGTKPVTFRTLDIGGDKALPYMEAVIEENPALGWRAIRLGLDRPGLLRGQIRALLRAGGGRALRIMFPMISEVAEFDAAKALVERELTYLRQHGHTLPERIDIGTMVEVPALLYQLDELLKKVDFISVGSNDLFQFLFAVDRGNAKVSERFDTMSAPILRALRDIARKSHAAQKSLSLCGEMASKPIGALALIAMGYRSLSLSATALGPVKAMVIDLDAKKAEAMLGPLLDAPSGSVSIRQKLTEFAEAEGLAL

SEQ ID NO: 5537 - protein, 451 aa, Medicago truncatula
MATHAALASTRIPTSTRFPSKASHSFPTQCASKRLEVAEFSGLKSTSCITYASNARESSFSDVVAAQLATKAIGSTAVRGETVAKLKVAINGFGRIGRNFLRCWHGRKDSPLEVIVVNDSGGVKNASHLLKYDSMLGTFKADVKILNNETITVDGKPILVVSSRDPLKLPWAELGIDIVIEGTGVFVDGPGAGKHIQAGAKKVIITAPAKGADIPTYVVGVNEQDYGHEVADIISNASCTTNCLAPFVKILDEEFGIVKGTMTTTHSYTGDQRLLDASHRDLRRARAAALNIVPTSTGAAKAVSLVLPQLKGKLNGIALRVPTPNVSVVDLVVNVAKKGISAEDVNAAFRKAAEGPLKGVLDVCDVPLVSVDFRCTDVSSTIDSSLTMVMGDDMVKVVAWYDNEWGYSQRVVDLAHLVANKWPGTPQAGSGDPLEDFCETNPSTDECKVFE

SEQ ID NO: 5538 - protein, 438 aa, Arabidopsis thaliana
MHSPLQTQQPEQRCWPMTSTVSEIEEVLPDEDSDRTTLLNGEPLRRRVSGKSPVDEGPRRIFRQQSFGRDIGHAAAETYLITGLSFKLLRYLGVGYRWMTKLLALTCYAMLLMPGFLQVAYSYFFSKQVRRSIVYGDQPRNRLDLYLPSNNDGLKPVVVFVTGGAWIIGYKAWGSLLGMQLAERDIIVACLDYRNFPQGTISDMVTDASQGISFVCNNISAFGGDPNRIYLMGQSAGAHIAACALLEQATKELKGESISWTVSQIKAYFGLSGGYNLYKLVDHFHNRGLYRSIFLSIMEGEESFEKFSPEVRLKDPVIIPYHAMKDPVVGKAASLLPPIILFHGSSDYSIPCDESKTFTDALQAVGAKAELVLYSGKTHTDLFLQDPLRGGKDELFDDIVSVIHAEDNDGLTKDSLAPPRKRLVPELLLKLAREISPF

SEQ ID NO: 5539 - protein, 469 aa, Symbiobacterium thermophilum IAM 14863
MRRVIIGPGAGFRTGGDHMNLKELDLRHLIHNEVRFRELARKGTTVITRAEGSTIWDIDGRAYLDAQAGMVLVNVGYGRRELGAVAAAQMERLMYYHTYFQYSNEPAVRLAAKLASLAPEGLGKVFFTLGGAESVETAVKIARLYQRARGRADGHKIICLDLGYHGNSLGALSATAFEAHRAYYGPLVPGFVHIPSPDTFEGPFRADDPEAGRKYAALLEERILAEGPETVAAFLAEPILGVGGIIVPPDDYLKHVRRICDKYGVLLILDEVMTGFGRAGTMWACGQFGVVPDLMCTAKGLTSGYLPLGAVLVGDHVIEAIAEADFPFEHGFTYAGHPVSCAVAMENIAILEREGLAERAARMGERLKEALLARDNPYIAEVRGRGLMVAAELVRDRETRERFPEGNRAFRFDVEAGCLREGVITGIAPYRDTLMITPPLVITEAEIDRLVDVYDRVIRQEGDRRRKQG

SEQ ID NO: 5540 - protein, 111 aa, Salmonella enterica subsp. enterica serovar Dublin
MILSVHILDQQTGKPAPGVEVVLEQKKDNGWTQLNTGHTDQDGRIKALWPEKAAAPGDYRVIFKTGQYFESKKLDTFFPEIPVEFHISKTNEHYHVPLLLSQYGYSTYRGS

SEQ ID NO: 5541 - protein, 347 aa, Streptococcus suis 89/1591
MKTAIYEKSGKMTVAEIEKPSLQAKDDVIIKVVRACVCGSDLWGYGEDIHHDHGDTNSGHEAIGIVEEVGEDITTLVPGDFVIVPFTHGCGHCDACRAGFDGTCDNHPGYTNWGNNYQSQYIRFHYGNWALVKIPGQPSDYSEGMIKSLLTLADVMPTGYHAARVADVKPGDKVVVIGDGAVGQCAVIAAKMRGASQIVMMSRHTDRQQMALESGATAIVAERGEEGIAKVREILGGGADAALECVGTEASIDQALGVLHNGGRIGFVGVPHYNNHALGSTFAQNIIIGGGSASVTTYDKEILLDAVLKGDINPGRVFTQTYSLDNIDQAYKDMANRKTIKAMITVD

SEQ ID NO: 5542 - protein, 134 aa, Glycine max
MASSSSPASSHPPGPFALGLESSANKIGIGVVSISGQILSNPRHTYITPPGHGFLPRETAQHHLVHLLPLLRAALAEADASPADLACICYTMGPGMGGPLQVAAASARALSLLWGKPLVAVNHCVAHIEMGRAV

SEQ ID NO: 5543 - protein, 583 aa, Medicago truncatula
MFSERSGAEESRCQEDFHGFSVSKRLVRSVSQKLRKKNNNRSLGEEDDDVNGVNFKCLSLYGRGGGCKVGADTSEELGDSSTRRRSSSSEEGKGYRPVCGPQDTAVVDCFSYGVRDRFWRRHHRKNSELDELLTTNNKMHVFLPDDILEMCLVRLPLTSLMNARLVCKKWRSLTTTPRFLQLRREGLYQNPWLFLFGAVKDGFCSGEIHALDVSQNQWHRIEAGFLRGRFLFSVASVQDDIFIVGGCSSLTNFGKVDRSSFKTHRGVLSFSPLTKSWRKISAMKYARSIPILGVFEVSLDFPSSQSHQSRQDRRFPRSKIGGVSDVYEDPHKLSMRRHCRSTFNETEASSLSSRKAHKFMRQISDLSSSKSSRRFLLIAVGGLGSWDEPLDSGEIYDSISNKWTEIPRLPFDFGIACSGVVCGKMFYVYSETDKLAAYDIERGFWIAIQATPIPPRVHEYYPKLVSSKGRLFMLSVSWCEGDGQIGRRNKAVRKLWELDLMYLTWTEVSVHPDAPMDWNAVFVADKNLIFGVEMFKIFGQVLDFFTVCDVTDMSNWNHISRNHVTHELDGSSCVTKSVAVMHL

SEQ ID NO: 5544 - protein, 514 aa, Burkholderia sp. 383
MTVTRPLPDSDPIALLRVADLRTAEADAAAALPPHTLMGRAGAAAAHWLSERMAGDDRPVWFAVGPGNNGGDALVAAAHLQQLGVATQAWMPVPVKPDDAQWALGLARAAGVPLSASPPASLDGYAWVVDGLFGIGLGRALDGAFAEQAARIAAHARSGGHVLALDVPSGLDSDTGQIVGAGVAVAATHTLTFIAAKPGLYTGEGRDLAGEIDVASLDVAPPAAPAIVLNAPARFAAALPARAFASHKGTFGSLAVLGGDTGMCGAPILAARAALFAGAGKVHVGFLGAGAPPYDPPFPELMLHPVDGLDLDAMTAIAAGCGLGTREAAATLVRDVLAHDAATLLDADALNLVATHADLATAVATRGTRGNPCVLTPHPLEAARLLGSDTATIQRDRVAAAQALAARYAAHVVLKGSGTVIAAPDGRVTINPTGNAALATGGTGDVLGGLIGAMLAQRVAPYEAALAGVYLHGLAADTLTAHGTGPAGLTAGELAPMVRTLINRLFYASPRADT

SEQ ID NO: 5545 - protein, 235 aa, Brassica napus
MSSSRKLQVVSPVPADIDIANSVEPLHIAEIAKDLNLSPLHYDLYGKYKAKVLLSAFDELKDREDGYYVVVGGITPTPLGEGKSTTTVGLCQALGAYLDKKVVTCLRQPSQGPTFGIKGGAAGGGYSQVIPMDEFNLHLTGDIHAITASNNLLAAAIDTRIFHEASQSDKALFNRLCPVNKEGKRSFSDIMFRRLTKLGISKTIPEELTPEEVKKFARLDIDPDSITWRRVMDVN

SEQ ID NO: 5546 - protein, 556 aa, Burkholderia sp. 383
MSRRGIPPDSRFTRTAMTLNSLPAWTALQSHFEQIRHARLRDWFAPENDHTPTRAERFTIPGGGIAADFSKNRINDDTLRLLVQLARDAGVEARRDAMFAGEIVNPTEGRAALHTALRATDPQAPFHAQISAERAKMATFARAVRSGTWTGYTGKRIRHVINIGIGGSDLGPKMVVHALHHVATPEITTHFVSNVDGADLARVLEQVDPEETLAIIVSKTFTTLETMTNARSLRDWFVARGCPEDALAKHFVGVSANPAEVVKFGIAADNVFEMWDWVGGRYSLWSAVGLSIMIAIGPEQFDELLAGANDMDRHFREAPLERNLPVLLGLIGIWYRNFFGSQSYLVAPYSEALHYLPSYLQQLEMESNGKSARLDGTFVDYPTSAVTWGEPGTNGQHAFFQMLHQGPTIVPIDFIAVLTPEHPLASHHPKLLANCFAQSEALMLGRTLDEARKVAGPGKEALAPHLTFPGNRPTTTLLVDALTPRTLGALIALYEHKVLVQATVWDINPFDQWGVELGKILGKVVEADLSAESIDPAKHDSSTTALIERARAALKR

SEQ ID NO: 5547 - protein, 959 aa, Saccharomyces cerevisiae
MTVTTPFVNGTSYCTVTAYSVQSYKAAIDFYTKFLSLENRSSPDENSTLLSNDSISLKILLRPDEKINKNVEAHLKELNSITKTQDWRSHATQSLVFNTSDILAVKDTLNAMNAPLQGYPTELFPMQLYTLDPLGNGVGVTSTKNAVSTKPTPPPAPEASAESGLSSKVHSYTDLAYRMKTTDTYPSLPKPLNRPQKAIAVMTSGGDAPGMNSNVRAIVRSAIFKGCRAFVVMEGYEGLVRGGPEYIKEFHWEDVRGWSAEGGTNIGTARCMEFKKREGRLLGAQHLIEAGVDALIVCGGDGSLTGADLFRSEWPSLIEELLKTNRISNEQYERMKHLNICGTVGSIDNDMSTTDATIGAYSALDRICKAIDYVEATANSHSRAFVVEVMGRNCGWLALLAGIATSADYIFIPEKPATSSEWQDQMCDIVSKHRSRGKRTTIVVVAEGAIAADLTPISPSDVHKVLVDRLGLDTRITTLGHVQRGGTAVAYDRILATLQGLEAVNAVLESTPDTPSPLIAVNENKIVRKPLMESVKLTKAVAEAIQAKDFKRAMSLRDTEFIEHLNNFMAINSADHNEPKLPKDKRLKIAIVNVGAPAGGINSAVYSMATYCMSQGHRPYAIYNGWSGLARHESVRSLNWKDMLGWQSRGGSEIGTNRVTPEEADLGMIAYYFQKYEFDGLIIVGGFEAFESLHQLERARESYPAFRIPMVLIPATLSNNVPGTEYSLGSDTALNALMEYCDVVKQSASSTRGRAFVVDCQGGNSGYLATYASLAVGAQVSYVPEEGISLEQLSEDIEYLAQSFEKAEGRGRFGKLILKSTNASKALSATKLAEVITAEADGRFDAKPAYPGHVQQGGLPSPIDRTRATRMAIKAVGFIEDNQAAIAEARAAEENFNADDKTISDTAAVVGVKGSHVVYNSIRQLYDYETEVSMRMPKVIHWQATRLIADHLVGRKRVD

SEQ ID NO: 5548 - protein, 423 aa, Arabidopsis thaliana
MSLFLKDDSIQIREVWNDNLESEMALIREVVDDFPFVAMDTEFPGIVCRPVGTFKTNTEYHYETLKTNVNILKMIQLGLTFSDEKGNLPTCGTDNKYCIWQFNFREFDLESDIYATDSIELLRQSGIDFVKNNEFGIDSKRFAELLMSSGIVLNENVHWVTFHSGYDFGYLLKLLTCQNLPETQTGFFEMISVYFPRVYDIKHLMKFCNSLHGGLNKLAELLDVERVGICHQAGSDSLLTSCTFRKLQENFFIGSMEKYSGVLYGLGVENASLSLRFGKDLCFSSFGKPAQRFNMSGDEAVAAPVVPPVAEAAVIPEDMDVSTALELTVRKSRAYGGVVRGLHESAKLIEKRNASASVSWLKIATNLIMSSLLKLFALTTAIKLLTVPSAKTLGEWAGLCKIDSEGQCKEGCWMLMSRDQGFR

SEQ ID NO: 5549 - protein, 406 aa, Triticum aestivum
MASLSLSLRASASSAAAGSRAAAPIKASCVRSKVTCSLPSIRATSSPARSIEPVRATATQAPPATPQSSSGEKTKVGINGFGRIGRLVLRIAIDRDDIEVVAVNDPFIDAKYMAYMFKYDSTHGPFKGTITVLDESTLEINGKKVSVTSKRDPSDIPWGNFGAEYVVESSGVFTTVEKASAHLKGGAKKVVISAPSADAPMFVVGVNEKNYNPSMDVVSNASCTTNCLAPVAKVVHEEFGILEGLMTTVHATTSTQKTVDGPSMKDWRGGRGAGQNIIPSSTGAAKAVGKVLPALNGKLTGMAFRVPTPNVSVVDLTCRLEKNASYEDVKAAIKDASEGSLKGILGYTDEDVVSNDFVGDTRSSIFDANAGMGLSSSFMKLVSWYDNEWGYSNRVLDLIGHMSLVA

SEQ ID NO: 5550 - protein, 279 aa, Mesorhizobium sp. BNC1
MAESLHRAFICGHPVAHSRSPVIHNFWLKQHGIEGSYERRDIAPEAFSLFIREFPRFYMGGNVTIPHKESAWRLVETRDEAAETIGAVNTLWLQDGRIMGGNTDTYGFAANLDMELAGWEKNAVATVLGAGGAALAVVHALQSRGIRDIRIVNRTVSRARAVVDRFKGGTSAHAWEAVPDLLSDTSLLVNTTSLGMHGGPEGHIDLAPLPDSAIVTDIVYVPLRTPLLASAAARGLRTVDGLGMLLHQAVPGFERWFGVRPEVTPHLREIVVADLEAGK

SEQ ID NO: 5551 - protein, 424 aa, Pseudomonas fluorescens Pf-5
MQDEFNDPLWRQVLSGAQMLFVAFGALVLMPLITGLDPNVALFTAGLGTLLFQVVTGRQVPVFLASSFAFITPIILAKGQFGLAATMGGVMAAGFVYTFLGLAVKIKGTGFIDRLLPPVVIGPVIISIGLAMAPIAANMAMGKAGDGSELIHYQTAMMISMPALLTTLIVAVFGKGIFRLVPIISGVLVGFALSFYFGVVDTAKIAAAPWLALPHFTAPEFNWQAILFIVPVALAPAIEHIGGVIAVGSVTGRDYLKKPGLHRTLFGDGIATTAAGLFGGPPNTTYAEVTGAVMLTKNYNPKIMTWAAVFAITLAFIGKFGALLQSIPVPVMGGILCLLFGSIAAVGMNTLIRHKIDLGEARNLVIVSVTLVFGIGGVLVGTGTGPDDFGLKGIALCAVVAIVLNLVLPGNDGWKNKKADEPLI

SEQ ID NO: 5552 - protein, 341 aa, Nostoc sp. PCC 7120
MLAALLYGQEDLRLEQVADPSPDVGEVVIKVGAATTCGTDLKVWRRGGHAKMLKLPTLFGHEAAGEIVAVGADVTGWQIGDRVVANNSAPCMKCFFCQRQEYSLCPNLTWNNGTFAEYLKIPAPIVQHNLLQVPDELPLSLAAMTEPLACVLHGVARSHIKPQDRVVVLGDGAIGLMFVAVLADKVEVLLWGGNDQRLEIGQKLGATKTFNYHQNPDIPHVVKELTQGWGADVVIEATGVPSVWETAIACARPGAIVNLFGGCPRDTTITVNTEQLHYSELTLKGVFHNTPEYVRAALALIASRKIPFELLISEQRPLKDLEQVFYDMKARKVIKVAMVCS

SEQ ID NO: 5553 - protein, 689 aa, Prochlorococcus marinus str. MIT 9211
MGKIHKGSPWPLGSSITSRGVNFSVASPEASYIELLIFKNEDDLQPKKILTLDKNHRSGDYWHIEVEGINTGCFYCYRVIGNRSTCKQDIFSRKILLDPCSRGIAGWNIFQRESATGLSTNIDKCLKSIVTERDQFDFQSYPRPKHSWDKTIIYELHVGGFTKSSESDVKDKIKGTFLGLIEKIPYLKQLGVTTLELLPVFAFDTTDSPYGLNNYWGYSPINWFTPHHSFIASNNPINARDQFRNFIKVCHKNDLEVILDVVYNHTTEGNEKGPIISWKGFAESTYYHQNKEGKYLDVTGCGNTIAANNPLVRQLILESMRCWANELGVDGFRFDLGISLSRGKDLKPLDSPPLFEEIESDPALSDLKLISEPWDCGGLYRLSDFPAKRCCTWNGHFRDDIRRFWNGDKNSTWPLKDRLTGSPELYKDNFKSAQKSINFITSHDGFTLKDLVSFNLKHNLSNGESNRDGENHNNSCNNGIEGPTTNKKVNLIRSKNQRNLIATLLLSPGIPMILMGDEVGRSQGGNNNAWCQDNPLGWMIWRTDNCDNELRSFVSMCIYIRKELSDFFAPLININSDSPSLQSQEKLWVQWHGVKINAPDWGSWSNTIGFSINKAKEGAIIWMGFNAFNQSMKFELPKPLSPWVKILDTTLLTQKEYGLFRLSNQLEIEIESKSLVVLVAKEYTKKLRI

SEQ ID NO: 5554 - protein, 433 aa, Magnetococcus sp. MC-1
MDQRGGTMSRSASLFQQAAGLIPGGVNSPVRAFKSVGGIPPFIREAAGAMMTDEDGKSYIDYVGSWGPMILGHAPKEVVAAIQQAAVRGCSFGAPTSNEILLAQKLIELVPSLEMVRLVNSGTEATMSALRLARAATGRDAILKFDGCYHGHADSLLVAAGSGLATFGVPSSPGVTRGTAKDTLTVPFNDLAAVEACFAQHPEGIAAVIVEPVAGNMGCVLPRPGYLKGLRDICTKYGTILIFDEVMTGFRVDLRCAQGFYDVTPDLTCLGKVIGGGLPVGAYGGKMELMNQVSPAGPVYQAGTLSGNPLATAAGLATLEAISQPGFYETLTSRTQRLTVGIGKALDEAGIPHVSYHIGSMFGLFFTDAREVYNFADAAKNDHNRFKDWFHCMLEEGVYFAPSPYEAGFVSIAHDEAIIDLTIEKARKVAKTL

SEQ ID NO: 5555 - protein, 110 aa, Oryza sativa (indica cultivar-group)
MDIESVRCACCGLEEDCTQEYIENVKANFGGKWLCGLCSEAVGDELSKDRREQDGIEDAIKAHMAFCRMALSSPAVKVADGMKEMLRKRSKDKVKPEIPSKAHPFLLGDN

SEQ ID NO: 5556 - protein, 154 aa, Synechococcus sp. RS9916
MPSSRRAWPSFLKVVDKGEQVVAKVLTVVTAVVIVAALGQLIMRVAMDLISPQPANWLGDGLIKVLGDLLTVLIALEVLQNVTSYLRRHVVQLELVLVTALTAVARKVIVLPAGSENKPQLLIGLGLASIALAGAYWLVIRSQPQGRIDQGSHQ

SEQ ID NO: 5557 - protein, 515 aa, Pseudomonas aeruginosa PAO1
MTATPKPLVLIILDGFGHSESPDYNAIYAAKKPVWDRLLATQPHGLISGSGMDVGLPDGQMGNSEVGHMNLGAGRVVYQDFTRVTKAIRDGEFFENPVIAGAVDKAVAADKAVHILGLLSPGGVHSHEDHLVAMAQMAARRGAGKIYLHAFLDGRDTPPKSAQPSLERLDATFAGLGKGRIASIIGRYFAMDRDNRWDRVQAAYELIVDGKAEFTADSSVAALEAAYARGESDEFVKATAVVPAGAEAVRVEDGDAVIFMNFRADRARELSRAFVEPAFNEFPRERAPQLAGFVMLTQYAASIPAPCAFPPEPLTNVLGEYLAKHGKTQLRIAETEKYAHVTFFFSGGREEPYEGEERILIPSPKVATYDLQPEMSAPEVTDRIVEAIEQQRYDVIVVNYANGDMVGHTGVFEAAVKAVECLDTCMGRIVEALDKVGGEALITADHGNVEQMEDESTGQAHTAHTCEPVPFVYVGKRKLSIREGGVLADVAPTMLTLMGLEQPAEMTGRSIVTLG

SEQ ID NO: 5558 - protein, 412 aa, Oryza sativa (indica cultivar-group)
MAEDPAGSRRWRCDAGDEHGCWLSSSAGGGGDDHFDRLPDPLLLVIFNRIGDVKALGRCSLVSRRFHDLVPLVDSVLVRVDCVIPDDPASSSSSSSSPSAAPSSPTASARARTVFSQIARIVLGGIVKPIQALGQILSPANSASVLAASVTSSPSSSSSSSSSSPPLPGDVSHHSPSEVLRSFKELRRLRIELPAGELSMEEGVLLKWKADFGSTLGSCVILGASSAGKDGGAGAAPAVDCGESDETGSIPESFYTNGGLKLRVVWTISSLIAASARHYLLQPIIADHTTLESLDLTDADGQGVLTMDKWQLQELRVKPVSASGGSHRTLMPALSMRLWYAPHIELPGGLVLNGATLVAIKPTEEATRDTVGTGIAGSAGGCWVSDAFEEPYRTAVGMLLKRRTYSLEMNSF

SEQ ID NO: 5559 - protein, 714 aa, Arabidopsis thaliana
MDDGTPKKLNILPDHFSAPSPTAESSQHDTPSSSQPKDDSSLRSYSQSRTRRNLKRAATMLNLFTLRRLPWVSDGQEKVELSAAELESLRSELSDMEEREAYLKAQLEHVDEVLRSARLSALPGEPPPIDDTEVDDWLPRFVVLQGPCLFFYLLSTDLSPQDSTLLADIVEIGSVPSYTREFDETHYCFYILTRQGLRFECSSTSKTQVDSWLSVLRLDCKSEPEERFTFLRSLFAHHSSQSSRIVSEKMSSQICRSASRAARSLLSSAKNARFFSEGRAIGAASVVHATGKVPQYASNFGKSGSGFVSNSWITGLLALPAAEPYYIRLAFFFIISVIAFMLQDQEALAAEMERTFIAIKPDGVQRGLISEIITRFERKGYKLVGIKVMVPSKGFAQKHYHDLKERPFFNGLCNFLSSGPVVAMVWEGEGVIRYGRKLIGATDPQKSEPGTIRGDLAVVVGRNIIHGSDGPETAKDEISLWFKPEELVSYTKRYFSFDLSLRSSSSSLSLIVFSCKMETGTPLIAETIALTEKKVAMALDDIIKLAKRKTNVNKGKKPRREKNKNQNFNGAARNNTSNVRHHMNSLSAVRQGAVGKRRSRFQGIQFPVTTNIARKASTAAPLDFRGRAFNGGRMTSANQSRLIAPPVQNISVQARVNAKRHEVDQKVEHRGGKRKTLDSRFASMKEQRMTINNYGVTVQVPRLPPWVRARRFSQ

SEQ ID NO: 5560 - protein, 614 aa, Tropheryma whipplei TW08/27
MITKDIRNIAVVAHVDHGKTTLISAMLQQTSDSTTAEDRVLDSHELEREKGITILAKNTAVTYKSSGRSVTLNIVDTPGHADFGGEVERGMSMVDGVVVLVDASEGPLPQTRFVLKKALLKKLPIVLAVNKTDRSDARIDDVVSEFQDLLISLAEEINDPAIYSILDVPIVYVSGRAGRASINKPDNGQLPDRNNLDDLFEKIISYIPAPEYDKSAPLQAHVANIDASAFLGRLALTRIYNGSISKGQTVCWVNTSSKQRVNVRVTELLKTVALDRVPVPSVSAGDIVAIAGIPDVMIGDSICDPDDVRPLPGISIDEPAISVVIGVNTSPLAGGVPGHKLTATQIKERLDRETIGNVSIRVIPTRGTDAWEVQGRGELALAVLIEQMRREGFELTVGKPSAVTRIVDGSLHEPYELLTVNLMDEYFGSVTKLLAERKCRVESVISNAGWTNADFVVPSRGLIGFRTEFLTITRGTGTANAIFHSYAPWSGQINQRAQGSAVADRAGHVTSYAILGLQERVLFFVSPSERVYEGMVVGRNSRPGDLNVNVTKGKKLTNTRSSTAEELEKIVPARHLSLEECLEFAGPDECVEVTPEAIRIRKIELSQSVRSKQR

SEQ ID NO: 5561 - protein, 255 aa, Arabidopsis thaliana
MYLTKGKVGNTKKHFEEKEEDKRRSTRIICLKSNRIDSVFFFFFTYLSLSLSWSIRYSILLVGAGESEMTWSVFRSINTPTLDLSTALRSTRTPLVAAGVGCATFAGVSLFRMSSRSPPFASLSVSASSVKKEVVSTEKAPAALGPYSQAIKANNLVFLSGVLGLIPETGKFVSESVEDQTEQVLKNMGEILKASGADYSSVVKTTIMLADLADFKTVNEIYAKYFPAPSPARSTYQVAALPLNAKIEIECIATL

SEQ ID NO: 5562 - protein, 498 aa, Vibrio vulnificus YJ016
MTAMDLRKALYTAKQVREGEVGAAANAGVTLYELMERAGRATFAVILNYYPAVSRLCVVCGKGNNGGDGYVVARLARQQGLYVVLIQSSDAESLSGDAKQAQQAWRDAGGEISDTASLNAALSDCDLVVDALLGTGLAGAVRDEMAKLIDAVNLAGKPIVSVDIPSGLCADTGQALPDAIHADHTVTFIGTKQGLVTGKARAFCGAIHFADLGIGTEFSKLVPSFKTTIERDEITQWRLTRARCAHKGDHGRVVLLGGNRGMSGAISLAATACARSGAGLVAALTHPESALPLQIHCPEVMTLGYNEDKRELEKKLDWADVLVVGPGLGTDEWAKKRWNDIANFQGPMVLDADGLNWLARYPNHNDQRIITPHPGEAARLLGCSVNEVEADRFAAVSVLQSQYGGVVVLKGAGTLVYDGTQTFVCNAGNPGMATGGMGDVLSGVIGALLVQKLPLLRAASLGVLLHSCAADICATEKGEIGLLASDLLDKIRQLLNAD

SEQ ID NO: 5563 - protein, 472 aa, Yersinia pestis KIM
MRECTMKNDSSTLKRGLSARHIRFMALGSAIGTGLFYGSAEAIRLAGPAVLLAYLIGGAAVFMVMRALGEMAVHDPVAGSFGHYASRYLGPLAGFLTGWTYTFEMVVVALADVTAFGIYMGLWFPDAPQWVWVLSIIFFIGALNLCSVKVFGEMEFWLSLLKVAAIIAMIAAGLGIMMFGFGAGHDSTGVSNLWAHQGFMPNGITGVIASFAVVMFAFGGIEIIGVTASEAKDPGKVLPRAINTVPIRILLFYVLTLFVLMAIYPWNSIGQNGSPFVEIFSSLGINSAANILNLVVITAAISAINSDIYGAGRMMYGLAQEGLAPKSFSRLTRNGVPYMTILVMAITLLCGVVLNYLIPKNVFLVIASIATFATVWVWLMILVSQVAMRRSMSKAQVARLAFPVPFWPLAPILTILFMAFIIAVLGYFPATRIAMYVGLAWVALMTLAWWIWLRKAPSCVIQERAKSSEMPS

SEQ ID NO: 5564 - protein, 591 aa, Aspergillus oryzae
MAISTEQLAANGHTNGHTNGTATPLDSSSTSEKPVHPRSVPLNREYGYTPRKLRIITIGAGFSGLLMAHKIQHRFKELEEYVTHTIFEMRKDIGGTWLVNDYPGVQCDVPAHIYAFPFDPNPNWTKFYASGPEIQAYIKNTVAKWNLDRDVQLNTRVVGARWNENDGVWKVTVERDGVQRDEFAEILISGQGVLCHPSWPTIPGLRQFKGKVVHSAEWDHGFDYSHKRIAVIGNGSSGIQITPQMANLPGTEVVNFVRGGGWIYYRIPPSRHLGRTTDEVNPTYTEEEKTRFQDPEYHHQYRKGIIDRTNKAYKLFLKGKNNEEAVRFGTEQMAAKLNHDPELCRILIPKWEVGCRRVTPGPGYLEAFSKPNCNLTDSPITHISENAVHTTDGNVFECDVVICATGFDVSHRPRFPLIGQNGANLAEKWADEPESYLSVATAGFPNYFIFSGPNSLGGHGSLVEALNWTGDYFVKWIKKIATEDIKSVVPKKSAEEAFVRYGDEVHKTIVWTGSCKSWYKRNKANGRVTALFGGSALLFNRLISELRPEDFEIEYHSANNFRFLGNGFLEYEMDPEQDLSWYVELPEPLKQ

SEQ ID NO: 5565 - protein, 303 aa, Triticum aestivum
FIDGTVLSLEDRVAVALRRLNSGGSLVTVGTSVGVNHSTVSLITWRFVEAVEARAGHHLRWPDSDEMAMIKSKFEKIHGLPNCCGVVDTTHIIMCLSSAEPNCKVWLDHEKNYSMVLQAVIDPDMRFTDIVTGWPGSMKESSILHSSGLFRLCENGARLNGSKLTVSDGSEVGEYVIGDAGYPLLPWLFTPYQENDLSELKVEFNKRHSAARTVALKALARFKDTWKFLQGEMWRPDKHKLPRIIHVCCLLHNIVIDMEEDAAMDDAHISDDHDANYRQQVCQLSDEKAVRMRDKLSEHLNSS

SEQ ID NO: 5566 - protein, 276 aa, Arabidopsis thaliana
MASLSFVSSSHLTLRTPSIALRSTGSSPRTSVSFSVKAQSVALSQDDLKKLAAEKAVEAIKPGMVLGLGTGSTAAFAVDQIGKLLSSGELYDIVGIPTSKRTEEQARSLGIPLVGLDTHPRIDLAIDGADEVDPNLDLVKGRGGALLREKMVEAVADKFIVVADDTKLVTGLGGSGLAMPVEVVQFCWNFNLIRLQELFKEFGCESKLRVDGDGKPYVTDNSNYIIDLYFKTPLKDGFAAAKEIGKFQGVVEHGLFLGMATSVIIAGKNGVEVMTK

SEQ ID NO: 5567 - protein, 314 aa, Polaromonas sp. JS666
MTSALDVITFGEAMMLLVADRPGPLEHAEAFHKRTAGAETNVAIGLARLGLKVGWASRLGTDSMGRYLLAAMAAEGIDCSHVVCDATQKTGFQFKGKVTDGSDPPVEYHRKGSAASHMGVADIDEAWLLSARHLHATGVFPAISATTLPAARKTMDLMRAAGRSVSFDPNLRPTLWATPELMRDAINDLATRADWVLPGMEEGRFLTGETTPEGVARFYRQLGAKLVVVKLGAEGAYFDGEAGSGRVAGFPVAEVVDTVGAGDGFAVGVISALLDGLGVPEAVKRGAWIGARAVQVLGDSEGLPTRAELNAAKL

SEQ ID NO: 5568 - protein, 351 aa, Bradyrhizobium japonicum USDA 110
MDGIISGLLPNVISPRCSPSVQGALQGRGAFPAGNHLEIAPNSRAILRHHAKGRPVMAEIKKAIEYSPSWTFFEGKWHDGNVPIMGPRTHAAWLGSVVFDGARAFEGVAPDLDRHIARANQSAINFGLKPVVDPGTWLTLANEGIARFATNAELYIRPMYWAENGSGGGVLFDPETTNWCLCIYEAPMPKPVGNAITLSPFRRPTAECAPVEAKAACLYPNNSRALAEAASRGFQNALMLDMLGNVAEFGNSNVFMARDGVVFTPVPNGTFLNGITRQRVIGLLRADGVTVVEKTLRYADFLAADEIFSTGNFAKVAPVIRIDERELKPGPLYTKARKLYWDFAHAVKLAA

SEQ ID NO: 5569 - protein, 311 aa, Bradyrhizobium japonicum USDA 110
MPLDPLAKRLLTMMAAAGPQVRNRPSVEARRQSLAKLMQFARTDAPDVTVSDGTLPGPGGELPYRLYSPATAAERAPGFVFFHGGGLVAGSVATHDRIAAALAHATGCRLVSVDYRLAPEHKFPAAVDDAIAATEWVAREASSLGIDAGRLVVGGDSAGATLAAIVCQEALQNAGLSIVAQCLICPVLDFEETSPSREAFAEGHLIDRITIEADLADYLPGGIDAADPRISPLRATRFAGLPTAIIHTAEFDPMRDEGNAYARKLLAAGVTVEHVCHDGMVHNFHAMGAILPQAQLVLSQIGEQVRRAVEK

SEQ ID NO: 5570 - protein, 246 aa, Synechococcus sp. RS9916
MALRLEGGGIAGGSRHEICVPRGLMQPLSPEFINHLRFNEAGLIPAVAQDWLDGAVLMQAWMNREALERTLSSGEVHYWSRSRQELWHKGATSGHTQTVKGIRYDCDADVLLITIEQTGDVACHTGARSCFYDDSDQPTGGGANALPPPADVCTELARVIEGRRDRPEEGSYTNKLLEGGDNRILKKIGEESAEFVMACKDDNAAEIAGEAADIIFHMQVALAHHGVSWRQVQEVLAQRRGAPRRH

SEQ ID NO: 5571 - protein, 577 aa, Yarrowia lipolytica CLIB122
MEKNEVVSTNSPHEEGSVTEANNGRWANFKDSFRRADLSEYDTEGLSDLEKAALATANSPLSRSLKGRHLQMIAIGGSIGTGLFVGSGTTLATGGPAAILIAYSIIGTMLFCTMHSLGELCACFPVSGAFASYSTRFIDPAWGFAMGWNYTLNWFIVFPLELVAASLTVNYWNEANGTNYNAGCWVAIFWVLIVSINFFGVKGYGEAEFYFSLIKVIAVVGFIILAIVLTCGGGPNHDYIGGRYWHNPGAFSAGAKGVCAVFVSAAFAFNGTELAGLAAAETANPRKSIPTATKQVFWRITLFYIVSLTLVGFLVPWDHPQLLNKSSSADASASPFVIAIKAAGIKGLPSVMNVVIMISVLSVGNSSIFGFSRTIAALAQQGQAPSFFAYIDRKGRPLFGIITVSLFGLFAFICAGPIETQNTVFYWLMAICGLSSIFTWGSINLCHFRFRMAMKVQGRSLREMPFLSHVGTIGSMYGFLLNVTVLGLQFWIALFPVGGAKPKADVFFQAYLAVPVVLAFYIFFKLWKRPSFVALKDMDLDTGRRETDFELLMHEMDEEAAYIASKPFYYRVYKFWC

SEQ ID NO: 5572 - protein, 358 aa, Agrobacterium tumefaciens
MPHKASVFIVEFKFELESCPLGVVIPLEESKNKLASVKPLVDLTRPDMERVNQLILSKAGSDVQMIPEVANHLISSGGKRLRPMLTLASASMFGYEGDNHIKLATSVEFMHTATLLHDDVVDESDLRRGKSTARTIWGNQASVLVGDFLLGQAFRMMVDVGSLDALDVLSTAASVIAEGEVLQLSVAKNMETTEDDYLQVIRAKTAALFAAAAEVGPIVAKTDKATRSALKSYGMNLGLAFQLVDDVLDYGGKSADLGKNTGDDFREGKITLPVILSYRRGTQDERAFWRTAIEKGESSDENLEKALGLITKYNGLGDTIGRATHYGTIARDALAPLPQSPWKDALLEVIDFCIERLN

SEQ ID NO: 5573 - protein, 183 aa, Malus sp.
MASSMISSGTVATVSADRPAPAQARMVAPFTGLKSSSASPVTRKSNDITSIASNGGRVQCMQVWPPLGLKKFETLSYLPPLSTESLAKEVDYLLRKNWVPCLEFELEHGFVYRENHRSPGYYDGRYWTMWKLPMFGCTDSSQVLKELEEAKKAYPQSFIRIIGFDNVRQVQCISFIAYKPAGF

SEQ ID NO: 5574 - protein, 197 aa, Pseudomonas aeruginosa PAO1
MAERKASVARDTLETQIKVSIDLDGTGKARFDTGVPFLDHMMDQIARHGLIDLDIECKGDLHIDDHHTVEDIGITLGQAFAKAIGDKKGIRRYGHAYVPLDEALSRVVIDFSGRPGLQMHVPFTRASVGGFDVDLFMEFFQGFVNHAQVTLHIDNLRGHNTHHQIETVFKAFGRALRMAIELDERMAGQMPSTKGCL

SEQ ID NO: 5575 - protein, 700 aa, Medicago truncatula
MSQLSLSSFFFFFFTLSFFSFTFSIIASTEFDFGTLTLTSLKLLGDAHLNNGTVTLTRDLTVPFSGAGQALYSRPIRFRQPGTTTPASFTTFFSFSVTNLNPSSIGGGLAFIISPDDESLGDAGGYLGLAGNGFVAVEFDTLMDVEFKDINGNHVGVDLNSVVSSKVGDLDSIGVDLKSGDSVNAWIEFDGSNNGFNVWVSYSNLKPKDPILTMNLDMGLYLNDFMYVGFSGSTQGSTEIHRIEWWSFSSSFMTGSGGLSPPPAVSMMNTTANSARSPPPSMAPTMNSSNEERKESKKSCHNGLCKQGLGAVAGVVTAGAFVLALFAGSMIWLYSKKVKRVSRFDSLGSEIIKMPKQFSYKELKSATKCFNANRIIGHGAFGTVYKGILTENGDIIAVKRCSHSSQGKNEFLSELSIIGSLRHRNLVRLQGWCHEKGEILLVYDLMPNGSLDKALFEARTPLPWPHRRKILLGVASALAYLHQECENQVIHRDIKTSNIMLDEGFNARLGDFGLARQTEHDKSPDATVAAGTMGYLAPEYLLTGKATDKTDVFSYGAVVLEVASGRRPIEKDAAGVGKVGVSSNLVEWVWSLHREGRLLAAVDPRLEGEFDEAGMTRVLLVGLACSHPDPLARPTMRSVVQMLGGEAEVPIVPRTKPSTGLSTSHSHLLMSLQDSVSDCDGILTISTSTSENSFNGGDIV

SEQ ID NO: 5576 - protein, 504 aa, Medicago truncatula
MVLSETATHMDASVHSTFASRYVRTSLPRFKMGENSIPKEAAYQIINDELMLDGNPRLNLASFVTTWMEPECDKLIMASINKNYVDMDEYPVTTELQNRCVNMIAHLFNAPLEDSEPAVGVGTVGSSEAIMLAGLAFKRKWQNRRKSEGKSCENPNIVTGANVQVCWEKFARYFEVELKEVKLRDGYYVMDPEKAAEMVDENTICVAAILGSTLNGEFEDVKRLNDLLVEKNAETGWDTPIHVDAASGGFIAPFLYPELVWDFRLSLVKSINVSGHKYGLVYAGIGWIIWRSKEDLPEELIFHINYLGADQPTFTLNFSKGSSQVIAQYYQLIRLGYEGYRNVMENCRDNMMVLKDGLEKTERFEIVSKDEGVPLVAFTLKDHNNFNEFQISDMLKRHGWIIPAYTMPPDAEHVTVLRVVIREDFSRTFAERLVIDITRVIHELDLVPSRVVSTNTITVTGGEEDADNDGTVTIANQSVLETQRKITTAWKKFVMNRKKTNGVC

SEQ ID NO: 5577 - protein, 530 aa, Medicago truncatula
MAPKPFHFPAKRTTAIFLLTAATAAIATANSDDLSSQIHGIVRTARAVSTVTSTVVDYEFSLRGLQKHSDQYRHTISQVHQRSAKRFLKLCEANKGFYVKAGQFIASQKVIPREYSSTLSVLQDQVSPLPFEVIEKVLKENLGPDFSEKFLSIDERPIGAASIAQVHHAVLKSGQEVAIKVQYPWIEKQMHFDTRTMYFLSKTIGWLYPQYRFGWLPLAFAKTVSSELDFVQEARNSERAAKNFRNNKMVRIPHVFWELTTKQVLTMQFYAGHKIDDLDFLNQIGVDPEKVAKSLFELFAEMIFVHGYMHGDPHPGNILVSPEGRNGFSLVLLDHAVYRELDEEFRKDFCQLWEALVLKDSKKTMWFGERFGAGKYSRYLPIIFTGTTIESKYSSGMSLKEKESMKHELKSLLFEDLSSFMESMPPDFIAILRVDALLRSTIRKMDVSRLIRLLTYTKYAVYGRLCPKLDGELCKMPGTNVWAIFDSTPWQQKVKNVQNYLYRKIGSSDFWGILVHSAFLLFCIHPNALF

SEQ ID NO: 5578 - protein, 829 aa, Vibrio vulnificus YJ016
MKMTRRAFVKANAAASAAAVAGITLPASAANLIASSDQTKITWDKAPCRFCGTGCSVLVGTQNGKVVATQGDPEAPVNKGLNCIKGYFLSKIMYGQDRLTQPLLRMKDGKYDKEGDFTPVSWDVAFDTMAEKWKASLAKKGPTSIGMFGSGQWTVMEGYAAAKMMKAGFRSNNIDPNARHCMASAVVGFMRTFGIDEPMGCYDDFEHADSFVLWGSNMAEMHPVLWTRITDRRLSHPHVKVNVLSTYYHRSFELADSGYIFKPQSDLAIANFIANYIIQNDAVNWDFVNKHTNFKQATTDIGYGLRDDDPLQKQAKNPNSGNMTSISFEEYKKSVAPYTVEKASEMSGVAQDKLIELAKQYADPNTKVMSLWTMGMNQHTRGVWMNSLVYNIHLLTGKIATPGNSPFSLTGQPSACGTAREVGTFAHRLPADMVVANPKHRAIAEKIWKLPEGTIPPKPGFHAVLQDRMLHDGVLNCYWVQCNNNMQAGPNINGERLPGYRNPENFIVVSDPYPTATAQAADLILPTAMWIEKEGAYGNAERRTQAWYQQVGTVGEAKSDLWQVMEFSKRFKMEEVWPEELLAKAPQYRGKTMYDMLFANGQVDKFPLSEARQLNDDSHHFGFYVQKGLFEEYAEFGRGHGHDLAPYDVYHTVRGLRWPVVDGKETLWRYKEGSDPYAKKGSGWDFYGKPDGKALIISAPYEAPPESPDAEYDMWLCTGRVLEHWHTGTMTRRVPELYKAVPDAVCYIHPEDAKARGLRRGDEVLISNKRGEVRVRVETRGRNRPPQGLVFVPFFDARILINKLILDATDPLSKQTDFKKCPVKITKVA

SEQ ID NO: 5579 - protein, 118 aa, Musa acuminata
IFQGLKMVSVERSFAEKHYADLSAKPFFAGLVEYIISGPVVAMVWAGKNVVVTGRKIIGATNPADSAPGTIRGDLAIEIGRNVIHGSDSIESASKEIALWFPEGVAEWQSNLHPWIYE

SEQ ID NO: 5580 - protein, 340 aa, Corynebacterium efficiens
MKLAVIGGDGIGPEVTDEALKVLRALRADIETTDLDLGARRYLRNGELLTDEDLALLREHDAILLGAIGAPGSVPPGVLERGLLLKLRFALDHHVNLRPSKLYEGVESPLKNPGEIDFVVVREGTEGAYTGNGGAIRVGTPHETANETSVNTRYGAERVIRYAFELAQSRRRHLTLVHKTNVLVHGGGLWQRTVDEVAREYPEVTVDYNHIDAATIYLVTDPSRFDVIVTDNLFGDILTDEAGAISGGIGLAASGNIDATGTNPSMFEPVHGSAPDIMGKGIADPTAAILSAAMMLRHLGDEANAVRIEEAVARDVAGRDPEAPISTTEVGDRIAAAVVA

SEQ ID NO: 5581 - protein, 202 aa, Mesorhizobium sp. BNC1
MAASNPRQAEISRKTNETDISVTVDLDGEGRSDISTGVGFFDHMLDQLSRHSLIDMKVSALGDLHIDDHHTVEDCGIAIGQAIAKALGDRRGITRYASLDLAMDEALTRAAVDVSGRPFLVWQVTFPSPKIGSFDTELVREFFQALAQNAGITLHVTNLYGANAHHIAETCFKAVARVLRAALSPDPRQLNAIPSTKGTLNG

SEQ ID NO: 5582 - protein, 403 aa, Arabidopsis thaliana
  misc_feature (67)..(67): Xaa can be any naturally occurring amino acid
MGFFGRLFGSKKKSDKAASSRDKRRWSFTTRSSNSSKRAPAVTSASVVEQNGLDADKHAIAVAAATXAVAEAALTAAHAAAEVVRLTSGNGGRNVGGGGNSSVFQIGRSNRRWAQENIAAMKIQSAFRGYLARRALRALKALVKLQALVRGHIVRKQTADMLRRMQTLVRLQSQARARASRSSHSSASFHSSTALLFPSSSSSPRSLHTRCVSNAEVSSLDHRGGSKRLDWQAEESENGDKILEVDTWKPHYHPKPLRSEKNNESPRKRQQSLLGPRSTENSPQVGSSGSRRRTPFTPTSRSEYSWGCNNYYYSGYHPNYMANTESYKAKVRSQSAPKQRVEVSNETSGYKRSVQGQYYYYTAVEEESLDVGSAGYYGGGGGDSDRLNRNQSAKSRMHSSFLV

SEQ ID NO: 5583 - protein, 376 aa, Oryza sativa (indica cultivar-group)
MAAVTRAARSRALLLLPRASAAAPHFSTTASSGAAAAAAAPVEAAAAGASDASAAAAAGAGEQPAPPPKRWGLLKFGAFAAVCGALGAAGYSSYAYTLEEVDQKTREFRKAMTTPRPVAEDASEFEKFQAMVYSTAMKAPVAAIEFYMDVRHTIEDHIRGFAEPTSDKLLPDLDPLNQHIFTLVLDLNETLVYSDWLRERGWRTFKRPGVDAFIEHMGKFYEVVVYSDQMPMYVDPVLERLDTKGFITGRLSRPATKYQDGKHYRDLSKLNRNPAQVIYISGHALESCLQPENCVQIKPWKLETDDTQLLDLIPFLEYVAMVRPSDIRTVLASYQGRDVAAEFIERSKEHQSFHKENFPSIWRMQEQKQHGRIWRR

SEQ ID NO: 5584 - protein, 330 aa, Anabaena variabilis ATCC 29413
MTVLQLPIIDISGLTCQRNNSSDVVAQQIKQACQDYGFFYIVGHGVDEQLQTQLEHLSQEFFAQDQETKLKISMALGGRAWRGYFPVGNELTSGRPDLKEGIYFGSELKDNHPLVKAGTPMHGRNLFPSNIPQFRETVLEYIDSMTKLGHILMAGIALSLDLDKSYFAERYTKDPLILFRIFNYPPNLGSQSEWGVGEHTDYGVLTILKQDNIGGLQVKSKSGWIDAPPIPGSFVCNIGDMLDRMTRGLYRSTPHRVRNLSTSNRLSFPFFFDPNFNVEVKPIDLKDVVVKDDQSDRWDKASVHEFRGTYGDYLLKKVSKVFPELRQKVL

SEQ ID NO: 5585 - protein, 121 aa, Synechococcus sp. RS9916
MPRPERIFPLVLVLVIGLIGALPATASLANPDSGNGSQIFSTNCAACHMGGGNVIRASRTLSEADLQAHLDSYSQDHLEAIEHQIEAGKNAMPPYQGKLSDDDIADVAAYVEEQAERGWQR

SEQ ID NO: 5586 - protein, 588 aa, Trifolium pratense
MEEEDDYEEYVPVAKRRAMEAQKILQRKGKASAAIDDESEKLKVVETKPSLLVKASQLKKDQPEISVTEQIVQQEKEMIENLPDNKTLKSVRELAKGITYTEPLPTGWKPPLHIRRMSKKGCELIQKQWHIIVDGEENPPPIKNFKDMRFPDPILKMLKTKGIVQPTPIQVQGLPVILSGRDMIGIAFTGSGKTLVFVLPMIMMAMQEEIMMPIVPGEGPFGLIICPSRELARQTYEVIEQFLLPLKEAGYPELRPLLCIGGIDMRSQLEIVKKGVHIVVATPGRLKDMLAKKKMNLDNCRYLTLDEADRLVDLGFEDDIREVFDHFKAQRQTLLFSATMPTKIQNFARSALVKPIIVNVGRAGAANLDVIQEVEYVKQEAKIVYLLECLQKTPPPVLIFCENKADVDDIHEYLLLKGVEAVAIHGGKDQEEREYAISSFKAGKKDVLVATDVASKGLDFPDIQHVINYDMPAEIENYVHRIGRTGRCGKTGIATTFINKNQSETTLLDLKHLLQEAKQRIPPVLAELNDPMEDNNDITDISGVKGCAYCGGLGHRIGDCPKLEHQKSMAIANNRKDYFGSGGYRGEI

SEQ ID NO: 5587 - protein, 261 aa, Streptococcus suis 89/1591
MGFLEEFPNLKVVSAAGNDIEDITILAKLKALESLNLDHNKVTDLSPLADLSQLTAVSLDNNRITDLSALQNKKKLTRLYISQNPQLDISTLKTENLEELTANESNVKDLQFVKNNPNLTSLTLKNNKITELQGIEENEKLVNLDVEGNQIKTLEIEGKQESVVRLNVADNQLKNLEGINDYKALEDLNASKNDIETLAITEPNKTLKTIDVSENHIPKEELNLNDQKIPSAIAEHFPAVEGGSIENNQPKEVDKEAKVGE

SEQ ID NO: 5588 - protein, 421 aa, Schizosaccharomyces pombe 972h-
MSSKSSLELANNAVKSNDIEKAIDLYKEVLNKGVSKDEKVANEQEQALTNLSDLYVRENRHNDLAQLVQQSRPLMANFSKAKSAKIVRTLIDKFSGEKKSLPLQIEVANDCIKWAIKEKRTFLRQALETKLISLYYDNSSYTDAINLINTLLSELKRMDDKMLLTEVHLLESKVYHAIRNIPKARASLTAAKTSANAVYCPPMLQGNLDLQSGILHADDMDFKTAYSYFYEAYEGFTSLDDDKKALSSLKYMLLSQIMLNSVSEVKSLLTGKHAIRYAGRDIEAMRAIAQAHENRSLADFEKALQDYKPELASDPIIRSHLSSLYDNLLEQNLLRVVEPFSRVEVSHIAELIGLSTVQVEGKLSQMILDKIFYGILDQGSGCLIVYDEPQQDKTYEAALEVIKNMGTVVDLLIENKASALL

SEQ ID NO: 5589 - protein, 293 aa, Fulvimarina pelagi HTCC2506
MFTGSMPATITPFTDDGAFDEAGFADFVEWQIAEGSSGLVPVGTTGETPTLSHDEHKEVVELCIRTAKGRVPVIAGAGSNNTAEAIELATFAEQAGADGVLVVTPYYNKPNQRGLYAHFSAVAKAISIPIVIYNIPGRSIIDMTPETMAQLANDFSNIVGVKDATAKMDRVSEQRHLCGPDFVQLSGEDVTALGFNAHGGVGCISVTANVAPRLCAEFQAACAAKDYVKALEYQDRLAPLHKALFIEPSPAGVKYALSKIGKCRNVMRSPMVPVSDETAEIVDAALRHAGLLN

SEQ ID NO: 5590 - protein, 457 aa, Prochlorococcus marinus str. MIT 9515
MNEKISFLKNKINLSSPNKNIVPITTNIDITEKLNIGGCSIEDLVKKYESPLYILDEITLRNSCRAYKKALEKYYRGVSLPIYASKANSSLFMSNLVASEGFGLDAVSEGELLTALKGGVPNEKIVFHGNNKSDKEIAFAIKNKIKVIVDNEHDLKRLEEISNSLNFDLEIMIRFTPGIECHTHEYIRTGSFDSKFGFGIESLTKLFGVIIKTKHLKLIGLHAHIGSQIFELEPHKDLGEIMVNVMLQAKKFGHNIKELNVGGGLGIKYTQEDDPPSIDEWIKTVSSSIEQACKKNKLDLPLLMCEPGRSIVSTAGVTIYKIGSFKEIPGIRTYLSVDGGMSDNPRPITYQSNYSACLVNDPLNINSKNKYTVAGKHCESGDVLFKEIELGKCKTGDLICVFGTGAYNNSMSSNYNRIPKPAAVLVCNGEAEIIQKRESPHDLLKNDVLPDRFINQS

SEQ ID NO: 5591 - protein, 510 aa, Trifolium pratense
MSLWIIVFVTIVAAILINRLLNLIKKPTLPLPPGPSPWPIVGNLPHMGPVPHHALAALALKHGPLMHLQLGFVDVIVAASASVAEQFLKVHDANFSSRPPNSGAKYIAYNYQDLVFAPYGPRWRLLRKISYVHMFSSKALDDFRHIRQDEVARLIRNLSNSGSKAANLGQMLNVCTTNALARVMIGRRVFNEGNGGCECDPRADEFKSMVVELMVLAGVFNIGDFVPSLEWLDIQGVQSKMKKLHKRFDSFLTSIIEDHMVSKSEKHNDLLSTLLSLKEKVDEDGDKLNDTEIKALLLNMFTAGTDTSSSTTEWAIAELIKNPKLMIRIQNELDTVVGRDRLVTEQDLTHLPYLEAVIKETFRLHPSTPLSLPRVATNSCEIFNYHIPKGATLLVNVWAISRDPKEWTNPLEFKPERFLPGGEKFDVDIRGNDFEVIPFGAGRRICAGMSLGLRMVQLLTATLAHAYDWELENGLSPEKLNMDEAYGLTLQRAVPILAHPRPRLSPHLYL

SEQ ID NO: 5592 - protein, 164 aa, Cleisostoma racemiferum
IENKINRQVTFAKRRNGLLKKAYELSVLCDAEVALIIFSNRGKLYEFCSSTSMLKTLEKYQKCNFGSPESTIISRETQSSQQEYLKLKSRVEALQRSQRNLLGEDLGPLGSKELEQLERQLDSSLKQIRSTRTQFMLDQLADLQRREHMLCEANKALKRRFEES

SEQ ID NO: 5593 - protein, 662 aa, Escherichia coli
SSRKELANAIRALSMDAVQKAKSGHPGAPMGMADIAEVLWRDFLKHNPQNPSWADRDRFVLSNGHGSMLIYSLLHLTGYDLPMEELKNFRQLHSKTPGHPEVGKTAGVETTTGPLGQGIANAVGMAIAEKTLAAQFNRPGHDIVDHYTYAFMGDGCMMEGISHEVCSLAGTLKLGKLIAFYDDNGISIDGHVEGWFTDDTAMRFEAYGWHVIRDIDGHDAASIKRAVEEARAVTDKPSLLMCKTIIGFGSPNKAGTHDSHGAPLGDAEIALTREQLGWKYAPFEIPSEIYAQWDAKEAGQAKESAWNEKFAAYAKAYPQEAAEFTRRMKGEMPSDFDAKAKEFIAKLQANPAKIASRKASQNAIEAFGPLLPEFLGGSADLAPSNLTLWSGSKAINEDAAGNYIHYGVREFGMTAIANGISLHGGFLPYTSTFLMFVEYARNAVRMAALMKQRQVMVYTHDSIGLGEDGPTHQPVEQVASLRVTPNMSTWRPCDQVESAVAWKYGVERQDGPTALILSRQNLAQQERTEEQLANIARGGYVLKDCAGQPELIFIATGSEVELAVAAYEKLTAEGVKARVVSMPSTDAFDKQDAAYRESVLPKAVTARVAVEAGIADYWYKYVGLNGAIVGMTTFGESAPAELLFEEFGFTVDNVVAKAKELL

SEQ ID NO: 5594 - protein, 330 aa, Methanococcus maripaludis S2
MHKICVIEGDGIGKEVVPAAVEVLKATGVEFEFNHALAGDEVFEKTGVALPEETIAAAKAADAILFGAAGETAADVIVKLRKILDTYANIRPVKSYNGINCLKTGIDYIIVRENTEGLYKGIEAEIADGVTVATRVITKDASERIFKHAFEMAKDRKKQGTAGKVTCAHKANVLKITDGLFKKTFYEVSNDYKDIQTEDFYVDAMNMFIISRPETFDIVVTSNLFGDILSDGAVGMVGGLGMAPSGNVGDKYGLFEPIHGSAPDIAGKGLANPTATILTAVMMLRYLKENEAAEKVEKALEEVLSLGLTTPDLGGTLSTSEMGQEVAKRV

SEQ ID NO: 5595 - protein, 522 aa, Xylella fastidiosa Temecula1
MTPNIHHDKILILDFGAQYTQLIARRIREIGVYCEVWPWDHSPEEILSFGAKGIILSGGPESTTSPGAPAAPQHVFDSDLPIFGICYGMQTMAVHLGGATEAADKREFGHASVQVIYPDTLFSGLSDHPSEFRLDVWMSHGDHVSRVPPCFTITAATDRIPIAAMSREDKRWYGVQFHPEVTHTLQGQALLRRFVVDICGCQTLWTSANIIEDQIARVRERVGCDEVILGLSGGVDSSVVAALLHKAIGSQLTCVFVDTGMLRWGEGDQVMAMFAEHMGVNVVRINAASRYFDALQGVYDPEAKRKIIGNLFIQIFEEEASKRKQAKWLAQGTIYPDVIESAGSKTGKAHVIKSHHNVGGLPEQMTLGMVEPLRELFKDEVRRLGVALGLPHAMVYRHPFPGPGLGVRILGEVKPEYAELLAKADSIFIDELHQADLYDKVSQAFAVFLPVKSVGVVGDARAYEWVIALRAVETVDFMTAHWAPLPYDFLSTVSNRIINELRGVSRVVYDISGKPPATIEWE

SEQ ID NO: 5596 - protein, 399 aa, Zea mays
MATTNAGNDHCWPEPIVPVQTLSNSGVSTVPQRYIKPPSERPNGTGSMNCCDDDDVVASIPIVDLARGFSSSAGGGIPDDDEHRDRRAAAALEAVGDACKNWGFFQVVNHGVGVDSVERMRGAWREFFDLPMEEKKPYANSPATYEGYGSRLGVEKGAALDWGDYYYLNLLPDDTKNLDKWPEMPRQLREVTEKYACDLMELSQVLLKAMSSTLGLDEDYLHMALGGTTKKGISASMRVNYYPKCPEPELTLGLSSHSDPGGITLLLLDEDVKGTQVRRGDDTWVTVHPIPGAFLVNVGDQIQILSNGAYKSVEHRALASSGHDRLTIAFFCNPCGDLPIVPAPQLVGPESPAVYGQPPITFNEYRKYVRTKGARGRAQVESLSISTTSTSTTNNNNTS

SEQ ID NO: 5597 - protein, 491 aa, Arabidopsis thaliana
MELEFESKYEINRTAEFIISKSFTRIALQFPDELLKDSTKVVSALKSKTRLLTDREVRFFVMADTTYGSCCIDEVGALHIDSECVVHYGQTCLSPTSVLPAFFVFGKASINVSSCVKHLIDYASKSDKPIMILYGLEYAHVIPQIREELGLSKTDSQLSVANVLCSFISPSKDPRESMEHPRPYSESDSSDSLSSSRSYRLGGLTWDLPEGSKIEDYLLFWIGSDSSAFANVVLTFNGCDIVRYDAEEDSLVTEFYQQRRILKRRYYLVEKAKDANIIGILVGTLGVAGYLHMIHHMQALISAAGKKSYILAMGRPNPAKLANFPECDVFIYISCAQTALLDSKEFMSPVITPFEANLAFSRGSEWTGAYLMHFQDVINSVKSESEAHIGSEEPRFSFFQGGYVEDHKTNDQAKNGEEDTGETMTLVQAAEKALQLRGNDHNSLTKQTAAKSGPEYFLNRVYRGLEINSENTLPEPYIVGRSGKASGYKHE

SEQ ID NO: 5598 - protein, 350 aa, Mesorhizobium sp. ICMP 15054
DPKGKLQHVTMDVIEVEEDMFADGVMFDGSSIAGWKAINESDMVLMPDADTVHMDPFFAQSTMVILCDILDPVSGESYNRDPRGTAKKAEAYMKSEGIGDQIFVGPEAEFFVFDDVKYKADPYNTGFKLDSTELPSNDDTDYETGNLGHRPRIKGGYFPVPPIDSAQDMRSEMLTVLAEMGVRVEKHHHEVAAAQHELGIKFDTLVRNADKMLIYKYVVHQVANAYGKTATFMPKPIFGDNGSGMHVHQSIWKNGKPTFAGNEYAGLSESCLFYIGGIIKHAKAINAFTNPLTNSYKRLVPGYEAPVLLAYSARNRSASCRIPFGSSPKSKRVEVRFPDPGANPYLAFAA

SEQ ID NO: 5599 - protein, 393 aa, Prochlorococcus marinus str. MIT 9211
MQTYKRLPISLVKGQGAWVWDDKGKKYIDAVAGIATCTLGHSDRKLRKALINQLRKIQHVSNLYQIPEQEELAKWLIKKSCADSAFFCNSGAEANEAAIKLARKYGHKERQIDRPVILCANGSFHGRTLAALSATGQEKYHEGFKPLVEGFAFFKFNDSASFQELHDQIEANGPRIAAVLIEPIQGEGGIRPGNKKFFKLLRDICTKNKILLIFDEVQSGMGRTGRLWGYQNLEVEPDALTIAKGLGGGHAIGALLVKNNANIFEPGDHASTFGGNPFACRAGLTIAKAIEERNLLEETLSRGKQLREGLQSIVKDHLDHLEEVRGIGLIQGLVIKNQSDLTSQIIVEEAINQGLLIISAGQKVVRMVPPLVITKRQVDFIIDRLSKTLVNII

SEQ ID NO: 5600 - protein, 325 aa, Pseudomonas putida
MSNQLSTEQLLHAYEVMRTIRAFEERLHVEFATGEIPGFVHLYAGEEASAAGVMAHLRDSDCIASTHRGHGHCIAKGVDVYGMMAEIYGKKTGVCGGKGGSMHIADLEKGMLGANGIVGAGAPLVAGAALAAKIKGKDDVSVAFFGDGASNEGAVFEAMNMASIMNLPCIFVAENNGYAEATASNWSVACDHIADRAAGFGMPGVTIDGFDFFAVYEAAGAAIERARSGQGPSLIEVKLSRYYGHFEGDAQTYRAPDEVKNLRESRDCLMQFRNKTTRAGLLTAEQLDAIDARIEDLIEDAVRRAKSDPKPQPADLLTDVYVAYP

SEQ ID NO: 5601 - protein, 390 aa, Synechococcus sp. CC9605
MASLLDQLSQMTVVVADTGDLEAIRKFTPRDATTNPSLILAAAQIPAYQNLIDEALRSSRKLMGSDAAVEDVVREALDEISVIFGKEILKIVPRRVSTEVDARLSFDTDATIEKGRKLIRLYNDAGISNDRVLIKIASTWEGIKAAEVLEQEGIHCNLTLLFGFGQAIACAEAGVTLISPFVGRILDWYKAETGRDSYPGPEDPGVISVTKIFNYYKTHGYDTEVMGASFRNIDEITELAGCDLLTISPKLLDQLRETDAVLTQKLDATHPTDGEAKIHVDRATFDALMQDDRMASDKLTEGIKGFSKAIETLEHQLAHRLAELEGGSAFRHAVSEIFMLNDMNGDGSITRDEWLGSDAIFDALDQDHDGLISQEDVRQGFGAALTLTSV

SEQ ID NO: 5602 - protein, 340 aa, Pseudomonas putida
MARKISYQQAINEALAQEMRRDNTVFHHWRRRGRRCRRPGEDDAWGGVLGVTKGLYHQFPGRVLDAPLSEIGYVGAAVGAATQGLRPVCELMFVDFAGCCLDQILNQAAKFRYMFGGKAVTPLVMRTMYGAGLRAAAQHSQMLTSLWTHIPGLKVVCPSSPYDAKGLLIQAIRDNDPVIFCEHKLLYSMQGEVPEEVYTVPFGEANFLRDGDDVTLVTYGRMVHVALEAANNLARQRSTAKCWTCAPPARWTKTAFSKAWKKPAALVVIDEANPRCSMATDISALVAQKAFGALKGPIEMVTAPHTPVPFSDALEDLYIPDAAKIEAAVRKVIEAARSAA

SEQ ID NO: 5603 - protein, 362 aa, Pseudomonas putida
MNDLSHTHMRAAVWHGRNDIRVEQVPLPADPAPGWVQIKVDWCGICGSDLHEYVAGPVFIPVEAPHPLTGIQGQCILGHEFCGQIAKLGEGVEGFAVGDPVAADACQHCGTCYYCTHGLYNICERLAFTGLMNNGAFAELVNVPANLLYRLPQGFPPEAGALIEPLAVGMHAVKKAGSLLGQTVVVVGAGTIGLCTIMCAKAAGAAQVIALEMSSARKAKAKEVGATVVLDPSQCDALAQIRALTFGLGADVSFECIGNKHTAKLAIDTIRKAGKCVLVGIFEEPSEFNFFELVSTEKQVLGALAYNGEFADVIAFIADGRLDIRPLVTGRIGLEQIVELGFEELVNNKEENVKIIVSPGVR

SEQ ID NO: 5604 - protein, 221 aa, Prochlorococcus marinus str. MIT 9211
MISVFAGFLAGAVHVVGGVDHIVAMAPNAFKSPKLALRDGLAWGLGHSTGILFLLGLAILLKDLVHIQRMSSFAEFSVGVVLLVGGTVAIKTSFGLKIHTHLHNHGEGHNHQHFHLHFRGAKKHAQHSHASTSLGVLHGLAGASHLFAVIPALALPPIGAVAYMAAYLLGSIVAMGAMLLAMSLATLKAGRKALPGLIGFTGGLSIITGFFWVHKTSSYIL

SEQ ID NO: 5605 - protein, 319 aa, Frankia sp. EAN1pec
MTGYVAVVGENVADAVVQPTETPNGAMRWQVFPGGSPANTAVALGRLGTPTRFLSRLPCGVLGGLFKRRLDDSSVDLSLSTWSDEPATLAITSVENSAAHYEFYATGTVDWQWRPDELNPARLRGASCIHAGSLGLVMEPGGRIVEELLDSIREHATVSIDPNVRTTLVSSEHYQSRLKEWYRLADIFRISEDDLTHLAPGFTPERIIGELNETGVQLAIVTRGEAGVLASFRGTLIDVPAVPTEIVDTIGAGDAFSAGLLHWLHQNGHLGGRLERLDQQGARSALIFASHVAALTCAAPGADPPWNRHLTPAVRNLLR

SEQ ID NO: 5606 - protein, 243 aa, Oryza sativa
MRKKGRGERGIELGGGQEGIADAQQGEGDGPRRGRLAVAMDTTTSTHNVGCLDREKKERGEVAFFIYLFLDWFIRHHAVGQNHSGLGQGDAVVGVADGVGGGGAEVDAGGEGEEEGTLEDEGVTVGGVDEEAENEQMHLMTFMEVAKLRCIDVTIFFVATNDFSSSDSYTEYLKDIEAGKIENVPTPPIAIDYWRLPADATLKDVVVVVCADEAHHRDVNHFASDVHFQGMDLKDTPALLDYH

SEQ ID NO: 5607 - protein, 440 aa, Trifolium pratense
MEEENNEMKSFKDLGLPEELVEACDNLGWKTPLKIQIEAIPLALQGKDVIGLAQTGSGKTGAFALPILHALLQAPRPNHFFACVLSPTRELAIQISEQFEALGSGIGVKSAVLVGGIDMVQQSIKIAKHPHIIVGTPGRVLDHLKNTKGFSLSKLKYLVLDEADRLLNEDFEESLNEILGMIPRERRTFLFSATMTKKVEKLQRVCLRNPVKIEASTKYSTVDTLKQQYRFLPAKRKDCYLVYILTEMAGSTSMVFTRTCDATRLLALILRNLGLKAIPINGHMSQPKRLGALNKFKSGDCNILLCTDVASRGLDIPAVDMVINYDIPTNSKDYIHRVGRTARAGRSGVAISLVNQYELEWYIQIEKLIGKKLPEYPAQEEEVLLLEERVSEAKRLAATKMKESGGKKKRRGEGDSGDDEDIDKYFGLKDRKSSKKFRRK

SEQ ID NO: 5608 - protein, 466 aa, Magnaporthe grisea 70-15
MASKASRWAVSQEDVAKAKQEREAKRRAKAAKAAARKAQEDTVAQSQLQSQPPAAENGPPAKRRRVTPAPDAAQNDDDDDGGRGTTNEHRLLRLPGPPFGKCRSVENYDKLNDIEEGAYGWVARAKELATGKIVALKRLKIDPKDRSGLPVTGLREIQILKDCSHRNVVEMHEVVVGDDTSKFENIFLVLEFLEHDLKSVLEDMPEPFLSSEVKTVLLQLAAGVDYLHENFILHRDLKTSNLLLNNRGQLKIADFGMARYVGDPPPKLTQLVVTLWYRAPELLLGTIKYGQAVDMWSVGCIFGELLTREPLLQGKNEVDELTKIFELCGVPTEESWPGFRRLPNARSLRLPKNPQAAGSVIRARFPLLTAAGSGLLSGLLSLDPERRITAKEMLAHDYFKQDPRPKHESMFPTFPSKAGQERRRRRDTPNAPIRGLAADLGDVDFTGIFARREREEKGAGFQLRMI

SEQ ID NO: 5609 - protein, 258 aa, Oryza sativa (japonica cultivar-group)
MALANKIGNLLKRATSSSPALYQSIRCMSSSKLFVGGLSYGTDEQSLRDTFANYGQVIEAKIINDRETGRSRGFGFITYASSEEASAAITALDGKDLDGRNIRVNTANERTGGFRSGGGGYGGGGYGGGGGGYGGGGYSGGGGYGGGGYSGGGGGGGGYQGGGGGYGGNNGGYGNRGGGGGGYGVAEGSADAFSGINLGGDGSFGGNPAGSFGDAGGSTGGGDFSGAGGDSFGSRKNDELMDDLFKDDEPDNYANKQG

SEQ ID NO: 5610 - protein, 190 aa, Methanococcus maripaludis S2
MRAFKVKRDTNETKIQLELNIDGTGKYSITTGIPFFDHVLSSFAKHGSFDLKLDVLGDLEIDDHHTVEDVGIVLGKAFENMEKKNIKRFGWAIIPMDEAKATVSIDIGGRPFVVGNYVPNTERIGSFSTENVVHFFESFSNNAKINLHFEVTGENEHHKVEALFKAFGVAMDMATQIDERKGIVSTKGVI

SEQ ID NO: 5611 - protein, 469 aa, Vibrio sp. Ex25
MSVENVLSLIQENEVKFVDLRFTDTKGKEQHISIPAHQIDADFFEEGKMFDGSSVAGWKGINESDMVMMPDASSAVLDPFTEDATLNIRCDILEPATMQGYDRDPRSIAKRAEDFMRSTGVADTVLIGPEPEFFLFDDVKFATDMSGSFFKIDDVEAAWNTGSDYEEGNKGHRPGVKGGYFPVAPVDSSQDIRSAMCLVMEEMGLVVEAHHHEVATAGQNEIATRFNTLTTKADEIQIYKYVVHNVAHAFGKTATFMPKPLVGDNGSGMHVHQSLAKDGVNLFAGDKYGGLSEMALYYIGGIIKHARAINAFANPSTNSYKRLVPGFEAPVMLAYSARNRSASIRIPVVPSPKARRIEVRFGDPAANPYLCFASMLMAGLDGIKNKIHPGEAMDKDLYDLPAEEAAEIPTVAYSLKDALAELDADREFLTAGGVFSDDFIDSYIELKSQDVERVNMTTHPVEFELYYSV

SEQ ID NO: 5612 - protein, 471 aa, Mesorhizobium sp. BNC1
MIAKELLVSAREDMPPAEPVAPRSSRIVIVGAGFAGLEAAKELGRAGIPVVLLDRQNHHLFQPLLYQVATAALSAADIAEPIRKILRPYESVQVLLGEVTSIDMAARVLHLADGSCLNFDYLILATGASHSYFGHPDWARFAPGLKTIADARRIRAKALLAFERAERTLDPDEQARQMTIAIVGGGPTGVELAGSLAELSRLTLARDFRSARPEAARIMLIEAGPRILPAFSEKISAYAHERLERLGVEVHTSTPVEDIQKDSITFGGSTVPVGLVLWAAGVAASPLAAQLGAETDRAGRVIVDGAMRVRGLRNVFAMGDAALFAGQDGKPLPGLAQVAKQQGRHLGRMLARHLRDGKPLDEFVYHGRGNTAIVGRHAAVFEQGRFKLTGWLAWLSWAIIHVYLLVGFQHRLTVSVQWLWRYLTFERGARLITDESLVSDRSPMLEEAETVAAEAKARTAASVSLPKERAP

SEQ ID NO: 5613 - protein, 703 aa, Oryza sativa
  misc_feature (163)..(163): Xaa can be any naturally occurring amino acid
  misc_feature (497)..(497): Xaa can be any naturally occurring amino acid
MASTTTKNALLLLLLLLLLFPLLHSSLADVAAAAPSSASAAEVDALMELKAALDPSGRLLPSWARGGDPCGRGDYFEGVSCDARGRVAAVSLQGKGLAGAISPAVAMLPGLTGLYLHYNELAGAIPRQLGDLPMLAELYLGVNNLSGTIPVELGRLPALQVLXLGYNQLSGSIPTQLGQLKKLTVLALQSNQLTGAIPASLGDLPELARLDLSSNRLFGSIPSKLAAIPKLATLDLRNNTLSGSVPSGLKKLNEGFHFDNNSELCGAHFDSLKPCANGDEDDNEEGSKMARKPESTNVKPLQAPQTMNVNRDCDNGGCSRSSSSSTTLSSGAILAGTIIIIGGAAACGISVISWRRRQKQKVGGGGTVESLEGRASSSNASSSLINVEYSSGWDTSSEGSQQGLRLSPEWSPSVRYNMEEVECATQYFAGANLLGRSGFAATYRGAMRDGAAVAVKSIGKSSCKAEEADFLRGLRAITSLRHDNLVALRGFCRSRAXRGECFLVYEFMANGSLSRYLDVKDGDVVLDWATRVSIIKGIAKGIEYLHSSKANKAALVHQNICADKILMDHLFVPHLSGAGEHKLLADDVVFSTLKDSAAMGYLAPEYTTTGRFTDRSDVYAFGVVVFQVLTGRKAVSSELRLLGGGGGAEYSGKLDDLVDPRLGGRFSRPEAAKLAGIALLCTSESPAQRPAMAAVLQQLGATQ

SEQ ID NO: 5614 - protein, 179 aa, Chrysanthemum x morifolium
MASISSSAVATVNRTTSAQASMVAPFTGLKSNVAFPVTKKSNDFSSLPSNGGRVQCMKVWPPLGLKKYETLSYLPPLTETQLAKEVEYLLRNKWVPCLEFELEHGFPYRENNRSPGYYDGRYWTMWKLPMFGCNDASQVLKELNECKKEYPQSWVRIIGFDNVRQVQCISFIAHKPDGY

SEQ ID NO: 5615 - protein, 675 aa, Arabidopsis thaliana
MASISLLQVSVAILCFLILHYFLFKKPHGRYPRNWPVLRMLPAMLKALHRIYDYSVKILETSDLTFPFKGPRFTGMDMLLTVDPANIHHIMSSNFSNYIKGPEFQDVFDVLGDSFITTDSELWKNMRKSYQAMLHSQEFQRFSMSTMTSKLKYGLVPLLNHFAEEGTTLDLQSVFGRFTFDTIFILVTGSDPRSLSIEMPEDEFAKALDDVGEGILYRHFKPRFLWKLQNWIGFGQEKKLTEANATFDRVCAKYISAKREEIKRSQGTSNGGSQDLLTSFIKLDTTKYKLLNPSDDKFLRDNILAFILAGRDTTATALSWFFWLLSENPHVVAKIHQEININTDLSRTGNSQENVDKLVYLHGALCEAMRLYPPVSFGRKSPIKSDVLPSGHKVDANSKIIICLYALGRMRAVWGEDASQFKPERWISENGGIKHEPSFKFLSFNAGPRTCLGKHLAMTQMKIVAVEILRNYDIKVPGDVVLDLSNMNNQTIKLGSGLLQDNDAISAMRAGKLSYSKPNKYWLESSHKRYIPRPDDHVLGIVVDSRADNFWVDIKGPQLALLPVLAFEGGTRRNIPKFEACRHSALSPGCQDKHRNESGAVLYRGLLNSPTRPVIEALGKKLSFEIAVGLNGRVWVNATAPRIVIIVANAIMNSESLSGTQQRIMVEKLLAIISD

SEQ ID NO: 5616 - protein, 323 aa, Arabidopsis thaliana
MAALSEKEAEAYLDARPRYPIDWYKKIAARTQDHKFAWDVGTGNGQAAIGLVEHYENVVATDINEAQLKRAIKHSRISYHHTPTTISEDEMVDLLGGENSVDLIVAAQAVHFFDLNVFYNVAKRVLRKEGGLIAVWVYNDIIISPEIDPIMKRLVDSTLPFRTPIMNLAFDGYKTLTFPFETIGMGSEGNPITLDIPHKLSLNGFIGFLRSWQPAMKAKEKGVELINEDLITKFEEAWGDETQVKDVFYKAHMIVGKIPEEKFESDQVLSNKGRLLLETEVGRNQKRPQPSDEGDRQSKKQNTSEDDACKDKPSSVFSTHYRF

SEQ ID NO: 5617 - protein, 329 aa, Triticum aestivum
RRYKQVPEWWFICILTVNIAVTVFACEYYIEQLQLPWWGVLLACAIAFFFTLPIGIITATTNQTPGLNIITEYIMGYLYPGRPVANMCFKVYGYISMSQALTFLQDFKLGHYMKIPPRTMFMAQVVGTLIAAFVYLGTAWWLMDSIPNICDTELLPAGSPWTCPGDHVFYDASVIWGLISPRRIFGDLGTYSAVNWFFLGGAIAPLLVWFAHKAFPGQNWILLINMPVLIGSTGQMPPATAVNYITWIFVGFLSGYVVYRYRRDWWERHNYLLSGALDAGLAFMAVLIYLCLGLENISLNWWGNDLDGCPLASCPTAKGIFVEGCPVYT

SEQ ID NO: 5618 - protein, 290 aa, Oryza sativa (japonica cultivar-group)
MNFKGAKMPSPPPAAAAGRLVKVGLLGGAAIYAAFNSLYNVEGGHRAIVFNRLEGIKDKVYPEGTHFMIPWFERPIIYDVRARPNLVESTSGSRDLQMVRIGLRVLTRPLPEKLPTIYRSLGENFNERVLPSIIHETLKAVVAQYNASQLITQREAVSREIRKILTERASNFNIALDDVSITSLSFGKEFTHAIEAKQVAAQEAERAKFIVEKAEQDKRSAIIRAQGEAKSAQLIGEAINNNPAFLALRQIEAAREISHTMASSNNKVYLDSKDLLLGLQQLNVDNKNKK

SEQ ID NO: 5619 - protein, 529 aa, Prochlorococcus marinus str. MIT 9211
MEIFFVNWPKSDADHLIASTAQMRSFENNLINRGMPVEALMEKVGQKLKDWFLERPELLLNGVLILVGPGHNGGDGLVLARELFLENIDVSIWCPLPITQSLTRRHQAYSHWLGIKELHEEPNVYCKTLWIDALFGLGQTRPLPEKIANLLKGREEKQPRRLISIDVPSGICSDTGKTFSNVAATASYTLTIGLNKQGLIQDIAIPYVGELIRLDIGIPQKVLKKDKQINFFKLAGDDLFSIPWPEPSSISSKYQRGRLLVVAGSDKYKGAALLALQGALASGVGSIKALLPQKMADNIWQVSPEIVVSGILGNSIDGESEIGEAILKHKLDRLDSLLIGPGLALANEKWSDIACQLEKFPGLLVLDADALNRLAFSTESWEWINKREGPTWLTPHLQEFYRLFPNLKDLSPLDAAPKAAKMTGANVLLKGAHSLIASPSGVRWQLVSTSSCAARAGLGDVLAGFVAGVGAIGFSIGGAMNDELLALAALLHAEAAKSCKKGSKASSIALALEKLVRHIQCPECVQRNI

SEQ ID NO: 5620 - protein, 360 aa, Prochlorococcus marinus str. MIT 9211
MNQSTIADHEMSNLPKKEDHAERLSSLSGGESAVIDRDTGLRLFKDMTLGRRFEDKCAEMYYRGKMFGFVHLYNGQEAVSSGVIGAMKLKHDWFCSTYRDHVHALSAGVPAREVMSELFGKETGCSKGRGGSMHLFSKEHHLLGGYAFIGEGIPVALGAAFSSRYKKEVFKDKNSDAVTAAFFGDGTCNNGQFFECLNMAQLWKLPIIFVVENNKWAIGMAHDRATSDPEIWRKAGAFGMEGEEVDGMDVLAVRGAAERALERARAGEGPSLIECLTYRFRGHSLADPDELRSEQEKEFWAQRDPLKNLAKVLVSKELANENELKNIEKEIDSEVTDAVEFALAAKDPDPSELTKYIWAE

SEQ ID NO: 5621 - protein, 425 aa, Thiomicrospira crunogena XCL-2
MDYQDAEKMQHQRSFWYFLGPAFLVSVGYMDPGNWATSIEAGSRYGYDLLWVITLASLVAILMQLLSAKLGIATGKNLAQMIRVQHPGKGGTFLLSSAALAMVATDLAEFLGVAVALNLLFDIPLVAAIFLTIFDVLLILWLERFGFRWVEVTIFAFVATIGLGYVVELWLVQPDWVEVAQALAVPNDTIMDTTALFIAMGILGATVMPHNLYLHSHQVTTRSNLAGDALQRFYKMMKWDTILALTAAWVVNSAILIMASAAFHEKGLLITDIDEAYHTLGPLLGSSAALTFAIALLASGIASSATGTLAGQIVFESFFKKRPINILKIRVYIRLATMIPAAIAILLSAKPLSLLVLSQVILSMQLPFAVIPLVMMTSNTTLMGDLVNQPKTKLMAWTATVIIVALNLWLLGMLFWEGFHKMNLH

SEQ ID NO: 5622 - protein, 324 aa, Neisseria meningitidis Z2491
MDTLTRFLPEHLQQNQLPEALGGVLLSVVSACTEINAKVRLGALAGVLGMAGTGNIQGEDQKKLDVIANNIMIDTLKANPAVAGLASEEEDSFVSAGENGRYLVLFDPLDGSSNIDVNISVGTIFSILEKPEGALATESFLQTGRQQLAAGYVLYGPQTQLVFTFGHGVYMFTLNAENEFVLTKEKPKVPESTKEFAINMSNRRHWLPPVQQYIDELLAGETGTRGKNYNMRWVASMVAEIHRILMRGGVFMYPQDKRDPSKPGKLRLMYEANPMALILEQAGASASNARQDILGIRPESLHQRVAVIMGSSEEVDYLNRLHSK

SEQ ID NO: 5623 - protein, 267 aa, Anabaena variabilis ATCC 29413
MKQIKFKNNAGKITAFLFLISILLTPFVVVNAGERGVLMQFGKVQETVIDEGIHIIIPIVHTVKKISVRIQKQEISTEASSKDLQNVFIDVALNWHILPEETNIMFQEIGEEKDIIEKIINPAIEEIIKAVIAGYKAEEIVTRRGELKSSFDQTLTSRLRDYHIAVDDISLVNVRFSDKFIEAVEAKQIAEQDARRADFIAMKAVKQAEAKVNLAKGEAEINRLLSDSLTNDILVRQAVEKWDGKLPIIINNDAPQVLNLREILKLK

SEQ ID NO: 5624 - protein, 246 aa, Mycobacterium sp. MCS
MSSTMSRVVAITGASSGIGEATARELARRGAAVVLGARRADHLDRVAAEIREAGGAAVVCTADVTRLDDVRRLADRAVDEFGRLDVMVNNAGIGRIGPISDLDVDGWSAMIDVNLRGVLHGIAAALPIFRRQGHGHFVTTVSTAGLKIVPDQGVYAATKNAVRTVLEALRQESTDGVVRTTAISPGFVNTKMDGSIDDPVLRERIRRSMDDVGLEPEAVAQAIAFAIEAPAHVEIGELTIRPAVQN

SEQ ID NO: 5625 - protein, 175 aa, Oryza sativa
  misc_feature (164)..(164): Xaa can be any naturally occurring amino acid
  misc_feature (169)..(169): Xaa can be any naturally occurring amino acid
MAPTVMASSATSVAPFQGLKSTAGLPVSRRSNSAGLGSVSNGGRISCMQVWPIEGIKKFETLSYLPPLTVEDLLKQIEYLLRSKWVPCLEFSKVGFVYRENHRSPGYYDGRYWTMWKLPMFGCTDATQVLKELEEAKKAYPDAFVRIIGFDNVRQVQLISFIAXKPPGXEESGAN

SEQ ID NO: 5626 - protein, 172 aa, Prochlorococcus marinus str. MIT 9515
MKFLKLIPIIFIFLGIFPSSNLIYAEGQDPNSYKVLSNNNKKLSIKNVQAYITEGDTFIEKGNFDEAKSSYDKARNLAKQLAGFYRDLNGAFRGLDSRIPDETGEKGRESIRIWAESNARLVALYKRRNQPEVAVPLLVEIIRLMSPKSSTGKEAYKDLIQLGFVETPYRGS

SEQ ID NO: 5627 - protein, 355 aa, Synechococcus sp. RS9916
MAENTYLAGDLGGTKTLLSVYGAENGQLQPLFSQRYLSGEWQCLEDMLQQFLKDVPTEHPQPVTSCIAVAGPVSDGSAKLTNLPWMLSETALVAATGLARLELVNDFAVLIHGLPHFDQEQQVTLQAAKTNNPGPEGSRGPVAILGAGTGLGMARGISDANGWIALASEGGHREFAPRTDDEWHLASWLKADLDLDRLSIERIVSGTGLGHVMRWRLQRSDGAGHPLLRAAEAWRTRAVDDDDYQDLPALVGQAAQRGDALARSALDLWLGAYGSTAGDLALQELCTGGLWIGGGTAAKQLKGLQSASFLEPMRRKGRFRPLIESITVQAVIDPNAGLFSAACRARDLAAGMTAT

SEQ ID NO: 5628 - protein, 387 aa, Schizosaccharomyces pombe 972h-
MNHGTKIPVDPFRIIKETARDGSTGEVKQLSYTSSKVVGSGSFGVVMQVHLIESDSKAAIKRVLQDKRFKNRELQIMRIMKHPNIVDLIAYYYTTGDNSDEVYLNLVLEFMPETIYRASRLYTRQKLSMPMLEVKLYIYQLLRSLAYIHASGICHRDIKPQNLLLDPENGILKLCDFGSAKILVAGEPNVSYICSRYYRAPELIFGATDYTHAIDIWSTGCVMAELMLGHPLFPGESGIDQLVEIIKILGTPSREQIKTMNPNYMEHRFPQIRPQPLSRVFSRSVPLDALDLLSKMLQYTPTDRLTAAEAMCHPFFDELRDPNTKLHNSRNPDASPRHLPELFNFSPFELSIRPDLNQKLIPSHARDALPVKLDDFVPIPIHRARID

SEQ ID NO: 5629 - protein, 345 aa, delta proteobacterium MLMS-1
MNNPKTDLKNLTLPELTAWVETLNLKPFRARQIFSWLYRPDFSDFAQMTDIAKHVRALLAEKATFSRLEAAKEEHSTDGTVKFAFRLSDGHLIESVLIPEEDRHTLCVSSQVGCAMGCNFCLTGTMGFIRNLTVAEMVGQVDQAAHWLWQRGAGSGRLNNLVFMGMGEPLLNFDNLIKAINILMEQRGHDLSGRRITVSTCGIVPRMKELGEKVPVNLAVSLHAADHATREQLMPVNRTYPLAELLQACRQYPLPPRRRIMIEYALLAGINDSPAAARLLVKQLHGIRCKINILPFNETPAFPYRCPDPATIEAFRQILRRAGHTTLLRTSRGADIAAACGQLAA

SEQ ID NO: 5630 - protein, 300 aa, Schizosaccharomyces pombe 972h-
MDYLLNYADQYALDSIYNAVYPLARDNIVRQSISLFFLTWFGGMFLYLTFASLSYQFVFDKSLMDHPKFLKNQVFMEVLTALQNLPGMALLTVPWFLAELHGYSYLYDNISDYGLKYFLCSLPLFVMFSDFGIYWAHRFLHHRYVYPRLHKLHHKWIICTPYASHAFKSADGFLQSLPYHLFPFFFPLHKLTYLALFTFVNFWSIMIHDGKYISNNPIINGAAHHNGHHIYFNYNYGQFTTLFDRLGNSFRAPDEAWFDKDLRQNEDVLRVELMEYEAIRNEVEGDDDREYIANSAKKNH

SEQ ID NO: 5631 - protein, 968 aa, Solanum lycopersicum var. cerasiforme
MMMVTSKVFSSLQFFTVFYLFTVAFASTEEATALLKWKATFKNQNNSFLASWTTSSNACKDWYGVVCLNGRVNTLNITNASVIGTLYAFPFSSLPFLENLDLSNNNISGTIPPEIGNLTNLVYLDLNTNQISGTIPPQIGSLAKLQIIRIFNNHLNGFIPEEIGYLRSLTKLSLGINFLSGSIPASLGNMTNLSFLFLYENQLSGFIPEEIGYLRSLTKLSLDINFLSGSIPASLGNLNNLSFLYLYNNQLSGSIPEEIGYLRSLTKLSLGINFLSGSIPASLGNLNNLSRLDLYNNKLSGSIPEEIGYLRSLTYLDLGENALNGSIPSSLGNLNNLSRLDLYNNKLSGSIPEEIGYLRSLTYLDLGENALNGSIPASLGNLNNLFMLYLYNNQLSGSIPEEIGYLSSLTELYLGNNSLNGSIPASLGNLNNLFMLYLYNNQLSGSIPEEIGYLSSLTELFLGNNSLNGSIPASLGNLNNLSRLYLYNNQLSGSIPASFGNMRNLQTLFLSDNDLIGEIPSFVCNLTSLEVLYMSRNNLKGKVPQCLGNISDLHILSMSSNSFRGELPSSISNLTSLKILDFGRNNLEGAIPQFFGNISSLQVFDMQNNKLSGTLPTNFSIGCSLISLNLHGNELADEIPRSLDNCKKLQVLDLGDNQLNDTFPMWLGTLPELRVLRLTSNKLHGPIRSSGAEIMFPDLRIIDLSRNAFSQDLPTSLFEHLKGMRTVDKTMEEPSYESYYDDSVVVVTKGLELEIVRILSLYTIIDLSSNKFEGHIPSVLGDLIAIRVLNVSHNALQGYIPSSLGSLSILESLDLSFNQLSGEIPQQLASLTFLEVLNLSHNYLQGCIPQGPQFRTFESNSYEGNDGLRGYPVSKGCGKDPVSEKNYTVSALEDQESNSEFFNDFWKAALMGYGSGLCIGISIIYILISTGNLRWLARIIEELEHKIIVQRRKKQRGQRNYRRRNNRF

SEQ ID NO: 5632 - protein, 392 aa, Acridocarpus adenophorus
DLEPVNPADVPVTAAGALKSYKLAAKAISRLQSLPSGDISLLCDVLVKEVRDLTGYDRVMAYKFHEDEHGEVVSECRRSDLEAYLGLHYPATDIPQASRFLFMKNKVRMICDCLAPPVKVIQDERLPQPLSLCGSTLRSPHGCHAQYMENMGTIASLVMSVSINEDDDMMDGDQQQMPRKLWGLVVCHHTSPRFVPFPLRYACEFLIQVFGVQINKEVELAAQVREKHILRIQTLLCDMLFRDAPVAIITQSPNVMDLVKCDGAALYYKNKFWLLGITPTEAQIRHIVEWLLECHSGNTGLSTDSLMEAGYPGASVLGDAVCGMAAVGITSRDFLFWFRSHTAKEIKWGGAKHDPDDKDDGTKMHPRSSFKAFLEVVKWRSLPWEDVEMDAI

SEQ ID NO: 5633 - protein, 545 aa, Magnaporthe grisea 70-15
MRLHFFTELLAAGSLLLSSVNALEAKLTQQEDKREKCVGMYSRSAWGGDIDPFILVRFNKVEEEGDHRASMLIFEWMDQDLVLFQSSPDTPKKLAICNPENVSAGNCNETHLGEYIVSANVNKESHNIVHTQVVDLKDPKPFNYPIKNTGYYCIFTAEYTRSDYEAIVEFRNAFGELPAAQIPKLPFYGGITILYALVAVFWGLLYYRHRSDILPVQNYITAILIFLVVEMLLTWAFYDYLNRHGSNTLSKFLLVLVAVLNAIRNSFSFFLLLIVCMGYGVVKHTLGKTMIYVRYLAIAHFFFGLVYAVASLVITPDSAGPFVLLIVLPLAGTLTAFYVWTLNSLNLTLKELNERKQHVKEGMYKKLWWCILISIIVIFGFFFFSSFSFTSMRDPDYVPFHWKTRWFMLDGWLNLVYFADVAFIAYVWRPTANNRRFAMSDEIAQEDDGTFDMTNMDIGAPDDSDDEEANIGTKPATSTHTATQTNGGAPSNARSGPTATRNAGPAARDSLDGETIFAVGEDLDKFSDDDEDSEEERGLVKKSNK

SEQ ID NO: 5634 - protein, 826 aa, Solanum lycopersicum
MMMVSSKIFSLLQFFALLNLFTVTFASTEEATALLKWKATFKNQDNSLLASWTQSSNACRDWYGVICFNGRVKTLNITNCGVIGTLYAFPFSSLPFLENLNLSNNNISGTIPPEIGNLTNLVYLDLNNNQISGTIPPQTGSLSKLQILRIFGNHLKGSIPEEIGYLRSLTDLSLSTNFLNGSIPASLGNLNNLSFLSLYDNQLSGSIPEEIGYLRSLTDLYLSTNFLNGSIPASLGNLNNLSFLSLYDNKLSGSIPDEIGYLTSLTDLYLNNNFLNGSIPASLWNLKNLSFLSLSENQLSGSIPQEIGYLRSLTNLHLNNNFLNGSIPPEIGNLWSLSIIDLSINSLKGSIPASLGNLRNVQSMFLDENNLTEEIPLSVCNLTSLKILYLRRNNLKGKVPQCLGNISGLQVLTMSRNNLSGVIPSSISNLRSLQILDLGRNSLEGAIPQCFGNINTLQVFDVQNNKLSGTLSTNFSIGSSLISLNLHGNELEGEIPRSLANCKKLQVLDLGNNHLNDTFPMWLGTLLELRVLRLTSNKLYGPIRSSGAEIMFPDLRTIDLSNNAFSKDLPTSLFQHLEGMRTIDKTMKVPSYEGYGDYQDSIVVVSKGLKLEVVRILSLYTVIDLSNNKFEGHIPSVLGDLIALRVLNMSHNGLKGHIPPSLGSLSVVESLDLSFNQLSGEIPQQLASLTSLGFLNLSHNYLQGCIPQGPQFRTFENNSYEGNDGLRGYPVSKGCGNDPVPDTNYTVSALDDQESNSEFLNDFWKAALMGYGSGLCIGLSIMYFMISTGNPIWLARIIDEMEHQINTRRRKKQQGQRNHRRRNNHF

SEQ ID NO: 5635 - protein, 944 aa, Solanum lycopersicum
MMMVTSKVFSSLQFFTVFYLFTVAFASTEEATALLKWKATFKNQNNSFLASWTTSSNACKDWYGVVCLNGRVNTLNITNASVIGTLYAFPFSSLPFLENLDLSNNNISGTIPPEIGNLTNLVYLDLNTNQISGTIPPQIGSLAKLQIIRIFNNHLNGFIPEEIGYLRSLTKLSLGINFLSGSIPASLGNMTNLSFLFLYENQLSGFIPEEIGYLRSLTKLSLDINFLSGSIPASLGNLNNLSFLYLYNNQLSGSIPEEIGYLRSLTYLDLGENALNGSIPASLGNLNNLSRLDLYNNKLSGSIPEEIGYLRSLTYLDLGENALNGSIPASLGNLNNLSRLDLYNNKLSGSIPEEIGYLRSLTYLDLGENALNGSIPASLGNLNNLSRLDLYNNKLSGSIPEEIGYLRSLTKLSLGNNFLSGSIPASLGNLNNLFMLYLYNNQLSGSIPEEIGYLSSLTNLYLGNNSLNGLIPASFGNMRNLQALFLNDNNLIGEIPSFVCNLTSLELLYMPRNNLKGKVPQCLGNISDLLVLSMSSNSFSGELPSSISNLTSLKILDFGRNNLEGAIPQCFGNISSLQVFDMQNNKLSGTLPTNFSIGCSLISLNLHGNELEDEIPWSLDNCKKLQVLDLGDNQLNDTFPMWLGTLPELRVLRLTSNKLHGPIRSSGAEIMFPDLRIIDLSRNAFSQDLPTSLFEHLKGMRTVDKTMEVPSYERYYDDSVVVVTKGLELEIVRILSLYTVIDLSSNKFEGHIPSVLGDLIAIRVLNVSHNALQGYIPSSLGSLSRVESLDLSFNQLSGEIPQQLASLTFLEFLNLSHNYLQGCIPQGPQFRTFESNSYEGNDGLRGYPVSKGCGKDPVSETNYTVSALEDQESNSKFFNDFWKAALMGYGSGLCIGISIIYFLISTGNLRWLARIIEELEHKIIMQRRKKQRGQRNYRRRNNRF

SEQ ID NO: 5636 - protein, 518 aa, Arabidopsis thaliana
MNRAENLDSIPTDLILEIFSRMSTKSIGRCRCVSKLWKSMLGHPYFTELFLTRSSDHPRLLFGVKRERQWLFFSSPQPQDLYEKSSLVDFHMNFSDFHMNFSGDIRRNECTYVSGFIYFPRKRIKNYLCDFRVICNPITGQYAILQLITFHEKRSFLGFDPIDKQFKVLRMKYNDRGIVVHHILTLEPGKMRWRKIRCPLAHEPFWEEICANGVLYYLAEPTDGGSYVICCFDVRSEKFKFIDAKCFGDFSIQLINYKGKLGGISWKYDTVDGKRTVELYMWVLEDVEKQKWSKYVYPLPGNSYHYSVAGVTAKGDIVFVKTYTSKPFYVFYVNPEKKTFQRVEIHGNHEVFDTNNLVYAFVDHVEDLQFDVMKKTYAAKPISPPKQKPKPPSTETSSREDHQGWISISSRKYHQVRTIAHRQQGRRKFESINKFNALYLDDGDEDTVAHQQRDHHTFKSISKFKAQRLLDDDEFTGVKTSKCDTSHLQVSCELSPLCWLSILLFLVMVYMSFMLQHL

SEQ ID NO: 5637 - protein, 802 aa, Solanum pimpinellifolium
MMMVSSKIFSSLQFIALLNLFTVTFASSEEATALLKWIATFKNQDDSLLASWTQSSNACRDWYGVICFNGRVKTLNITNCGVIGTLYAFPFSSLPFLENLNLSNNNISGTIPPEIGNLTNLVYLDLNNNQISGTIPPQTGSLSKLQILRIFGNHLKGSIPEEIGYLRSLTDLSLSTNFLNGSIPASLGKLNNLSFLSLYDNQLSGSIPDEIDYLTSLTDLYLNNNFLNGSIPASLWNLKNLSFLSLRENQLSGYIPQEIGYLRSLTYLRLNNNFLNGSIPREIGYLRSLTNLHLNNNFLNGSIPPEIGNLRSLSIIDLSINSLKGSIPASLGNLRNVQSMFLDENNLTEEIPLSVCNLTSLKILYLRRNNLKGKVPQCLGNISGLQVLTMSPNNLSGEIPSSISNLRSLQILDLGRNSLEGAIPQCFGNINTLQVFDVQNNKLSGTLSTNFSIGSSLISLNLHGNELEGEIPRSLANCKKLQVLDLGNNHLNDTFPMWLGTLLELRVLRLTSNKLHGPIRSSGAEIMFPALRTIDLSNNAFSKDLPTSLFQHLKGMRAIDKTMKVPSYEGYGDYQDSIVVVSKGLKLEVVRILSLYTVIDLSNNKFEGHIPSVLGDFIALRVLNMSHNGLKGQIPPSLGSLSVVESLDLSFNQLSGEIPQQLASLTSLGFLNLSHNYLQGCIPQGPQFRTFENNSYEGNDGLRGYPVSKGCGNDPVPETNYTVSALDDQESNSEFLNDFWKAALMGYGSGLCIGLSIMYFMISTRNPKWLARIIDEMEHKINMRRIKKQQGQRNHRRRNNHF

SEQ ID NO: 5638 - protein, 508 aa, Magnaporthe grisea 70-15
MGSTSEARTSSSAGASQPSSIRSVDVSAKSSPTLAPQNGHHNGVPNSAEQVLKPVEKTSVKERLTRMFSTKDTQRSSNLAPPSGDKSAPVSPGLAPPVRNQPPSRKGSTTDKASEKTAAASAAKAAKSSNGTAHQQQRFLVNPDAQGGHEHHLKSSRRQEKLSDMFRSMLGGGKRAEQQDHDLSLVSGWVDTLKQEKDKDKDVGQAGEKRGGPNASVTLVEKYGKCQEVVGRGAFGIVRISHKKMDNGAGERLFAVKEFRRRPEENEKKYSKRLTAEFCISSSLRHPNVIHTLDLLQDAKGDYCEVMEFCPGGDLYTLVLAAGKLEVQEADCFFKQMMRGVEYMHEMGVAHRDLKPENLLLTTHGALKITDFGNGECFRMAWENDAHMVSGLCGSGPYIAPEEYTSKEFDARAVDVWACGVIYMAMRTGRHLWRIAKKDEDEFYARYLEGRRDEEGYGPIESLHRARCRNVIYSILDPNPSRRITASQVLKSEWGREIKLCKAGEEGL

SEQ ID NO: 5639 - protein, 402 aa, Arabidopsis thaliana
MDIDGEDVSRRLHVKFVTKLDSPFKVPVNSVAIPSNVTRLGLSSIVNSIIESENPEWKTEPFDFLIDGELIRMSLEEFLLAKGISAERTLEIEYIRAVTPRKEEEPSLHDDWVSAVNGSSPRFILTGCYDGLGRVWSSAGSCSHILEGHSGAISSVALVNSNDAETVTVATASKDRTLRLFKFDPAESVDSTTKVRAYKILRGHKASVQSVSAQKSGNMVCSSSWDCTINLWNTNESTSEGESVSVKKRKGNNQAEESQSEGEAVTSLVGHTQCVSSVVWPEHDVIYSSSWDHSVRRWDVETGKDSLNLFCGKALNTVDVGGESSALIAAGGSDPILRVWDPRKPGTSAPVFQFSSHSSWISACKWHKSSWFHLLSASYDGKIMLWDLRTAVMTKHTHSFPL

SEQ ID NO: 5640 - protein, 519 aa, Arabidopsis thaliana
MNRGAQRYSNLAAAVENTITPPVKVEHTQLLIGGRFVDAVSGKTFPTLDPRNGEVIAQVSEGDAEDVNRAVAAARKAFDEGPWPKMTAYVYNKVVLCLSSERSKILFRFADLIEKHNDEIAALETWDNGKPYEQSAQIEVPMLARVFRYYAGWADKIHGMTMPGDGPHHVQTLHEPIGVAGQIIPWNFPLLMLSWKLGPALACGNTVVLKTAEQTPLSALLVGKLLHEAGLPDGVVNIVSGFGATAGAAIASHMDVDKVAFTGSTDVGKIILELASKSNLKAVTLELGGKSPFIVCEDADVDQAVELAHFALFFNQGQCCCAGSRTFVHERVYDEFVEKAKARALKRNVGDPFKSGIEQGPQVDSEQFNKILKYIKHGVEAGATLQAGGDRLGSKGYYIQPTVFSDVKDDMLIATDEIFGPVQTILKFKDLDEVIARANNSRYGLAAGVFTQNLDTAHRLMRALRVGTVWINCFDVLDASIPFGGYKMSGIGREKGIYSLNNYLQVKAVVTSLKNPAWL

SEQ ID NO: 5641 - protein, 486 aa, Pseudomonas putida
MKEIKHFINGAFVDSASGRTFEDINPVNGQVIGRVHEAGRAEVDAAVRAARAALKGPWGKMTVAERAEILHRVADGVTARFDEFLEAECLDTGKPKSLASHIDIPRGAANFKVFADLIKNVPTEAFEMATPDGAGALNYGVRRPKGVIGVISPWNLPLLLMTWKVGPALACGNCVVVKPSEETPLTATLLGEVMQAAGVPAGVYNVVHGFGGDSAGAFLTEHPDVDAYTFTGETGTGETIMRAAAKGVRQGSLELGGKNAGIVFADCDLDKAIEGTLRSAFANCGQVCLGTERVYVERPIFDAFVARLKAGAEALKIGEPNDPEANFGPLISHKHREKVLSYYQQAVDDGATVVTGGGVPEMPAHLAGGAWVQPTIWTGLTDDSAVVTEEIFGPCCHIRPFDSEEEAIELANSLPYGLASAIWTENASRAHRVAGQIEAGIVWVNSWFLRDLRTAFGGSKQSGIGREGGVHSLEFYTELKNICVKL

SEQ ID NO: 5642 - protein, 506 aa, Aspergillus oryzae
MAVSLSFLTYLFLIVAGVYLARKISRAVQIRQFKKRHGCLPPPRDHHKDPVLGLDEVRSMLRVFREDYLMEYTLEKYRRHGNTFATSVLGDDDIFTAEPENIKTILAVKFKQFDLGETRRRTFHPLLGDGIFAADGPQWEHSRTLLRPSFTRTQIAATDLHERHIQRLISRIPRDGSTVDLQELFFNLTLDTATEFLFGESVESLRLGSSAGSSSFAHHFNVAQDEIAFSMVIAPFDQLIFRPRFRESVREARGYVGNFVKKAIEYRHSLDAEKHAGDTTDSQSRYVFLEELAKETDNPSDITDQILNILLAGRDTTASLLSMVFYNLARRPDIWDLLRSEVATLDGKCPSFEELKQLKYLSWVINETLRLYPVVPSNSRTANEDTFLPVGGGPDGKSPVFVAKGQRVAYDVYVMHRRHDIFGPDAEEFRPERWETIRPGWGYLPFNGGPRICLGQQFALTEASYTTVRIVQSFKEITSRDPEPYRERLALTLASRHGTKVAMVPA

SEQ ID NO: 5643 - protein, 375 aa, Neorickettsia sennetsu str. Miyayama
MVDVEDVKDCRVVLRVDFNVPVNQEGLITDFSRIAVVLPTINLLLKNGCAILLLSHFGKPTAAIKEKFSFERIIGQICQFTGLDIRVVSDLSNELLLRQGEIILLENVRFFAGEVENDSKFAMLIARHGDVYVNDAFSVSHREHASVVGIPQFLPSAMGLAFLREYQELDSAATKGTVAVIGGSKISTKLPLIRGLLKKVKMVILGGALVNVILRSRGYNVGKSMCEDCHCDITLPELFIPFDFVTSHGVEDQNFHFTDARMIPHNEMILDIGPASLIAMKGILSKAEKILWNGPIGAFEFEPFCSGTHELARFISFLTKNANIKSIIGGGDTLAAIKSLQEPCFSYISTSGGAFLKFQEEGTLPGIEAIKKCKV

SEQ ID NO: 5644 - protein, 549 aa, Methanococcus maripaludis S2
MLFTNDTIGEFFEKQAQKDPDREFLVYPDRNLRFTYKEFDERTDLLAKGLLEIGIKKGDHIGIWARNVPDWLTFMFATAKIGVVLVTVNTAYKSHELAYVMKQSDMKALAIIDSFRDVNYLEILYELVPELKTSQRGKLNSEEFPYLKNVIYVGQEKHRGMYNTTELMLLGNYVSDEKLIEAKKGLDSDDVINMQYTSGTTGFPKGVMLTHKNILNNGYYIGEKQKFTEEERLCLPVPLFHCFGIVLGVLALLTHGGTLVMLEIFDPLLVLAAIQKEKCTAVYGVPTMFIAEFSHPMFEMFDLSSLRTGIMAGSTCPIEAMKKVMSDMYMREITISYGLTEASPVFTMTSVDDPFEKRVESVGKAMPHCEVKIIDPETGETLAPGNVGEICCRGYNVMKGYYKMPEKTAEVIEKDGWLHSGDLAVEDEDGYYKIVGRIKDMIIRGGENIYPREIEEFLYTMPGINDAQVVGIPDEKYGEIVGAFVIPKEGYEIKEEDVRDFALEKIARYKVPKHVFVVEEFPMTASGKIQKFKLTELAVELLKKKKEEL

SEQ ID NO: 5645 - protein, 459 aa, Sulfolobus tokodaii str. 7
MVKRLDNAEVIRLHILATIIGALGGFLFGYDTGIIGSVLVYVTPLFHLTPPEVAILTSGTSLLAGIGALAAGPITDKYGRKSLLVTDGIMYAVFALLSAIAINSFLLILWRSLVGFAIGADTAIATAYISEFSPKRWRGRLAITQQLMIFSGITASFWAGYLLSFSANWRLMLGLGVIPAVILVALRAFLPESPRWLLLNGMEEKAKNILRKFGVNIAENEHIAAPSKELSFKEMFNNKAIRTAIILVGLWLAFQQITGINVILYYGPTIYKYLGLTGPRAILNTAISESLGAIEYAISFYLIDKWGRRKLGIFGYAGLVGSLAIMLIGLRAFTSGIVFAGVALVFTAMTLFLLFFHVGVGGVGWVLQGETIPTEVRGRGAGLLAAIDWFANFVIIFIFPYWKAAFGVYSFFALELVLSILAIAIVYLFMPETKGVSLEDMLKVFERGLSVQRQKQYAK

SEQ ID NO: 5646 - protein, 421 aa, Xanthomonas oryzae pv. oryzae KACC10331
MPRSPPSCLHQPESAAVEMPMLSEPLIDFLTSGVARLGVWGMLAVLLVFTQLTIFAVTLYLHRSQAHRGVDFHPVIAHFFRFWTWFTTSMISREWVAIHRKHHAKVETEEDPHSPQSKGISQVFWRGVELYREARTQRADIEQYGKAAPTDWIERHLYTPHANAGPVALLVINSVLFGLPGIALWAVQMAWIPFWAAGVVNVLGHWWGYRNFESADTSTNLTPWALRIGGEELHTHHHAFPSSARFSMRRWELDIGWVVIRSVQAFGLAKVLRVAPSLDIRPNIAVLDADTLKPLLSHRFQAMTDYQRNVLKPALREEAAATGAKLRELLPRRLRKGLVDDGRWLKPEARAQLQTWVAQRPRMRTLVEYRARLTAVLEARSHDASERLRQLQQWCHEAEASGNAALQAYAARLKGDALSGA

SEQ ID NO: 5647 - protein, 399 aa, Aspergillus oryzae
MGSVGISADEVVDNLIRKHIEELSNDPYVSQSDHPFFVADGSRIVEQHLRWKSSLPDIQPFYAVKCNSDVNFLRYLDRLGVNFDCASQGEIELILSLGVDPSRIIFAHPCKSISALHFAAKQGIRWATFDNIDELEKVKQHSPQIGLLLRIFAEDDGAKVCLGDKFGAPWNTTVALLERARELHLQIVGVSFHIGSGASDPEAFTTAIQQARHVFDQGERLGFNMTVLDVGGGFQHTNFEFMASSLRPALAREFGDRPVRVIAEPGRFFATPCYTLVCKVIARRTHIGAAPSNPADMLYQNDGLYGCFSCGWSEGEEYMPVLVKQNEGRDDHRESGEHRYSLWGPTCDSIDQIAKEVVMDGEVKVGDWLVYKDMGAYTMSASSQFNGFPNSYTVIYQDF

SEQ ID NO: 5648 - protein, 428 aa, Chlorobium tepidum TLS
MTARELALRVLLELDGMRKSEELLNRMHEHAGLGKNDRALAKELVAGTLKYRLQCDFIIARFYRHDYAKAATVLKHILRLGVYQLLRLDRVPKSAAVNESVKLARKFKGDHLARLVNGLLRNISKATIDLDAWTAEMPESKRLSILYSFPEWLAARWLMRYGPDATLAMLAHGNLPPATGYRINRLKANPETLLARPELSDAKRVADADGLDRFFFSKQFALLEPLLKEGLVSVQNPAQGQACLMAAPEPGSTVFDMCAAPGGKSTFMAELMENRGRIIALDRTPAKVARIASNASALGITIIEPREGDALTFDPGCAMDTILLDAPCTGTGVLGRRAELRWRTTPEKLRELAALQAAMLDRAASLLRPGGVLLYATCSVEPEENELQTEAFLKRHPEFIAEASRLTLPGSHEGFDGGFAARFRKTEG

SEQ ID NO: 5649 - protein, 628 aa, Sulfolobus tokodaii str. 7
MIIPINPNFKTKPEEYSEEEKIKLMTKGLTQDSLGIYNSLSDLTKDDIEKEISQIVKSFGIYLEFNRDKMKFDRVKDWIYMIRVAIPGGGPISSDQWRILDEVANKYTVSNAYTGYPQPSLKLTTRQDVQFHNVKKKDLVNAIRDIVQSKFYTLNGCGDNVRNTISCPISSYYGFDINRLAKKIAEYFRLPSKLYIQVFELDPNISSELENRESFQYSDNLLPRKFKIAIAGIIKINGSYVIDNCVEVRANDIGIVPVIEEGKIEGYQIYVGGSMGENNSYPTFSALALPIGTVSEEELVRVLDAIVRIQQEWGDRKNRHWARLKYLVYKMGVEWIREKVKEYSGIELGEIKDIDLSFKELHLGWIKLGDKWGYGIFIENGRVIDGKNGKVKSMIRYIVDNYYDVKLFITPNQHLIITQIDQREEFEKIFKEFGYGIRDGKAYSKLRINSIACVGFPTCKLSFTDSERFLPSLIDELERRGFSNVSASVGISGCVAQCSRPATHPISWVGSGYELYMLKIGGSNDHIGEPLIDWEENVIYLYQVPSKRLADVTEALLQLYEKNKDLGKDAGEVFRKLGNKKIIEYLKSHEKTRDLMKPHKFDTKIEGYREYHELLKQRINEVIKFKQG

SEQ ID NO: 5650 - protein, 435 aa, Wigglesworthia glossinidia endosymbiont of Glossina brevipalpis
MIKNSITNKLYVEAKKIIPGGVNSPARSFYFVKEIPVIAKRSKGPYIFDVDNNKYIDYICSWGASILGHNNYYITSKIIEYSKKGLNFGLLTEIEIKIARLISKYIPSIEMIRMVNSGTEATMSAIRLARSYTKKNKIIKFDGCYHGHADFLLANSNLDPYDLFSSNPISSGIPKNILKDTLICPYNDYESIEKIFDLYPNKIACIIVEPIAGNMGCVLPEKNFLYKLRMLCNKFNSLLIMDEIITGFRISLGGAQSYYNIYPDITCLGKIIGGGLPIGAFGGKKRIMNHVSPSGSVYQAGTFSGNPISMISGYACLKLLKSPDLYNKLNKKTEYLVNELRSSACDNKIPVVINSLGSMFSIFFTNLDKIKCYKDVSSCNYKKFILFFNEIKKLGILFSPSLFESNFITLMHKKKDLEKTIDSANKVFKILKNKV

SEQ ID NO: 5651 - protein, 512 aa, Triticum aestivum
MMELLPVPLGVGFMGYVRAAAPLVAAAVAFYFLVEQLSYHRNKGVLPGPSLVVPFLGSIVPMIRDPTGFWEVQAARARDSGAGLAADFLVGRFILFVRDSELSHRVFANVRPDAFHFVGHPFGKKLFGEHNFIYLFGDEHKDLRRRMAPTFTPRALSTYAAIQQRIVLAHIRRLLDETSPATPAPIRVACRDMNLETSQTVFVGPYLTQEARARFGEDYAVFNVGVIALPVDLPGFAFRRARLAVGRLVRTLAECVGQSKARMRAGGEPECLVDYWMQGLVKEMDEAAAAGRPLPKHTADEDLGGYLFDFLFAAQDASTSSLCWAVAALGSHPDVVARMRAEVSAVWSPESGEPITPDKFMQLKYTHAVAREVVRYRPPATLVPHIAAEPFKLTEWYTVPKGAIVFPSVYESSFQGFTEAEAFDPDRFFSEARREDEAFKRNFLAFGAGAHQCIGQRYALNHLALFLALFVSVVHFKRHTTHGCDEPVYMPTIVPKDDCTVYLHQRCSSFSF

SEQ ID NO: 5652 - protein, 392 aa, Acridocarpus chevalieri
DLEPVNPADVPVTAAGALKSYKLAAKAISRLQSLPSGNIFLLCDVLVKEVRDLTGYDRVMVYKFHEDEHGEVVSECRRSDLEAYLGLHYPATDIPQASRFLFMKNKVRMICDCLAPPIKVIQDERLPQPLSLGASTLRSPHGCHAQYMANMGTIASLVMSVTINEDDDMMDGEQQQMARKLWGLVVCHHTSPRFVPFPLRYACEFLIQVFGVQINKEVELAAQVREKHILQIQTLLCDMLLRDAPVAIITQSPNVMDLVKCDGAALYYKKKFWLLGITPTEAQIRDIVEWLLEFHSGNTGLSTDSLMEAGYPGASVLGDAVCGMAAVSITSKDFLFWFRSHTAKEIKWGGAKHDPDDKDDGRKMHPRSSFNAFLEVVKWRSLPWEDIEMDAI

SEQ ID NO: 5653 - protein, 375 aa, Arabidopsis lyrata
MALSLQSPPCATLSASIQKGRWKTLAAGFSATPLPAVNFSIRRSIPRILASASSSSSPSSSSLEAGENNELNAVSAFSEIVPDTVVFDDFERFPPTAATVSSSLLLGICGLPDTIFRNAVDMALADSSCAGLETTESRLSCFFNKAIVNVGGDLVKLVPGRVSTEVDARLAYDTNGIIRKVHDLLRLYNEIDVPHDRLLFKIPATWQGIEAARLLESEGIQTHMTFVYSFAQAAAAAQAGASVIQIFVGRLRDWARNHSGDTEIESAIKSGEDPGLALVKRSYNYIHKYGYKSKLMAAAVRNKQDLFSLLGVDYVIAPLKVLQSLKDSPAIPGDEKYSFVRKLTPETATHYHFTNKELIKWDQLSLASAMGPASV

SEQ ID NO: 5654 - protein, 337 aa, Lilium hybrid cv. 'Star Gazer'
MAAQHIISMAAMASLLVVLSAIPRGVESIGVCNGMDGDNLPQPADVVNLYKSNNIAGMRLYRPDQATLQALQGSNIYLILDVPNSDLQNIASDQSAATNWVQTNVQAYPNVAFRYIAVGNEVIPGGQAQYVLPAMNNIQSALSSAGLQNIKVSTSVSFGVVGTSYPPSAGSFSSDASSTLGPIIQFLASNGSPLLANIYPYLSYAGNSGSIDLSYALFTASGTVVQDGSYAYNNLFDAMVDALYSALESAGGPNVPVVVSESGWPSAGGTAATVSNAQTYNSNLINHVGQGTPKRPGAIETYIFAMFNEDQKQPQGIENNFGLFYPNEQPVYSISFT

SEQ ID NO: 5655 - protein, 891 aa, Zea mays
  misc_feature (346)..(346): Xaa can be any naturally occurring amino acid
  misc_feature (494)..(494): Xaa can be any naturally occurring amino acid
  misc_feature (581)..(581): Xaa can be any naturally occurring amino acid
  misc_feature (592)..(592): Xaa can be any naturally occurring amino acid
  misc_feature (833)..(833): Xaa can be any naturally occurring amino acid
MFWHGVADRLTGKNKEAWSEGKIRGTVRLVKKEVLDVGDFNASLLDGVHRILGWDDGVAFQLVSATAADPSNGGRGKVGKAAHLEEAVVSLKSTADGETVYRVSFEWDESQGIPGAVLVRNLQHAEFFLKTLTLEGVPGKGTVVFVANSWVYPHKLYSQERIFFANDTYLPSKMPAALVPYRQDELKILRGDDNPGPYQEHDRVYRYDYYNDLGDPDKGEEHARPILGGSQEHPYPRRCRTGRHPTKKDPNSESRLFLLNLNIYVPRDERFGHLKMSDFLGYSLKTIIEAVLPTLGTFVDDTPKEFDSFEDILGLYELGPEAPNNPLIAEIRKKIPSEFLRSIAAXGSHDHPLKMPLPNVIKSDVLKKAPEFKFGWRTDEEFARETLAGVNPVIIKRLTEFPAKSTLDPRQYGDHTSKITEAHIRHNMGGLSVQNALRNKRLFILDHHDHFMPYLDEINELEGNFIYASRTLLFLKDDGTLKPLAIELSLPHPXDASSAAAVSKVYTPAHTGVEGHVWQLAKAYACVNDSAWHQLISHWLNTHAVIEPFVIATNRQLSVVHPVHKLLSPHYRDTLNINALXARQTLINAGGXVFERTVFPAKYALGMSADVYKSWNFNEQALPADLVKRGVAVPDQSSPYGVRLLIKDYPYAVDGLVIWWAIERWVKEYLDIYYPNDGELQRDVELQAWWKEVREEAHGDLKDRDWWPRMDTVQQLARACTTIIWVASALHAAVNFGQYPYAGYLPNRPTASRRPMPEPGSHDYKKLGAGQKEADMVFIRTITSQFQTILGISLIEILSKHSSDEVYLGQRDEPDRWTSDAKALDAFKRFGSXRLVQIENRIKTMNDSPDLKNRKGPVEMPYMLLYPNTSDVTGEKAEGLTAMGIPNSISI

SEQ ID NO: 5656 - protein, 650 aa, Anabaena variabilis ATCC 29413
MVKSAPPPTTGRKPSKVEGLKENSNFLREPVATQILEDTTHFTEDAVQILKFHGSYQQDNRDNRTKGQEKDYQFMLRTKNPGGLVPPQLYLALDKLADEYGNHTLRATTRQGFQMHGILKKNLKAAIATIVKNLGSTLGACGDINRNVMAPPAPFKKRAEYQYAWEYAQNIADLLSPQTGAYYEIWLDGEKAISAEESPEVKAARQSNGNGTIIHDTEEPLYGTYYMPRKFKVSVTVPGDNSIDLYSQDLTLVVLTDKKGNLEGFNIFAGGGLGRTHNKEETFARLADPIGYVAKEDVYNAVKAIVATQRDYGDRTDRRHARLKYLINDWGVDKFRAKVEEYFGKPIAPFKQLPEFKYHDFLGWHEQGDGNLFLGISIDNGRVKDEGSFQLKTALREIVEQFNLPIRLTPNQNLIFYEITPENKPAIQAILDRCGVVSDPTTIEPLVRYAMACPALPTCGLAITESERAIPGILERIRTLLDKVGLQNEHFVVRMTGCPNGCARPYMAELGFVGSAPESYQVWLGGSPNQTRLAQPYVEKLHDNDIESFLEPIFVYFRKSRKSGESFGDFCDRVGFDGIREFVAQYQPETTPVTIEPEQPEAVSKSRKARYRVSLHDDLYNKVKATATSQGRSMTDLVKDALEAYFQSLS

SEQ ID NO: 5657 - protein, 392 aa, Acridocarpus excelsus
DLEPVNPADVPVMATGALKSYKLAAKAISRLQSLPSGDISLLCDVLVKEVRDLIGYDRVIVYKFHEDEHGEVVSECCRSDLEAYLGLHYPTMDIPQASRFLFMKNKVRMICDCLAPLVKVIQDERLHQPLSLYGSTLRSPHGCHAQYMANMGTIASLVMSVTINEDDDMMDGDQQQMPRKLWGLVVCHHTSPRFVSFPLRYACEFLIQVFGVQINKEVELAAQVREKHILRIQTLLCDMLLRDAPVAIITQSSNVMDLVKCDGVALYYKNKFWLLGITPTEAQISDKVEWLLECHSGNTGLSTDSLMEAGYPGASVLGDAVCGMAVVGITSRDFFFWFRSHTTKEIKWGDAKHDPDDKDDGTKIHHRSSFKAFLKVVKWRSLPWEDVEMDAI

SEQ ID NO: 5658 - protein, 351 aa, Oryza sativa (indica cultivar-group)
MGSPPPHRLLLLLAVAAVLHRSAAAAEGVIRLPRGRACAAPTDPAAYDRPVIGIVSHPGDGAGGRVSNGTAASYIAASYVKFVESAGARVVPLIYNEPEERLLEKLSLVNGVLFTGGSVKSGPYFETIKKVFQYVLDKNDAGIPFPLFAQCLGFELVSMIVSKDNNILESFSATNQASTLQFPNYSSLEGSVFERFDPDLIKKLSTSCLVMQNHKYGISPKTLRENVALSSFFKILTTSPDENGEVYVSTVQANKYPITCTQWHPEKAIFEFGKQMIPHSEEAVQVTQNFANYFISQARKSQNRPPADKVLDNLIYNYSPTFIGKKSILRLEEPKLETEDSGAMNPPASNP

SEQ ID NO: 5659 - protein, 334 aa, Synechococcus sp. RS9916
MTIRIGINGFGRIGRLAFRQAMSSPDVEVVAINDLIQVDYLAYLLRYDSTHRRFPGDIQVEDGHLMVNGKPIRVTAERDPHQLHWDEVDVDYVLESSGLFLTADKAHAHLEAGAKRVVMSAPSKDDTPMFVMGVNHTSYAGQDIVSNASCTTNCLAPLAKVVNDNFGIVSGLMTTVHATTATQKPIDSPSLKDWRGGRGAGQSIIPSSTGAAKAVGRVIPELNGKLTGMAFRVPTPDVSVVDLTVNLARPASYDEIKQAMKAASQNGLSGILGYTEDPIVSNDLLGESCTSVFDAGAGMALNDQFMKLVAWYDNEWAYSCKCIDLIRHMAAYTG

SEQ ID NO: 5660 - protein, 478 aa, Oryza sativa (japonica cultivar-group)
MELGVPLPRRPVPGSYGVPFVSAVRDRLDFYYLQGQDKYFESRAERYGSTVVRINVPPGPFMAREPRVVALLDAKSFPVLFDVAKVEKRDVFTGTFMPSTSLTGGYRVCAYLDPSEPNHAKIKQLLLSLLVSRKDAFVPVFRSNFGALLDTVESQLASGGGKSDFTALNDATSFEFIGEAYFGVRPSASSSLGTGGPTKAALWLLWQLAPLTTLGLPMIIEDPLLHTLPLPPFLISSDYKALYAYFAAAASQALDAAEGLGLSREEACHNLLFATVFNSYGGFKLLLPQILSRVAQAGEKLHERLAAEIRSAVADAGGNVTLAALEKMELTTSVVWEALRLDPPVRFQYGRAKADLEIESHDASFAIKKGEMLFGYQPCATRDPRVFGATAREFVGDRFVGEEGRKLLQYVYWSNGRETENPSVDNKQCPGKNLVVLVGRLLLVELFLRYDTFTAEAGKKVVITGVTKASTSAVNRTA

SEQ ID NO: 5661 - protein, 392 aa, Acridocarpus orientalis
DLEPVNPADVPVTAAGALKSYKLAAKAISRLQSLPSGNISLLCDVLVKEVRDLTGYDRVMVYKFHEDEHGEVVSECRRSDLEAYLGLHYPATDIPQASRFLFMKNKVRMICDCLAPPIKVIQDERLPQPLSLGGSTLRSPHGCHAQYMANMGTIASLVMSVTINEDDDMMDGDQQQMARKLWGLVVCHHTSPRFVPFPLRYACEFLIQVFGVQINKEVELAAQVREKHILQIQTLLCDMLLRDAPVAIITQSPNVMDLVKCDGAALYYKKKFWLLGITPTEAQIRDIVEWLLEFHSGNTGLSTDSLMEAGYAGASVLGDAVCGMAAVSITSKDFLFWFRSHTAKEIKWGGAKHDPDDKDDGRKMHPRSSFKAFLEVVKWRSLPWEDVEMDAI

SEQ ID NO: 5662 - protein, 799 aa, Solanum lycopersicum var. cerasiforme
MMMVTSKVFSSLQFFTVFYLFTVAFASTEEATALLKWKATFKNQNNSFLASWTTSSNACKDWYGVVCLNGRVNTLNITNASVIGTLYAFPFSSLPFLENLDLSNNNISGTIPPEIGNLTNLVYLDLNTNQISGTIPPQIGSLAKLQIIRIFNNHLNGFIPEEIGYLRSLTKLSLGINFLSGSIPASLGNMTNLSFLFLYENQLSGFIPEEIGYLRSLTKLSLDINFLSGSIPASLGNLNNLSFLYLYNNQLSGSIPEEIGYLRSLTYLDLKENALNGSIPASLGNLNNLSRLYLYNNQLSGSIPEEIGYLSSLTNLYLGNNSLIGLIPASFGNMRNLQALFLNDNNLIGEIPSFVCNLTSLELLYMPRNNLKGKVPQCLGNISDLLVLSMSSNSFSGELPSSISNLTSLKILDFGRNNLEGAIPQCFGNISSLQVFDMQNNKLSGTLPTNFSIGCSLISLNLHGNELEDEIPWSLDNCKKLQVLDLGDNQLNDTFPMWLGTLPELRVLRLTSNKLHGPIRSSGAEIMFPDLRIIDLSRNAFSQDLPTSLFEHLKGMRTVDKTMEEPSYEIYYDSVVVVTKGLELEIVRILSLYTVIDLSSNKFEGHIPSVLGDLIAIRVLNVSHNALQGYIPSSLGSLSILESLDLSFNQLSGEIPQQLASLTFLEFLNLSHNYLQGCIPQGPQFRTFESNSYIGNDGLRGYPVSKGCGKDPVSEKNYTVSALEDQESNSKFFNDFWKAALMGYGSGLCFGISIIYFLISTGNLRWLARIIEELEHKIIMQRRKKQRGQRNYRRRNNRF

SEQ ID NO: 5663 - protein, 392 aa, Acridocarpus smeathmannii
DLEPVNPADVPVTAAGALKSYKLAAKAISRLQSLPSGNISLLCDVLVKEVRDLTGYDRVMVYKFHEDEHGEVVSECRRSDLEAYLGLHYPATDIPQASRFLFMKNKVRMICDCLAPPIKVIQDKRLPQPLSLCGSTLRSPHGCHAQYMANMGTIASLVMSVTINEDDVMMDGDQQQMARKLWGLVVCHHTSPRFVPFPLRYACEFLIQVFGVQINKEVELAAQVREKHILQIQTLLCDMLLRDAPVAIITQSPNVMDLVKCDGAALYYKKKFWLLGITPTEAQIRDIVEWLLEYHSGNTGLSTDSLMGAGYPGASVLGDAVCGMAAVSITSKDFLFWFRSHTAKEIKWGGAKHNPDDKDDGRKMHPRSSFNAFLEVVKWRSLPWEDVEMDAI

SEQ ID NO: 5664 - protein, 1016 aa, Solanum lycopersicum var. cerasiforme
MMMVTSKVFSSLQFFTVFYLFTVAFASTEEATALLKWKATFKNQNNSFLASWTTSSNACKDWYGVVCLNGRVNTLNITNASVIGTLYAFPFSSLPFLENLDLSNNNISGTIPPEIGNLTNLVYLDLNTNQISGTIPPQIGSLAKLQIIRIFNNHLNGFIPEEIGYLRSLTKLSLGINFLSGSIPASLGNMTNLSFLFLYENQLSGFIPEEIGYLRSLTKLSLDINFLSGSIPASLGNLNNLSFLYLYNNQLSGSIPEEIGYLRSLTKLSLGINFLSGSIPASLGNLNNLSRLDLYNNKLSGSIPEEIGYLRSLTYLDLGENALNGSIPASLGNLNNLFMLYLYNNQLSGSIPEEIGYLRSLTYLDLGENALNGSIPASLGNLNNLSRLDLYNNKLSGSIPEEIGYLRSLTYLDLGENALNGSIPASLGNLNNLFMLYLYNNQLSGSIPEEIGYLSSLTELYLGNNSLNGSIPASLGNLNNLFMLYLYNNQLSGSIPEEIGYLSSLTELFLGNNSLNGSIPASLGNLNNLSRLYLYNNQLSGSIPASFGNMRNLQTLFLSDNDLIGEIPSFVCNLTSLEVLYMSRNNLKGKVPQCLGNISDLHILSMSSNSFRGELPSSISNLTSLKILDFGRNNLEGAIPQFFGNISSLQVFDMQNNKLSGTLPTNFSIGCSLISLNLHGNELADEIPRSLDNCKKLQVLDLGDNQLNDTFPMWLGTLPELRVLRLTSNKLHGPIRSSGAEIMFPDLRIIDLSRNAFSQDLPTSLFEHLKGMRTVDKTMEEPSYESYYDDSVVVVTKGLELEIVRILSLYTIIDLSSNKFEGHIPSVLGDLIAIRVLNVSHNALQGYIPSSLGSLSILESLDLSFNQLSGEIPQQLASLTFLEVLNLSHNYLQGCIPQGPQFRTFESNSYEGNDGLRGYPVSKGCGKDPVSEKNYTVSALEDQESNSEFFNDFWKAALMGYGSGLCIGISIIYILISTGNLRWLARIIEELEHKIIVQRRKKQRGQRNYRRRNNRF

SEQ ID NO: 5665 - protein, 171 aa, Prochlorococcus marinus str. MIT 9515
MENKLIELIETYNDFPRKGIEFKDVLGIIQEPKIFKELILKMSSSQIIRNAEAIISIDARGFIFGSAISLEASKPMIVARKPGKLPGELSKKKYSLEYGENSLSIQKKCLQKYNSYAIVDDLLATGGTVSCVSKLLESNGKEVLGLLVVVELMKLKGRFKLKFPVESSITF

SEQ ID NO: 5666 - protein, 392 aa, Acridocarpus zanzibaricus
DLEPVNPADVPVTAAGALKSYKFAAKAISRLQSLPSGNISLLCDVLVKEVRDLTGYDRVMVYKFHEDEHGEVVSECRRSDLEAYLGLHYPATDIPQASRFLFMKNKVRMICDCLAPPIKVIQDERLPQPLSLGGSTLRSPHGCHAQYMANMGTIASLVMSVTINEDDDMMDGDQQQMARKLWGLVVCHHTSPRFVPFPLRYACEFLIQVFGVQINKEVELAAQVREKHILQIQTLLCDMLLRDAPVAIITQSPNVMDLVKCDGAALYYKKKFWLLGRTPTEAQIRDIVEWLLEFHSGNTGLSTDSLMEAGYPRASVLGDAVCGMAAVSITSKDFLFWFRSHTAKEIKWGGAKHDPDDKDDGRKMHPRSSFKAFLEVVKWRSLPWEDMEMDAI

SEQ ID NO: 5667 - protein, 382 aa, Xylella fastidiosa Temecula1
MQVTSKLPQVGTTIFSVMSQLADVYGAVNLGQGFPDFPVPLRLQEALAGAVREGHNQYPPMIGVAGLRQGIAAKVLRCYGAQVDADVEITVTSGATEAIFNAIHAVVGAGDEVIVLDPAYDCYEPGIVLAGARAVHVPLDAVSFKVDWERVGAAITSRTRLLIVNSPHNPSGALFSADDMRALAALLDGTDILLISDEVYEHIVFDGCGHESVLRWPQLRARAFVISSFGKTYHCTGWKIGYAIAPSALSAEFRKVHQYNTFTSFGPAQYAFAAMLHEEPGYVEQVGLFYQARRDCFREQLLTTKLVPLPVSGGYFQLVDYGAVSDLSDVEFSRWLAVEKGVASIPLSPFYETAPAGQRLVRLCFAKNDMTLGAAIERLQRL

SEQ ID NO: 5668 - protein, 326 aa, Mycoplasma pulmonis UAB CTIP
MIKKIAILTSGGDSPGMNNAIRAIIKTARLYDIETYLVYEGFLGLYNGWIKPSEGIDEDSYINKGGTFIFSARFVEFAQEKYRQVAKENLLKLGIEALVVIGGDGSYKGAQKLHEMGIKTIALPGTIDNDITSSDFTIGYDTALNTIVEAVDKIRDTASSHKRCIMVEVMGHGASDLALYSGMATGSEIIVSNDYKLSVEEMAKIVKKQFEKPNKRSVIITVSEFVFKDLQQVAKQIEELTNITTKAVVLAHIQRGGYPSARERINATILGKHAVLRLKQGQSGIALGLIKNQVAATPILEALAMPQTRKDLLERRTKSYNDINQA

SEQ ID NO: 5669 - protein, 288 aa, Crocosphaera watsonii WH 8501
MSILTGKTQLLGIIGDPVEHSLSPVMQNAAIQHLGVDYIYIPFPVKPENLAIALDGFANIGVMGFNATIPHKQAIIPLLSEITTTAQLVGAVNTVWRTETGWKGTNTDVMGFLAPLKPLKRPWNTLKPIILGNGGAARAVVVGLAELGCPEIAVLGRDQGKLEEFKQSWHNSDLKASVTVHSWDELSGLVSESQLIVNSTPIGMFPHTDNSPVDSHIWGKCPENAIAYDLIYNPSPTQFLKDAQQQGLKIVDGLDMLVYQGAAALEIWVEKSAPGEVMSQALKQYLFT

SEQ ID NO: 5670 - protein, 130 aa, Debaryomyces hansenii CBS767
MTRTSVLADALNSINNAEKTGKRQVLIRPSSKVIVKFLTVMQKHGYIGEFEYIDDHRSGKIVVQLNGRLNKCGVISPRFNVKVGDMERWTDNLLPARQFGYVILTTSAGIMDHEEARRKHVAGKILGFVY

SEQ ID NO: 5671 - protein, 337 aa, Arabidopsis thaliana
MSYSGAGLGKPGSGKRRIRDLLTQSDNRVCADCGAPDPKWASANIGVFICLKCCGVHRSLGSHISKVLSVTLDEWSDEEVDSMIEIGGNASANSIYEAFIPEGSSKPGPDASHDQRMRFIRSKYEHQEFLKPSLRITSVRVSSTKTPAFLSSSLSKKIVDSFRTNSSSQQPQLEGMVEFIGLLKVTIKKGTNMAIRDMMSSDPYVVLTLGQQKAQSTVVKSNLNPVWNEELMLSVPHNYGSVKLQVFDYDTFSADDIMGEAEIDIQPLITSAMAFGDPEMFGDMQIGKWLKSHDNALIEDSIINIADGKVKQEVQIKLQNVESGELELEMEWLPLEQ

SEQ ID NO: 5672 - protein, 249 aa, Diospyros kaki
MGRGRVELKRIENKINRQVTFAKRRNGLLKKAYELSVLCDAEVALIIFSNRGKLYEFSSINNMPKTLERYQKCSYGTLEDNRSAKEMEQNSYREYLKLKAKYEELQHFQRHLLGEDLGPLNLKDLEHLEHQLETSLKQIRSTKTQSMLDQLCDLQNKEKMWIEANKALERKLDEIYRENQLQSSWGGGGGEQGNSSFNHHHHHPHSQAFFHPFDCNPTLQIGYPEVSNQMGTAATHEQNMNGLVPEWML

SEQ ID NO: 5673 - protein, 168 aa, Triticum aestivum
MAPTVMASSVTSVDPFQGLMSTAGLPVSRRSDGASLGSVSNGGRIRCMQVWPIEGIKKFETLSYLPPFSTEALLKQVDYLIRSKWVPCLEFSKVGFIFREHNASPGYYDGRYWTMWKLAMFGCTDATQVINEVEEVKKEYPDAYVRIIGFDNMRQVQCVSFIAFKPPG

SEQ ID NO: 5674 - protein, 289 aa, Methanococcus maripaludis S2
MQGVYPAIITPLKENKVDYDGLRNNIDFLIENGVSGVIPVGTTGESPTLTPLEHEKVVEKVVEFVDGRVEVIAGTGSNSTSEALEFSQYAEDVGVDGVLLITPYYNKPTQEGLKRHFGEIANSINVPIVLYNVPSRTALNIEPETIKYLFNEYSNISAVKEANPNLSQVSEVLDSCDIDILSGNDELTLPIISLGGKGVVSVIANIAPKEFVQMVDFANAGKFDKAKEIHYKLFPLMKLMFVETNPIPIKTAMNMLGMPSGELRLPLCEMAESNKLKLQNALNNLGLLK

SEQ ID NO: 5675 - protein, 353 aa, Xanthomonas oryzae pv. oryzae KACC10331
MHARPLCEEFPMTSLTNRRIVLASRPQGEPSADNFRIEDIAVPPTGHDQILVRNRFLSLDPYMRGRMDDGPSYVAPVAIDALMEGGTVGEVIESNHADYHPGDLLVLPGGWQTHSLLTPKTPLRKLPQDDGLPPSTALGVYGMPGFTAYAGLHEIGKPQSGETLVVAAASGPVGATVAQLARLQGLRVVAIAGGEEKVRYLRDTLRVDVALDHRADDFAEQLRAATPDGIDIYFENVGGKVFDAVLPQLNDFARIPVCGVIATYNSRGQVLPGPDRLPEFIGQLLRKRLTVRGFIQHDVIRLMPAFLREMGQWLREDKIQYREHVLHGLDSAPQGLVDVLRGKNFGKAVVALD

SEQ ID NO: 5676 - protein, 308 aa, Yarrowia lipolytica CLIB122
MPEIAPHNDKERVWTTLITNTKYLDGLLTLDYSLKRVGSQYRLIALYTDSFEKEGHDALAERGIPSKHVEYLIPAKSKDYSQDVRFYDCWSKLQPFSLFEYDKVVQLDSDMVVVQNMDELFDLPVGESNGNGSTWAFAASHACTCNPYNKPHYPKDWIRENCAFTNISKSDDLKNPLFQSCNLGLGICNGGLQVVKPDPELYDKIIDAVSAPATGEYDFADQSLLSDVFKDRWIGLSYRYNALKTLRVFHKELWDDSVIKNIHYIITPKPWEVEEDEYEDTTGTFKWWWDINKERLTLEGARISTPPS

SEQ ID NO: 5677 - protein, 1383 aa, Oryza sativa (indica cultivar-group)
MELSNQGQTPMSTNMGSQPLPSSNIQPNQAEYPSMLYPSLPADWGAQPMFSMGASVPISSYFIVPMSQQSVQIGASRPETPRSSGAHSLSRVSLRPPQQVLSIRTSLPTMVGSQHSPAGKKLQPTIASPKVQILKSTQSQSSNKRSAQKETPSKVQTQQLESVRSKFRESLSAALRTDSDQSKNQSSDVQPDGSADQKKEMDVDADQVATTSQGMSAAKSEVLTSVGAERRAEDEKLNSDLVSNIATPLNADIQQQPENASLQDEMLGQYTVVADELLQGHGLCWVSDFDAGVPEPATQPNLKRSRASDIDPVVADTLSESESKRMKSANDEEAIDKDSIIQKADDLAVRIEEELFKLFGGVNKKYKEKGRSLLFNLKDKSNPELRERVLSGDITPDRLCSMTAEELASKELSEWRLAKAEELAQMVVLPSTEVDVRRLVRKTHKGEFQVEVEETDGISVEVELGGNLLTQVPSKAPEDQTKSDDKESTDDKTGIQDNDKAPDGTSQDEDNGAGKNDPQDDLEYVDNEKSDLMQELMVDDLKDTENLPPIPSLDEFMQGLDSEPPFENLSAGTPEEDSDDRDEADTTAESAELPEEEVKVSAAEKIVSEADLPSSQDKSESKLESPKDEVGSNLGPVEQREGKLIKSSPDSVEVKQTTTENVLNRDSTVHNMATTLPMIRESIWEGAIQLTMSSLTNVVAIFKSGEKPPVKEWRSFVEIKGRVKLSAFQEFVEQLPKSRSRAIMVTELCWKEGSHESGRQHLLQTIDSYISDERVGLAEPADGIELYLCPSQGKTVEILSRHLPKEHLESLAVSASSIIGVIVWRRPNVPRMPAHPRHDGSRRPSILKKPQVTGSTPGPRPSLPMSSHGAPPGFPVQRHRHEEDVTDDVPPGFGPGVARDEDDLPEFNFVNSSNPAANVTTTQAYKGRQHVPLTSARPVEQMRELVQKYGKRSSVQARPWDDDDDDDIPEWNPNQLVTQQQPTRQLPVPPTPQQPLPPPPPPPSLQQLHHPYQHQQLYHHQNALQPQIPSNSIPQAYLRTQQPLQQLPLMQQQLQPAQAWQQTNAWWPAQGGAAAAAAAAAAPASMVQQSQYGVIPNSNNSTQSYGSGSESGSEDDDLDVGIGDVPSELEVKNSGLIPAQSKETERQLSKKELKKKELAELDTVLAELGISGHAERKPDKQNGGDKNGAPQGPWRGGGYKSEEEITAVYVKEKMKKIASAKKKSGRGGWGCKACCKMEDAARSAKLAGAKKKEKTNSLSIDRLLPSPSSEFRMSTGLICSTCYYEVEVPGVGFAPRIDLKLCFASWLFLKSALRIGSTVTLKLMNKEYAAKESLKKFLRFFVGVPKRHFCLSLESKPAALSSHPLWQYPFTRNRRFAYSYYKL

SEQ ID NO: 5678 - protein, 392 aa, Camarea axillaris
DLEPVNPADVPVTAAGALKSYKLVAKAISRLQSLPSGNISLLCDVLVKEVRDLTGYDRVMVYKFHEDEHGEVVSECRRSDLESYLGLHYPATDIPQASRFLFMKNKVRMICDCLAPPVKVIQDERLPQPLSLCGSTLRSPHGCHAQYMTNMGTIASLVMSVTVNEDDDTMDGDQQHMTKKLWGLVVCHHASPRFVPFPLRYACEFLIQVFGVQINKEVELAAQVREKHILQIQTMLCDMLLRDAPVAIITQSPNVMDLVKCDGAALYFKNKTWLLGVTPTEEQIRGIAEWLLEYHSGNTGLSTDSLMEAGYPGASGFGDAVCGMAAVSITSRDFLFWFRSHTAEEIKWGGAKHDPDDKDDLRKMHPRSSFKAFLEVVKWRSMPWEDVEMDAI

SEQ ID NO: 5679 - protein, 174 aa, Mycobacterium sp. MCS
MPKLWDAVAGFAVTFGTLFKKPITEEYPEKPGPVAPRYHGRHQLNRYPDGLEKCIGCELCAWACPADAIYVEGDDNTADERYSPGERYGRVYQINYLRCIGCGLCIEACPTRALTMTNDYEMADDNRADLIWGKDKLLAPLQDGMLAPPHPMAPGATDDDYYLGRIGPATEDVR

SEQ ID NO: 5680 - protein, 392 aa, Heteropterys aureosericea
DLEPVNPADVPVTAAGALKSYKLASKAISRLQSLPSGNISLLCDVLVKEVMDLTGYDRVMVYKFHEDDHGEVVSERRRSDLESYLGLHYPATDIPQASRFLFMKNKVRMICDCLAPPVKVIQDERLPQPLSLCGSTLRSPHGCHAQYMTNMGTIASLVMSVTINEDDDMMDGDQQQMTRKLWGLVVCHHTSPRFVPFPLRYACEFLIQVFGVQINKEVELAAQVREKHILQIQTMLCDMLLRDAPVAIITQSPNVMDLVKCDGASLYFKNKTWLLGVTPTEEQIRDIAEWLLEYHSGNTGLSTDSLMEAGYPGASVLGDAVCGMAAVSITSRDFLFWFRSHTAKEIKWGGAKHDPDDKDDLRKMHPRSSFKAFLEVVQWRSMPWEDIEMDAI

SEQ ID NO: 5681 - protein, 63 aa, Brassica rapa subsp. pekinensis
MSRLSICLLVLLCAFAAKTAAQPANVRATYHFYNPAQNGWDLYRVSAYCSTWDGNQPLEWRQR

SEQ ID NO: 5682 - protein, 392 aa, Heteropterys bahiensis
DLEPVNPADVPVTAAGALKSYKLASKAISRLQSLLSGNISLLCDVLVKEVRDLTGYDRVMVYKFHEDEHGEVVSECRRSDLESYLGLHYPATDIPQASRFLFMKNKVRMICDCLAPPVKVIQDERLPQPLSLCGSTLRSPHGCHAQYMTNMGTIASLVMSVTINEDDDMMDGDQQQMTRKLWGLVVCHHTNPRFVPFPLRYACEFLIQVFGVQINKEVELAAQVREKHILQIQTMLCDMLLRDAPVAIITQSPNVMDLVKCDGAALYFKNKTWFLGVTPTEEQIRDIAGWLLEYHSGNTGLSTDSLMEAGYPGASVLGDAVCGMAAVSITSRDFLFWFRSHTAKEIKWGGAKHDPDDKDDLRKMHPRSSFKAFLEVVKWRSMPWEDIEMDAI

SEQ ID NO: 5683 - protein, 446 aa, Mycobacterium sp. MCS
MTTPPGPPNAGGDARTGTDTVIVVGGEDWEQVVAAAEQAQAGERIVVNMGPQHPSTHGVLRLILEIEGETITEARCGIGYLHTGIEKNLEYRNWTQGVTFVTRMDYLSPFFNETAYCLGVEKLLGVTDAIPERVNVIRVMLMELNRISSHLVALATGGMELGAMSAMFYGFREREEILSVFEMITGLRMNHAYIRPGGLAADLPDGAVPRIRELLALLPGRLRDLENLLNENYIWKARTQGIGYLDLAGCMALGITGPVLRSTGLPHDLRRAQPYCGYEDYEFDVITDDGCDAYGRYLIRVKEMRESLKIVEQCVDRLKPGPVMIADKKLAWPADLELGPDGLGNSPAHIARIMGQSMEGLIHHFKLVTEGIRVPAGQVYTAVESPRGELGVHMVSDGGTRPYRVHYRDPSFTNLQAVAAMCEGGMVADAISAVASIDPVMGGVDR

SEQ ID NO: 5684 - protein, 231 aa, Mycobacterium sp. MCS
MTEANGTTGGGAGDPEVIDVRRGMFGAKGSGDTSGYGRLIRSVALPGGSPRPYGGHFDEVVDALAAALGQDLYDASVERIVVYRDELTLEIARARLPVVAKTLRDDAALRFELCLGVSGVHYPGDAGRELHAAYPLMSITHNRRIRLEVAAPDDDPHIPSLFSVYPTTDWHERETYDFFGIIFDGHPSLTRIEMPDDWVGHPQRKDYPLGGIPVEYHGARIPPPDERRAYN

SEQ ID NO: 5685 - protein, 392 aa, Heteropterys bicolor
DLEPVNPADVPVTAAGALKSYKLASKAISRLQSLPSGNISLLCDVLVKEVRDLTGYDRVMVYKFHEDEHGEVVSECRRSDLESYLGLHYPATDIPQASRFLFMKNKVRMICDCLAPPVKVIQDERLPQPLSLCGSTLRSPHGCHAQYMTNMGTIASLVMSATINEDDDMMDGDQQQMTRKLWGLVVCHHTSPRFVPFPLRYACEFLIQVFGVQINKEVELAAQVREKHILQIQTMLCDMLLRDAPVAIITQSPNVMDLVKCDGAALYFKNKTWLLGVTPTEEQIRDIAEWLLEYHSGNTGLSTDSLMEAGYPGASVLGDAVCGIAAVSITSRDFLFWFRSHTAKEIKWGGAKHDPDDKDDLRKMHPRSSFKAFLEVVKWRSMPWEDMEMDAI

SEQ ID NO: 5686 - protein, 354 aa, Camellia sinensis
MTTVAAPRVQSLATSGIESIPKEYVRPKEELTGIGNIFEEEKNEEGPQVPTIDLKDIDSEVEEVRERCREALKKAAVDWGVMHLVNHGIADDVRERVKVAGEGFFEQPVEEKEKYANDPDNGNLQGYGSKLANNACGQFEWEDYFFHLAYPEDKCDMSIWPKTPTDYIPATVEYAKQLRALATKTLSILSLGLGLEENKLEKEVGGKEELLLQMKINYYPKCPQPELALGVEAHTDLSAVSFILPSMVPGLQLFYEGKWITAKCVPNSIIMLIGDTVEILSNGKYKSILHRGLVNKEKVRISWAVFCEPPKEKIILKPLPETVSEAEPPLFPPRTFAQHIQHKLFRKSQELGSK

SEQ ID NO: 5687 - protein, 392 aa, Heteropterys byrsonimifolia
DLEPVNPADVPVTAAGALKSYKLASKAISRLQSLPSGNISLLCDVLVKEVRDLTGYDRVMVYKFHEDEHGEVVSECRRSELESYLGLHYPATDIPQASRFLFMKNKVRMICDCLAPPVKVIQDERLPQPLSLCGSSLRSPHGCHAQYMTNMGTIASLVMSATINEDDDMMDGDQQQMTRKLWGLVVCHHTSPRFVPFPLRYACEFLIQVFGVQINKEVELAAQVREKHILQIQTMLCDMLLRDAPVAIITQSPNVMDLVKCDGAALYFKNKTWLLGVTPTEEQIRDIAEWLLEYHGGNTGLSTDSLMEAGYPGASVLGDAVCGMAAVSITSRDFLFWFRSHTAKEIKWGGAKHDPDDKDDLRKMHPRSSFKAFLEVVKWRSMPWEDIEMDAI

SEQ ID NO: 5688 - protein, 540 aa, marine gamma proteobacterium HTCC2143
MHGLMMDTPLTITSVMKHAEKFHGGTEIVSVTNDNPRHRYTYTDAFTRVRKLANSLQRLGAKPGDRIATLAWNDYRHFELYYAVSCSGMVCHTINPRLFPEQVEYIVNHADDTFIYTDVLFLPLLEQLQALMPNVKGIIVLTSEDCMPETSMNNVYCYETLLASENDSFEWPEIDELEASSLCYTSGTTGHPKGVLYNHRSTVLHCLGGSLRDVMGLNSNDVILPIVPMFHVNAWGIPYGAAMIGTKLVFPGSKMADGEVLTELINEEKVTFSAGVPTVWLALQNYLEQTGKRIDPLDRVIVGGAACPVSIMETFDKYGVYTHVGWGMTEMSPLGTYNPKLDRDALGEEAFARMRVKAGRGMYGVEMKIVDEDNKELPWDGVAFGGLKVRGPWVCSNYFKLDDSNAHDDEGWFDTGDVSTIDADGFMQITDRSKDVIKSGGEWISSIDLENAAVDHPAVEEAAVIGLYHEKWTERPLLLVIKKEGAELSREEMLGWFKGKVATWWTPDDCLFVTELPHTATGKLSKKDLRDQYKDYVFPA

SEQ ID NO: 5689 - protein, 407 aa, Prunus avium
MWEEMALRRILPRLPSKSLMRFKCVRKSWYTLINNPTFVENHLSNSMHSKLSTCVLFSRFVQRDTNSDEKELAFSFLYLRNDYDDDEHNVNFVVEDIKSPLSSGRFIGLEDVESPSILGHCNGIVCLSPCSDNLLLCNPGIKEIKLLPKSGLPDWWGCAVGFGYDPKSKDYKVSRIASYQAEIDGLIPPPRVEIYTLSTDSWREIKNNSLETDTTCFFPDYFQMYFQGICYWVGYEQPKQSVEYEDEEQKPMVIFFDTGDEIFHHILFPDSFYMYEEGSSYAYEMSYIMYTDLRIILWNGSIALFGFNRFSVFPDSYGVWVLDDFDGAKGSWIKHLTFEPLMGIKRVLEFWKSDEILMVTEEDGDIVSYSLETEKLKNLPMNSPSDFETILYVNSLVPITGGNKLES

SEQ ID NO: 5690 - protein, 428 aa, marine gamma proteobacterium HTCC2143
MAASFGARVAVAEDRYMGGTCVNVGCVPKKLYVYASQFSNAFGDARGFGWTTSAPSFHWPTLRDNKVAEISRLNDVYQNMLGGAGVNIIDGRARFIDAHTVEVNGQSYSAERIILATGTWPFIPNIPGSEHAITSNEIFDLENFPQRLLVVGGGYIAVEFAGVFNGLGAETTQLYRGPLFLRGFDQDIREFAAQEIEKAGVNLRFNSNIAAIEKLADGSLEATLDDGTTIAADAILYATGRNPHLQDLGFENVNIALNDNGTVKVDDHFQTTEPSIYALGDITGGMELTPVALAEGMALAKTLYNDQPTSVDYDTIPTAVFCQPNIGTCGLTEQEGKDKYGEITVYESDFRAMKHTIGGRQERTYMKLVVDTATDKVVGIHMMGDDAGEIVQGMAIAMKAGATKALFDSTIGIHPTAAEEFVTMRTPR

SEQ ID NO: 5691 - protein, 505 aa, Arabidopsis thaliana
MGSSFETIDIATSARRIGVDNRISLKFYFRIADNILKQANIFRAEKNVIDLYVMLLRFSSLALETIPSHRDYRTSLKSNKEYLRMRLLDVLTELEKLKPVVQQRIDELYPKLKPRYNVQAHPANGSLGWSSAVKPSFNSYDHAKVRNPPGHNSGYMGSRGQQFLNAAPLEERFRKMSVNFRPNEETLSKHSILGPGGLSAQWQPPKYDTKVQYPSNIDFSPVVIPSFQQLVDSKPMITNGSNDEPEKPIVEPSVASNEKIQKNYTEELSSMISFEEPESVNENNLIRQPSPPPVLAEVQDLVPALCPEVREPECMIENSLPDESLRSESPLELHIATSMMDTFMRLAKSNTKKNLETCGILAGSLKNRKFYITALIIPKQESTSDSATNEEEIFEVQDKQSLFPLGWIHTHPTQSCFMSSIDVHTHYSYQIMLPEAVAIVMAPQDSSRNHGIFRLTTPGGMTVIRNCDRRGFHAHSSPEDGGPIYNTCKEVYMNPNLKFDVIDLR

SEQ ID NO: 5692 - protein, 229 aa, Xylella fastidiosa Temecula1
MPLNEVSGNAFPRTVLFDLDGTLLDSAPDMLATANAMLAARGRAPITLMQLRPVISRGTFRIIAVAFPELDAAAIQGLIPEFLQRYEALIGSVSKPFDGVEMMLHALECAGTVWGIVTNKPEFLARLILPLLGWTSRCAVLIGGDTLAERKPHPLPLLTAAERIGVMPTDCVYVGDDVRDIQAARAAGMPSMVALWGYRSHEDNPMTWQADTLVEQPHLLSRPDVWPST

SEQ ID NO: 5693 - protein, 352 aa, Chlorobium tepidum TLS
MMYKIVSIPGDGIGPEVVAGALDVLNAVAKKHGFEVSVEEHLFGGASYDVHGSMLTDETLEACKNCDAVLLGAVGGYKWENLPHDKKPEAALLKIRKELGLFANLRPARVYDALVASSTLKTEVVQGTDFMVFRELTGGIYFGQPRGYDETRGWNTMVYERYEVERIARLAFEYAQKRGNAKVTSIDKANVLEVSQFWRNIVHEVHQDFPEIELVDMYVDNAAMQVVRNPKQFEVIVTSNLFGDILSDISGMITGSLGMLPSASIGSEHALYEPIHGSAPDIAGQNKANPIATIASVAMMFENSFNRPEVAADIYAAIEGALAAGFRTGDIAAAGEAISSTTEMTAAIVARI

SEQ ID NO: 5694 - protein, 285 aa, Nostoc sp. PCC 7120
MAEKQTLQPPQQQQPPGTESKMQPKPQADDAQYRGSGKLKDKVALITGGDSGIGRAVAIAYAKEGADVAFVYLSEHDDAEETKNLVEEQGRRAVSIAGDITDEAFCQRAIQQTVDEFGKLDILINNAAEQHPQESIEDITKEQLERTFRTNIFSMFYLTKAAIKHLKKGSAIINTTSVTAYKGSPQLLDYSSTKGAIVAFTRSLSQNLISKGIRVNAVAPGPIWTPLIPSTFPAEKVETFGKQVPMQRAGQPEEVAPSYVFLASDDSSYMSGQVLHPNGGEVVNG

SEQ ID NO: 5695 - protein, 207 aa, Triticum aestivum
RCPTLPTRPLKTVAKEKKTKATNNWMTILGLPPKKASANDQVPPNEQQQTQHKTSEDTKKLAANALAAVRDAATAASGRGKVEITEVRDFAGKDIEIKKLVDADSKEAVEKASAAGASPSAVDNILEQIRKKQKLSVLDKTKKDWGEYKAEKGVEEELGAYKKSSNQYLDRQSFLKRADYREYELERDARLSLMAKRKSESMQDDDV

SEQ ID NO: 5696 - protein, 274 aa, Arabidopsis thaliana
MAGRSGGGRGGGGGGASADLHSAARSGDLAAVQSIISSNPLAVNSRDKHSRTPYPFFSQNQSSSILSFVVHFFVLNIMISWGNRLHLAAWAGHNEVVSYLCKNKADVGAAAGDDMGAIHFASQKGHLEVVRTLLSAGGSVKSITRKGLTPLHYAAQGSHFEIVKYLVKKGASVRATTKAGKSPADVAGNAETQNFLEECEEQARKAKVNNEKKTEIVKPESCSNEGDVKDLKRKDSEDGNEGEEEEASSKPKKPKVALSHLQDIDDTEADQEEE

SEQ ID NO: 5697 - protein, 527 aa, Triticum aestivum
MAFDLAAAAAAVPWSYLLYGLTGSALLWQARLLLDRLWWRPRRLERTLRAQGVGGTPYRFLMGDLKDFGRLNDEAWAKPLPLRCHDIVPRVIPFLHNNVRDNGKPCFSWFGPVANVAITDPELIKDVLSNKFGHFQKPQFPALTKLLANGLTTHEGEKWVKHRRILNPAFHLEKLKLMLPAFSASCEELVTRWKELHCSGGSCEVDVWPELQNLTGDVISRTAFGSSYLEGRRIFQLQSEQAKLFVGAVQRIIIPGYLFLPTKNNLKMRKNNKEVESVLQGLINKRMRAMEEGEKSENDLLGLLLESNMKDMDENGQPSQGMAMEDVIEECKLFYLAGMETTSVLLTWTMIVLSMHPEWQDLAREEVLGLFRKNKPEYEGLSRLKMVTMILHEVLRLYPSATVFSRKTYKDMDIGGVRYPSGVFIEVPVLFINHDPDIWGSDVNEFKPDRFAQGISKASKHPGAFLSFGWGPRVCIGQNFAMLEAKMALSMILQHFEFELAPSYTHAPHTVMTLQPMHGAQINLRAI

SEQ ID NO: 5698 - protein, 474 aa, Solibacter usitatus Ellin6076
MKTTYTAVDAAYLGERKLRRHARVFQLWAMGVGAVISGDFFGWNFGLTAGGFGGMLLAVAVMTVMYIGLCFSIAEMSPALPHAGGAYSFARTSMGPWAGYITGLAENMEYILTPAVIVVGIGGYLGAVFGTPHAWEPLWWLAAYGVFVALNIWGVEMTFHVSVVITLAAIAILAVFWVGALPHFDLHQWASPYFPAGRGKASSALVELPFALWLYLGIEQLPLAAEESHDPKRDMPRGILYGLVTLIAISFLTVVLSVGIAPGAAAIAKSNEPLFLGFQTIFGHGMQARLLALIACTGLIASFHTIIYAYGRQIYSISRAGYFPTWLSVTHGTRQTPQRALLAGSALGFLAALVIHLAPQGSPVGAVLLNMAVFGAVLAYMLQMLSFLVLRVRFPKMARPYRSPVGLAGAALALAIAGITLFTLFRNPDYNKGVIGAALWFLLGIGYHAFHGRHGLVLAPEEEAAMRLRAERAP

SEQ ID NO: 5699 - protein, 392 aa, Heteropterys capixaba
DLEPVNPADVPVTAAGALKSYKLASKAISRLQSLPSGNIFLLCDVLVKEVRDLTGYDRVMVYKFYEDEHGEVVSECRRSDLESYLGLHYPATDIPQASRFLFMKNKVRMICDCLAPPVQVIQDERLPQPLSLCGSTLRSPHGCHAQYMTNMGTIASLVMSVTINEDDDMMDGDQQQMTRKLWGLVVCHHTSPRFVPFPLRYACEFLIQVFGVQINKEVELAAQVREKHILQIQTMLCDMLLRDAPVAIITQSPNVMDLVKCDGAALFFKNKTWLLGVTPTEEQIRDIAEWLLEYHSGNTGLSTDSLMEAGYPGASVLGDAVCGMAAVSITSRDFLFWFRSHTAKEIKWGGAKHDPDDRDDLRKMHPRSSFKAFLEVVKWGSMPWEDVEMDAI

SEQ ID NO: 5700 - protein, 113 aa, Wigglesworthia glossinidia endosymbiont of Glossina brevipalpis
MKDNIFTKIINNEYPAEILYKNKYVTAFRDINPKAPIHIIIVTNDVIRTVNDIKEQHATMLGHLFIASAKIAKKEKINHAGYRLIVNCNKDGGQEIYHLHMHLLGGKNLGCIL

SEQ ID NO: 5701 - protein, 435 aa, Wigglesworthia glossinidia endosymbiont of Glossina brevipalpis
MNKNKNLKKIIIVGGGAGGLELVTKLGNNLGKKKLAKIILVDNNYIHLWKPWLHKFASGSLNEGTNYISYISHARSNYFEFCIGKMIGIDRNRKIIILDDIFDENGKQVLCKREINYDILVISVGSKSNYFNIPGVKENCNFIDNIYQAKKFHKKMFNLFLKISIKPDENKKSNISIVGGGATGVELSAELINSIEELYKYGFQGLNKNLIEITLIEMGERILSSLPKRISNIVDSELKKIGIKIITNTAIIKCDANGLFTNNGSYIESDIMVWAAGIKSQKFNSSIDLETNNINQFIVKKTLQTTLDEKIFAIGDCSCFLLKTGEYVPPRAQAAHQMARCVYLNILFLIKNKKLNDYVYKDYGSLISLSKFKTVGSFMGNMTKNSIFIEGIIAKLAYVMLYRMHQISVNGCLKTSLMILSTGIENIISPKLKLH

SEQ ID NO: 5702 - protein, 424 aa, Prunus avium
MATLSKFSEDMMGNILSRLPPKSLMRFRCVLKSWHDLIDKPSFVDQHLSTSMDNKVTSSTYVLLKHNVLTDPSIKDDEKAVRATLFNPDSDQRDILLSSINLGSLVDDGLEIENHVVPPPMRGYALSLEIAGSCDGLICLNTFNSEDIVLCNPALEEYRVLPKSCILLPPRVPRQVEENEDDDYYEEDDDDEIESNPKCVGFGYDPNSKDYKVVRAAQFVSGVFTQHPSKVEVYSLAADTWREIPVDIQPHGSLNPSYQMYFKGFFYWIAYWTEERNVILSFDMSEEVFHGIALPESGPDAYEYTSIAVWKDSLVLLTYPVENEAPKTIDLWVLDEDLKGAKGLWTKHLAIGPLEKGVEAPLVFWKDEELLMVTTNGDVVNYSLDTLKLKHVPRHGLGEPTNIQAVPYVNSIVSIKPGNKIESI

SEQ ID NO: 5703 - protein, 392 aa, Heteropterys catingarum
DLEPVNPADVPVTAAGALKSYKLASKAISRLQSLPSGNISLLCDVLVEEVRDLTGYDRVMVYKFHEDDHGEVVSECRRSDLESYLGLHYPATDIPQASRFLFMKNKVRMICDCLAPPVKVIQDERLPQPLSLCGSTLRSPHGWHAQYMTNMGTIASLVMSVTINEDDDMMDGDQQQMTGKLWGLVVCHHTSPRFVPFPLRYACEFLIQVFGVQINKEVELAAQVREKHILQIQTMLCDMLLRDAPVAIITQSPNVMDLVKCDGASLYFKNKTWLLGVTPTEEQIRDIAEWLLEYHSGNTGLSTDSLMEAGYPGASVLGDAVCGMAAVSITSRDFLFWFRSHTAKEIKWGGAKHDPDDKDDLRKMHPRSSFKAFLEVVKWRSMPWEDVEMDAI

SEQ ID NO: 5704 - protein, 392 aa, Heteropterys chrysophylla
DLEPVNPADVPVTAAGALKSYKLASKAISRLQSLLSGNISLLCDVLVKEVRDLTGYDRVMVYKFHEDEHGEVVSGRRRSDLESYLGLHYPATDIPQASRFLFMKNKVRMICDCLAPPVKVIQDERLPQPLSLCGSTLRSPHGCHAQYMTNMGTIASLVMSVTINEDDDMMDGDQQQMTRKLWGLVVCHHTSPRFVPFPLRYACEFLIQVFGVQINKEVELAAQVREKHILQIQTMLCDMLLRDAPVAIITQSPNVMDLVKCDGAALYFKNKTWFLGVTPTEEQIRDIAEWLLEYHSGNTGLSTDSLMEAGYPGASVLGDAVCGMAAVSITSGDFLFWFRSHTAKEIKWGGAKHDPDDKDDLRKMHPRSSFKAFLEVVKWRSMPWEDIEMDAI

SEQ ID NO: 5705 - protein, 1059 aa, Streptococcus suis 89/1591
MPKRTDIKKIMVIGSGPIVIGQAAEFDYAGTQACLALKEEGYSVVLVNSNPATIMTDKEIADKVYIEPITLEFVTRILRKERPDALLPTLGGQTGLNMAMELSKAGILDELGVELLGTKLSAIDQAEDRDLFKQLMEDLNQPIPESTIVTTVDEALEFAAEIGYPVIVRPAFTLGGTGGGMCANEEELREIAENGLKLSPVTQCLIERSIAGFKEIEYEVMRDAADNALVVCNMENFDPVGIHTGDSIVFAPTQTLSDIENQMLRDASLSIIRALKIEGGCNVQLALDSHSFKYYVIEVNPRVSRSSALASKATGYPIAKLAAKIAVGLTLDEMVNPVTGTTYAMFEPALDYVVAKIPRFPFDKFEKGERRLGTQMKATGEVMAIGRNIEESLLKACRSLEIGVYHNEMPELSQVTDDQLVEKIVKAQDDRLFYLSEALRRGYTVEELAQLTKIDLFFLDKLLHILEIEQELATNFDNIDLLKKAKKYGFADRKIAELWGRTESYIRQLRTEHKIVPVYKMVDTCAAEFESATPYFYSTYEWENESIRSEKESVLVLGSGPIRIGQGVEFDYATVHSVKAIQAAGYEAIIMNSNPETVSTDFSVSDKLYFEPLTLEDVLNVIDLEKPKGVIVQFGGQTAINLAEPLAKAGIPILGTQVADLDRAEDRDLFEKALKDLGIPQPPGQTATNEEEALEAARKIGFPVLVRPSYVLGGRAMEIVENEEDLRSYMRTAVKASPEHPVLVDSYIVGRECEVDAISDGKDVLIPGIMEHIERAGVHSGDSMAVYPPQTLSKEVQATIADYTKRLAIGLDCIGMMNIQFVIKDETVYVIEVNPRASRTVPFLSKVTDIPMAQVATKLILGQSLAELGYQDGLYPESNQVHVKAPVFSFTKLAKVDSLLGPEMKSTGEIMGSDLTLEKALYKAFEASYQHLAEFGNVVFTIADEDKEEVLGLAQRFYELGYGLLATAGTAAFLTENGLAVTTVGKLGDDSRPDIPSLVRAGKVQAIINTVGKKRVADGDGQVIRSSAIEGGIPLFTALDTAEAMVKVLESRSFMTQAI

SEQ ID NO: 5706 - protein, 416 aa, Prunus avium
MTYFCKMTEEMEVQILARLPPKSLMRFKCVCNSWHALLKNPHFVAKHLHLYNYQPSSTCILFKRSVLSRTEHNKEELVFTFLNLHNDNESNADHNLINCNVEDLHFPHSMGLKSRGPFIELPGLELGESVHIVGHCDGLFCLSLYTGELVFYNPAIKEFRVLPQSCLENAFSCTLGFGYDPKRKDYILLSVVSYGEEILDDERLVIHPPQAEIYTLSTNSWRGIETHYLETETTYFWGNETFSTYFNGVFYWLGYEEKKDFVSFYDRLEEEKTQVIILFDTFDEVFHNMPLPDCFYEFPTHEMSLTVWNESIALFGFYRCEFETFEVWVMDEFDGWTKHLSVVPKVDQEVDIPLALWRNEVLLVDRDGRIFSYNLDTENLKYLPVHGVSRGDFQAVVCVNSIVSVKCDNKFETKDY

SEQ ID NO: 5707 - protein, 392 aa, Heteropterys lindleyana
DLEPVNPADVPVTAAGALKSYKLASKAISRLQSLPSGNISLLCDVLVKEVRDLTGYDRVMVYKFHEDDHGEVVSECRRSDLESYLGLHYPATDIPQASRFLFMKNKVRMICDCLAPPVKVIQDEGLPQPLSLCGSTLRSPHGCHAQYMTNMGTIASLVMSVTINEDDDMMDGDQQQMTRKLWGLVVCHHTSPRFVPFPLRYACEFLIQVFGVQINKEVELAAQVREKHILQIQTMLCDMLLRDAPVAIITQSPNVMDLVKCDGASLYFKNKTWLLGVTPTEEQIRDIAEWLLEYHSGNTGLSTDSLMEAGYPGASVLGDAVCGMAAVSITSRDFLFWFRSHTAKEIKWGGAKHDPDDKDDLRKMHPRSSFKAFLEVVKWRSMPWEDVEMDAI

SEQ ID NO: 5708 - protein, 410 aa, Prunus mume
MWEEMALRHILPRLPSKSLMRFRCVRKSWYILINNPTFVENHLSNSMQSKLSTCVLFSRFVQSDANSDEKELAFSFLYLRNDYDDDEHNVNFVVEDIKFPLSSGRFIGLEDVESPSILGHCNGIVCLSPCSDNLVLCNPAIKEIKLLPKSGLPDWWGCAVGFGYDPKSKDYKVSRIASYQAEIDGLIPPPRVEIYSLSTDSWREIKNNSLETDTTCFFPDYFQMYFQGFCYWVGYEQPKQSVEYEDEEQKPMVIFFDTGDEIFHHILLPDNFYMYEEGSSYAYEMSYIMYTDLRIILWNGSIALFGFNRFSVFPDSYGVWVLDDFDGAKGSWTKHLTFEPLMGIKRVLEFWKSDEILMVTEEDGSIVSYNLETETLKNVPMNSPSDFETILYVNSLVPITGGNKLGSVDM

SEQ ID NO: 5709 - protein, 296 aa, Crocosphaera watsonii WH 8501
MSEQTFGKVITAMVTPFDQQGNVNYEMAEKLAVHLVNNGSDSLLVSGTTGESPTLSWSEKCQLFKVVKKAVGNKAKVLAGTGGNSTQHAIEMTQEVAKMGLDGSLQVVPYYNKPPQEGLYEHFKKIAETVGNFPIMLYNIPGRTGTNMSPETTAKLAKIDNIVAIKEASGNLEQACKIRRMTDSSFLIYAGDDFLTLPLLTVGGVGVVSVASHLVGLQMQEMIAAYNQQQGSQASQINVKLFPLFKVLFCTSNPLPIKAALNLQGWDVGGVRLPLVSISEKLKQEVKLVLEELSLL

SEQ ID NO: 5710 - protein, 392 aa, Heteropterys megaptera
DLEPVIPADVPVTAAGALKSYKLASKAISRLQSLPSGNISLLCDVLVKEVRDLTGYDRVMVYKFHEDEHGEVVSECRRSDLESYLGLHYPATDIPQASRFLFMKNKVRMICDCLAPPVKVIQDERLPQPLSLCGSTLRSPHGCHAQYMTNMGTIASLVMSVTINEDDDMMDGDQQQMTRKLWGLVVCHHTSPRFVPFPLRYACEFLIQVFGVQINKEVELVAQVREKHILQIQTMLCDMLLRDAPVAIITQSPNVMDLVKCDGAALYFKNKTWLLGVTPTEEQIRDIAEWLLEYHSGNTGLSTDSLMEAGYPGASVLGDAVCGMAAVSITSRDFLFWFRSHTAKEIKWGGAKHDPDDKDDLRKMHPRSSFKAFLEVVKWRSMPWEDMEMDAI

SEQ ID NO: 5711 - protein, 429 aa, Prunus mume
MMREMATLSKFSEDMMGNILSRLPPKSLMRFRCVLKSWHDLIDKPSFVDHHLSISMDNKVTSSTYVLLKHNVLTDPSIKDDEKAVRATLFNPDSNQRDILLSSLNLGSLVDDGLEIENHVVPQPMRGYALSLEISGSCDGLICLNTFNSEDIVLCNPALEEYRVLPKSCILLPPRVPRQFEENEDDDYYEEDEDDEIESNPKCVGFGYDPNSKDYKVVRAAQFVSGVFTQHPSKVEVYSLAADTWREVPVDIQPHGSLNPSYQMYFKGFFYWIAYWTEERNVILSFDMSEEVFHDIALPESGPDAYEYTSIAVWKDSLVLLTYPVENEAPKTLDLWVLDEDLKGATKGLWKKHLAIGPLEKGVEAPLVFWKDEELLMVTTNGDVVNYSLDTQKLKHVPRHGLGEPTNIQAVPYVNSIVSIKPGNKIESI

SEQ ID NO: 5712 - protein, 142 aa, marine gamma proteobacterium HTCC2143
MAIERTFSIVKPDAVAKNVIGKIYSRFEEAGLCLVASKMLQLSRGQAEGFYAEHKGRPFFPALIEFMTSGPVMVQVLEGESAISKNRELMGATNPKEAEAGTIRADFADSIDANAVHGSDSAESAAREIAYFFSTCDLCGRA

SEQ ID NO: 5713 - protein, 407 aa, Prunus mume
MTYFYKMTEEMEVQILARLPPKSLMRFKCVCKSWHALLNNPHFVAKHLHLYNNQPSSTCVLFKRSVLSRTEHNKEELVFTFLILRNDNESNADHNLINCNVEDLHFPRSMGLKSRGQFIELPGLELGESVHIVGHCDGLFCLSLYTGELVFYNPAIKEFRVLPQSCLEDACSCTLGFGYDPKRKDYVLLSIVSYGEEIFDDERLVIHPPQAEIYTLSTNSWREIETHYLETETTYFWGNETFSAYFNGVFYWLGYEEKKEFVSFYDRLEEEKKQVIILFDTFDEVFHNMPLPDCFYEFPSHEMSLTVWNESIALFGFYRCEFEPFEVWVMDEFDGWTKHLSVVPKVDQEVDIPLAIWRRNEVLLVDRDGRIFSYNFDTENLKYLPVHGASRGDFQAVVCVNSIVSVK

SEQ ID NO: 5714 - protein, 255 aa, Methanococcus maripaludis S2
MLVMAGLGLYDERDVTLKTLDFAKKVDKIYAEFYTAILTGTTMEKIEGTLQKPITVLDREKVEYETNKLIDEAKDKDIMFLTAGDPMVATTHVDIAVEARKKGIEVVIINAPSIYSAIGITGLQLYKFGKTTSIVFPEPNYFPETPYDVIKDNLKLGYHTLCLLDIQADKERFMTANEGLDALLKIEEKRKENVISEETEVAVVARAGSINPGLYYGKIKDLLNYDFKSPLHCVIIPGKLHFMEEDALKYLFENI

SEQ ID NO: 5715 - protein, 221 aa, Polaromonas sp. JS666
MFNNIDAVLFDLDGTLIDSAPDLGAAADKMRTDRGLASLPLSQYRPMAGAGARGMIGVAFGLTPDDAGFPALREEFFANYEACMTERTYAFDGVAELIAKIDQAGLKWGVVTNKSARFTLPLTQAMPLFGTAQAIVSGDTTPHAKPHPAPLLEAARRLKVAPARCIYVGDDERDMVAGRAAGMPTVAAAYGYLGATADMQGWFADATITKPALLLNLLRMP

SEQ ID NO: 5716 - protein, 287 aa, Acinetobacter sp. ADP1
MNKMNNNILKKNDLSSQEESTHEIQDVLDQLDFYTYKIALFLDIDGTLADFKIDPLACFISKKILKSIQDIQSKGCLVSVITGRDYNSAQKLLADVSLPIAALHGLDIHINEKTQLNAINQNNQIFIQNFLCRLKEEIKYQPDLSIENKHHSIALHYRKNPDLYDIAKHIMNTVKKDNDEFKVIEGKYVFELIPKNSNKGSAIKTLLSYFDAEHYLSIFIGDDITDEDGFNMVNQLEGISIKVGSGKTVARFRLKNIEHVEEFLNLLSHHFPDSSTQITKKYGEQHV

SEQ ID NO: 5717 - protein, 259 aa, Zea mays
MKTLCPKPGKGGKIHPSPAEDPTAAAFRLLPAAILVLVAGLCPEDQRVLAHLVTRSFLLGWDTITAPPPEQARGGPRRRRGHPPTVGCLCFQCYGSFWSRWDCSPQHDRIHAVLDAFEEHLNAAESAAAATATPPSSKRRDKGKRSRAPAATTPPPQPPTRGSPESQEPPSEVAHEPSAPLLPSCPCTPPPPAPAACLSENKENVPEETGAEAKAEQCGGEVAAEADEERKRGWADVMGGVLNLRRWGIWSPAVESGAT

SEQ ID NO: 5718 - protein, 471 aa, Polaromonas sp. JS666
MAKTVADVMKMVKENEVKFVDFRFTDTRGKEQHVTVPVSHFDEDKFTSGHAFDGSSIAGWKGIEASDMQLMPDPNTANIDPFFEETTLFMSCDVLEPSDGKSYDRDPRSIAKRAESYLKASGLGDTAYFGPEPEFFIFDDVRWNTDMSGTFFKIEEYEAPWNSGSKLEGGNRGHRPTVKGGYFPVPPVDSTQDMRAEMALILESLGIPVEVFHHEVAGAGQNEIGTRFSTLVQRADWTQILKYVVQNVANAYGKTATFMPKPIVGDNGSGMHVHQSIWKDGKNLFAGDGYAGLSDFALYYIGGIIKHARALNAITNPGTNSYKRLVPGYEAPVKLAYSAKNRSASIRIPYVANPKGRRIEARFPDPLANPYLCFSALMMAGLDGVENKIHPGEAATKDLYHLPPEEDAKVPTVCHSLDQALDCLNADRGFLTKGGVFTDSMLDAYIELKMGEVTRLRMATHPIEFEMYYSL

SEQ ID NO: 5719 - protein, 297 aa, Zea mays
  misc_feature (39)..(39): Xaa can be any naturally occurring amino acid
MSGHGDTATSAKMAKLKELLQKSENHICADCGASDPKWXVLSVTLDKWSDSEVDSMIEVGGNSQANAIYEAFIPEGYQKPHSDSTQEEREKFIRSKYELQEFLKPSLRIVSHQPSDSGKHAGNASHSDGSKSQVGMIEFIGILNVKVIGGTNLAIRDMSSSDPYVVLTLGQQKAQTSVINGNLNPVWNEELKLSVPQQYGPLKLQVFDHDMVSKDDLMGEAEIDLQTMINAAAAFGDPELLGNIQIGRWLKSEDNALVRDSAVVVSGGKVKQGMALKLQHTESGELELEMEWMPLNV

SEQ ID NO: 5720 - protein, 186 aa, Yarrowia lipolytica CLIB122
MAVLWCPVLSFLFPLILLPYLLAFPHIQQLVDVSNSPAPLDKKPIHHTPLTVIPTLLSSHHTQHTPPSTEMADPSAMEVDTPVEQVEEVIEKPKKSAKKRLEVKKWSAVAFWSWDIQVETCAICKNHIMEPCIDCQANASGTQADCNVAWGKCNHAFHFHCINRWLKSRNTCPLDSKDWEFTRYGQ

SEQ ID NO: 5721 - protein, 392 aa, Heteropterys nitida
DLEPVNPADVPVTAAGALKSYKLASKAISRLQSLLSGNISLLCDVLVKEVRDLTGYDRVMVYKFHEDEHGEVVSECRRSDLESYLGLHYPATDIPQASRFLFMKNKVRMICDCLAPPVKVIQDERLPQPLSLCGSTLRSPHGCHAQYMTNMGTIASLVMSVTINEDDDMMDGDQQQMTRKLWGLVVCHHTSPRFVPFPLRYACEFLIQVFGVQINKEVELAAQVREKHILQIQTMLCDMLLRDAPVAIITQSPNVMDLVRCDGAALYFKNKTWFLGMTPTEEQIRDIAEWLLEYHSGNTGLSTDSLMEAGYPGASVLGDAVCGMAAVSITSRDFLFWFRSHTAKEIKWGGAKHDPDDKDDLRKMHPRSSFKAFLEVVKWRSMPWEDVEMDAI

SEQ ID NO: 5722 - protein, 320 aa, Schizosaccharomyces pombe 972h-
MSEKQTIKALPAHNPTQVKKLGPVSGFLSGGLAACGAVTLTNPFEVIKTRFQLQGQLTKLDPSKRIYKSVGQAFSLIARHEGIRGLQRGLGTAYVYQICLNGCRLGFYEPIRRTLNTWFLDDPKGNKLAINVASGAGSGLCGALFGSPFFLVKTRMQSYSPKFPVGQQYGYKHIFNAFSRIIKENGVKGLFVGADAAILRTVSGSSVQLPIYNWAKRMIEHYNLLEEGMIKHLTASAVSGFGVCCTMQIFDTVMTRMYNQKNKELYKNPIDCILKTIRSEGFFALYKGFGAHLARIAPHTIFCLTFVEQTNKLFLKFQKD

SEQ ID NO: 5723 - protein, 479 aa, Gibberella zeae PH-1
MSSLATKQQSLKIFEKLKTKPANKICFDCGQKNPTWTSVPFGIYLCLDCSSNHRNLGVHISFVRSTNLDQWQWDQLRVMKVGGNESATKFFQQNGGTAALNSKDPKTKYQSNAATKYKDELKRRAARDAQDYPTEVIITDAIDDGSATPAGEPDDDFFSSWDKPAIKRPTPPVSRTGTPPVVGRTPSPFLNSGNGKDIARTASPLSRTSTGENKPASRITTSAALRKTPASTGPRKANVLGAKKTTKLGAKKVTADIIDFDEAERKAKEEADRIAKLGYDPDAEEDPATKNSGSAAAIISPTPVAPSRGSASSHTRQKSDAEVERLGMGMNRLGFGQVGGPKAAASSAPKRNAGGFGSVGPVRAQDVDDSERYAREKFGTQKGISSDEFFGKGAFDPSQQSEAKTRLQGFEGATAISSNAYFGRPEDEPEEEYGDLESAAKDFVRKFGITAGDDLENLTQMAGEVSTRLQGAIRSYLGN

SEQ ID NO: 5724 - protein, 392 aa, Heteropterys pauciflora
DLEPVNPADVPVTAAGALKSYKLASKAISRLQSLPSGNISLLCDVLVKEVRDLTGYDRVMVYKFHEDEHGEVVSECRRSDLESYLGLHYPATDIPQASRFLFMKNKVRMICDCLAPPVKVIQDERLPQPLSLCGSTLRSPHGCHAQYMTNMGTIASLVMSVTINEDDDMMDGDQQQMTRKLWGLVVCHHTSPRFVPFPLRYACEFLIQVFGVQINKEVELAAQVREKHILQIQTVLCDMLLRDAPVTIITQSPNVMDLVKCDGAALYFKNKTWLLGVTPTEGQIRDIAEWLLEYHSGNTGLSTDSLMEAGYPGATVLGDAVCGMAAVSITSRDFLFWFRSHTAKEIKWGGAKHDPDDKDDLRKMHPRSSFKAFLEVVKWRSMPWEDVEMDAI

SEQ ID NO: 5725 - protein, 493 aa, Schizosaccharomyces pombe 972h-
MAPQFKRPELFGFDKSHAQSFVQGKWISSPNNKTFEVDNPATGEIIGKVADVSVEETKKAISAANEAFKTYKNFTHVQRSQLLERWAELIMENKDDLVKMLTLENGKPLSQAEMEVTTCSGYLKWYAAEAVRTFGDVAPSSLQSQNFLISIKQPVGVSALITPWNFPAAMIARKGGAALAAGCTAIFLPAFRTPYVCLGLVRLAQEAGFPDGVLNVITSSDASAHGKELTTNPIVRKVSFTGSTNVGKILMGQSASTIKKVSMELGGNAPFIVFPDFPIDQAVESFCTIKFNSCGQVCVCPNRVYVHKNVYDEFVSKLTEKVKTIKVGDGFDSSSAVGPLISQDGCKKVSKHIEDAVSKGAKITVGGKEISSSKGYFFEPTVLSGVTQDMLVASEETFGPLASVFKFDDTEEVIEWANDSDVGLAGYVFTNNLSTMIHVAKELEVGLVGANIEMVDEPFISFGGIKQSGFGKEAGRLGVQEFMVVKEINLKTL

SEQ ID NO: 5726 - protein, 392 aa, Heteropterys rhopalifolia
DLEPVNPADVPVTAAGALKSYKLASKAIARLQSLPSGNISLLCDVLVKEVRDLTGYDRVMVYKFHEDEHGEVVSECRRSDLESYLGLHYPATDIPQASRFLFMKNKVRMICDCLAPPVKVIQDERLPQPLSLCGSTLRSPHGCHAQYMTNMGTIASLDMSVTINEDDDMMDGDQQQMTRKLWGLVVCHHTSPRFVPFPLRYACEFLIQVFGVQINKEVELAAQVREKHILQIQTMLCDMLLRDAPVAIISQSPNVMDLVKCDGAALYFKNKTWLLGVTPTEEQIRDIAEWLLEYHSGNTGLSTDSLMEAGYPGASVLGDAVCGMAAVSITSRDFLFWFRSHTAKEIKWGGAKHHPDDKDDLRKMHPRSSFKAFLEVVKWRSMPWEDVEMDAI

SEQ ID NO: 5727 - protein, 392 aa, Heteropterys sanctorum
DLEPVNPADVPVTAAGALKSYKLASKAISRLQSLPSGNISLLCDVLVKEVRDLTGYDRVMVYKFHEDDHGEVVSECRRSDLESYLGLHYPATDIPQASRFLFMKNKVRMICDCLAPPVKVIQDERLPQPLSLCGSTLRSPHGCHAQYMTNMGTIASLVMSVTINDDDDMMDGDQQQMTRKLWGLVVCHHTSPRFVPFPLRYACEFLIQVFGAQINKEVELATQVREKHILQIQTMLCDMLLRDAPAAIITQSPNVMDLVKCDGASLYFKNKTWLLGVTPTEEQIRDIAEWLLEYHSGNTGLSTDSLMEAGYPGASVLGDAVCGMAAVSITSRDFLFWFRSHTAKEIKWGGAKHDPDDKDDLRKMHPRSSFKAFLEVVKWRSMPWEDVEMDAI

SEQ ID NO: 5728 - protein, 392 aa, Heteropterys sericea
DLEPVNPADVPVTAAGALKSYKLASKAISRLQSLLSGNISLLCDVLVKEVRDLAGYDRVMVYKFHEDEHGEVVSECRRSDLESYLGLHYPATDIPQASRFLFMKDKVRMICDCLAPPVKVIQDERLPQPLSLCGSTLRSPHGCHAQYMTNMGTIASLVMSVTINEDDDMMDGDQQQMTRKLWGLVVCHHTSPRFVPFPLRYACEFLIQVFGVQINKEVELAAQVREKHILQIQTMLCDMLLRDAPVAIITQSPNVMDLVKCDGAALYFKNKTWFLGMTPTEEQIRDIAEWLLEYHSGNTGLSTDSLMEAGYPGASVLGDAVCGMAAVSITSRDFLFWFRSHTAKEIKWGGAKHDPDDKDDIRKMHPRSSFKAFLEVVKWRSMPWEDVEMDAI

SEQ ID NO: 5729 - protein, 347 aa, Sulfolobus solfataricus
MRAVRLVEIGKPLSLQEIGVPKPKGPQVLIKVEAAGVCHSDVHMRQGRFGNLRIVEDLGVKLPVTLGHEIAGKIEEVGDEVVGYSKGDLVAVNPWQGEGNCYYCRIGEEHLCDSPRWLGINFDGAYAEYVIVPHYKYMYKLRRLNAVEAAPLTCSGITTYRAVRKASLDPTKTLLVVGAGGGLGTMAVQIAKAVSGATIIGVDVREEAVEAAKRAGADYVINASMQDPLAEIRRITESKGVDAVIDLNYSEKTLSVYPKALAKQGKYVMVGLFGADLHYHAPLITLSEIQFVGSLVGNQSDFLGIMRLAEAGKVKPMITKTMKLEEANEAIDNLENFKAIGRQVLIP

SEQ ID NO: 5730 - protein, 335 aa, Arabidopsis thaliana
MRLRGKDHNEKSTICAYFAYRGAKRWIYLNQQRRGMGFRGLHSSLSNRLSAGNAPDVSLDNSVTDEQVRDSSDSVAAKLCTKPLKLVSGSCYLPHPDKEATGGEDAHFICAEEQALGVADGVGGWAELGIDAGYYSRELMSNSVNAIQDEPKGSIDPARVLEKAHTCTKSQGSSTACIIALTNQGLHAINLGDSGFMVVREGHTVFRSPVQQHDFNFTYQLESGRNGDLPSSGQVFTVAVAPGDVIIAGTDGLFDNLYNNEITAIVVHAVRANIDPQVTAQKIAALARQRAQDKNRQTPFSTAAQDAGFRYYGGKLDDITVVVSYVAASKEEGKH

SEQ ID NO: 5731 - protein, 500 aa, Crocosphaera watsonii WH 8501
MCGIAGIWGQTEQTNVEAMMKSIIHRGPDAKGIFTVPNGSGILGHQRLSIMDVDGGDQPIYSKANTQAIIGNGEIYNYPKLQPELAKKYKFLTKSDTEAVLHLYEEKNTTAVGELDGMFAFAIIDDNKFIAARDPIGIKPLYYSEKDGNFWFASELKAITQFCENVEEFPPGHFFSSETGFSQYYSLPDIPPELDANVDELLQEIRETVEASVVKRLMSDVPLGAFLSGGLDSSIIAAIAKKHKSELHTFSVGIAGSKDINAARLVSDYLGTIHHEYIITPEEAIAKLPEIIYYLESFDQDLVRSGIPCYFTSRLASEYVKVILTGEGADELFAGYTYYKDIPSDDTLHRELRRSVNSLHNINLQRVDRLTMAHSIEGRVPFLDLKMIELGQKVPAHLKLKGTPPVEKWILRKAFEDILPEEIVWRKKEQFDEGSGTVDLLTETLKDVMNEQQAQQYQKEHPDIKLRSAEECYYHQIFMKAFDNPDALLTNVARWAETRF

SEQ ID NO: 5732 - protein, 896 aa, Xylella fastidiosa Temecula1
MNRLKEALHNDPNPLETQEWLESIKAVIDIAGPERAHQLLEGVAEQIHRTGTNLPFSPITEYVNTIPTADEAKNPGDPALERSIRSIIRWNAMATVVRANRKPGDLGGHIASFASSATLYDVGFNHFWRAPSPQHPGDLLYIQGHSSPGIYARAFLEGRISESQLDHFRMEVDGKGISSYPHPWLMPQFWQTPTVSMGLGPLSAIYQAQFMKYLEHRGLIAPSDRKVWCFIGDGESDEPETLGAIALAGREGLDNLIFVVNCNLQRLDGPVRGNGKIIQELEGVFRGGGWNVIKLLWGAHWDPLLAQDTQGVLRKLMMETVDGEYQNCKAFGGEYTRKHFFDKYPETAAMVAHLSDNDIWRLNRGGHDPHKIYAAYHRAVNTQGMPTVILAKTVKGYGMGTAGESLNPTHQTKKLDHDAIKHFRDRFNIPISDQQLDAADQIPFYHPGPDSPEIKYMLARREALGGFLPQRRTKSSKSFIVPGLDKYERLLTSSGERTYSTTMAFVQSLNITLRDKALGPHIVPIVADEARTFGMEGLFRQIGIYAPFGQKYKPVDADQLMYYREDESGQVLQQGITEPGAIASWMAAGTSYSVSDVPMLPFYIYYSMFGFQRIGDIAWQAADMRTRGFLLGGTAGRTTLNGEGLQHEDGHSHLMAGAIPNVRSYDPTFGYEVTVILQHGMKAMMQDQIDEYYYLTLMNENYAHPDMPAGAEQGIIKGMYLLKDAGKPKKGELRVQLLGSGTILREAIAAAELLHQDFGITADIWSCPSFSELRKDGFDAERWNRLHPDNQPRTPYVTQQLENRQGPAIAATDYVRLFADQIRAFVPMHYTVLGTDGFGRSDTRSNLRRFFEVDRYFIAHAAIAALAKEGKMTGKDVARAIEQYNINPEKLNPVDT

SEQ ID NO: 5733 - protein, 230 aa, Methanococcus maripaludis S2
MEKIRVKEIFDNVYSVDFGDGLKRIATKSLVPGKRVYGEKLVYSDSIEYRIWNPNKSKLGAAIINGLKKMPIKKGEKVLYLGASAGTTPSHVADIAENSLVYALEFAPRIMREFIDSCNERKNLIPVLGDANRPQDYSNIVEKVDVIFEDVAQPNQAEILVKNAKWFLKENGYAMISIKARSVDVTKNPREIFAEQKKILIEGGFEIVDEVNIEPFEKDHMMMVGIWKGN

SEQ ID NO: 5734 - protein, 103 aa, Nicotiana tabacum
MSGRGKGGKGLGKGGAKRHRKVLRDNIQGITKPAIRRLARRGGVKRISGLIYEETRGVLKIFLENVIRDAVTYTEHARRKTVTAMDVVYSLKRQGRTLYGFGG

SEQ ID NO: 5735 - protein, 375 aa, Rhizobium leguminosarum bv. viciae 3841
MAKADFYETLGVAKSADEKELKSAFRKLAMKYHPDKNPDDKDAERKFKEINEAYEMLKDPQKRAAYDRYGHAAFEHGGMGGGGGGFAGGGFSDIFEDIFGEMMGGGRARQRSSGGRERGADLRYNMEITLEESFSGKTAQIRVPTSITCDVCSGSGAKPGTQPKNCGTCQGTGRVRAAQGFFSIERTCPTCHGRGQIIPDPCPKCHGQGRVTEERSLSVNIPAGIEDGTRIRLQGEGEAGARGGPAGDLYIFLSVKPHEFYQRDGADLYCAVPISMTTAALGGTFDVATLDGTKSRVTVPEGTQVGKQFRLKGKGMPVLRSVQTGDLYIQIQIETPQKLTKRQRELLQEFEQLSSKENNPESTGFFARMKEFFEG

SEQ ID NO: 5736 - protein, 377 aa, Zea mays
MADGEDIQPLVCDNGTGMVKAGFAGDDAPRAVFPSIVGRPRHTGVMVGMGQKDAYVGDEAQSKRGILTLKYPIEHGIVSNWDDMEKIWHHTFYNELRVAPEEHPVLLTEAPLNPKANREKMTQIMFETFNVPAMYVAIQAVLSLYASGRTTGIVLDSGDGVSHTVPIYEGYALPHAILRLDLAGRDLTDSLMKILTERGYSFTTTAEREIVRDIKEKLAYVALDYDQELENAKSSSSVEKSYELPDGQVITIGAERFRCPEVLFQPSFIGMEAPGIHETTYNSIMKCDVDIRKDLYGNIVLSGGTTMFPGIADRMSKEITALAPSSMKIKVVAPPERKYSVWIGGSILASLSTFQQMWISKAEYDESGPAIVHRKCF

SEQ ID NO: 5737 - protein, 507 aa, Candida albicans
MRSYKSSITDENELTKQRLRAKSIANLSSNHATAGQTSTSSQHREALTDLTSQENKNHPRVKLTQTNTNHHRNSSSSSNKIQIYQQIEQKKTDIHQFKKPRLEKVLLNDDDDETDDEFDDEEDKENRYHDLELNDDDSKHQLISEAFETIDDRGISEGENDTAQEARERLEEETQSHTQDMRSIYGVHVPMQPMWNNAIINELKYVIQKYSRNTLDENDEDTYDTTMVAEYSPEIFNYLHELENKFTPDPNYMDFQDDLKWEMRAVLIDWVVQVHARFNLFSETLYLTVNYIDRFLSKRRVSLSRFQLVGAVALFIAAKYEEINCPTVQEIAYMADNAYSIDEFLKAERFMIDVLEFDLGWPGPMSFLRRISKADDYDYETRTLAKYFLEITIMDSKFVASPPSWLAAGAHYISRILLGRGEWTELHVFYSGYTEKQLQPLADVLLENCRHAEINHKAIFEKYKERRYRKSSLFVQEYFRHIMSRVDLKTSFQQCGTLHFIQSSQNH

SEQ ID NO: 5738 - protein, 470 aa, Zea mays
  misc_feature (248)..(248): Xaa can be any naturally occurring amino acid
MDPGNKRAGNGDYPVPSGLTSNPVMNGAVVYHSSEPLPAFKDVPASEKQNLFVKKVNLCCAVYDFADPTKNLKEKEVKRQTLMELVDYITSANGKFSEVVMLEITKMVSINLFRSSSPTPRENKAIEGVDLEEDEPLMDPAWSHLQIVYEVFLRFVASQETDAKLAKRYIDHSFILRLLDLFDSEDPRERDYLKTILHRIYGKFMVHRPFIRKAINNIFYRFIFETEKHNGVAELLEILGSIINGFAXPLKEEHKLFLVRALIPLHKPKCVSMYHQQLSYCITQFVEKDCKLADTVIRGLLKYWPVTNSSKEVMFLGELEEVLEATQLAEFQRCMVPLFRQIARSMNSSHFQVAERALFLWNNDHIENLIKQNYKVLLPIIYPALERNSRDHWNQAVRSLTLNVRKIFSDHDSAFFGECVQRFSDEELKQEESDSKREALWMRLEEMAALKPRENSPLGAPNGKPSQAAG

SEQ ID NO: 5739 - protein, 330 aa, Ralstonia metallidurans CH34
MTNATLPLHELARESRMGAHGSETDTREIRCIDLSDFDTRKPEITDQLWRAATDIGFFQLRHHGIDLPAIRQAFAMAEQFFALPETVKARYPLQKANNAGWESRAQVRPSTGTPDQKESYQITRPHMAPLWPSETELPGFRQTMLEFEAQCWNVGMKVLSCFADRLGFDTDFFSRAHDPAAPDYQSTLRLLHYYAIPPEAQDKLDLWRAGAHTDFDCLTLLFQREGQGGLQVCPGKEMDAQAWTPIAPIEDVVTCNIGDMLMRWSDDHLPSNFHRVRNPAPGEYMGPRYSLAFFCQANRDAVIEGPSKRYPAITAGDFLRQRVAANFKAY

SEQ ID NO: 5740 - protein, 266 aa, Triticum aestivum
AYLGDTIEQVCTKKQAGTGPEFPGYRRPTRPLTRRAWEKDVQVMNEGPGHIPMHKIPENMEKQLEWCNEAPFYTLGPLTTDIAPGYDHITSAIGAANIGALGTALLCYVTPKEHLGLPNRDDVKTGVISYKIAAHAADLAKRHPYAQAWDDALSKARFEFRWLDQFALSLDPVTAMSFHDETLPSDGAKVAHFCSMCGPKFCSMKITEDIRKYADEHGYGTVEEAVRQGMSEMSAEFLAARKTISGEQHGEAGGEIYVPESYVVQK

SEQ ID NO: 5741 - protein, 125 aa, Glycine max
MAALTVGHCCCSKRVPSSHHEFTNRSRSPRIFILSSCHGRTPDPKEKKDDHKMGEGKLSLLKWKMLNDIEKVGKRVKQNLSPQQKQKGDWKDLLLMSISFAVYVYISQMLVCAYFAWTSMPKPIW

SEQ ID NO: 5742 - protein, 442 aa, Oryza sativa
  misc_feature (359)..(359): Xaa can be any naturally occurring amino acid
MASPAKAQRRPEGASVLETLPALPLAIIIAKAGPRCAAALACASSTLRAAASGEALWRHFCSDDFALDAPLAPGDLPLPSFKDAYKAWFQSFGMYPLPLVKRVKIFWSSFRAWLCEYFPEGLRTLGEGVSEAEIAVAECNLGLVLPMPTKLLYRFCNGQLHIGRGEEVSYGVMGGYDYVHQRYTVRLLPLAHHAVQKNSNYIVVATSCFGEKIFLLDCASGRLYVGTKYWNEEREIMACVPKATIRLAVDDDHGMPQDGFLLWLEEHLSRLQDGLIKVQSCKFPMLARHISLYPVQLPYCSSASMHGIKVRASAVFAPENSAFADYRCRYSYYFSIRLSLPEAFVVDGKWYSSFQLQLXHYTIQIGDEVLPYTCNYGGHGKCPLLRCGEELFVYGCSISAALEPGSVMGNLTLVPWRCGQPRGSPFIADIAPFPLHPPDYIF

SEQ ID NO: 5743 - protein, 138 aa, Yarrowia lipolytica CLIB122
MSGIFLYLGAVLLNAGSLFFQVFFVVMYSDLEADFINPIDLCNKLNVYIRPEAGLQLFTSLLLLINFKWFSFLINLPMILFNVRYIFLDWPQYKLDATEIFRTLNKYKKQSFIKLGFYFFLFFYYLYCMIMAIVESEK

SEQ ID NO: 5744 - protein, 664 aa, Erwinia carotovora subsp. atroseptica SCRI1043
MSSRKELANAIRALSMDGVQKAKSGHPGAPMGMADIAEVLWRDYLNHNPANPNWANRDRFVLSNGHASMLIYSLLHLSGYDLPIEELKNFRQMHSKTPGHPEYGYTAGVETTTGPLGQGVANAVGMAIAERTLAAQFNRPGHDIVNHHTYTFLGDGCMMEGISHEVCSLAGTMKLGKLTAFYDDNGISIDGHVEGWFTDDTAARFEAYGWHVVRGVDGHDADAIKRAIGEAQLVTDKPSLLMCKTVIGFGSPNKAGTHDSHGAPLGQAEVAASREQLGWTHAPFDIPADIYAAWDAKPAGQRKEAAWDEAFSAYASAYPELAAEFTRRTGGELPTHWQADAQKFIEDLQANPAKIASRKASQNALEAYGKLLPEFLGGSADLAPSNLTIWSGSVSLDKDHAGNYIHYGVREFGMTAIANGIALHGGFVPYTATFLMFVEYARNAVRMAALMKIRSIYVYTHDSIGLGEDGPTHQPVEQLASLRVTPNMSNWRPADQVETAVAWKYAIERQDGPTSLILSRQNLAQQTRTAEQLANVVKGGYVLKDSDGQPELILIATGSEVELAVGAYDKLTAAGRKVRVVSMPSTDAFDKQDAAYREAVLPKAVSARVAIEAGIADYWFKYVGLNGAIVGMTSFGESAPAELLFEAFGFTVDNVVEKAQALLK

SEQ ID NO: 5745 - protein, 316 aa, Erwinia carotovora subsp. atroseptica SCRI1043
MNQLEALKQFTVVVADSGDIDSIRQFSPQDATTNPSLILKAATLPQYQPLFDDAIAYANLQGGSPETRLINASDRLAVNIGAEVLKSIPGRISTEVDARLSFDRGMCVAKARKLIGMYQEKDIPRSRILIKLAATWEGIRAAEELEKEGINCNLTLLFSFAQARACAEAGVFLISPFVGRIYDWYQEKQPTSDYQAESDPGVISVRDIYDYYKRHRYQTVIMGASFRKVEQILALAGCDRLTISPALLEQLKNSSDPVERQLTPSTEAFHPPSPLSEAEFRWEHHQDAMAVDKLAEGIRLFAADQQKLEALLAAKL

SEQ ID NO: 5746 - protein, 340 aa, Brucella suis 1330
MTLVGNFSPLVLVGDSDRVEAETVGAYLDGWAGHDKVRLATANAIKAILSGAGRLVGRIARGYLPGDPGKLVGVNSDQDQQKSIDVGSHNLFVELLIAAGVASILSEEADLPVAGKADGLVAVAIDPLDGSGNVGLGAPLGTIFSIFPADVEEPFLQPGNRQIAAGYVSYGNSVDLGFSVGEGVIFATLDPVSGQFHITRRNVKLPERTSDLAFNASVQRHLSAGMQAYVNDAFLGKDGPRGRNFNMRWLGAAVGDMHRIMQRGGLFFYVNDSRPGYEKGRLRLVYEANPIAFLAREAGGKATDGSRPILDIVPQTYHERSALVFGVAEELDILGEYFVK

SEQ ID NO: 5747 - protein, 446 aa, Wigglesworthia glossinidia endosymbiont of Glossina brevipalpis
MNKSLEEINNTVPIPDRKDSKLKKLIAFSGPGALVAVGYMDPGNWITSIQGGSLYGYLLLSVILLSSLIAMLLQSMCAKLGIVTGMDLAQSTKNLVGKKISFILWIISELAIIATEIAEVIGSAIALNLLMKIPLIIGVAITVLDVFLLLILLKYGIRTIEALVFVLISTIFCIFLYEVALANPNINSIIYSFIPSKDILTAHVEQGESAFFIALGIVGATVMPHNLYLHSSIVQSRRYNRKDKNALKEAIKYAKIDSNIQLSFSFFINCLILILGSALFFGKNPEDIGRFTQLYDALQDNSMVGTIASSSLATLFALALLFSGQNATITGTLTGQIVMEGFINLKLSIWKRRIITRLIAITPVIICVYFWDGKEDLVEKLLVYTQIFLSLSLPVSMVPLLYLTSSKKIMGKFVNCISASAVGWLSTGVLIILNSQLILETIKSSF

SEQ ID NO: 5748 - protein, 608 aa, Brucella suis 1330
MELRNIAIIAHVDHGKTTLVDELLKQSGSFRENQRVAERMMDSNDIEKERGITILAKATSVVWKNTRINIVDTPGHADFGGEVERILSMVDGAIVLVDAAEGPMPQTKFVVGKALKVGLKPIVAINKIDRPDGRHEEVVNEVFDLFANLDATDEQLDFPILYGSGRNGWMALSPEGPKDQGLAPLFDLVLKHVPAPKVAEGPFRMIGTILGADPFLGRIITGRIHSGSIKPNQAVKVLGQDGSVLENGRISKILAFRGIERQAIDEAHAGDIVAIAGLSKGTVADTFCDPSVSEPLAAQPIDPPTVTMSFIVNDSPYAGTEGDKVTSRVIRDRLLKEAEGNVALKIEESTEKDSFFVSGRGELQLAVLIENMRREGFELGVSRPRVVMKDGENGEKLEPVEEVVIDVDEEYSGTVVQKMSERKAEMVELRPSGGNRVRLVFYAPTRGLIGYQSELLTDTRGTAIMNRLFHDYQPYKGEIVGRNNGVLISNDQGEAVAYALFNLEDRGPMIIEAGVKVYQGMLIGIHSRDNDLEVNVLKGKKLTNIRAAGKDEAVKLTPPIKMTLERALSWIQDDELVEVTPKSIRLRKLYLDPNEHKRFQKSKSSSAA

SEQ ID NO: 5749 - protein, 538 aa, Wigglesworthia glossinidia endosymbiont of Glossina brevipalpis
MIFNKIARAYIIIKIILNYGLDEIIPKKYFIFHFFRKIIFWIPNKNKNIEFSKRLILAIEKLGPIWIKFGQMLSTRNDIFKKDIIKQLQNLQNEVTPFDSKIAIRCIENSMNNKIEKIFNNFNKSPIASASIAQVYTAKLKNGKRVVVKVIRPGIIKKIKSDIKLMLVLAKFLSKIFKYGKNLRLIDIIIEYKKIILNETNLLYEAVHTIQLRRNFKESNMLYIPKVYINYCNENVMISEKINGIKISNIFDLKKNNVNMKLLAERGVKIFFTQVFRDNFFHGDMHPGNIFVSYENPDDPKYIGIDCSIIGRLTKLDKYFLAENFVAFFNRDYRKIAKLHIDSGWVDKKTNVNDLESSIRVVCEPIFEKSLSDIYFGKILLAFFSSTKDFKINIQPQLILLQKTLFYIEGIGKQLYPELNLWKTAKPFLENWIKNETRFLKILSILKENAILLAINFDGKKLFKNSFYEEREKKIKKKEKINILILCKSIFLFLLGTTIILFSLFLFMNENINQILFNILVFTSVILFIFSWKFLNRI

SEQ ID NO: 5750 - protein, 745 aa, Agrobacterium tumefaciens str. C58
MQRERLEKVMSSHTPKLDSCGAEPIHIPGAIQEHGALLVLSAREFSVVQASDNLANYIGVDLPIGAVATEANLPFISVLSAWYSGEESNFRYAWAEKKLDVSAHRSGTLVILEVEKAGVGESAEKLMGELTSLAKYLNSAPSLEDALFRTAQLVSSISGHDRTLIYDFGLDWSGHVVAEAGSGALPSYLGLRFPAGDIPPQARQLYTINRLRMIPDVDYKPVPIRPEVNAETGAVLDMSFSQLRSVSPVHLEYMRNMGTAASMSVSIVVNGALWGLIACHHATPHSVSLAVREACDFAAQLLSMRIAMEQSSQDASRRVELGHIQARLLKGMAAAEKWVDGLLGGEGEREDLLKQVGADGAALVLGDDYELVGNTPSREQVEELILWLGEREIADVFATDNLAGNYPTAAAYASVASGIIAMRVSELHGSWLIWFRPEVIKTVRWGGDPHKTVQESGRIHPRKSFEIWKEQLRNTSFPWSEPELAAARELRGAIIGIVLRKTEEMADLTRELQRTNKELEAFSYSVSHDLRAPFRHIVGFAQLLRERSDALDEKSLHYLQMISEAALGAGRLVDDLLNFSQLGRTQLTLKPVDMQKVVSEVRRSLSHAVSDRQIEWRIGALPVIFGDPTLLRQVWYNLIENAIKYSSREPVSIITISAVETEDDVTYSVEDNGVGFDMAYYNKLFGVFQRLQRVEDFEGTGIGLALVRRIVERHHGLVGAEGTVGEGATFSFTLPVTKVEEEKIA

SEQ ID NO: 5751 - protein, 152 aa, Triticum aestivum
MEYGQQGQHGHGTTGRVDQYGNPVGAGTGGMGTGTGGMGQLGEHGGAGMGGGQFQPAREEHKTGGILHRSGSSSSSSSEDDGMGGRRKKGIKEKIKEKLPGGHKDNQHATATGGGAAYGQQEHTGAGTYGTEGTGEKKGIMDKIKEKLPGQH

SEQ ID NO: 5752 - protein, 318 aa, Glycine max
LEANSLLRHIGSIDSDGLPIGLSSDTIGKKFATQSNARVLKIVVFVHGFQGHHLDLRLVRNQWLLIDPKVEFLMSEANEDKTFGDFREMGHRLAKEVIAFLKSKMDKASRYGSLGDIRLSFVGHSIGNLIIRTAIADSIMEPFLCHLHTYVSVSGPHLGYLYSSNSLFNSGLWFLKKLKGTQCIHQLTFTDDPDFQNTFLYKLCKQKTLEHFRNIILLSSPQDGYVPYHSARIESCQAASRDTSKKGKLFLEMLNACLDQIRANSMQHRVFMRCDVNFDASTQGKNLDSIIGRAAHIEFLDSDIFARFIMWSFPDLFR

SEQ ID NO: 5753 - protein, 579 aa, Xanthomonas oryzae pv. oryzae KACC10331
MRRRRRLRSPQQTSGVACSARHHRRLGAITRTKEEHMLEIYGKPTPINVRNVLWLCDELALDDTLHAYDRTRFATIWLHAANATSWTDSFAVLRWATLAHCVESREVRMSSWLRRKSIDQVTVHEAGRQLVRSLSWPHLIALGIGAIVGTGIYTLIGVGADKAGPAVLLSFVAAGIVCACAALAYAEMATMMPAAGSAYTYSYTALGESIAWVVGWSLVLEYSLVVSTVAVGWSGYFVGFLQWLGASLPHELIAGPHAGGIANLPAVVITFLVAGMLMAGTKESATLNAVLVVLKIIALGVFVAIALPTFKSANLQPFMPYGISKAMGPDGVERGVMAAAAIIFFAFYGFDAISTAAEETKNPGRDLSIGIVGSMIGCTLIYVLVALAAVGAMRFTVFGKSPEPLALILRELGHGKAALVIGAVAIIALPTVLLAFLYGQSRIFFVMSRDGLLPRGLSKVNARTGTPVAITLLTAVLVAALAGVARLDEIAALANAGTLAAFTAVAACLLVLRVREPGRARAFRTPLAWVVGPVAILGCLYLFWSLPSNTQGWFLLWNALGVVVYLAYGRRNSRLNSAG

SEQ ID NO: 5754 - protein, 195 aa, Solibacter usitatus Ellin6076
MRSATIQRDTKETRIGGTLKLEGRGRYEIATGIRFLDHMLELFAKHGGFDLKFQADGDLDVDQHHTVEDAGIVLGQLFAKALGDRKGINRAGYFVLPMDETLAVVAVDLGGRPALVYKDRVKVRLVGDLQTELVHDFFDGFVVHAGANLHAKVLYGRSNHHKLEAIFKCFARAMKYACSKDARLKDQLPSTKGLL

SEQ ID NO: 5755 - protein, 376 aa, Prunus dulcis
MTFIQLKKEILIDILVRLPAKSLVRFLCTCKSWSDSIGSSSFVSTHLHRNVTKHSHVYLLCLHHPNFECAVDPNDPYIEEEVQWSLFSNETFEQCSKLSHPLGSTEHYVIYGSSNGLVYISDEILNFDSPIHIWNPSVRKLRTPPISTNINIKFSCVALQFGFHPVVNDYKAVRMMRTNKGALAVEVYSLKTDCWKMIEAIPPWLKCSWQHHDRTFFNGVAYHIIEKGPIFSIMSFDSGSEEFEEFIAPDAICSPYEACIDVYKEQICLLFEFYDCEEEGMDKIDFWVLQEKRWKQLCPFSYPLGYCYRITGISIDNELLMGRRDFAKGGAELYICNYESKQVLETGIKLGSMTYGEIEFLFSITYIESLVLLINY

SEQ ID NO: 5756 - protein, 126 aa, Solibacter usitatus Ellin6076
MNLDFAKSDGLVTAVIQDHASGRVLMVGYMNQEAFNKTVETGFATFWSRSRKKLWLKGESSGHRLVVKEISTDCDLDAVLVKVEAQGPGVCHEGYESCFFRRLDAGEWKVADNPTYDPGAVYGGKS

SEQ ID NO: 5757 - protein, 324 aa, Neisseria meningitidis MC58
MLENLPYFQRHLPEDLAKVNEVINRAVQSDVALISQIGTYIISAGGKRLRPIMTILAGKAVGYDDEKLYSLAAMVEFIHTSTLLHDDVVDESDLRRGRATANNLFGNAAAVLVGDFLYTRAFQLMVASGSMRVLEVMADATNIIAEGEVMQLMNIGNTDITEEQYIQVIQYKTAKLFEAAAQVGAILGKASPEHERALKDYGMYVGTAFQIIDDVLDYSGETEETGKNVGDDLAEGKPTLPLIYLMRQGSEQVANDVRTALENADRSYFEKIHDYVVRSDALAYSIGEARKAVDCAVTALDALPDSEVKDAMIQLAKESLVRVS

SEQ ID NO: 5758 - protein, 687 aa, Neurospora crassa
MLRQSIIAASHCPNAPVAGITIPPTRAATRSLVRTRTSRTAWSHATTAPGPSSGPFEPLTPPSPSKLGAPYPARSYTRTRRWSRRLLILSSLIGVAYLTDKYVYASGLARSLRTFGVGLVVAADYKLNFRPEPLSIPWIGIPEGIPELHRRNAERLSDLLRHNGGLYLKIGQAIAMQSAVLPPEFQAMFSRMFDDAPQDSWEEVEQVIREDFGGRSVEEVFGVSFSGAEGRGVMERTARASASVAQVHWARLPDGREVAIKIQKPEIERQIGWDLWAFKVVTWVYTWWFDLPLYSLVPFISERLRLETDFENEAKNSEIMRQLVENEPSLRGRVYIPPVYPELSSKRVLTTEWIEGIRLWDKDAMTRPWLDGYGKGSAGVHGAQLDPPDMPAIRRELRKNTQGYTFMIKPERTEWKGRRGKGGLGLSTKDVMTTMVDLFSAQIFKWGVVHCDPHPGNVFIRRLPNGRAELVLIDHGLYVYMSDKFRHEYGEFWKALMTFDNNKIKEITDEWGIKAVDLFASATLLRPYEGGDDGGFQAKLMKHLDGNKTASERSYEMQARMKQGIRDVLADEDKWPKELIFIGRNMRIVQGNNQYLGSPVNRIKMMGEWASRSSFQDPNLPLGQRLVNYWHHFLFKCVLALTDVAFYFFRVRQLLHRGGGMEDELEARMRDVAKEFGVELQHNVFEG

SEQ ID NO: 5759 - protein, 340 aa, delta proteobacterium MLMS-1
MKAEKLKKQLQAAAGQIETVMAADLEGVTSPRLREVLEHALFAGGKRIRPLLTLLAARLTTAANHGGVPTEPPAADQATDRQRLAIAFEYLHTASLLHDDVIDHAAQRRGRETVNSRWDQGHAILAGDFLHARAMWLAGNYGGQPCLELIASATEAMVAAEFLQAEAAAARDWRRETYFAVLEGKTAALIAAACQCGVVAGGGDYRQGQALRVYGANLGLAFQIIDDLLDFLGDPRATGKAVGNDLQEGKMTLPLLLAHQRATPEQRCWLEQLLAAEPARRQAELDTVRQLLTETDAFAGCRSQARELIATGLAGLEIFPAGGERELLQGLGEYVLQRDH

SEQ ID NO: 5760 - protein, 370 aa, Brucella suis 1330
MASRKLLLLPGDGIGPEAMAEVRKVIAFLNSDLNLGFETEEGLVGGCAYDAHGQAISDADMEKALAADAVLFGAVGGPKWDSVPYEVRPEAGLLRLRKDMQLYANLRPAICYPALAHSSSLKPEVIEGLDILILRELTGGVYFGEPKEIIDLGNGQKRGIDTQVYDTYEIERIADVAFELARTRRNKVTSMEKRNVMKSGVLWNQVVTARHKEKHADVQLEHMLADAGGMQLVRWPKQFDVILTDNLFGDLLSDVAAMLTGSLGMLPSASLGAADSKTGKRKALYEPVHGSAPDIAGKGIANPIAMIASLAMCLRYSFGLVAEADRLEAAIAGVLDDGIRTADIWSEGNTKVGTTEMGDAILAKFKALSA

SEQ ID NO: 5761 - protein, 547 aa, Neisseria meningitidis MC58
MNAFTRAWYALERHYQDTRHVLLRDRFACEPDRFERMHERLDGMLFDYSKNRLGEDTLQLLCNLADAADLEGKMRALRTGAKVNGSEGRAALHTALRLPDGADAVYVDGRDVLPEIRRELNRALKFAHSLDDGSYQGITGKRITDFVHIGIGGSDLGPAMCVQALEPFRRHITVHFAANADPACLDAVLCRLNPETTVFCVASKSFKTPETLLNAQAVKAWYRGAGFSESETACHFCAVSADTAAAAAFGIAAERVFAMYDWVGGRYSVWSPVGLPVMVAVGGARFRELLAGAHAMDRHFFSTPTRHNIPVLMALIAVWYNNFQHADGQTAVPYSHNLRLLPAWLNQLDMESLGKSRASDGSPAVCKTGGIVFGGEGVNCQHAYFQLLHQGTRLIPCDFIVPMTAQGREDGRSRFTVANAFAQAEALMKGKTLDEARAELADLPEAERERLAPHKEFPGNRPSNSILIDRLTPYNLGMLMAAYEHKTFVQGAIWNVNPFDQWGVEYGKQLAKTIIGELEGGTSVHDASTEGLMAFYRECRLKGGGAA

SEQ ID NO: 5762 - protein, 180 aa, Amborella trichopoda
MFPMVTGFMNYGQQAVRAARYIGQSFMITLSHANRLPVTIQYPYEKSITSERFRGRIHFEFDKCIACEVCVRVCPIDLPVVDWRFETDIRKKRLLNYSIDFGICIFCGNCVEYCPTNCLSMTEEYELSTYDRHELNYNQIALGRLPIPVVGDYTIQTIMNSNQTKIAMNKPLDSRTITNY

SEQ ID NO: 5763 - protein, 255 aa, Arabidopsis thaliana
MSTREENVYMAKLAEQAERYEEMVEFMEKVAKTVDVEELSVEERNLLSVAYKNVIGARRASWRIISSIEQKEESKGNEDHVAIIKDYRGKIESELSKICDGILNVLEAHLIPSASPAESKVFYLKMKGDYHRYLAEFKAGAERKEAAESTLVAYKSASDIATAELAPTHPIRLGLALNFSVFYYEILNSPDRACSLAKQAFDDAIAELDTLGEESYKDSTLIMQLLRDNLTLWTSDMTDEAGDEIKEASKPDGAE

SEQ ID NO: 5764 - protein, 542 aa, Xanthomonas oryzae pv. oryzae KACC10331
MAERIPTGYNLHDGSRDTSRDVLQSAAEAIRRAATRRSTELLVDGLPATRLPDAIGRLDALQKLMLLYTGVQSLPDSLGQLSQLRHLQISGAQELKTLPPSLTRLSNLRTLQLMMVPLDELPADLGRMQGLRSLALGGGHYARLPASIVELSRLTGLRVWHSSHFRELPENIGLMQGLRSLELASNSKLEQLPGSLTQLHRLKKLDLSSNRRLAHLPEDIGQLRGLTELSLKSCAALRQLPGSVGDLAQLQLLDLRGTGLQTLPPWLARLPDRCDIKVSDHLADQLQQIRDPERAQRAAQRLADRRRHASVPAAQQAGASWNRVPEFTRVLRSVDADLGERFEKWTQGLTQNARIFGASITSADMPLLDQVVAEAIRSPEFRSTFGQFLNEHTVKTLNMDGMTQVGDGGPRVRGDVKTAFAEMLKHNIMHTQDQETALGLLQQALQNSGLGLARERLLRSTNQLTGRAEMWPPLKAYISMHDVEGKAAQDAAITWAMAQLDEAHEGVIGEAEAKQESEQAQANANRFIERRARVLLREWGIH

SEQ ID NO: 5765 - protein, 256 aa, Novosphingobium aromaticivorans DSM 12444
MSHRPYIVGNWKMNGSRAMLAEARAIDRAAGRYPDVQVAIAPPFTLIGALREAVSAMGVGGQDCHTEVKGAHTGDVSAAMLVDTGADFAILGHSERRKDHGENDALVKAKAEAALTAGLDIIVCVGETLDQRDAGKAEAVVSSQVDGSLPSPETAAEAVAAGKVAVAYEPVWAIGTGRVAAVEDVVTMHAAIRARLVALYGESGSKVRILYGGSVNSGNAAELLAADGVGGALVGGASLTAEAFLPIVAAAGTGEA

SEQ ID NO: 5766 - protein, 364 aa, Vibrio vulnificus CMCP6
MNIQALPMHRFLDYEGNVQSPLPSWASEERLVQFYRDMLITRAYDNKAVALQRTGKLGTYPSHLGSEAFGVGIGHALKPSDVFIPYYRDMPAMWVRGIGMEKNLQYWGGDERGSDFCPEESHLRCSDLPFCVPIATQCTHAVGVASALKIQGNHDAALVTCGDGATSKGDFLESINCAGVWHLPLVFVVNNNQWAISVPRQLQCAADLLSEKAKGAGIPGITVDGNDVVAVYDAVNNALDRARKGKGATLIEAISYRLSDHTTADDASRYRSADELKQAWQYEPIKRLQAYLTAQGLWNEELEQQWLAHCKQQVEQAVAHYLSLPPQAPESAFDYLYASLPVELHAQRDMLINKAMRMQGGKHG

SEQ ID NO: 5767 - protein, 327 aa, Vibrio vulnificus CMCP6
MAELTLVEAVNLALHHEMDRDANVVVLGEDVGDNGGVFRATVGLKQKFGLKRVMDSPLAEALIGGVAVGMATQGLRPVAEFQFQGFVFPAMEHLICHAARMRNRTRGRLTCPAVFRAPFGGGIHAPEHHSESIEALFAHIPGFKVVIPSSPQRAYGLLLAAIRSDDPVMFFEPKRIYRTVKSEVMDNGEALPLDSCFTLRKGRDVTLVTWGACVVESLQAAQTLSSQGIEAEVIDLASIKPLDMATIFQSLEKTGRLLVVHEASRSGGVGGEIIARVAEQAMCLLKAPPKRVTGMDTVMPYYRNEDYFMIQEQDIVLAARELMEGWK

SEQ ID NO: 5768 - protein, 659 aa, Neisseria gonorrhoeae FA 1090
MSQLANVIRFLSADAVQKANSGHPGAPMGMAEMAETLWTKFLNHNPANPKFYNRDRFVLSNGHASMLLYSLLHLTGYNLSIEDLKNFRQLHSKTPGHPEYGYTDGVETTTGPLGQGIANAVGMALAEKILAAEFNKDGLNIVDHYTYVFMGDGCLMEGVSHEACSLAGTLGLGKLIVLYDDNNISIDGKVDGWFTENIPQRFESYGWHVVPNVNGHDTAAIQTAIEAARAETGKPSIICCKTLIGKGSANKEGSHKTHGAPLGADEIEATRKHLGWAYPAFEIPQEIYDAWNAKEKGAKLEAGWNELFAQYQAKYPAEAAEFVRRMDKKLPENFDEYVQTALKEVCAKAETVATRKASQNSIEILAKELPELVGGSADLTPSNLTDWSNSVSVTRDKGGNYIHYGVREFGMGAIMNGLVLHGGVKPFGATFLMFSEYERNALRMAALMKINPVFVFTHDSIGLGEDGPTHQPIEQTATLRLIPNMDVWRPCDTAESLVAWAEAAKAEDHPSCLIFSRQNLKFQARSEQQLNDIKRGAYVISEAQGNAQAVIIATGSEVGLAVEAQKVLAGQGIAVRVVSMPSTSVFDRQDAAYQAAVLPEGLPRIAVEAGHTNGWYKYVGLNGAVVGINRFGESAPADLLFKAFGFTVDNVVDTVKSVL

SEQ ID NO: 5769 - protein, 206 aa, Rhodopirellula baltica SH 1
MFREFRGRGKKMGLTGVSGWFTLRSQLSTTFGLVGLFWKRFPVKRARMREASCLVGDGLQGIRLVTNIYVGNLSFKATEEELRGAFEQYGEVSAVNIIMDRETGRSRGFAFVEMADAEGAKDAIENLNGHEIDGRSVTVNEARPREPRSGGGGGGGGYGGGGGGRGRGGGGGGYGGGGGNRGGGYGGGGGGYGGGGGGGYGGRGDR

SEQ ID NO: 5770 - protein, 485 aa, Rhodopirellula baltica SH 1
MNIAIIGGGLSGLSTSVHIRLLAQKQNKPLPNITLFEASDRLGGVIHTETLTDDHGRTFVIDHGADMFATAPSAAIDLCEQLGVADQLLRPSPLGRGAMIARGNRLIPIPEGFVLMRPTKLGSMLTTPLLSLTAKLRLLQERFIARRVESVTDESVGSFVRRRLGEECLDNIVAPLVAGIYTADVDRLSMAATMKPIWDMETSDGSLAKATLRRIRTGEDSTEQASSGARYEKFRAFPNGMKQWIDTLADFTGRENIRLNTAVQSIVPLPDNRYQLNVKSDIDGQSTQEFDQVVVSTPAHVAATLLQPLSEEAASTLRSIPFASTAIVVMAVRRECISRLPTTFGFVVPPKENRRVLAGSFASTKFPQRAPDDYVIVRAFVGGVMQPEILDSSDNEIIDIVRAELGELIGLDQTQSLQDITAMVKVVRWNDAMPQYEVGHLDKVQRIRTALASLEGLHLNTNALGGVGIAPVIAASKRTAERILK

SEQ ID NO: 5771 - protein, 110 aa, Populus tomentosa
MDTDVTMVPAGEASSSSSRKPKRFEIKKWNAVALWAWDIVVDNCAICRNHIMDLCIECQANQASATSEECTVAWGVCNHAFHFHCISRWLKTRQVCPLDNSEWEFQKYGH

SEQ ID NO: 5772 - protein, 335 aa, Pseudomonas syringae pv. syringae B728a
MTDLSNRQFLLAKRPSGDARREDFTYQEVPVSALADGQILVRSKYLSLDPAMRGWMNEGKSYIPAVELGEVMRAIGVGEVIESKNPKFAVGDHVQGRLGVQDYFAGEPKGFYKVDTNLAPLPLYLSALGMTGMTAYLALLDVGQPKSGDTVVISGAAGAVGSIAGQIAKLKGCRVVGIAGGTKKCRLLTEELGFDAAIDYKSEDVMDGLKRHCPDGVNVYFDNVGGDILDAALSQLAVGARVVICGAISQYNSTKAIKGPANYMSLLVNRARMEGFIVLDHPERYAEAGQVMAGWIKEGKLKSKEHIVEGLETFPETFQMLFSGENQGKLILKVE

SEQ ID NO: 5773 - protein, 429 aa, Rhodopirellula baltica SH 1
MIMDLNNTIALILGGGRGTRLFPLTKIRAKPAVPLAAKYRLIDIPISNCINSGLNRAYVLTQFLSESLHRHLRQTYTFDHFSGGFVELLAAQQTVNSGTDWYQGTADAVRKNLVHLRESWIKHVLILSGDQLYRMDFRDMMKTHIESGAAATIAGIPVTRKDASALGIMQVDDTGRVTGFVEKPQTEEEIAKVRMEPSWIDARGIESQGRDLLASMGLYIFDKDLMVDMLENSLHSDFGKEVFPEAINTHKVQLHLFDGYWEDIGTIRSFYEANLSLASKNPPFDIRNRHSPIYSRPRFLPPTIMGDAKITGSLIADGCRIGDNVTIENSVIGLRTVIGDNVTIKDSVVMGADFIEMRGAERDGKLPVGVGAGSVIQGAILDKNCRVGENVRILNEAKVDHQGEDDDLQIRDGISIVIKDGQIPDGFSC

SEQ ID NO: 5774 - protein, 705 aa, Solibacter usitatus Ellin6076
MPTDSKTLEELCINTIRILAADAVQNANSGHPGMPMGAAAMAYTLWSRYLKHNPKNPGWFDRDRFVLSAGHGSMLLYGLLHLTGYDLPLEEIKRFRQLGSKTPGHPERGLTPGVEVSTGPLGQGFSNGVGMAIAQNFLAARFNRPGHNIIDHYIYAICGDGDLMEGITQEAASLAGHLQLGKLVYLYDNNHISLAGQTSLCFTENVQERFNAYQWHTHAVADGNDTAEIAAAIEEARKDPRPSLILVRTHIGYGSPHKHDNFGSHGSPLGEEELSATKKALGWPTLDKFYIPDEARAQFRGAIEKGAAAEAEWSGRLNAYRAAFPTECAQLESMMAGQLPEGWDADLPKWKLSDKAIATRVAGGQALNAIAKRMTNLIGGSADLNPSTETALKGLGDFQPPNTDGTNVQGEVGGVWSYAGQNVAFGVREHAMGAAVNGMAAHGGVHPFSATFLVFSDYMKPAIRLGALSDLKALYIFTHDSIGVGEDGPTHEPVEQLAGLRAIPGLVVIRPADPNETSEAYRFAIPHDGPVLIALTRQNVPHVSQNPPVAKGAYVLADSEGTPDVILVGTGSEVALCVKAQEKLKQFGVKARVVSMPSWELFEKQDAAYREQVLPKTVRKRVCVEAESPFGWERWAGDEGAIIGINRYGLSAPGAEVMKYFGFTVERVTSTALRLLGKVREAEEVEPGFGGETAVKPTSPQEGHS

SEQ ID NO: 5775 - protein, 393 aa, Amborella trichopoda
MTVPATRNDLMIVNMGPHHPSMHGVLRLIVTLDGEDVIDCEPILGYLHRGMEKIAENRTIIQYLPYVTRWDYLATMFTEAITVNAPEELGNIQVPRRASYIRVIMLELSRIASHLLWLGPFMADIGAQTPFFYIFRERELLYDLFETATGMRMMHNFFRIGGVAADLPHGWIDKCLDFCDYFLPEVAEYQKLITRNPIFLERVEGVGFIAEEEAINWGLSGPMLRASGIPWDLRKVDHYECYDEFDWEVQWQKEGDSLARYLVRISEMIESVKIIQQALEGIPGGPYENLEARRFDRVRNIEWNDFEYRFISKKPSPTFELSKQELYVRVEAPKGELGIFLIGDNSVFPWRWKIRPPGLINLQILPQLVKRMKLADIMTILGSIDIIMGEVDR

SEQ ID NO: 5776 - protein, 468 aa, Mycobacterium sp. MCS
MSGIRELCRSRRGLLRHRRPGTRGGPQDGGPFRGQDPGRGGCAQLSGGSVGSRRRMTSRVVIVGSSVGGVRTAQALRSQGYDGDIVLVGEETALPYDKPPLSKALLAGTSDIAAATLLTRDAAAADAIELLLGRRAIGVDVAACQVEFADDEPLRYDHLVVATGASARPSPWGHGSGVHVLRTLEDCLRLRADLVAGARLVVIGAGFIGAEVASTARSLGLQVTVVDPVPVPMSRVLTEEIGGWFVDLHRDHGVHTRFGVGVENIEGERGNLKIGLTDGTVLEADTVVVGIGAVPNDGWLMPSGLVVDDGLVCDEFCRAVTSQNIYAVGDVSRWFHRARGVTMRIEHWTNAVDQASCVAHNILYPDELRCYEPVEYVWSDQYDWKIQFCGQTTHLGEPLVVGDRLSDNRFTALYPDREQRLSGAAIVNWPRALIECRRALKAGSDLETVRERLELLTNPPDTAATRSP

SEQ ID NO: 5777 - protein, 332 aa, Neisseria meningitidis MC58
MSRPVPAVFGSVFHSQMPVLAYREGKWQPTEWQSSQDLSLAPGAHALHYGSECFEGLKAFRQADGKIVLFRPTANIARMRQSADILHLPRPETEAYLDALIKLVKRAADEIPDAPAALYLRPTLIGTDPVIGKAGSPSETALLYILASPVGDYFKVGSPVKILVETEHIRCAPHMGRVKCGGNYASAMHWVLKAKAEYGANQVLFCPNGDVQETGASNFILINGDEIITKPLTDEFLHGVTRDSVLTVAKDLGYTVSERNFTVDELKAAVENGAEAILTGTAAVISPVTSFVIGGKEIEVKSQERGYAIRKAITDIQYGLAEDKYGWLVEVC

SEQ ID NO: 5778 - protein, 556 aa, Carboxydothermus hydrogenoformans Z-2901
MKSDIEIAQEAKLEPIVKIAEKLGLTEDDIELYGKYKAKIAAHVWDRIKDRPDGKLILVTAINPTPAGEGKTTTTVGLGDALSRLGKKTVIALREPSLGPSFGVKGGAAGGGYAQVVPMEDINLHFTGDLHAITTAHNLLAAMIDNHIHQGNELGIDPRRVVWRRVVDLNDRALRKVVIGLGGPAQGVPRETGFDITVASEIMAILCLASDLMDLKERFNRILIGYTYDQKPVYARDLKAAGAMTVLMKDAIKPNLVQTLEHTPAFVHGGPFANIAHGTNSILADKIALKLADYLVTEAGFGADLGAEKFFNVVCRFAGFKPSAVVIVATVRALKYNGGVPRAELNKENLEALEKGFANLEKHIENIGKFGLPAVVAINRFPTDTDAELNKLRELIEATGAEFALSEVWAKGGEGGIELAQKVLKVIEEKPANFRYLYDLEMPIKQKIETIAREIYGADGVVFTADAEKTLAKFEEMGFGNMPVIMAKTQYSLSDDPNKLGRPTGFNITVRELRASVGAGFIVAITGDIMTMPGLPKRPAAEVIDIDADGKITGLF

SEQ ID NO: 5779 - protein, 208 aa, Triticum aestivum
ENLWQTIKQKRASFNISSSGCHIAHRVFFDQAFWDYSEKKLIQKAKAEWSVISEWSPDGRHFMTATTAPRLQIDNRIKIFDHTGSLQFIKEFEKLYQVDWKPESPERFVDIAELTISLNGIKIEETKKQGQGSKSAQTSGKAPVNVATKPAGAYRPPQSKHTAALQDKLFGGLAPTGGEMSKTALRNKKRREKQKEKKAGEGSSADDS

SEQ ID NO: 5780 - protein, 125 aa, Ehrlichia ruminantium str. Gardel
MSNLLKEFNEQQIKLLSNREIPKFKSGDTLRVTMKIFDSAGERIQTFEGVCIKKRNNGLHSSFTLRKISYNESIQLQIFLYSPTIESIEVVKFGKVRRAKLYYMLSLFGKSARIKERIDRSKKSS

SEQ ID NO: 5781 - protein, 585 aa, Crocosphaera watsonii WH 8501
MGKRYQWLGYWGLDQAQEFAKTLQILFPHIQNNYQLQILNNNENISGTIAYFGETLLETKAGNPRVINFAASGVNNTADSWIKIDEDYLILGRDTFGRVLSYWTQINQGIWFSSHCQLLLPLLSSPRVNLTALHNYTCFSYFPTPLTPIKEISAINAGEEVVFSCLNNQLTHSKKIIHQWQSLPKTFNEEKEAIPQLQTLLKRSVENQLQGINNEPVGICLSGGLDSSIIAALLVKLGVKVRAYTLEFEKDNLSEYPYAEMVAKHLNIPLVKVSITPEKIKKHLIKAVRALDLPFGDGVTLPLYLLYQTASQETEMIFNGENGDQLFAGWTNKPIIAANIYQFQHPEYQKDFTEQYLQTFHHLYGYEKRIFTSEIYNQLLLNEPREAIQSSLDKEFSTDLLDRLRRATLMLKGAQNIQPRATYLSNENGLWVRSPFCDIDLTQWTFQTSENLFLQQSCEKYILKKSVESWLPSEIVWRKKRGMGVPLTSWCLNSLWLTLGSWLNPTVLKAEGRFLDHLPLQVILGQISGHLRGRRIGEILWLLLIWEVWRVKVLGEDKAKVSLLNPFYIPRPVWQKYANIRANYF

SEQ ID NO: 5782 - protein, 404 aa, Crocosphaera watsonii WH 8501
MTEIAQKQNQPFSATLAHSLLNCYGSPLYVYQSDLLRHGISHITTSIPYNNTLFQFATVTNGNIELLKLFNDQGWGIHANTPGDIYLGLKAGFSGEKIVYSGSNLNPEEMTQILKWGVRTLNLDSISQLELLYEIYKSFPGDLSSLKLGLRLNEPNLIKDSRIGVQPQEFPEAIKIAKRVGLNIQGLHFYRGTGTNATRAFTKVIDDIIQIGQLLPNWEYLDFGGGFGYPYHHDKIAFNWHKFGQELTDKLNQLSKPIQLIIEPGRAVIANCATLLAKVVSVKWQGDKQIIGVDTTVGNLSVPSVHGGYRKIISWPEKSQTLWLTDVCGNTTYSRDYLGKNCQLPALEIGDIIGILEVGAYGYAMSSHFLHRPRPAEVLLEKESHRLIRQREDYQVLIDNQILN

SEQ ID NO: 5783 - protein, 450 aa, Acinetobacter sp. ADP1
MSTMSLNINDLLNQAKFSKFHLSVVFWCTLINICDGYDLVIYGVVLPRLMEQWSLTSVQAGMLASTAMCGMLVGALSCGILADKFGRKRVLLLCVFFLSTFTLLGSFASTPTEFAILRFLAGLGIGGAMPNVVALTSEYSPKKSRVTMVSIMSCGYAVGAIISALVGSILVERFGWQIMFILAGIPLLFIPIIWKYLPESLVFNVKKNNTEKAHALIAKVDPTVLVSQHTKLVLNESLEKAYGSRRVLFQEGRAAGTLKFWIAFFMCLLVVYALSSWLPKLMYNAGYPLGKSILFLLAMNVGGIIGGTTSGMLADKFKIKPVVISLFCIAALSLIALGFNTSAIILYTLVAVAGASIQGASILLYSYVAQFYPLVANSTGIGWASAIGRTGAIMGPILAGMLLVLNLPHLMNFVLISVPALIAAISIGFLTTSKKKVEQPVALVTQQSLE

SEQ ID NO: 5784 - protein, 341 aa, Rhizobium leguminosarum bv. viciae 3841
MSKPNNSTAPLPFPILIGDIGGTNARFSILTDAYAEPKQFPNVRTADFATIDEAIQQGVLDKTAVQPRSAILAVAGPINDDEIPLTNCDWVVRPKTMIEGLGMEDVLVVNDFEAQALAIAALSDENRERIGDATRDMIASRVVLGPGTGLGVGGLVHAQHSWIPVPGEGGHVDLGPRSKRDYDIFPHIETIEGRVSAEQILCGRGLVNLYHAICVVDGIEPTMKDPADITSHALAGSDKAAVETVSLFATYLGRVAGDLAMVFMARGGVYLSGGISQKIIPALKKPEFRIAFEDKAPHTALLRTIPTYVVTHPLAALAGLSSYARMPANFGVSTEGRRWRR

SEQ ID NO: 5785 - protein, 311 aa, Ralstonia metallidurans CH34
MSIDILAYGEPLIEFNQQPDDPSRYLQGFGGDTSNFCIAAARQGATTGYITAVGADSFGERLLALWTRERVDTRHVVVNASAPTGVYFVSHDNHGHRFDYLRERSAASRYHHEQLPLATIAQARFLHLSGISLAISTSACDAGLAAMEHARKAGAKVSLDTNLRLRLWSLARARGIMREAFSLTDICLPSWDDITILTGLDDRDAIVDYLLGCGVELVALKLGEEGSYIATQESRALVAPFPVRPVDATGAGDCFGGSFIARLAADADPFDAARYANIAAALSTTGYGAVAPIPHAETVRARLEQGVTVIA

SEQ ID NO: 5786 - protein, 545 aa, Acinetobacter sp. ADP1
MQGLMQNKQLLISTLIEHAGLNHPEVQIVSRTCEGTIHRTNYATLRKRAKQLAKALLALGIESGDRVGTLAWNTYRHQELYFAVPGMGAVLHTINPRLFADQIEYIIQHAEDTVLFFDITFSTLLEPLLPKLKHVRAFIALCDIDQLPQNIPNCLSYEQLLREQNDEFEWPEFAETQAASLCYTSGTTGNPKGVLYSHRSTLLHAFTVCTVDGLQLSRKDCVLLAVPMFHVNAWGFPYAAAMCGAKVCFPAAQIDAASLCELAAQEQCTMSIGVPTVWLSVMDYLEHHPEKTKQLNINRIVMGGSATPRALIDRIQNNLNATTIQAWGMTETSPMGTIGNLLPEHMALEQSERFDIQSKQGRAIYGVEIRVIDDHGQVLARDGVSAGHLQVRGPWIVSAYFKADEQNILDAHGWFSTGDIACISAEGYLQITDRSKDVIKSGGEWISSIDLENTAVAHPAIQEAAVIGLNHSKWQERPLLVAIKRPDMQIDEQELIHFLSKRVAKWWLPDDVVFVQSLPHTATGKLQKNVLREQFKDFVFSSDRS

SEQ ID NO: 5787 - protein, 428 aa, Novosphingobium aromaticivorans DSM 12444
MSDNQASLTADGKTVEMPVKSGTIGPDVIDIRKLYGQTGMFTYDPGFTSTASCDSALTYIDGDEGVLLHRGYPIGQLAEHSSFMEVSYLLLNGELPSQQELADFTRTITRHTMLHEQLATFYRGFRRDAHPMAIMCGVVGALSAFYHDSTDISDPTHRKISSHRLIAKMPTIAAMAYKYSVGQPFVYPDNKLSYTGNFLKMTFGVPAEEYEVIPAVEKAMDRIFILHADHEQNASTSTVRLAGSSGANPFACIAAGIACLWGPAHGGANEAALNMLKEIGTPDKIPHYIERAKDKNDPFRLMGFGHRVYKNYDPRATVMQQTVREVFDALKVNDPLFETALRLEEIALNDPYFVEKKLFPNVDFYSGIILSAIGFPTTMFTVLFALARTVGWVAQWNEMISDPGQKIGRPRQLYTGPTQRDYVPLASR

SEQ ID NO: 5788 - protein, 208 aa, Helicobacter pylori 26695
MIVIKDAHFLTSSSQLFQCPASLTSEMVVLGRSNVGKSSFINTLLGKNLAKSSATPGKTRLANFFSTTWEDKENALRATFNVIDLPGFGYAKVSKSLKKEWEGFLWELLSVRVSIKLFIHLVDARHLDLEIDKNAKENIQALLRPDQAYLSLFTKFDKLNKNEQHRLFLNAPKPFLINTAHFNALSSKYPTLEIVRQTLLKHLLTNPL

SEQ ID NO: 5789 - protein, 251 aa, Ustilago maydis 521
MTGQAMATLVIVMGTSGSGKSTVGSALSAALGCAFVDGDDLHPASNVDKMSRGQPLNDQDREPWLITIRRTGLELATSQTLASDALRNKEKSQSAKLAEVYETSRQSTSQIDLAAESSSIRAKPQPSQAHSNKHIAVIACSSLKLIYRRLLRGTIPSLTHPTASQPESQLPSDLQVIHIYLDLSKQLLEHRMSNRKGHFMKLDMLYSQLDTLQVPDEHKEFGVIKVKVESETTTDEIVKDAMDQLKQRGVI

SEQ ID NO: 5790 - protein, 656 aa, Arabidopsis thaliana
  misc_feature (179)..(179): Xaa can be any naturally occurring amino acid
  misc_feature (225)..(225): Xaa can be any naturally occurring amino acid
MAVSVSKQYMTSLVVILLFISLSSLSPTSTSHSCDPVEEEEEASSFGYVCHSNLQKCHTFAILRAKPPFYSLSDLSRHLGLDADDEYVPKGQLLLIPIECRCNGSIYEASLIKNCVKGDTFRSVSQSLQGLTTCLSIREKNPHISEDKLGDNIKLRLAIRCSCPQEGVSNASFLVTYPXVGVRDSVSSLAVRFNTTEDAIVSANNKSGVVPLKPALIPLDHKPEXKQGSRKRNPSKKKRSKMKLMIAVSSAIAGVCGLVTLMVFGYLHWKKETQIQTQTQKWISNKDPETRQLSLSIRTTSDKKISFEGSQDGSILDSHNTVGTTTPRKPVLEIYAFEELEKATENFSSSNHIKGSVYFGSLKGKDLAIKQVNADEMKRFDFGLLNDQSHYYNHNVIRVLGTCFREIDQDSYLVFEYARNGSLWDWIQNKLAIKNQFIESCYCFLAWKQRIKICHDVAIALKYMHRINYVHGNIKSRNIFLNEDLRGKVGNFGMSKCVTNELATEENLIESSLSPASDIFAYGIIVMEVLSGQTPDMLLGLQEVETTSLGTQETFVSEWSRLRRLLGDKEKLREVMDSTLGESYSVDSAFEIASIARDCTAEEAESRPSAVEIAERVSRLVDDDEDEEDEAVIDRESTLISESSYKPLVKKSSIID

SEQ ID NO: 5791 - protein, 575 aa, Erwinia carotovora subsp. atroseptica SCRI1043
MISGILVSPGIAFGKALLLKEDEILINRKKISADQVEQEIERFLTGRSKASAQLEAIKKKAGETLGAEKEAIFEGHIMLLEDEEFEQEIIALIKDEHASADAAAFSVIENQAKALEELDDEYLKERAADMRDIGKRLLRNILNMAIVDLGDIQDEVILVATDLTPSETAQLNLDKVLGFITDIGGRTSHTSIMARSLELPAIVGTTDVTRQVKNGDYLILDAVNNKIYQNPTADKIEELKAVQQQYHAEKYELAKLKDLPAITLDGHQVEVCANIGTVRDVAGAERNGAEGVGLYRTEFLFMDRDSLPTEEEQFQAYKAVAEAVGAQAVIVRTMDIGGDKDLPYMDLPKEENPFLGWRAIRICLDRKEILHAQLRAILRASNFGKLRIMFPMIISVEEVRELKAELEMLKAQLREEGKVFDESIEVGVMVETPAAAVIAPHLAKEVDFFSIGTNDLTQYTLAVDRGNELISHLYNPMSPAVLTLIKQVIDASHAEGKWTGMCGELAGDERATLLLLGMGLDEFSMSAISIPSIKKIIRNANYEDAKALAEQALAQPTAQELSNLVSRFIKEKTLC

SEQ ID NO: 5792 - protein, 95 aa, Triticum aestivum
AEGKMFGDDALGEVNIKMVEVARSVGAASKFTGSGGAVVALCPDGDAQAELLKAACQQAGFAVEPIEVAPSALTEEPIKVTPSQLTEEELKFVMG

SEQ ID NO: 5793 - protein, 167 aa, Solibacter usitatus Ellin6076
MANPIEEILGTAAAIAKGMGITFKEMMGPTVTDDYPDAPPKFEERFRGVHVLQRDVNGMEKCVACFLCAAACPSNCIYIEAAENTDKIRMSGGERYAKVYNIDYNRCIFCGYCVEACPTDAITHGHGFEAASYNTSTLVKRKEDMLVPVPPGAKPPSMADEVPAGAH

SEQ ID NO: 5794 - protein, 324 aa, Neisseria meningitidis MC58
MAENGKYLDWAREVLHAEAEGLREIAAELDKNFVLAADALLHCKGRVVITGMGKSGHIGRKMAATMASTGTPAFFVHPAEAAHGDLGMIVDNDVVVAISNSGESDEIAAIIPALKRKDITLVCITARPDSTMARHADIHITASVSKEACPLGLAPTTSTTAVMALGDALAVVLLRARAFTPDDFALSHPAGSLGKRLLLRVADIMHKGGGLPAVRLGTPLKEAIVSMSEKGLGMLAVTDGQGRLKGVFTDGDLRRLFQECDNFTGLSIDEVMHTHPKTISAERLATEALKVMQANHVNGLLVTDADGVLIGALNMHDLLAARIV

SEQ ID NO: 5795 - protein, 273 aa, Carboxydothermus hydrogenoformans Z-2901
MWYIEKHNENYQVGWRVSDILYQKKTPYQNLAIVEFAEFGRSLILDDAVQTTEKDEYVYHEMLVHPAAFTHKSPRRALIIGGGDGGTLREVLKHKTIEKVDLVEIDEEVIKASKQFLPSLSESFNDPRVEVIIDDGIRYVKKVKNYYDLIFVDASDPVGPAVVLYSEEFYRSLFDALTADGIAAVQSESPNFYPDIFVKIVTTLRDIFPKVNVALAPVPSYISGFFAFTVASKVYNPKETTPNITFPTKYYNEEIHNACFALPNFILDMLKIR

SEQ ID NO: 5796 - protein, 379 aa, Phytophthora sojae
MMLRPVLRNAQRGAALGTTRRLMLQAEASSVLAKVGRDIPLKVVPRAERRAARKAAKHSADAAEHKVVRTSSLPARISFALLAGSISGSILWHFVLDDGIKTRITETLGATVLGDVYAFLAKKVEETVKPFTDPSRQKLLPDWPIPQVPADTPPVPVLVLDLEDTLVHSESLMVYRFIILQRKHGWRHAKRPGVDEFLETLCQYYEIVIFSQNYGAEEIVQKLDPKQCALHVLSRDATRYLNGAHVKDLSNLNRDLRQVVILDDDPAAYQLQPENAIPVKPFTNGRDRDDHELKDLIPFLKALASERVPDFRQVIGEFRDDDGVVRDLATKYGARVHQLEMEKEQKKKKGFGGFVRGRMSHHPAPPNGGVAASGFGGGH

SEQ ID NO: 5797 - protein, 131 aa, Salmonella enterica
GMHCHMSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGIKNKIHPGEAMDKNLY

SEQ ID NO: 5798 - protein, 896 aa, Ustilago maydis 521
MQQLTTPLLPLVDAESIKGSALIDAVSRIAPVLVPQDLVSTLPANVAYLVLAEPSLSYDAAADLLDAGAEAIVTADTQLIQQFDATIASARFIYLCASGAAPVAEVLKSVAGAVLTLPAASAIASSSQLIKTTADVLQTKTSGKSLFVLATSGVPTVQDVQAVAQLTASLIAPSSVLGVAADEAHKQQGKLDIVDAFVAPLTSDRTDGLFATTVVSSACTASLGLVYSSPLSIRKSIVTGSAHYQSRNRGLWHKGESSGATQQVVSIRQDCDSDAIQFAVRQSRGTLASGFCHLENREGCFSSATGLAKLEATLKHRLQTAPAGSYTARLFNDASLLGAKLREEAAELADANNNDKKHVAFEAADLIYFALTKCVSAGIGLEEIEASLDAKAKKVSRRKGDAKPAFAAQQKAAETQRAAGTPAAAAETVKDASAPIKIQSYRYEDLSAAQRKELLKRPALRTEQVMDICRPILRSVKERGDAALLELTEKFDKAKLTNAVRLPPFVDDSVMAQIKPEVKVAIDIAYNNIYKFHKAQKTTFGNKSAGATGSGSADGSEGAQDGVLEVETMPGVVCRRFARPIESVGLYVPGGSAVLPSTALMLGVPAQVARCPTVVIATPPRADGSISPEVLYCASKVNASAILCAGGAQAVAALAYGTESCPKVDKIVGPGNQFVTAAKMLVQNETDAIVSIDMPAGPSEVLVIADREADAAFVASDLLSQAEHGPDSQVVLVGIALSSSELAAIEAEVDRQARALPRVDVVRQAIDKSVTVIVPDRATAMEWSNAYAPEHLILQTRDAESLVECVQNAGSIFVGPWSPESCGDYMSGTNHSLPTAAYAKSYSGVNVATFEKCITSQSLTQQGLKGFAQNVIDLAMCEGLQAHAMAVKIRLDRIQS

SEQ ID NO: 5799 - protein, 236 aa, Neisseria gonorrhoeae FA 1090
MNAAIEHVQAVAFDLDGTLCDSVPDLAAAAEAMLEQLGMKPLPAKVVESYVGDGIGKLVHRVLTNDRDREADSELWEKGFVSYMKYYRDHLSVFTRPYPETEAGLALLKSLGIPLVIITNKNEILAAELLKQLGLADYFSLILGGDSLPEKKPSPLPLRHAAEVLGIDAANMLMVGDSRNDIIAAKAAGCLSVGVTFGYGDMTLLSQDDTTRPDRIIGALPEIYENLQPQKNKDEE

SEQ ID NO: 5800 - protein, 265 aa, Triticum aestivum
  misc_feature (182)..(183): Xaa can be any naturally occurring amino acid
  misc_feature (245)..(245): Xaa can be any naturally occurring amino acid
  misc_feature (259)..(259): Xaa can be any naturally occurring amino acid
NKFVQKSRLVPVRNSRDIVDPRVRADKGALVIATPYASGFDHFFIADQVQFKFDRCLRNLVEPVNDLPTFGVGHSLGSVIHLLIGSRYAVQRSGNILMSFNNKEASLAIPLFSPVIVPMAQSFGPILSQLTSSPTIRFGAEAAIKQIENLGPPVVKQLLPLIQQLPPLYMDLVKGREDFIPXXEETRRLIKSYYGISRNLLVKFEDDQIDETSIISQVLSSESAISSLLDMSIRSLPGDHGLPLXQVLPDVPPGMADAXSRGGEL

SEQ ID NO: 5801 - protein, 525 aa, Novosphingobium aromaticivorans DSM 12444
MFGRVKPLDAILATAEKKSLHRSLGPVQLTLLGVGAIIGTGIFVLTAAAAQKAGPGMMWSFVIAGFVCAVAALCYSELASMVPVSGSAYTYSYAVVGEMLAWMVGWALILEYAVAASAVSVGWSGYFMGLLKSLTGFELPAMLQAGPTWTMNGLLPHADFSTGLINVPAIVVALLVTWLLMLGTKESATFNAILVAIKVAALTMFIVLTLPAIEREHFAPFAPNGWFGPAGTTGMGIVGAASSIFFAYVGFDAVSTAAEETKNPQRNVPIGLIGSLAICTVFYLLVAAGAIGSIGAQPTALGVAPGSAEFTQQCAALLASGQEPLVCSNEALAHVLRAINYTYAGDLIGLAANLALPSVILMMLYGQTRIFFVMARDGLLPEKLATVHPKWKTPHIVTAMTGVFVAIAAALLPVGQLADISNSGTLFAFFMVAIAVMLLRARDPNRVRPFRTPAVWVVGPIAAIGCIFLYWNLPFEAKMVLPVWGAIGLVFYFAYGYRKSHVGQGHVEVHEGDADVPPMPVPPID

SEQ ID NO: 5802 - protein, 318 aa, Brassica napus
FLIDLFSAEYPQVHMAVPLYLSEMAPYKYRGALNIGFQLSITIGILVAEVLNYFFAKIKGGWGWRLSLGGAVVPALIITLGSLVLPDTPNSMIERGQHEEAKTKLRRIRGVDDVSQEFDDLVAASKESQSIEHPWTNLLRRKYRPHLTMAIMIPFFQQLTGINVIMFYAPVLFNTIGFTTDASLMSAVVTGSVNVAATLVSIYGVDKWGRRFLFLEGGTQMLICQAVVAACIGAKFGVDGTPGELPKWYAIVVVTFICIYVAGFAWSWGPLGWLVPSEIFPLEIRSAAQSITVSVNMIFTFIIAQIFLTMLCHLRFGL

SEQ ID NO: 5803 - protein, 538 aa, Ustilago maydis 521
MSFEANDLSKTTSRGSSTRSSLFSRASGFVMGSASRRHPHPHPPAPASDSQAASSVSSPNMPSNDTMTDYSKPESSDAARGPRKFDHIFATPDPSVKLAPPTALSDSQQEKYDQMLEHFTSTKLFPTSLKPNSAKKPLDDWEKMRNLSRESMIRYLRATKWDVASAKKRLTDTIAWRREYGVDSLKAEDLEPEAMTGKETILGYDNKGRPLHYMHPSRNTTEETPRQMQFAVWILERAIDLMPPGVEMLALLINFGGKKRNPTSISNAKLMLYILQNHYVERLGIALCINVPWIFKAFWNAIYPFIDPVTKGKCKFDEAIKDEVPNGQLASDFGGLLDFPYEHEKYWPQLVELTNKRREEQMERFKTLCGAEIGASEWVIRGGDAPNRSTAPKKQDSGYHEVESKSLPAYQPAAGSSENESQLDRFYTSPSELPPELERQLDESDSENNTVVNDDHASSAVDATPQRKEHKQGDASLFAAVVGGVSAGLVGGKAASDAAEQAGKNAGDEAQKHHQHLSHIKAVLGRKSDGESRPAVSA

SEQ ID NO: 5804 - protein, 397 aa, Rhodopirellula baltica SH 1
MAKKTIDQIDVQDKTVLMRVDFNVPLDESLAITDDRRIRMALPSIKSVIDRGGKVILMSHLGRPTGGEGDEKYSLAPAAKRLGELLGSTVHFATDTVGDDASSKASSLAAGEVLVLENLRFNPGEKKGDSEFAGKLAAMADAYCNDAFGTCHRKDASMVAVPEAMAGKPRVVGHLVAKEIQYLTDAISKPERPFVAILGGAKVSDKINVINNLLGICDAVLIGGAMAYTFSLASGGKVGKSLVEKDKVELAKELMAKGGDKLQLPVDTHCGDDFGNIAGCNKKVVAAGEIPDDMEGLDIGPETAKKYAEVIKSAKTIVWNGPMGVFEKPPMDEGTKAVAQAIADGDAVSIIGGGDSAAAVDQLGFADDVSHVSTGGGASLAMLEGQAFAAVDLLDEA

SEQ ID NO: 5805 - protein, 510 aa, Oryza sativa (japonica cultivar-group)
MICRSLLLLRSNAASKASNIVKHVAATGCLPKYSSEAPARYFSSEPSLQVDSTEENGFKGHGMLAPFTAGWQSTDLHPLVIDRSEGSYVYDINGKKYIDALAGLWSTALGGNEPRLIKAATDQLNKLPFYHSFWNRTTKPSLDLANEILSMFTAREMGKIFFTNSGSEANDSQVKLVWYYNNALGRPNKKKFIARSKSYHGSTLVSASLSGLPALHQKFDLPAPFVLHTDCPHYWRFHLPDETEEEFATRLATNLENLILKEGPETIAAFIAEPVMGAGGVIPPPKTYFEKIQAVLKKYDILLIADEVITAFGRLGTMFGCDMYDIKPDLVSIAKALSSAYMPIGAILVSPEITDVIYSQSNKLGSFAHGFTYSGHPVSCAVAIEALKIYKERNIIEHVQKIAPRFQEGIKAFSGSPIVGEIRGLGLILGTEFVDNKSPNDPFPAEWGVGSLFGAECEKRGMLIRVAGDNIMLSPPLIMTPDEVEEIICKYGDALKATEERIAELKAKRG

SEQ ID NO: 5806 - protein, 521 aa, Bordetella pertussis Tohama I
MPTPLPSSSAWLAFADAARHSSRRGARLRVIEAAGLRVDLTAQAHSDDLDSAAEDLLAQQDFDNARAQLFDGGPANWTEHRPAWHTALRAARPPTPVAGAILGERDRLRRFVQDADMRGAYRHVLHLGIGGSDWGPRMVTRALRHNGLKREVRFASNVDSHAVADALHHLDPHDTLIIVASKSFTTTEPLANAEVAMNWLRNAGVADPVRQVVAITANVDAALDFGISPQHIFRFWDWVGGRYSLWSAIGLPVALALGCDALDELLAGAAAMDQHFLHTPMRRNAPLQMALAGVANRSVLGYGSLAITPYDSRLTHLVPWAQQLEMESLGKVAGHDGSPAGVPTGPVVWGMTGTDCQHTFFQWLHQDTAGAPVDFIVCEQADHPYDHFHKLLIANCLAQRAALLRGKPFDEALKEARLVESDPQQAEILAHHRVHPGGRPSTLIMLPRLSAHALGALLAMYEHKVFAQGVLWGINPFDQWGVEYGKALARNIIRELENPSSEVNQQDPSTRYWIDALRKQP

SEQ ID NO: 5807 - protein, 459 aa, Photobacterium sp. SKA34
MNYQFPKNFRWGSAASSTQTEGASFEGGKGESIWDHWYKEQPNRFHNGLSSTIASTFYKNFKSDIQLMKEIGHNSFRTSISWARLIPKGTGEVNQEAVDFYNKVIDELIAQDIEPFICLYHFDMPMAMQEIGGFENRKVLDAYENFAEVCFKLFGDRVKNWFTFNEPIVPVEGGYLYDFHYPNVVDFKRAATVAYHTILAHAKAVVKFRALGKNGSIGIILNLTPSYPRSQNPADLKAAHICDLMFNRSFLDPAVKGEYPQELVEILKEHGQIPVIEEGDCELIAQGKIDVLGVNYYQPRRVKARENAVHPEAPFMPEHFFDYYEMPGRKMNPHRGWEIYEKGIYDILTNIRENYGNLPCYISENGMGVEGEEKFLIDGQIQDDYRIDFIREHLKWLHKGIEEGSACFGYHLWTFIDNWSWANAYKNRYGFYQLDLKTQQRSVKKSGEWFAEVSKNNGF

SEQ ID NO: 5808 - protein, 433 aa, Solibacter usitatus Ellin6076
MALVVIGGTAAGMSAAARARRIDPRLEIIVLEKGPVISLGACGLPYFVEGKIREAKDLTVFTPERFRKERNVDVRTGARVISIAHPRREVLLESGARVAYEKLVIATGARSESLGIAGDTQEHVFHMQTLEDAQRMRGFVRERKPKRAVVVGAGYIGVEAADALRRNGLQVTILEFSPYALLRADDAFTAEVRKQLERHRVELKTGVRVTAIEPDSIAGVPCDMVVIAAGFRPAATLAADAGVELGRSGAIRTDDRMETNVRGIFAAGDCAEVQHLVSGRPTWIPLGTTANKCGRVAGANAAGARERFPGIVGTSIVGIFGMGFATTGFSAAEARAEGFTPVTARIEALSRPRYYQGVKTIVELVADKATRRLLGGSIIGEDGTAGRINVLATALTARLRVDDFEQLDLAYSPPFAPVWDPVLIAAQQLIKEL

SEQ ID NO: 5809 - protein, 149 aa, Zea mays
  misc_feature (91)..(91): Xaa can be any naturally occurring amino acid
  misc_feature (107)..(107): Xaa can be any naturally occurring amino acid
  misc_feature (120)..(120): Xaa can be any naturally occurring amino acid
  misc_feature (124)..(124): Xaa can be any naturally occurring amino acid
  misc_feature (139)..(139): Xaa can be any naturally occurring amino acid
LISVDESFICDPTDLYIYVTPEKVEEALAENQQQRALILSLRLNEDLLIKKCILAVDPSDVRAICSAIPYKYLQRLIDTFASLLESCPHLXFILLWYQHMYRLHGAXILQSSRCLLPSLXSLQXFISRLHQDVADTCSXNEYLLGYLCT

SEQ ID NO: 5810 - protein, 1102 aa, Klebsiella aerogenes
MLRYTCHALFLGSLVLLSGCDNSSSSSTSGSPGSPGNPGNPGTPGTPDPQDVVVRLPDVAVPGEAVQASARQAVIHLVDIAGITSSTPADYATKNLYLWNNETCDALSAPVADWNDVSTTPTGSDKYGPYWVIPLTKESGCINVIVRDGTNKLIDSDLRVSFSDFTDRTVSVIAGNSAVYDSRADAFRAAFGVALADAHWVDKTTLLWPGGENKPIVRLYYSHSSKVAADSNGEFSDKYVKLTPTTVNQQVSMRFPHLASYPAFKLPDDVNVDELLQGETVAIAAESDGILSSATQVQTAGVLDDTYAAAAEALSYGAQLTDSGVTFRVWAPTAQQVELVIYSADKKVIASHPMTRDSASGAWSWQGGSDLKGAFYRYAMTVYHPQSRKVEQYEVTDPYAHSLSTNSEYSQVVDLNDSALKPEGWDGLTMPHAQKTKADLAKMTIHESHIRDLSAWDQTVPAELRGKYLALTAQESNMVQHLKQLSASGVTHIELLPVFDLATVNEFSDKVADIQQPFSRLCEVNSAVKSSEFAGYCDSGSTVEEVLTQLKQNDSKDNPQVQALNTLVAQTDSYNWGYDPFHYTVPEGSYATDPEGTARIKEFRTMIQAIKQDLGMNVIMDVVYNHTNAAGPTDRTSVLDKIVPWYYQRLNETTGSVESATCCSDSAPEHRMFAKLIADSLAVWTTDYKIDGFRFDLMGYHPKAQILSAWERIKALNPDIYFFGEGWDSNQSDRFEIASQINLKGTGIGTFSDRLRDAVRGGGPFDSGDALRQNQGVGSGAGVLPNELTTLSDDQARHLADLTRLGMAGNLADFVLIDKDGAVKRGSEIDYNGAPGGYAADPTEVVNYVSKHDNQTLWDMISYKAAQEADLDTRVRMQAVSLATVMLGQGIAFDQQGSELVRSKSFTRDSYDSGDWFNRVDYSLQDNNYNVGMPRSSDDGSNYDIIARVKDAVATPGETELKQMTAFYQELTALRKSSPLFTLGDGATVMKRVDFRNTGADQQTGLLVMTIDDGMQAGASLDSRVDGIVVAINAAPESRTLQDFAGTSLQLSAIQQAAGDRSLASGVQVAADGSVTLPAWSVAVLELPQGESQGAGLPVSSK

SEQ ID NO: 5811 - protein, 641 aa, Bordetella pertussis Tohama I
MCGIVGIWGPLRDKANVLAESCRRIRHRGPDSNGYWEDAEADLALAHVRLAILDLTEAGHQPMVSACGRYVIVLNGEIYNHMELRERLQQDGLAPAWRGHSDTETVLACFAGWGIEQTLQAAVGMFAIVLWDRAERKLALMRDRMGEKPLYYGYSQANLLFGSELKAFMPVPGFGRELDRNALASFMRHNYIPAPQSIYAGIRKLPPGAWVEIDAAQMRRGELPEPQVYWSARRAADQGLGDRRRFESDAQAIDALEQVVSQAVRGQMLSDVSLGAFLSGGIDSSTVVALMQAQSAQPVRTFAIGFHEKGYNEAEHAKAVAAHLGTEHTELYVTAEDGLAVVPSLADMYDEPFADSSQIPTSLVTRMARQHVTVALSGDGGDELFGGYSRYFRVDNWWRKCAAMPGPLRHLAGAALRGSAALPGAGAWRGKVGKLGELLGADTRGEFYRLFVSYWADPGRVVIGGTEPLSPFEQPMEGSTFDAMMKLDTVTYLPDDILVKVDRAAMAVSLETRVPLIDHRVYEFAWQLPFEYKVRGGTGKWLLRQLLYRHVPQAMVDRPKRGFAVPLAAWLRGPLRDWAEALLDPARLRQEGWFEPEPILRKWREHLSGHRNWDSHLWGVLMMQAWLDRYRAGAGDEAGRR

SEQ ID NO: 5812 - protein, 903 aa, Streptomyces seoulensis
MTDPNAIQPSALDQLPDRDPEETAEWRASLDAVAREAGPHRAAYLMRRTLERAEAGGVALPKLLETDYVNSIPTAAEPGVPGDEAMETRITAWNRWNAAAMVTRGSKHGVGGHIATFASAAWLYETGFNHFFKGKESPDADGSGDQLYIQGHASPGIYARAFLDGRLDEAHLDNFRQEAAGNGLPSYPHPRRLPWLWEFPTVSMGLGPLSAIYQARFNRYLTNRGIKDVSASHVWAFLGDGEMDEPESTAALALAAREELDNLTFVINCNLQRLDGPVRANFKIVQELEAQFRGAGWNVVKTLWGTAWDELFQLDTTGALVRRLRQVPDAQIQTYQTRDAAYIRQDFFGADPALVEMAKLLSDDKILECFHLSRGGHEARKVFAAYKAAVEHKGAPTVILAQTVKGHTLGPGFASKNANHQMKKLSVDEFKAMRDLLELPISDSAFADGQVPYGHPGADSPEVRYLQERRAALGGPAPARRTHPVAPLPAPAEKAFTSFDKGSGSQNVATTMAFVRLVKDLVRDKETGKRWVPIVPDEARTFGMESLFPSLGIYSPKGQTYEPVDRDQLMYYKEAKNGQILNEGITEAGSMADFIAASTAYATHGETMIPFYIFYSMFGWQRTADQMWQLGDQLGRGFLVGATAGRTTLTGEGLQHADGHSPVIAATNPAALTYDPAFAYEVAAIVKEGLRRMYGEAAPGEDQDVFYYLTVYNEPMPQPAKPAVPGIDEGIVKGLYRFNTAESAGVTVPANAPRIQLLGSGTAIHWALDAQRMLAEEWGVAADVWSATSWSELRRDAMDADAALLRGEERVPFVRRALQGAEGPVLAVSDYMRQVPDQIAQWVDQDWSSLGADGFGLSDTRPAARRHFGVDAESIVVASLAQLAKRGGVKATAVKEAREKYGL

SEQ ID NO: 5813 - protein, 269 aa, Neisseria meningitidis MC58
MTALPRYAVFGNPVAHSKSPQIHQQFALQEGVDIEYERICADIGGFAQAVSTFFETGGCGANVTVPFKQEAFHLADEHSERALAAGAVNTLIPLKNGKLRGDNTDGIGLTNDITQVKNIAIEGKTILLLGAGGAVRGVIPVLKEHRPARIVIANRTRAKAEELAQLFGIEAVPMADVNGGFDIIINGTSGGLNGQIPDIPPDIFQNCALAYDMVYGCAAKPFLDFARQSGAKKTADGLGMLVGQAAASYALWRGFTPDIRPVIEYMKAL

SEQ ID NO: 5814 - protein, 612 aa, Streptomyces seoulensis
MAVSVTLPALGESVTEGTVTRWLKAEGERVEADEPLLEVSTDKVDTEIPSPVAGVLASIKVAEDETVEVGAELALIDDGSGAPAAEAPAAEAPAAEAPAPAAEEAPQSAPSTEQEAPAEAPTAEAASGGGSAEGTDVVLPALGESVTEGTVTRWLKSVGDSVEADEPLLEVSTDKVDTEIPAPTSGTLLEIVVGEDETAEVGAKLAVIGAAGAAPAAAPEAPKAPAAEAPAAPAPAAPAPAAPAAPAPQAPAPQAPSAPAPQQQTAPAPDPAPAAPAPAPAPAPAQAPAAAPSAPTATQATDEGAYVTPLVRKLAAESSVDLASVKGTGVGGRIRKQDVIAAAEAAKAAAAPAPAAAQAPAAAKKAPALEASPLRGQTVKMTRIRKVIGDNMVKALTEQAQLSSVVEVDVTRLMKLRGKAKDSFAAREGVKLSPMPFFVKAAAQALKAHPVINARINEAEGTITYFDTENVGIAVDSEKGLMTPVIKHAGDLNLAGIAKATAELAGKVRANKITPDELSGATFTISNTGSRGALFDTIIVPPNQVAILGIGATVKRPAVLETEEGTVIAVRDMTYLTLSYDHRLVDGADAARYLTTVKQILEAGEFEVELGL

SEQ ID NO: 5815 - protein, 472 aa, Neisseria meningitidis MC58
MSIKNAVKLIEESEARFVDLRFTDTKGKQHHFTVPARIVLEDPEEWFENGQAFDGSSIGGWKGIQASDMQLRPDASTAFVDPFYDDATVVLTCDVIDPADGQGYDRDPRSIARRAEAYLKSSGIGETAYFGPEPEFFVFDGIEFETDMHKTRYEITSESGAWASGLHMDGQNTGHRPTVKGGYAPVAPIDCGQDLRSAMVNILEELGIEVEVHHSEVGTGSQMEIGTRFATLVKRADQTQDMKYVIQNVAHNFGKTATFMPKPIMGDNGSGMHVHQSIWKDGQNLFAGDGYAGLSDTALYYIGGIIKHAKALNAITNPSTNSYKRLVPHFEAPTKLAYSAKNRSASIRIPSVNSSKARRIEARFPDPTANPYLAFAALLMAGLDGIQNKIHPGDPADKNLYDLPPEEDALVPTVCASLEEALAALKADHEFLLRGGVFSKDWIDSYIAFKEEDVRRIRMAPHPLEFEMYYSL

SEQ ID NO: 5816 - protein, 85 aa, Glycine max
MADTGGGDAVRPVVICDNKCGCTLPCTGGSTCRCTSAGTATGGGDHVTCSCGEHCGCNPCSCPKIAAAGSGCRCGTDCACASCRT

SEQ ID NO: 5817 - protein, 390 aa, Carboxydothermus hydrogenoformans Z-2901
MLEATRVRNLPPYLFARIERLIAEKKEAGVDVISLGIGDPDTPTPKHIIEELYLAAQNPENHQYPSSVGMLSYRQAVAAWYARRFGVELDPKTEVVSLLGSKEGIAHISWCYVDPGDLVLVPDPGYPVYEGGTILAGGTTYKMPLKPENGFLPDLDSIPEEVARKAKLMFINYPNNPTGAVADLGFFEKVVHFAKKYEILVCHDAAYSEITFDGYRAPSFLEVKGAKDVGIEFHSLSKTYNMTGWRIGWAVGNAKAIDALGRLKSNIDSGVFQAIQYAGIKALEGPQDVVKELCDLYAQRRDLVIETLNKLGWNLSKPKGTFYIWAPVPKGFTSASFAEYLIEKAGVVITPGNGYGTNGEGYFRISLTIPTSRLKEALQRIEQHLGKVEF

SEQ ID NO: 5818 - protein, 929 aa, Cryptococcus neoformans var. neoformans B-3501A
MPPSEGRYLAALPAQHKDAAPDTLYQGAYGAVYRGKHIATGHIVALKIINLDTEDDDVADIQKEISLLQQLMLGGSNSGGPPPNVIKYYGSLMQGPRVWIIMEYAEGGSIRTLSRAQPLKELHICLVIREVLLALAFLHKNGVIHRDIKAANILLTTQPHRILLCDFGVAALLQSSTSKRSTFVGTPYWMAPEVVTEGRMYDAKADIWSLGITLLEMAYGEPPMSGQPAARAVMLLGDKRMRAPRLEGDHWSKEMRDFVVGCLNEEPADRLSAEELSKSKWIKQQSKTPLTAMNDLIARYQAWKESGGQRQSLAAGVGANVDDDDDDLDGHPADGDWAFDTVRSRASILLGKQQSEDNASSNLSPPTAHPAPAPQSLRRLFHDESSTDPDPFKSFAHQQPPTPQTTEGSDTIKQTGRFPSPEQEDLPPLVDTDSPPATPGKNELDGQTIRQARLGRDGRSPTPLMITTGYSPSPSSNTLSAASTATYYPIETPQEHTPIARTDAGVPSPRRIRNKISLDNLSLTPTSKTQPAAEERSKSSGGMRRPSASDAREGLRGFQFPLMTKSGPGPTPITTASMSTSTNTPTSTQPPAAGKLFPPPLNRNHSAAPAYPFADPTTTSTTTTTTTSPTGTSSPGFGGLAFGPRPPMMRQASVAVMEGRAASQSQSQAQAQALALALAHTQTHQQQQQQQQQQGSTSPPTPKKAVALGAPNSIGLGRPGVSAAAAAASATAAGGGGGQGMMIRSRSGSKAEDGHPVGLRDLLKLSPAVPDMPDLLPPSPSVANTPHKFFPSPSPLAQTTHAHAEPSLASAASASAASASAASASATAAFSFPTLASAPMSAAPSQRSLLPAGTIPASAPPGLATQPNAFAPVHATMGPPIRPLDLSMLESDDVFDELGRMVDDMQSWFGCVESGLEELLTTGVDVQNA

SEQ ID NO: 5819 - protein, 196 aa, Onion yellows phytoplasma OY-M
MIKKATFVRSIVHFKDIPLKKQPEIVLMGRSNVGKSTFINALTQRKKLAKISQTPGKTITLNYYDINESFYLIDTPGYGYAKKSKEIQKQLLPMIISFLEQTSHLKAVFQLIDFKVGATQEDDRIHQALLQAGFEVVLLFVKKDKVKKNLVPKQLKMLVNHFPQIKYFFLISSKQQEGLEELKLFLSQLMDPNAND

SEQ ID NO: 5820 - protein, 477 aa, Neisseria gonorrhoeae FA 1090
MNEYSQLIKHPDISLSPISDGIGVGNPATGEILAYVRNTGSDKLKNLIQKAAAAQKLWAAKTALERADILWRWYFLVKENKEALARLMTMEQGKSLTEARGEIDYAASFVRWFAEEARRIDGDVLTSVKASQKLVVLKQPVGVTAAITPWNFPSAMIARKAAPALAVGCAMIVKPASLTPLSAYALAVLAYEAGVPQDLLPVVSGRASEISHEFATNPTVRKISFTGSTEVGAKIFAGSAADIKKLSLELGGNAPFIVFDDADLDKAVEGALASKFRNSGQTCVCTNRVYVQSGIYDVFCRKLSEKAAALKLGDGLDEGVNQGPLIEEKAVEKVEQHIADALSKGAVCLTGGKRSALGGTFFEPTVLSGVTAQMAVAREETFGPLCPVFRFETEAEVIEAANNTEYGLAAYLFTSDTARQWRVGEVLEYGMVGINTGLISNEAAPFGGVKRSGLGREGSKYGADEYLELKYLCIDAG

SEQ ID NO: 5821 - protein, 340 aa, Helicobacter pylori 26695
MILSIESSCDDSSLALTRIEDAQLIAHFKISQEKHHSSYGGVVPELASRLHAENLPLLLERIKISLNKDFSKIKAIAITNQPGLSVTLIEGLMMAKALSLSLNLPLILEDHLRGHVYSLFINEKQTCMPLSVLLVSGGHSLILEARDYENIKIVATSLDDSFGESFDKVSKMLDLGYPGGPIVEKLALDYRHPNEPLMFPIPLKNSPNLAFSFSGLKNAVRLEVEKNAPNLNEAIKQKIGYHFQSAAIEHLIQQTKRYFKIKRPKIFGIVGGASQNLALRKAFENLCDAFDCKLVLAPLEFCSDNAAMIGRSSLEAYQKKRFVPLEKANISPRTLLKSFE

SEQ ID NO: 5822 - protein, 378 aa, Novosphingobium aromaticivorans DSM 12444
MSAEIDFYELLEVERTADDKVLKSAYRKLAMKYHPDKNPGCADSEARFKQINEAYACLSDPQKRAAYDRYGHAAFQQGAGGGAGGGGFGGGDFGDIGDIFETIFGGAFGGGGRQQPRRGADLRYDMEISLEDAFHGKDAEIEVEVSQKCDPCGGSGATPGTSARRCNLCGGHGKVRAQQGFFMVERPCPNCHGRGEVIEKPCKHCRGEGRVDAEQRLQVTIPAGVDNGTRIRLAGKGEAGPFGAPPGDLYIFLHIQRHRVFEREGTTLLTRCPISFTTAALGGEIEIPGLDGKVHAIEIPAGIQSGKQLRKRGAGMPVLQGRGIGDLVVEIHVETPTKLSARQKELLREFQATETGEECPQSKGFFERIKDAWTDLTE

SEQ ID NO: 5823 - protein, 461 aa, Escherichia coli CFT073
MADNKPELQRGLEARHIELIALGGTIGVGLFMGAASTLKWAGPSVLLAYIIAGLFVFFIMRSMGEMLFLEPVTGSFAVYAHRYMSPFFGYLTAWSYWFMWMAVGISEITAIGVYVQFWFPEMAQWIPALIAVALVALANLAAVRLYGEIEFWFAMIKVTTIIVMIVIGLGVIFFGFGNGGQSIGFSNLTEHGGFFAGGWKGFLTALCIVVASYQGVELIGITAGEAKNPQVTLRSAVGKVLWRILIFYVGAIFVIVTIFPWNEIGSNGSPFVLTFAKIGITAAAGIINFVVLTAALSGCNSGMYSCGRMLYALAKNRQLPAAMAKVSRHGVPVAGVAVSIAILLIGSCLNYIIPNPQRVFVYVYSASVLPGMVPWFVILISQLRFRRAHKAAIASHPFRSILFPWANYVTMAFLICVLIGMYFNEDTRMSLFVGIIFMLVVTAIYKVFGLNRHGKAHKLEE

SEQ ID NO: 5824 - protein, 441 aa, Bordetella pertussis Tohama I
MNAPASPPDLSHLWMPFTANRQFKSQPRLLARAEGMYYTSTDGRQILDGTAGLWCVNAGHCRPEIVQAIASQAGEMDYAPGFQLGHPLAFEAATAVASFMPAGIDRVFFTNSGSESVDTALKIALAYHRARGDAQRTRLVGRERGYHGVGFGGISVGGISANLKTFSGALLPAVDHLPHTHSLKHNAFSKGQPAWGEHLADELERIVALHDASTIAAVIVEPMAGSTGVLVPPKGYLQRLREITARHGILLIFDEVITAYGRLGSPTAAEHFGVTPDIITMAKGVSNAAVPAGAVAVKREVHDAIVNGVQGGIEFFHGYTYSAHPLAAAAILATLGIYRRDDLFGRARDLSPAFEKAAHALQGAPHVIDVRNIGLVAGIELASRPDAPGARAAEAFRKCFDSGLMVRYTGDILAVSPPLIIDEAQIGELFEGIGKVLKEIA

SEQ ID NO: 5825 - protein, 442 aa, Brucella suis 1330
MLTKTNAPSLDNFWMPFTANRQFKAAPRLLASASGMYYTDVDGNQVLDGTAGLWCCNAGHGRKRITEAVERQISTMDFAPIFQMGHNVAFDFAEKLAAIAPGGAEAKLDRVFFTNSGSESVDTALKIAIAYQRAIGQGTRTMVLGREKGYHGVGFGGISVGGLVNNRRVFPQIPADHLRHTLDIEKNAFSKGLPANGIELANDLERLVQLHGAEKIAAVIVEPMSGSAGVILPPKGYLERIRATADKYGILLIFDEVITGFGRLGTPFAVDYFGVVPDLVTTAKGLTNGAIPMGAVFAARKVYDGLMTGPENAIELFHGYTYSGHPVASAAGLATLEIYAEEGLLTRGAGLADYWQEALHSLKGAPNVIDIRNLGLVGAVELASRKDAPGARAYDIFVECFKKGLLIRVTGDVIALSPPLIIEKEQIDTIISVLGDAIKRAA

SEQ ID NO: 5826 - protein, 548 aa, Carboxydothermus hydrogenoformans Z-2901
MAAENTAMPWLKHYVKGVRPHIDYPEKTLPELLWETIEKYPGIIATIFLGEKMTYKEFGEKVKRLTRALSQIGIKKGDRVAIMLPNSPQFVMSYFAILSLGGVVVQLNPMYVEREIEYYLNDSGAETIILLDVLYPRARAVKGNTSLKNIIVVNIPQLGTYPGEFGPEVYYFNDLVLNSEPDVPEVAVSPDDVAVLQYTGGTTGVSKGAMLTHKNLVANAYQVREFSHRLFVPGQERILIALPLFHVYGMTTGMNLATCFGGTMILVPRFEAGLILEHIDLYRPTAFPGAPTMYIALLNYPDLTRYDLKSIYVCVSGSAPLPVEVQTKFEEITGAIVVEGYGLSEASPVTHLNPIGGLRKIGSIGVPYPDTLAKIVDLETGEDLPPGEIGELVVKGPQVMKGYWNRPEETAQVLKDGWLYTGDIARMDEDGFFYIVDRKKDMIIASGYNIYPREVEEVLYQHPKVKEAVVVGVPDAYRGETVKAYIVVKDGETLTEQEVIDFCNARLARYKVPRLVEFRSELPKTAVGKVLRRLLREEELKKHGGEKS

SEQ ID NO: 5827 - protein, 677 aa, Candida albicans
MPSLDELTISTIRGLSVDAVSAANSGHPGAPLGLAPAAHVVWQKMKFNPKDPNWINRDRFVLSNGHACALLYSLLVLYKFELTVDDLKQFRQLGFKTPGHPEATDTAGVEVTTGPLGQGISNAVGIAIAQKQFAATYNKPDITLSDSYVYTFVGDGCLMEGVSSETSSLAGHLQLNNLIAFWDDNRISIDGDTAVSFTENVPDRYRAYGWNVLEVPDANTNIEAIAAAVDEAKKSTDKPTLIRLVTTIGYGSLKQGSHDVHGSPLKPDDIKQLKKSWGFKEDVDFFIPEEVSEYLAKHVSENQKVQKEWEAKLAEYKKKYPTEGAEIQRRLDGKLPEGWKEYLPKYTPADKPLATRKLSENVINALHGKIPEFIGGSADLTGSNLTRAEGSVDFQPPSTGLGNYDGVYIRYGVREHGMGAIMNGIAAFGANYKNYGGTFLNFVSYAAGALRLSALSHHPVIWVATHDSIGLGEDGPTHQPIETLAHFRAIPNLSVWRPADGNEVSAAYAAAIESTSHPSVIALTRQNLPQLEGSSIENALKGGYTLVKKDNPDVIIVSSGSEVSISVAASEELAKQGVKANVVSLPDFFTFDQQSDEYRLSVLPDGVPILSVEVMSTFGWSKYSHEQFGLNRFGASGKAADLYKYFEFTPEGIAERAQKTIKYYEGKQLLSPLDRAF

SEQ ID NO: 5828 - protein, 499 aa, Cryptococcus neoformans var. neoformans B-3501A
MDSEGRNTAPLQPSPASPSRHQSPLAENQGSSSSISKGKKKSLLDGVAHNGESPSSPGPISIKRRLVRPKKIRQSHGDVSPPASVDPQIRQETLAVAEPEPLKPARSPSLRQSSRSPSRHPSPAASTPSFADAPLPPPPRSRFAPPRSAHPPLVSCRSVYNYTRLNHIEEGTYGVVFRARCNDTGEIYALKKLKLDEEKQGFPITSLREVMALMISGGHENVVGIREIVVGDTLNQVFIVMPFIEHDLKTLLADMPHPFLQSEVKTIMLQLLSAVAHCHANWILHRDLKTSNLLMNNRGQIKVADFGLARKFGDPLGEMTQLVVTLWYRSPELLLGGKEYTTAVDIWSIGCIFAELMQGEPLFPGRGEIDQINRIFQLLGRPNDESWPGYSTLPLVQKINPIGPMFSTLRQKFKHLTYEGHNLLSSLLCYDPERRITAEEALKHPYFSEHPLPKHPDLFSSFPSQAAGERKHKSLISPSAPVREDRMAKDSLADLDSFV

SEQ ID NO: 5829 - protein, 343 aa, Vibrio vulnificus CMCP6
MTQPTNRQIVLASRPVGAPTADNFALTQSDIPTPAQGEMLLRSVYLSLDPYMRGRMSDAKSYAEPVGIDEVMVGGTVCQVEASNHAEFEVGEWVLAYTGWQDYALSDGEGLIKLGKQPSHPSYALGVMGMPGFTAYMGLLDIGQPKEGDTLVVAAATGAVGSMVGQIGKLKGCRVIGIAGGEEKCQFAKETLGFDECIDHKATDFAEQLAKVCHNGIDIYFENVGGKVFDAVMPLLNTGARIPLCGLISQYNATSLPEGPDRMSMLMAQLLIKRIKMQGFIIFDDYGHRYGEFAADMTQWLAQGKIHYREHLVQGLENAPDAFIGLLEGKNFGKMVVQTNQPR

SEQ ID NO: 5830 - protein, 443 aa, Vibrio vulnificus CMCP6
MWFKPFIQSYLVVFIGYLTMYLIRKNFNVAQNDMISTYGLSMTDLGLIGLGFSITYGIGKTVVSYYADGKNTKQFLPFMLILSGLAMLGFSFSMGGGSASLFLMVAFYALSGFFQSTGGPSSYSTITKWTPRNKRGSYLGLWNMSHNVGGAGAAGVALFGANYLFDGHVIGMFVFPSIIAIIVGFIGMRFGSDSPEAYGLGKVEELFDEAISEEDTAAEENQMTKKEIFVEYVLKNKVIWLLCFANIFLYIVRIGIDQWSTVYAYQELGLSKEAAISGFTLFEVGALVGTLMWGYLSDLANGRRALVACVSLALIIVSLEFYQHATSEFMYLASLFVLGFLVFGPQLLIGVAAVGFVPKKAISVADGVKGTFAYLIGDSFAKLGLGMIADGTPIFGLTGWKGTFAALDTSAMICIVLLAFVAIAEEKKIRHNKKKLELAASQS

SEQ ID NO: 5831 - protein, 446 aa, Vibrio vulnificus CMCP6
MFGLFQSPSYTQAPLDKSQVDERYRYWRLHIMIGMYIGYAGFYFTRKTFNYAAPAMIVDLGLDKGDLGLIGTLFYITYGLSKFISGTISDRSNPRYFMGVGLIASGIINIVFGFSSSLIALSILWVLNAWFQGWGWPSCSKLLTTWYSRSERGFLWAIWNTAHNVGGALIPLLVGYLTFHFSWREGFIVPGIIGVLLGLIVCWRLRDKPTTQGLPTVGQWRHDALELAQEKHGQGLSYHEILTHYVFNNKYIWLLAFSYVLVYIVRTAINDWGNLYLTEQHHYSLINANAALSMFEIGGFVGSLVAGWGSDKLFGGNRGPMNLLFAAGIFLSVAALWLMPLTNFAFQAAGLFSIGFFVFGPQMLIGMAAAECSHKDSAGAATGFVGLFAYMGAALSGYPLALILEEYSWTGFFVTISICAAVIGLLLLPFLQAQPSRKPLAPKLRL

SEQ ID NO: 5832 - protein, 337 aa, Ralstonia eutropha JMP134
MKVSLKKIGSQVIVLTGATSGVGLVTARKAAAMGARLVLVARSEDSLHKLAEELREKGAEVITVTADVGRHEDVARVAHAAIERFAGFDTWVNNAGVTIFGRHADVPLEDQRRLFDTNYWGTVHGSLAAAAHLRERGGAIINIGSEASDGPLPLQSAYAASQHAIKGFTDSLRLELEQEMAPISVTLIKPAGLETPLAMHAKNFLDVEPRLPPPLYDPALAAEAILFAAEHPRRDLFVGGAAKAFSAAAYHAPRTFDQVMRRFMGRAQQTRHPAGPLEDNTLYGGGNDLQERTGNRVALQSCPYTTSARHPVLTTALVVGASAALAAVMQVRRGRHD

SEQ ID NO: 5833 - protein, 135 aa, Brassica napus
MVALLGRRIGVAAAAAAFIALVAFGSASSSPKSFVKSTVSAHDVVIFSKSYCPYCKRAKAVFKELELKKEPYVVELDQREDGSEIQDALLEIVGRRTVPQVFVHGKHLGGSDDTVDSYESGKLARLLNIGVKDDL

SEQ ID NO: 5834 - protein, 340 aa, Erwinia carotovora subsp. atroseptica SCRI1043
MKSIVIQQPNSLVIEERSIPQPAAGEVRVKVKLAGICGSDSHIYRGHNPFAKYPRVIGHEFFGVIEAVGDGVDAARLGERVSVDPVVSCGHCYPCSIGKPNVCTSLVVLGVHRDGGFSEYAAVSAKNAHVIPDEIPDEFAVMVEPFTISANVTAQVKPTEQDIALIYGAGPMGLTSVQVLKGVFKVKEVIVVDRIPERLEMALRSGADRVINNASLSLKDELETLNIKPTLIIDAACHPSILQEAITIASPAARIAIMGFSSEPCQISQQGITSKEISIFSSRLNANKFPIVIEWLKEKRIDPAKLITHRFDYQQVVQAIEVFEKDQKRCCKVLLTFNEA

SEQ ID NO: 5835 - protein, 214 aa, Bordetella pertussis Tohama I
MHDISSLTTRTKALPPLRVGVGGPVGSGKTTLLEMVCKAMYPQFDLIAITNDIYTKEDQRLLTLSGALPPERILGVETGGCPHTAIREDASINLIAIDQMLEQFPDADIVFVESGGDNLAATFSPELSDLTLYIIDVASGEKIPRKGGPGITKSDLFIINKTDLAPYVGADLAVMEADTRRMRGDKPFVMCNLKTGDGLDQVIAFLKTEGLFRG

SEQ ID NO: 5836 - protein, 248 aa, Pseudomonas putida KT2440
MCLIVFAWRPGHALPLIVAANRDEFYARPTQPLAAWEDAPGVHAGRDLEAGGTWLGVGPQGRFAALTNIRDPGQAQGPRSRGELVAAFLQGELGVGAYLDQVASRSGQYSGFNLLVGDGQRLGYLHAREATPRLLKAGVYGLSNAGLDTPWPKLVKARDGLENLLDTPEPHRLLALLADNEPAADGDLPETGVGLATEKLLSSVFIASQNYGTRASTVLIVDDQGQRRLVERSFGPFGGHLGEIELLV

SEQ ID NO: 5837 - protein, 759 aa, Pseudomonas putida KT2440
MLNTLRKIVQEVNSAKDLKSALGIIVLRVKEAMGSQVCSVYLLDPETNRFVLMATEGLNKRSIGKVSMAPNEGLVGLVGTREEPLNLENAADHPRYRYFAETGEEKFASFLGAPIIHHRRVVGVLVIQQKERRQFDEGEEAFLVTMSAQLAGVIAHAEATGSIRGLGRQGKGIQEARFVGVPGSPGAAVGRAVVMLPPADLEVVPDKTVDDIDAELKLFQNALEGVRDDMRKLSAKLATQLRPEERALFDVYLMMLEDAALGGEVTEVIKTGQWAQGALRQVVGEHVNRFELMDDDYLRERASDVKDLGRRLLAYLQEARSQSLVYADNTILVSEELTPAMLGEVPEGKLVGLVSVLGSGNSHVAILARAMGIPTVMGLVDLPYSKVDGIELIVDGYKGEVFTNPSEVLRKQYSEVVEEERQLAQGLDALRELPCVTPDGHRMPLWVNTGLLADVARAQQRGAEGVGLYRTEVPFMINQRFPSEKEQLAIYREQLAAFHPLPVTMRTLDIGGDKALSYFPIKEENPFLGWRGIRVTLDHPEIFLVQTRAMLKASEGLNNLRILLPMISGIHELEEALHLIHRAWGEVRDEGTDVPMPPVGVMVEIPAAVYQTKELARQVDFLSVGSNDLTQYLLAVDRNNPRVADLYDYLHPAVLQALNTVVRDAHGEGKPVSICGEMAGDPAAAVLLMAMGFDSLSMNATNLPKVKWMLRQINMGKAKELLAEALSHDNPQVIHSSLQLALKNLGLARMIGPGANKTL

SEQ ID NO: 5838 - protein, 330 aa, Escherichia coli
  misc_feature (40)..(40): Xaa can be any naturally occurring amino acid
  misc_feature (43)..(43): Xaa can be any naturally occurring amino acid
  misc_feature (118)..(118): Xaa can be any naturally occurring amino acid
  misc_feature (128)..(128): Xaa can be any naturally occurring amino acid
  misc_feature (172)..(172): Xaa can be any naturally occurring amino acid
  misc_feature (228)..(228): Xaa can be any naturally occurring amino acid
  misc_feature (267)..(267): Xaa can be any naturally occurring amino acid
TIKVGINGFGRIGRIVFRAAQKRSDIEIVAINDLLDADYXAYXLKYDSTHGRFDGTVEVKDGHLIVNGKKIRVTAERDPANLKWDEVGVDVVAEATGLFLTDETARKHITAGAKKVVXTGPSKDNTPXFVKGANFDKYAGQDIVSNASCTTNCLAPLAKVINDNFGIIEGLXTTVHATTATQKTVDGPSHKDWRGGRGASQNIIPSSTGAAKAVGKVLPELNGKLTGXAFRVPTPNVSVVDLTVRLEKAATYEQIKAAVKAAAEGEXKGVLGYTEDDVVSTDFNGEVCTSVFDAKAGIALNDNFVKLVSWYDNETGYSNKVLDLIAHISK

SEQ ID NO: 5839 - protein, 168 aa, Brassica napus
MPLNLASASSSSLRRSLFASLRKKISPMASAPASASAALSTAAPADNGAAKPAEQRPVQVAKRLEKFKTTIFTQMSMLAVKHGAINLGQGFPNFDGPDFVKEAAIEAIKDGKNQYARGYGVPELNSAVAERFLKDSGLQIDPDKEVTVTSGCTEAIAATILGLINPWG

SEQ ID NO: 5840 - protein, 224 aa, Pseudomonas putida KT2440
MTQDQLKQAVAQAAVDFILPKLDEKSVVGVGTGSTANFFIDALAQHKTAFDGAVASSEATAQRLKGHGIPVYELNSVSELEFYVDGADESDAHLHLIKGGGAALTREKIVAAVAKTFICIADGSKLVPVLGAFPLPVEVIPMARSHVARQLVKLGGDPVYREGVVTDNGNVILDVYNLQITNPVELEAQINAIVGVVTNGLFAARPADLLLLGTAEGVKSLKAE

SEQ ID NO: 5841 - protein, 441 aa, Ralstonia eutropha JMP134
MTHVFHRNPRQTLPVAVAGSGVELVDSEGRRYLDASGGAAVSSLGHGHPRVIAAIKAQLDTIAYAHTSFFTTEVSETLAQTLAQAAPGDLEHVYFVSGGSEAVEAALKLARQYFVELGQGSRRHFIARRQSYHGNTLGALAIGGNAWRREPFLPLLVPAHHVSPCYAYRDQVAGETDAQYAQRLADELEAKIQELGAENVAAFVAETVVGATAGAVPPVGDYLKRIRAVCDKYGVLLILDEVMSGMGRTGYLFACEEDGVVPDIVTIAKGLGGGYQPIGAMISTRRIYDTIVAGSGFFQHGHTYIGHATACAAALAVQRTIAEDNLLANVRQRGEQLRARLRESLGNHPNLGDIRGRGLFVGVEFVADRDSKATLDPKLKTHARLKSTAMQHGLLVYPMGGTVDGVHGDHVLFAPPFICTAQDIDKIVERFTAAVAAVLPA

SEQ ID NO: 5842 - protein, 226 aa, Glycine max
MALVNKLGNLLKKATSSNPTLYQAIRCMSSSKLFVGGLSFNTDEGSLRDAFSHYGEIIDAKIIVDRDTGRSRGFGFITYAAEEQASSAIMALDGKDLHGRNLRVSAATERTAGFRNGAGYGGGGGGFGGGGYGGGGYGGGGYGGNSGGGGGFAPAGGDNFAAGNFGGDRGFGGNPAGNHGAPAGSTSGDEFSLGTPGSSFESAKNDDVMDDLFKDDEPDKYASKNF

SEQ ID NO: 5843 - protein, 212 aa, Cryptococcus neoformans var. neoformans B-3501A
MKSVNRWLYGPTPEEKVRSWQTKLRQQERQLDKEIRNLETATQRSRIELKQLAKKNDVKSAKILAREVVRANKQRDRLESSKARIKSVNMQLQHQLSMVKVTGAFQKSTEIMKTTNALVKLPQLSATMREMSMEMMKSGIMEEMMEETLDSVDDEEIEEEADAEVDKVLYELTDGKLGQAGAVGAALPAEEEEENEEEMQRMRKEMQELLSS

SEQ ID NO: 5844 - protein, 175 aa, Triticum aestivum
MAPPVMPSSPTSVAPFQGLKSPAGLPVSRRSNGASLGSVSNGGRIRCMQVWPIEGIKKFETLSYLPPLSTEALLKQVDYLIRSKWVPCLEFSKVGFIFREHNASPGYYDGRYWTMWKLPMFGCTDATQVINEVEEVKKEYPDAYVRIIGFDNMRQVQCVSFIAFKPPGCEAPGKA

SEQ ID NO: 5845 - protein, 355 aa, Arabidopsis thaliana
MPSLAEEICIGNLGSLQTLPESFTWKLTAADSLLRPSSAVSFDAVEESIPVIDLSNPDVTTLIGDASKTWGAFQIANHGISQKLLDDIESLSKTLFDMPSERKLEAASSDKGVSGYGEPRISPFFEKKMWSEGFTIADDSYRNHFNTLWPHDHTKYCGIIQEYVDEMEKLASRLLYCILGSLGVTVEDIEWAHKLEKSGSKVGRGAIRLNHYPVCPEPERAMGLAAHTDSTILTILHQSNTGGLQVFREESGWVTVEPAPGVLVVNIGDLFHILSNGKIPSVVHRAKVNHTRSRISIAYLWGGPAGDVQIAPISKLTGPAEPSLYRSITWKEYLQIKYEVFDKAMDAIRVVNPTN

SEQ ID NO: 5846 - protein, 347 aa, Arabidopsis thaliana
MSSTLSDVFRSHPIHIPLSNPPDFKSLPDSYTWTPKDDLLFSASASDETLPLIDLSDIHVATLVGHACTTWGAFQITNHGVPSRLLDDIEFLTGSLFRLPVQRKLKAARSENGVSGYGVARIASFFNKKMWSEGFTVIGSPLHDFRKLWPSHHLKYCEIIEEYEEHMQKLAAKLMWFALGSLGVEEKDIQWAGPNSDFQGTQAVIQLNHYPKCPEPDRAMGLAAHTDSTLMTILYQNNTAGLQVFRDDVGWVTAPPVPGSLVVNVGDLLHILTNGIFPSVLHRARVNHVRSRFSMAYLWGPPSDIMISPLPKLVDPLQSPLYPSLTWKQYLATKATHFNQSLSIIRN

SEQ ID NO: 5847 - protein, 398 aa, Acidovorax sp. JS42
MTAFVEAASPHVMNTYGRVPIALERGQGVRVWDVNGKQYLDGLGGIAVNTLGHNHPKLVPALQDQIAKLIHTSNYYHVPGQEKLAQLLTERAHMTNVFFCSTGLEANEAAIKIARKYGVDKGIEKPVIVVYDHAFHGRSIATMTATGNPKVRNGFGPLLEGFLRVAPNDIEALQEATEGNANIVAVMMEPIQGEGGLHPMRTDYLQQVRALCDANGWLLMLDEVQAGMGRTGKWFAHQWAGIVPDVMTLAKGLGSGVPVGAVLAHGAAAQVLKPGNHGSTFGGNPLAMRAGVETIRIMEEDGLLQNAADVGAHLKAELQRALGETAGVNEVRGQGLIIGMELDRPCGVLIDRAAEAGLLLSVTAERVIRLVPALTLTRAEADEIVALLTPLVQTFLSE

SEQ ID NO: 5848 - protein, 136 aa, Zea mays
MASVGGAVAGGVGAPTPHVLAVDDSSVDRAIIAAILRSSRFRVTAVESGKRALELLGTEPNVSMIITDYCMPEMTGYELLKKVKESSKLKQIPVVIMSSENVSTRIRRCLEEGAEDFLVKPVRASDVSRVFSRVLR

SEQ ID NO: 5849 - protein, 435 aa, Oryza sativa
MAIQSYSYSGRGSERTAYRIIFFGQSNRIGFHYILSHFFLTLWFYKTPHMTSKVTPLSQQSKIPNPTQPNPTALSRHSSPARPPPESPSPDRRRVRVPTGGFSPCITMGSDFKAIPLIDISPLVGKIDDPSMVNDEDLLQVVQMLDDACREAGFFYVKGHGIADSLMKQVRDVTQKFFQLPYEEKLKIKMTPQSGYRGYQRVGENITKGKPDMHEAIDCYTPIEPGKYGDLAKPMVGSNLWPKYPSNFDVLLENYISLLRDLSRKIMRGIALALGAPVDAFEGTTAGDPFWVCRLIGYPVSTDIPEEQRTDTGCGAHTDYGLLTLVNQDDDICALEVRNQSGEWIYAKPIPGTFVCNIGDMLKVWSNGIYQPTLHRVVNNSPRYRVSVAFFYESNFDAAVEPVEFCRERTGGVAKYEKVVYGEHLVQKVLTNFVM

SEQ ID NO: 5850 - protein, 206 aa, Myxococcus xanthus DK 1622
MIKVLDARFVTTAVEPKGYPTDHTAEVAFVGRSNVGKSSMINALTGRRKLVRVSNTPGRTRTLNFFDVDLERGGVRHQIRLADLPGYGFAKASKADKAQWEKMITTYLEKRHRLEAVVSIVDVEVGPTPDDLTTLDYLQAHNRRVLVVATKVDRLTKARLKPRLVELSKLMDLPLEVILPFSSTEKLGVDEVWGALLDTFGKSARV

SEQ ID NO: 5851 - protein, 319 aa, Rhizobium leguminosarum bv. viciae 3841
MSDKQVPIGSGFGAHTTADEVLAGLDLSGKRVIVTGGHSGLGLETTRALAGAGAQVTIGARSIEAARRAVAGIDGVEIDRLDLSDLESVRVFAERFVASGRSIDILINSAGIMACPETRVGDGWEAQFATNHLGHFALVNRLWPAISPGARIVAVSSGGHHNSAIRWEDVQFETGYDKWRAYGQSKTANALFAVHLDRLGRDTDIRAFSLHPGKIFTPLQRHLAKEEMVSAGWIDADGNPIDPTFKTPAQGAATQVWAATSPQLDGMGGLYCEDCDIAIRATDGAPGGVSDHAADPEEAARLWILSARLTGIDAFAAHA

SEQ ID NO: 5852 - protein, 175 aa, Triticum aestivum
MGPTVMASSATSVAPFQGLKSTAGLPVSRRSNGASLGSVSNGGRIRCMQVWPIDVIKKWETLSYLPPLSTEALLKQVDYLIRSKWVPCLEFSKVGFIFREHNASPGYYDGRYWTMWKLPMFGCTDATQVINEVEEVKKEYPDAYVRIIGYDNMRQVQCVSFIAFKPPGCDESGKA

SEQ ID NO: 5853 - protein, 394 aa, Arabidopsis thaliana
MGMTSFTDGPAEESKLTGVGEIRLVPDLSTKQTIPWTKQESMVLADMQLKPGEAWGYCPRETLRRVAKVLKDEFDLVMNAGFENEFYLLKNVVREGKEEYMPFDFGPYCATSSFDAASPIFHDIVPALESLNIEVEQFHAESGKGQFEVSLGHTIASHAADNLVYTREVIRSVARKQGLLATFVPKYDYCDIGSGSHVHLSLWKNGENVFPASNNSSSHGISSVGEEFMAGVLFHLPSILAIIAPLPNSYDRIQPNTWSGAFQCWGKENREAALRAASPPGTPDGLVTNFEIKSFDGSANPHLGLAVIMAAGIDGLRRHLQLPTPIDINPADVAATLNRLPETLSEAVEALDKDKVLHDLLGQKLLVAIKGVRKAEVEYYSKNPDAYKQLIHRY

SEQ ID NO: 5854 - protein, 162 aa, Brassica napus
FGDERIIVFTTNHKERLDPALLRPGRVDMHINLSYCTGLGFRTLVSNYLGLDGLNHPLCEEIETLVDSTEVTPAELAEELMQDDDCDVVLPGVVSFVEKRKVERSKAKESVSICDEVVKTDDDAEKQSVCTNGMRNRKKQAGRRKGRGARVVNARTYLQVGM

SEQ ID NO: 5855 - protein, 468 aa, Oryza sativa (indica cultivar-group)
MVIQMVHLAWKMKLHINIINNKSRMYLLENNVSCDFECHHTIIVKIPTQLYLDLDAARFSRRQKMRFVYFDGLELWNRDGCRKIFRGFMHMLSQGSQSQTSGNGSQNSTSPQFPSIFSQSQFSQSSTPTFQNFHPFGAPTNYQPYGNSTPSFHGFQQQAHWLHSTPVSFQGFRPSENWVYSPNQITGSASSHGSESASQCPARYEENNVVDIEESSDNSQEAGRRGTRVNWTEEENIRLLSSWLNNSVDPINGNDKKAEYYWKAVAAEFNSNTSRTYSRARSTFSCGYSDDMIMEKAHIMFKSENNEKPFTLEYMWRELKDQPKWRRVLEEDSKNKRTKISESGAYTSSSDQDTEEENRRKEKRPEGQKKAKAKLKGRGKNVAPSPLGDQPCQDFVLYNEAIKVKAEAMLKSVEATSKSAEAKKEYTRMEKYQTYLKLLDKDTSNFSDAKLKRHEAVLEKLATELAEE

SEQ ID NO: 5856 - protein, 535 aa, Carboxydothermus hydrogenoformans Z-2901
MAIEVNRQLLTPLWFLKRAAYVFPEKTAVVDGERRFTYREFKERVNRLASALKKYGIGKWDKVAYLAPNIHPFLEGHYGVPLARGVLVSINTRLKSNEILYILNHSESKILIVDSELASLIEPIYDQLETVQKIVMINQVPRETKLPAVDYEEFLQEGEPEDLPIPIEDEFEPITLNYTSGTTGFPKGVQYTHRGAYLNSLSEVIEMGLNQYSKYLWILPMFHCNGWCFTWAVTAVGATHYCFRKFEPEAALEIIEKEKITNFCGAPVVFNAMTAAKKAEGLKFNHPIRAFIAGAAPSPTIISKMERLGVEVVHVYGLTEVYGPFTVCEWHPEWDNLSAEEKAIYKARQGVPMVTTGEVRVVDAEMNDVPADGKTMGEIVMRGNGVMAGYYKAPEDTAKAFAGGWFHSGDLAVMHPNGYIEIMDRSKDIIISGGENISSVEVENVLYSHPAVYEVAVVASPDERWGEVPKAFIVLREGASVTPEELIAYCREKMAGFKVPKKIEFVDALPKTPTGKIQKFVLRNLEWKGEKKVKG

SEQ ID NO: 5857 - protein, 174 aa, Glycine max
  misc_feature (4)..(5): Xaa can be any naturally occurring amino acid
  misc_feature (8)..(9): Xaa can be any naturally occurring amino acid
  misc_feature (15)..(16): Xaa can be any naturally occurring amino acid
  misc_feature (18)..(19): Xaa can be any naturally occurring amino acid
  misc_feature (21)..(23): Xaa can be any naturally occurring amino acid
  misc_feature (25)..(29): Xaa can be any naturally occurring amino acid
  misc_feature (32)..(32): Xaa can be any naturally occurring amino acid
  misc_feature (34)..(34): Xaa can be any naturally occurring amino acid
  misc_feature (36)..(42): Xaa can be any naturally occurring amino acid
  misc_feature (47)..(48): Xaa can be any naturally occurring amino acid
  misc_feature (50)..(51): Xaa can be any naturally occurring amino acid
  misc_feature (54)..(55): Xaa can be any naturally occurring amino acid
  misc_feature (58)..(58): Xaa can be any naturally occurring amino acid
  misc_feature (60)..(64): Xaa can be any naturally occurring amino acid
  misc_feature (66)..(68): Xaa can be any naturally occurring amino acid
  misc_feature (71)..(71): Xaa can be any naturally occurring amino acid
  misc_feature (73)..(77): Xaa can be any naturally occurring amino acid
  misc_feature (79)..(80): Xaa can be any naturally occurring amino acid
  misc_feature (82)..(83): Xaa can be any naturally occurring amino acid
  misc_feature (88)..(90): Xaa can be any naturally occurring amino acid
  misc_feature (95)..(95): Xaa can be any naturally occurring amino acid
  misc_feature (105)..(105): Xaa can be any naturally occurring amino acid
  misc_feature (112)..(113): Xaa can be any naturally occurring amino acid
  misc_feature (115)..(115): Xaa can be any naturally occurring amino acid
  misc_feature (118)..(118): Xaa can be any naturally occurring amino acid
  misc_feature (120)..(120): Xaa can be any naturally occurring amino acid
  misc_feature (125)..(125): Xaa can be any naturally occurring amino acid
  misc_feature (127)..(127): Xaa can be any naturally occurring amino acid
  misc_feature (129)..(130): Xaa can be any naturally occurring amino acid
  misc_feature (134)..(134): Xaa can be any naturally occurring amino acid
  misc_feature (136)..(136): Xaa can be any naturally occurring amino acid
  misc_feature (141)..(141): Xaa can be any naturally occurring amino acid
  misc_feature (144)..(144): Xaa can be any naturally occurring amino acid
  misc_feature (148)..(150): Xaa can be any naturally occurring amino acid
  misc_feature (152)..(152): Xaa can be any naturally occurring amino acid
  misc_feature (154)..(154): Xaa can be any naturally occurring amino acid
  misc_feature (157)..(157): Xaa can be any naturally occurring amino acid
  misc_feature (167)..(169): Xaa can be any naturally occurring amino acid
  misc_feature (172)..(173): Xaa can be any naturally occurring amino acid
KDFXXPIXXAEIFPXXLXXWXXXNXXXXXFQXFXSXXXXXXXQDFFXXAXXGYXXSPXQXXXXXQXXXFFXIXXXXXDXXGXXFVSPXXXRKYPXTVNLWQPKKXAFEWATXXKXPPXKXAIGVXQXPXXFFIXEXRKSPXPPXAQKXXXNXIXNYXPTFGGTAGKXXXQGXXF

SEQ ID NO: 5858 - protein, 284 aa, Streptococcus pneumoniae TIGR4
MKLDGYTRLAAVVANPIKHSISPFIHNRAFEATATNGAYVAWEIEASDLVETVANIRRYQMFGINLSMPYKEQVIPYLDKLSDEARLIGAVNTVVNENGNLIGYNTDGKGFFKCLPSFTISGKKMTLLGAGGAAKSILAQAILDGVSQISVFVRSVSMEKTRPYLDKLQEQTGFKVDLCALEYVSELQARIAESDLLVNATSVGMDGQSSPVPENIVLPETLLVADIIYQPFETPFLKWARSQGNPAVNGLGMLLYQAAEAFQLWTGKEMPTEEIWQSLTEKYQ

SEQ ID NO: 5859 - protein, 285 aa, Arabidopsis thaliana
MRFVPYLYEIERLWLSLVNYLSPRKNKNRRCGEIDKIRMVKKGGTKRKIAIETIQKSDYLRVTCTKRREGLFSKASQLCLLSDAQIAILATPPTSESNISFYSFGHSSVDAVVSSFLSGQRCVPLQEDTKEMREDVAICLSRTNLGLGFWWNNESLNKSENPQEISDAINSMLTLLSNLKELSGEEALVNDHKDLKKNERSDVVLQHGTQYETLNPNSNTTTICCVPDELPANSNEIVGISPNPLIMLEKKKSQIEEKFEKEWQVSVTRIENEATSSYAKRRRSI

SEQ ID NO: 5860 - protein, 343 aa, Zea mays
MAAAATRSLHSFLALLLLLAAAAAAAALSYETKSIDPGLVVMTLPEPVSGPESLAFDGRGGGPYSGVSDGRVLRWQGPLRGWTEFAYNSKHRSVALCAPDKKLVVPESLCGRPLGLQFHRQSGDLYVADAYLGLLRVAARGGLAQVVATEAAGGPFNFLNGLDVDQRTGDVYFTDSSATYRRSDYLLVVAMGDETGRLLRYERRTGRVGVLQAGLSYPNGVAVSADGTHVVVAHTALCELRRYWIRGARAGTSDTFAELPGYPDNLRADGRGGYWVALSSGVAADEAAAAPTVAVRVSRDGNVTEALDGFSFVSVSEVAQRGGALWVGSVDTPYAGQLKRRAS

SEQ ID NO: 5861 - protein, 298 aa, Oryza sativa (indica cultivar-group)
MSFMDPMRSSGYYDFLKDPDLAHHISMKQQPKEIFLNPVSAWLENSTDVIEGNSRKGDTYWKQVAATYNSTTEEERKRDPKHLKGHWHKNTKKVSAFNGVYVQLRDNYQSGRSEEMLIEQALTMYESRVGQPFALMYWWKAVCDSPKWNAYVTLLGHGTTKIRAEFDVNAPPVEEQPAQVRPMGIKRAKKGRQTDYSEEVKELIKSLCKSHARQEDETAEMKEFQQKLSEEKLEAANILLKAAQEKTKARLIEQQTKLLERFTQMISVDTSRMETWAREAHIKACTLMSDQLWGQGGY

SEQ ID NO: 5862 - protein, 464 aa, Mycobacterium tuberculosis H37Rv
MTHYDVVVLGAGPGGYVAAIRAAQLGLSTAIVEPKYWGGVCLNVGCIPSKALLRNAELVHIFTKDAKAFGISGEVTFDYGIAYDRSRKVAEGRVAGVHFLMKKNKITEIHGYGTFADANTLLVDLNDGGTESVTFDNAIIATGSSTRLVPGTSLSANVVTYEEQILSRELPKSIIIAGAGAIGMEFGYVLKNYGVDVTIVEFLPRALPNEDADVSKEIEKQFKKLGVTILTATKVESIADGGSQVTVTVTKDGVAQELKAEKVLQAIGFAPNVEGYGLDKAGVALTDRKAIGVDDYMRTNVGHIYAIGDVNGLLQLAHVAEAQGVVAAETIAGAETLTLGDHRMLPRATFCQPNVASFGLTEQQARNEGYDVVVAKFPFTANAKAHGVGDPSGFVKLVADAKHGELLGGHLVGHDVAELLPELTLAQRWDLTASELARNVHTHPTMSEALQECFHGLVGHMINF

SEQ ID NO: 5863 - protein, 437 aa, marine gamma proteobacterium HTCC2080
MDRKTLEAHWMPYTGNRQFKEDPRIITSAEGVWYTDDKGRKVLDGHSGLWTSGLGHGRKEISAAVSQQINTLDFAPPFQFGHPPAFELADRIKGLMPEDLDYVFFTNSGSESADTSLKMARAYWRLMGQPTKTRFVGRMKGYHGVNFGGISVGGIAANRKFFGQGVEADHLRHTMLPQNRFCRGMPQDGAELADELNEMIALHDASTIAAVIVEPMAGSAGVIPPPVGYLQKLRDICDANDILLIFDEVITGFGRCGAMTGADAFGVVPDILNVAKQITNGAIPMGAVIARAGIYDTFMAHGGPDYALEFAHGYTYSAHPVACAAGLAALDVLTGEALPQRVADEAPFFEALLHDALSDKLHVSDVRNYGFAGAITLEPYPGEPLRRPFEVAMKMWEKGFLVRYGGDTIQLAPMFVMERPEMESLVGALADSLQELA

SEQ ID NO: 5864 - protein, 265 aa, Ralstonia eutropha JMP134
MPPLPLIEPNTALFLDFDGTLADLAPRPELVQVEPELVGTLRRLYDRLDGALAIVSGRPIIELDHFLQPLLLPAAGVHGAELRTAGAQIEMKPAPGLEPLIPPLEALVRRHPGLRLERKSVAVAIHYREAPELEGLVRAAVTDVLRHANGLEGMPGKMVVEIKPAGINKGDAIAAFMNMPPFAGRGPLFAGDDVTDEAGFAVVRKLGGVGVLVGQRETMATVSVTGPAALRCWLHRSARAFDGTPAPDERPAVSDPQRDLEGDSL

SEQ ID NO: 5865 - protein, 219 aa, Haemophilus influenzae R2846
MNQLEMKKLAAQAALQYVKADTIVGVGSGSTVNCFIEALGTIKDKIQGAVAASKESEELLRKQGIEVFNANDVSSLDIYVDGADEINPQKMMIKGGGAALTREKIVAALAKKFICIVDSSKQVDVLGSTFPLPVEVIPMARSQVGRKLAALGGSPEYREGVVTDNGNVILDVHNFSILNPVEMEKELNNVAGVVTNGIFALRGADVVIVGTPEGAKVID

SEQ ID NO: 5866 - protein, 200 aa, Cichorium intybus x Cichorium endivia
MATIGHNNLNAKLVLLGDMGAGKSSLVLRFVKGQFLEFQESTIGAAFFSQTLVVNDATVKFEIWDTAGQERYHSLAPMYYRGAAAAIIVYDITSADSFTRAKKWVQELQKQGNPNMVMALAGNKADLEDKRKVTVEEARVYAEENGLFFMETSAKTAANVNDVFHEIAKRLPRAQPTQNPAGMVLVDRPAEGARAASCCS

SEQ ID NO: 5867 - protein, 200 aa, Cichorium intybus x Cichorium endivia
MATIGHNNLNAKLVLLGDMGAGKSSLVLLFVKGQFLEFQESTIGAAFFSQTLAVNDATVKFEIWDTAGQERYHSLAPMYYRGAAAAIIVYDITSADSFTRAKKWVQELQKQGNPNMVMALAGNKADLEDKRKVTAEEARVYAEENGLFFMETSAKTAANVNDVFHEIAKRLPRAQPTQNPAGMVLVDRPAEGARAASCCS

SEQ ID NO: 5868 - protein, 163 aa, Arabidopsis thaliana
  misc_feature (21)..(21): Xaa can be any naturally occurring amino acid
  misc_feature (50)..(50): Xaa can be any naturally occurring amino acid
  misc_feature (81)..(81): Xaa can be any naturally occurring amino acid
  misc_feature (140)..(140): Xaa can be any naturally occurring amino acid
MASSMLSYAAVATSPAQATMXAPFTGWKSSAGFPATRRTNTDITSIASNXGGRVSCMKGWPPIGKKKLETLSYLPDLNDVXLTKEADYLLRNTWIPCAEFKLQHGYAYREHGYTPGCYDGPYWTKWKLPLFGCTDCAQVXNEAEECKREYPGACIRIIGCDNT

SEQ ID NO: 5869 - protein, 373 aa, Oryza sativa (indica cultivar-group)
MAQLLNREEEERLMEKKGGRRQGPRRRRRHHRPLLLPPPPRPPPRRRAKADVDLAKADVDRGRVVAEVRAAAETVGFFQVVNHGVAGELMEEMLAAVRRFHEEPLEAKVPYYTRDVASKVRFNSNFGLFRNGFRSPAANWRDTMFVEMFPEAPSPEEIPPPCRGVLEVYAAAVRRLGERLFELLSEALGLPVGYLGRDAGCMDGLSLSVAAHYYPACPEPEATMGATKHSDPSFLTVLLQDTSGGLQAVLPRPPEERWVDVPPVAGALLVNVGDLLQLVSNDRLRSVEHRVLPTGAAGPARVSVACFFRHAYASTRSCVPVVVGGGGARAAAVYRSTTAGEFLAHYNGKGLDGRSALDHFRLPAAASSPPPPL

SEQ ID NO: 5870 - protein, 275 aa, Medicago truncatula
TLLSGLVKEVRRLDDKLLLVDIDLLESKLHFSLRNLPKAKAALTAARTAANAIYVPPAQQGAIDLQSGILHAEEKDYKTAYSYFFEAFESFNALEDPKAIFSLKYMLLCKIMVNQADDVGGIISSKAGLQYVGPDLDAMKAVADAYSKRSLKFFETALQDYKAQLGEDPIVHRHISSLYDTLLEQNLCRLIEPFSRVEIAHIAELIELPIDHVERKMSQMILDKKFAGTLDQGAGCLVIFDDPKTDAIYPATLETISNVGKVVDSLYVRSAKIMA

SEQ ID NO: 5871 - protein, 659 aa, Cryptococcus neoformans var. neoformans B-3501A
MTTASPFLFQSSLHDTGLIHEMLSNPLKFGAPVNKKSLGFEAGMKEVVSEPESPNLVKRQLKNVNDEVKYDTEGELAAKDKSQKQFNGNAKNPQRVNPEFINQSVTPLSPAKSQIPDTNEGDNTQGLFPSTFDLSWPEAIATAKRAAGLHNPSMACYANATLQVLLHTPPVLRIALTHDEGSCSQIKKKNFCMLCSLKHMAEGSHWSGRKAYAPGIHRSLSQIKKGFSKNRQEDTHEFFRFVTDALQNTALAKLPKCVLPYNHRKFAHTTSRDTPEKIKHTSWVYRIWGGRVRSRVVCSRCNNPSDTFDSFLDLSLDVNKQGKKSVLGMLAGFTKEDRLEGDNKYHCERCKRKANATKSFKIDQAPPILTLHLKRFSVNYNPYSGRARAEKFNQPIKFEQTLDIAPYMVDPASPGTKYRLFGVTCHRGTELRFGHYTSYVRGPSGQWFHADDDEVSPVQLEQVLNDKTAYLLSYIRVDNGNEGLCESPAVRDRVKGLVNGSAKGMRDDESESQSEAESSSHKSSSPIKRKSTYDPEDPPRMKIGAFVNNKAYAPSTNKSESPFSDGENKMPPELPKFGYKPKPTIRAPAPVEASSFYTSPVARPSNSLAGMSKKEKKKFKHKEKGKPRHSATPMPFAQGRVGNGRNRQPGVLSRMKGRA

SEQ ID NO: 5872 - protein, 484 aa, Francisella tularensis subsp. tularensis SCHU S4
MSQKLKRGLHTRHMSMIALGGCIGTGLFVALGGAIADAGPGGTVLAYVIIAIMVYFLMASLGEMAAHSPVSGTFCEYATRYVDPALGFSTGWSYWFNWAITVATEVIAAALIMQYWFPGSSILLWSGFFFVLVFALNIFSVKIYGEVEYWLSFIKVSTVIIFIIVGFLSILGLVGNHQSVGFQNWHIGDAPFHNGWWGFISVFMIAGFSFQGSELIGVTAGEAKDPNTSIPKAIKQTFWRLFIFYILAVVIISFLIPYNNPSLIKAGASNDVSVSPFTIVFENVGLNSAATIMNVIILTAIISACNASMYSATRVLWHLGNIKQAPQFFATTNSKGTPMIALLVTAVIGSSFFFVSFVGSGYIFTWLVNVSSLAGFIAWFTIALSHYRFRRAYIKQGKSLEDLPYVAKFFPWAPIIALTMVSIVIVGQGVTMLTMEGRTWFSVIIEFLSTYIGFFAFVILYFVYKFIKKTKLIRLEDCDLTRES

SEQ ID NO: 5873 - protein, 534 aa, Arabidopsis thaliana
MKNRSLGFWAIGVLLIGSLIGATEGSIHEYNNEKFTAKFNARFFHGGSEGLYASKSQDLNSSSSSDNSFKGKSFIRFDDVTFVRTKESASKQNAMQSTSGLVEAIILEVKDRDRIGGTFLKSEVICCTPELADTGSCSLGEVIIKRESNDVEWPRQIKTFFKGNKTEVNMSPETVVINKTGMYYLYFMICDPELDGTRIKGRTVWKNPDGYLPGKVAPLMNVFGFMSLAYILLGLVWFVRFVQFWKDIIQLHYHITLVIALGMCEMAVRYFEYVNFNSTGMRPMDVTLWAVTFSSIKKTLSRLLLLVVSMGYGVVKPTLGGITSRILLLGVIYFVATEALELVEHLGNINDFSGKTMIVLVIPVALLDACFILWIFSSLARTLEKLQIKRNMAKLELYRNFTNALAISVLLSIAWIGFESYASFGLHQIILQGSNTSISVYSNVLDSDGPNGSTAKDVKIQDTYLLFTERLSFCTQLTSNWFKPFRYSYLAETGDEFEEEGISLTGSGIKSTEDVERNELLFGLPDDVEEGKRE

SEQ ID NO: 5874 - protein, 532 aa, Oryza sativa (indica cultivar-group)
MGSADLVLKAACEGCGSPSDLYGTSCKHTTLCSSCGKSMALSGARCLVCSAPITNLIREYNVRANATTDKSFSIGRFVTGLPPFSKKKSAENKWSLHKEGLQGRQIPENMREKYNRKPWILEDETGQYQYQGQMEGSQSSTATYYLLMMHGKEFHAYPAGSWYNFSKIAQYKQLTLEEAEEKMNKRKTSATGYERWMMKAATNGPAAFGSDIKKLEPTNGTEKENARPKKGKNNEEGNNSDKGEEDEEEEAARKNRLALNKKSMDDDEEGGKDLDFDLDDEIEKGDDWEHEETFTDDDEAVDIDPEERADLAPEIPAPPEIKQDDEENEEEGGLSKSGKELKKLLGKAAGLNESDADEDDEDDDQEDESSPVLAPKQKDQPKDEPVDNSPAKPTPSGHARGTPPASKSKQKRKSGGGDDSKASGGAASKKAKVESDTKTSVAKDETPSSSKPASKATAASKTSANVSPVTEDEIRTVLLAVAPVTTQDLVSRFKSRLRGPEDKNAFAEILKKISKIQKTNGHNYVVLRDDKK

SEQ ID NO: 5875 - protein, 148 aa, Lithospermum erythrorhizon
MATTEGCLVASTNRGCKAIYASGGATSVVLRDAMTRAPVVRFGTAKRAAELKFFLEDPLNFETIAAAFNQSSRFGRLQSIKCAIAGKNLYTRFSCSTGDAMGMNMVSKGTQQSLEFLQNEFPDMDVIGISGNYCSDKKPAAVNWIEGR

SEQ ID NO: 5876 - protein, 565 aa, Oryza sativa (indica cultivar-group)
MASHALRLHPLLFSAAAARPAPLAARPGGGARRVHRRHSLAVVRCSSSAAQALKVKVFQQENYLANWIQALFNSLPPEDYVGGTLVLGGDGRYFNKDAAQIITKIAAGNGVGKILVGRNGLLSTPAVSAVIRKRQANGGFIMSASHNPGGPDNDWGIKISEIKTADIPDVDLSSLGVVSYGDFTVEVIDPVLDYLELMENVFDFQLIKGLLSRPDFRFVFDAMHAVTGAYADPIFVEKLGADPVDYILNGVPLEDFGNGHPDPNLTYAKELVFTMFGSGAPDFGAASDGDGDRNMILGRRFFVTPSDSVAIIAANAQAAIPYFQSGPKGLARSMPTSGALDRVADKLNVPFFEVPTGWKFFGNLMDAGKLSICGEESFGTGSDHIREKDGIWAVLAWLSILAHRNKDKKAGERLVSVEDVAREHWATYGRNFFSRYDYEECESESANKMMEHLRDVIAKSKPGEKYGNYTLQFADDFSYTDPVDGSTVSKQGLRFVFTDGSRIIFRLSGTGSAGATIRIYIEQFESDASKHDLDAQIALKPLIDLALSVSKLKDFTGRDKPTVIT

SEQ ID NO: 5877 - protein, 367 aa, Sinningia cardinalis
MAPSPRVEILASSGNQSIPMEYVRSKEELKSMCTDIFLEEKSNEGPQVPIIDLKAISAEDEDTRKKCHEELKKAAMEWGVMHLINHGVSEEIISRVKIAGKEFFELPVEEKEKYANDQAAGNLHGYGSKLANNANGMLEWEDYFFHCIFPEEKRDFSIWPENPTDYIPSVSQYGKQLRGLATKILSVLSLGLGLEEDRLENEVGGMEELLLQHKINYYPKCPQPELALGVEAHTDISALTFILHNMVPGLQLFYQGKWVTAKCIPNSIIMHIGDTVEILSNGKYKSILHRGSVNKEKVRISWAVFCEPPMEKIVLKPLPETVSQDKPPLFPPCTFAEHVKHKLFRNGSEDAAVDKKSIGDECKEARG

SEQ ID NO: 5878 - protein, 665 aa, Escherichia coli CFT073
MNSQLLANAIRMLSVDAIQKANSGHPGAPMGMADIAEVVWRRHLRHNPKNPQWFNRDRYVQSNGHGSMLIYALLHLTGYDLSMDDIRDFRQLHSRTPGHPEYGYTPGVETTTGPLGQGVANAVGMAIAEKALAAEFNKPGFNIVDHHTWLFLGDGCLMEGISHEACGLAGTLKLGNLIAIWDDNGISIDGHVEGWFAEDTAARFRAYGWHVIEGVDGHDPEEVDAAVREAKSVTDKPSLLCCKTIIGFGSPNKANSHDCHGSALGADEVALVRERLQWPYAPFEIPGEIYAAWDATEKGAQVQQEWDALFADYAKQWPELAAEFTRRMKGDLPAGWVENMQKYVHDLQSHPAALATRQVSQKCLNHFADMLPELMGGSADLSPSNLTRHQKSVDFTGENPAGNYISYGVREFGMSAIMNGLALHGGFIPYGGTFLMFMEYARNALRMAALMKIRSVFVYTHDTIGLGEDGPTHQPVEQLASLRLTPNMETWRGCDQVEVAVAWQQAIERKDGPTSLVLTRQPLAQQPRTAAQLAEIARGGYVLSDCDGQPEMILISAGSEIELVVSAAKALTEEGRKVRVVSLPCTERFDNQDAAYKESVLPKAVRKRLAVEASIAGFWERYVGLNGKVIGMTSFGESAPANVLFKHFGFTPENVLAQARELLNS

SEQ ID NO: 5879 - protein, 420 aa, marine gamma proteobacterium HTCC2080
MTADRAAFAVLGATGFTGRAIVGYLLKRISAPLKWIIAGRDVQALTEMAAEFAQGYAPEIVEIEDLGLADIGRLTSQTEWLINAAGPYAHHGDRVIESCLGSGTHYIDISGEVDVIGDWIHLFHDRAVAANIQIIPAAGFEALPFDLMTRAAVERMAADHPVTQVHVDVLLSYRGLSWVNFSQFASSGTVATALETLVRNPSKQRLIDPSSLIANDLAQFSRDRNRLDLSAKYDHEYQVWRAPLVPGPFINPAVIHRSNALLNGLGEGYGQGFSYEESMNVSSIAPWPLGQSVLANTLASSAREFLAALGEDSVRRQSTLALWRSLAEQPSRVTSKSLDAVGYQLDVVASHHGTPKVRARMYGTGHPGYRSTGNIIGEIALGFAKSRGKVRRGGVLTPAVGLEKDILARLNKAGISCCWL

SEQ ID NO: 5880 - protein, 674 aa, Oryza sativa (japonica cultivar-group)
MNPKLLFFPLLATLLLLCHHAHAVCEPATCGDLTIKYPFWLSGPDLNRSSLAIAACGHPSFELWCSRDGVASLRGSQILVLGIDYTNSSFVAGHKRVADGGDGVCRTDFNISSSLALSPFTISSSNRAICFLYSCNGTEPPEIDGLVNATISNCSKPIYAYLGGSYDRDKPPAIKAGNCTYSYLPVLWPESPVNLTAGTNYSPLFKKGFVLEWQKNGFGDCDACNASGGQCRYNNDSAAAFACLCSDGELRGTICAGSKKTGRRTILIVLTAAAAGLLLPCIYVLIWHGKGKQLRYFLYTKTSSTSERNIEALIISYGSIAPTRYKYSEVTKITSFLNYKLGEGGYGVVFKGRLQDGRLVAVKFLHDSKGNGEEFVNEVMSIGRTSHINIVSLFGFCLEGSKRALLYEYMPNGSLDDYIYSENPKEILGWEKLYGIAIGIARGLEYLHHSCNTRIIHFDIKPQNILLDQDFCPKIADFGLAKLCRTKESKLSMTGARGTIGFIAPEVIYRSFGIVSTKSDVYSYGMMLLEMVGGRKNAKSMVENSSEKYFPDWIYDHFALDDGLQACEVTSEVEQIAKKMTLIGLWCVQVLPMHRPTITQVLDMFERSLDELEMPPKQNFSELLEHPAQEINTESTSSTINTKAAQALSEVLRVEETSLVNSKDPTVTTNYAKR

SEQ ID NO: 5881 - protein, 200 aa, Pavlova lutheri
TLMPGGVSSPVRAFKSVGGDPVVFDRVKGAYAWDVDNNKYIDYVGSWGPAIIGHADDEVLAALKKVIDKGTSFGAPSALENVLAKMVIDAVPSVEMVRFTNSGTEACMGVLRLMRAYTKREKLIKFEGCYHGHADSFLVQAGSGVATLGLPDSPGVPQGATKSTLCAKYNDLKSVEAIFDANPGEIAGVILEPVVGNSGF

SEQ ID NO: 5882 - protein, 453 aa, Pseudomonas putida KT2440
MSVNNPQTREWQTLSGEHHLAPFSDYKQLKEKGPRIITKAQGVHLWDSEGHKILDGMAGLWCVAVGYGREELVQAAEKQMRELPYYNLFFQTAHPPALELAKAITDVAPKGMTHVFFTGSGSEGNDTVLRMVRHYWALKGKPHKQTIIGRINGYHGSTFAGACLGGMSGMHEQGGLPIPGIVHIPQPYWFGEGGDMTPDEFGVWAAEQLEKKILEVGEDNVAAFIAEPIQGAGGVIIPPETYWPKVKEILARYDILFVADEVICGFGRTGEWFGSDYYDLKPDLMTIAKGLTSGYIPMGGVIVRDTVAKVISEGGDFNHGFTYSGHPVAAAVGLENLRILRDEKIVEKARTEAAPYLQKRLRELQDHPLVGEVRGLGMLGAIELVKDKATRSRYEGKGVGMICRTFCFENGLIMRAVGDTMIIAPPLVISHAEIDELVEKARKCLDLTLEAIQ

SEQ ID NO: 5883 - protein, 452 aa, Pseudomonas putida KT2440
MSNNLDQLTDWLKEHKITEVECMISDLTGITRGKISPTNKFIAEKGMRLPESVLLQTVTGDYVDDDIYYELLDPADIDMICRPDENAVFLVPWAIEPTAQVIHDTYDKKGNPVELSPRNVLKKVLKLYADKGWQPIVAPEMEFYLTKRSEDPDFPLQPPVGRSGRPETGRQSFSIEAANEFDPLFEDVYDWCELQQLDLDTLIHEDGTAQMEINFRHGDALHLADQILVFKRTMREAALKHNVAATFMAKPMTGEPGSAMHLHQSVVDVATGKNIFSNEDGSMSALFLNHIGGLQKFIPEALPLFAPNVNSFRRFLPDTSAPVNVEWGEENRTVGLRVPDAGPQSRRVENRLPGADANPYLAIAASLLCGYIGMVEGIEASAPVQGRGYERRNLRLPLTIEDALERMENSRALVQYLGKKFITGYVATKRAEHENFKRVISSWEREFLLFAV

SEQ ID NO: 5884 - protein, 376 aa, Oryza sativa (indica cultivar-group)
MATVSGTDRLRDLHAFDDTKAGVKGLVDAGVTTVPYFFRHHPDPLPVAAPSEAASAIPLIDLAKADVDRGRVVAEVRAAAETVGFFQVVNHGVAGELMDEMLAAVRRFNEEPLEAKVPYYTRDVASKVRFSSNFDLFRSPAANWRDTMFVEMFPEVPSPEEIPPPCRGVLEEYAAAVRRLGERLFELMSEALGLPAGYLGRDAGGTDGLSVAAHYYPACPEPEATMGATKHSDPSFLTVLLQDTSGGLQAVLPRPPEERWVDVPPVAGALVVNVGDLLQLVSNERLRSVEHRVLPTGAAGPARVSVACFFSLAYSSTRPCVPVVGGGSGARAAAVYRSTTAGEFLAHYNGKGLDGRSALDHFRIPAAAASPPPPPQ

SEQ ID NO: 5885 - protein, 330 aa, Glycine max
  misc_feature (263)..(263): Xaa can be any naturally occurring amino acid
MNFRFQNLLGAPYRGGNVVISSNTVLLSPVGNRVAVTDLLKSETTTLPLQSSSNVTRITVSPDATFLLAIDDRNRCLFINLRRRALLHRITFKHRVAASKFSPDGALIAVAAGKLVQIWRSPAFRREYFPFELGGTFADFDAKVTSLDWSPDSKYLVAGSKDLTARILCLKKLNTGGVKKRPFLLLGHRDSVAGSFFGVNSKTNRVCKAYTVSRDCYLFSWGFTSDDDGEGEEDGGEGSEPPSPGTPERDVEENFELSENDGXEEKKKISENDGVKKRKKIDIEDGDEGYLSRGKWELLRKDGFMQGWAKVTACDYHRGLDMVVVEFSNG

SEQ ID NO: 5886 - protein, 348 aa, Oryza sativa
MHHVTEGHQLQPINVENGNNGNATRTEKRLGWSTEEDLRLVSAWLNNSNDPIESNFKKNDKYWADVAAAYNSTTPSSRFRQVKQVKDRFSKIKKKVGNFCCSWKEANSLYASGECNVDLMAKAQKIYENDFKDGPFLLTQCWNELKTQPKCHAYLDQLDKLTSLAGFRSPLFLDTVRGEAPQVHYYVNGKEYNHEYYLADGIYPEWAVFQKTIPLPQTEKHKLYAEHQEGARKDVERAFGVLQARFNNVRRPAKKWKRKSVGNIMLACVILHNMIVEDEGEDAICDLDLNRIPRTSIVLPPEVTSGGNPCFRDVLSRKAAIRARSMHTQLKTNLLEHIWNRFRNTQRA

SEQ ID NO: 5887 - protein, 495 aa, Chromobacterium violaceum ATCC 12472
MARSHAEWKQLAAELKIEGRAFINGEYRDAAEGKRFDCVNPANGAKLAEIAHCGEAEVEAAVKAARRAFESGVWSELAPLKRAAVLKRFAALIREHADELSLLETLDVGKPIGDTTAVDVPASAYCVEWFAEAIDKVGGEVVPVDPKLVGLVTREPIGVVAAVVPWNFPILMASWKFGPALAAGNAVIVKPSEKSPLTAIRIAALAKQAGIPDGIFQVLPGAGDVGRLLALHMDVDCVAFTGSTNVGKLIAGYAAQSNLKRAWLELGGKSPNIILPDCPDLARAARAAASGIFYNMGEVCTAGSRVLVHKDIKERFLEEFKKAAAGFFPGDPLDPATSMGAIVDDIQYRKVLNYIDKGLSEGANLLLGGKAVHTDKGLFIEPTAFDCPSDDLTICREEIFGPVLSVITFSELDDAIRIANDTSYGLAAAVWTSNVSTAHQVSRRLRAGTVWVNCYDEGGDMNFPFGGYKQSGNGRDKSLHALEKYTELKSTLIKL

SEQ ID NO: 5888 - protein, 316 aa, Vibrio vulnificus CMCP6
MSNKLEQLRKLTTVVADTGEIDAIKKYQPEDATTNPSLILKAAQIAEYAPLIDASIEYAKTQSDDKAQQIQDTCDMLAVNIGKEILKTIPGRISTEVDARLSYDMEGSVAKARQLVKMYNDAGITNDRILIKLASTWEGIRAAEILEKEGINCNLTLLFSFAQARACAEAGVFLISPFVGRIMDWYKAKEGRDFEAQEDPGVLSVTKIYNYYKEYGYKTVVMGASFRNIGEILELAGCDRLTIAPALLAELEAAEGEVVEKLVDSKGAAERPAAMTHAEFLWEHNQDPMAVEKLAEGIRNFAVDQGKLEAMIAAKL

SEQ ID NO: 5889 - protein, 663 aa, Vibrio vulnificus CMCP6
MDRKQLANAIRALSMDGVQKANSGHPGAPMGMADIAEVLWRGHLNHNPSNPEWADRDRFVLSNGHGSMLIYSLLHLSGYELSIDDLKNFRQLHSKTPGHPEYGYAPGIETTTGPLGQGITNAVGMAMAEKALAAQFNKEGHDIVDHFTYVFMGDGCLMEGISHEACSLAGTLGLGKLIAFWDDNGISIDGHVEGWFSDDTPKRFEAYGWHVIPAVDGHNAEAINAAIEAAKADPRPTLICTKTIIGFGSPNKSGSHDCHGAPLGAEEIAATRKELGWEHGPFEIPQEVYAEWSAKEAGAAKEAAWNEKFAAYEAAYPELAAEFKRRVNGELPAQWEEKANQIIADLQANPANIASRKASQNALEAFGKMLPEFMGGSADLAPSNLTMWSGSKSLEASDFSGNYIHYGVREFGMTAIMNGIALHGGFVPYGATFLMFMEYARNAMRMAALMKVQNIQVYTHDSIGLGEDGPTHQPVEQIASLRLTPNMSTWRPCDQVESAVAWKLAIERKDGPSALIFSRQNLAQQPRSAEQVADIAKGGYILKDSDGKPELILIATGSEVELAVKAAEQLTAEGKKVRVVSMPATDTFDKQDAAYREAVLPSDVTARIAIEAGIADFWYKYVGFDGRIIGMTTFGESAPADQLFEMFGFTVENVVNTAKELLA

SEQ ID NO: 5890 - protein, 434 aa, Streptococcus pneumoniae TIGR4
MQFPEGFVEKYKEILGDEARDFLASFEEEAVSAFRVNPLKEEQLSFSDAITQTPWGHYGKVSGKSPEHATGLVYSQEPAAQMVAQVAQPSPGMKVLDLAAAPGGKSTQLAAYLAGEGLLVSNEISSKRAKILVENMERFGATNVVVTNESADRLVKVFKGYFDLIVLDAPCSGEGMFRKQPDAMDYWSLDYPSQCASLQREILEDAVTMLAEGGHLVYSTCTWAPEENEEIVNWLLEEYDFDLLPVEHINGMVAGIDLPETARMYPHQFKGEGQFVAHLQFKGNNPAPKFKASKSNLSREQVALWQEFAQNHLKVNLPGILQIFGDQLYLLPELLPDLWKLKIARNGLHLGTFKKKRFEPSFALGLALKPSQVEQSVEIGQEAFVKYAAGETVQLAESLPNGWYQVLVKGNGLGFAKVTGNVLKNYFPKGLRFK

SEQ ID NO: 5891 - protein, 358 aa, Ustilago maydis 521
MADFVKLSIFGTVFEVTTRYVDLQPVGMGAFGLVCSANDQLTSTSVAIKKIMKPFSTPVLSKRTYRELKLLKHIRHENIISLSDIFISPLEDIYFVTELLGTDLHRLLTSRPLEKQFIQYFLYQILRGLKYVHSAGVVHRDLKPSNILVNENCDLKICDFGLARIQDPQMTGYVSTRYYRAPEIMLTWQKYDVAVDVWSAGCIFAEMLEGKPLFPGKDHVNQFSIITELLGTPPDEVIKTICSENTLRFVQSLPKRERVPFSQKFKNADPMALDLLEKMLVFDPRTRISAAEALAHPYLAPYHDPTDEPEAEEAFDWSFNDADLPVDTWKVMMYSEILDFHNIDNSGQDEGPVPPVNN

SEQ ID NO: 5892 - protein, 371 aa, Yersinia pestis CO92
MSHENLKGAQMAEGIPETMRAVVAYGPRDYRFERVPVPTIDAKEILVKVEGCGICAGDTKAFEGAPSFWGDDKQPAYIKAPMIPGHEFIGHVVGLGADVEGFELGDRVTSEQIVPCWGCRFCNHGQYWMCEKHDLYGFQSNVNGAMAEYLKFTKEAINYHVPDHLPLEKAILIEPYACAFHAVQRAKIKLGDVVVLAGSGTLGLGMIGAIKKSGAAKLIVLDLSDDRLALAKKFGADLVLNPSRDDVNTLIKEMTGGYGCDIYIDATGAQKAVEQGLTLLRKLGTFVEFSVFKDPVTVDWSIISDRKELDVLGSHLGPYCFPLVIEGISNGDLPTEGVVTHILPLEKYAEGIELVKRGVDSLKVVLNPNLT

SEQ ID NO: 5893 - protein, 609 aa, Saccharomyces bayanus
MPLSEDFGSSGKKEASPDSISIRSFSAVNNLQSSSSEKNYSGQTTRNNKLIHRFVDSFKRAEGSTTHTKQINENTSDLEGDVNSFTSDSKLKKSMKSRHVVMMTLGTGIGTGLLVANAKGLHYGGPAALVIGYFLVSFVTYFMIQAAGEMAVTYPTLPANFNAYSSIFISKPFGFATVWVYCFQWLTVLPLELITAAMTIKFWNDTINPDIFILIFFVFLLFIHFFGVKGYGETEFIFNCCKILMIAGFIILSVVINCGGAGNDGYIGGKYWRNPGAFAGDTSAGRFKNVCYILVTAYFSFGGMELFALSVQEQANPRKTTPVAAKRSIYRILVIYLLTMILIGFNVPYNDDQLMGAGGSATHASPYVLAASIHGVKVVPHIINAVILISVISVANSSLYAGPRLMCSLAQQGYGPKFLDYVDREGRPLIALIVCSVFGVIGFVAASSKEEVVFAWLAAIAGLSELFTWTSIMLSHLRFRQAMKVQGRSLDELGYKATTGIWGSAYGVFFNILVFIAQFWVALAPLNNGGKCSAESFFQSYLAFPIWIAFYLGYMIYNRDFTFLNPLDKIDLDFHRHIYDPELMRQEDLENEERKRDMSLMRKTYHFWC

SEQ ID NO: 5894 - protein, 454 aa, marine gamma proteobacterium HTCC2080
MLLGQAMTAMIYPTTNPAATEVMVVSRGEGPYIYDQAGKQYLEGMAGLWCTSLGYGNQEIIETATRQMEQLSFSHMFSGKTHPSAIELADKLAAMAPIDDARVFLGASGSDANDTLVKLIRYYAVASGQPDRVKIIARDKGYHGVSVASAALTGLHANHAHFQLPFDALGVLRTGAPHYYRCAEAGETEADFVARRASELEALILDEGPDTIAAMIAEPVNGAGGVIIPPEGYFEAVQAVLDKYGIMLWDDEVICGFGRLGAAFGAEKLNMKPRMMACAKALTSAYVPLSAAIVAGDIAEAIAGPAADMGVFGHGYTYSGHPLGCAVASKVLDIYVRDRLFEHAATLGAYMSKRLAEFSDHPLVGEVSAMGLLGALELVANKDSKQPFEGMRVAQFCAKAAEDNGLIIRPLGGNRMALCPPLIIQEAHVDEIMDKLSRALDSTLDFVTAEGLTV

SEQ ID NO: 5895 - protein, 235 aa, Zea mays
GPGTTMECSVTLWEHFLGKEKAVEVSGPLVMRPNPGDEYTITELNQVSWSFEGTPQILVPIADGSEEMEAVAIIDVLKRAKANVVVAALGNSLEVVASRKVKLVADVLLDEAEKNLYDLIVLPGGLGGAEAFASSEKLVNMLKKQAESNKPYGAICASPALVFEPHGLLKGKKATAFPAMCSKLTDQSHIEHRVLVDGNLITSRGPGTSLEFALAIVEKFYGREKGLQLSKATLV

SEQ ID NO: 5896 - protein, 525 aa, Ralstonia eutropha JMP134
MTRLLRLGKILFVILYYGLDELVLSGFQNRKIRFLVRVMTIGRKLDMPRGERLRLALTKLGPIFVKFGQVLSTRRDLMPPDIADELALLQDQVPPFDSAVAVKIIERSLGRTLADLFETFEHQPVASASIAQVHFATLKGGPNHGREVAVKVLRPGMLPVIDSDLALMRDLATWLERFWADGKRLKPREVVAEFDKYLHDELDLMIEAANASQLRRNFADTNLLLVPEVFWDWCSSTVFVMERMHGIPISRTESLKAAGVDMHQLAEEGVEIFFTQVFRDGFFHADMHPGNILVSVQPETFGRYIALDFGIVGALSEFDKNYLAQNFIAFFRRDYHRVALLHVESGWVPPDTRVEELESAVRACCEPYFDKPLKEISLGMVLMRLFQTSRRFNVEIQPQLVLLQKTLLNIEGLGRQLDPDLDLWKTAKPFLERWMHEQVGWKGAWERIKVEAPLWAKMLPDFPRLAHQFLERRALNTNGEQERLLAQLVTEQRRTNRLVGTALLLVGGFVAGIVLTHVLGWIGYW

SEQ ID NO: 5897 - protein, 425 aa, Mesorhizobium loti MAFF303099
MSGRSLMSPVWHPFTQHALELAIPEIARTEGAYLHKADGTRILDAISSWWVVTHCHRHPRIIKAIETTAASLDQIIFAGFTHEPAERLARALVGLAPAGLDWVFYSDSGSTSVEVALKMALGYFRNIGAPRSRIVVMEHSYHGDTIGTMSVGARGVFNAAYEPLLFEVDTIPFPAAGQEQETLDRFEAVSRDRRAAALIVEPLVLGAGGMQMYPAWVLAELKKITEASGTLLITDEVMTGWGRTGTMFACEQASISPDILCTSKGLTGGTIPLAATLATDAIFQAHYSEDRKKTFFHSSSYTANPIACGAALANVEIWRDEPVAERIAALSAMQAAGLRRFGDNPRFTDSRVTGTIAALDLRTSSAGYLADIGPKLRAFFLERGLLVRPLGNVLDLMPPYCITGDELDGLYDAIEEAAERFGSRP

SEQ ID NO: 5898 - protein, 580 aa, Xanthobacter autotrophicus Py2
MPEATQSPAAPALTNQQRARAVRRLFLRIALHIFFWDIVMTRGPLKRLRRAPAPRWAALARQYRREAERLGGVLIKLGQYVSARVDLLPEEVTHVMADLRDAVPPVPGPQIIAQIEEDFLLPITGLYHSFDEVPIGAASLGQAHRAVLPEGQPVVVKVLRPGIDAIVASDLEIVGQFIRQLKRLESIRRRVDLDLLASEFTAVTYRELDLVAEARNCERFAREFAHEPTIHTPTIYWSRSGRRTLTMEDVSYFPIHDVLGFEAAGIDRRRVASKLMDCYLDQVFRHGFVHADPHPGNLFVRPLAADGESAASWPPFSLASGRVHIPHVANRPFQVVFIDFGMAVEIPERLRHSLTTYATGMVARDAYTIVQSYVEGDLLLPDTDLDELERMTAALINKFPHALVGQVRKKDLTPFAELSEEYQTLLYNSPMKMKAELLFVFRAMGICSGTVAGIDAAFDPAERFMPLAQRLVADELKPDSDRLKRLISATVRLPMRLDNLLTTLERGKLRIRTDGADRRRDDIRQLTRAANRLGVAVLAGSAMICAVLLGRQGEIVTTPTGLAVLAIAVVAAGVLIKQRS

SEQ ID NO: 5899 - protein, 280 aa, Cryptococcus neoformans var. neoformans B-3501A
MPSTEDVYSNDQDWYPGIRQRSKPGKAPHEAIYDKTQDINGTLVTDKPANRAMLANQRRQKEHDAKVQAKRERRAAQMGQQSKSSLWTFLPILLFLPLLSSFLTQSYTFNLSPYVLPHLRNFWAETPLNIWRREMKEFTPLQLAMFDGSPDRPVYLAIDGIVYDVSANRRIYGKGGSYNMMAGRDASRAFITGCFETHLTHDIRGLSKEELASLEHWKSFFAKSDKYFKVGTVLNPPIDTESPIPPSCREDESASGADIHAPGEAAAKKGKIKPGPVHGQ

SEQ ID NO: 5900 - protein, 459 aa, Chromobacterium violaceum ATCC 12472
MQKQRTTSQWRELDAAHHLHPFTDTASLNQAGARVMTRGEGVYLWDSEGNKIIDGMAGLWCVNVGYGRKDFAEAARRQMEELPFYNTFFKTTHPAVVELSSLLAEVTPAGFDRVFYTNSGSESVDTMIRMVRRYWDVQGKPEKKTLIGRWNGYHGSTIGGASLGGMKYMHEQGDLPIPGMAHIEQPWWYKHGKDMTPDEFGVVAARWLEEKILEIGADKVAAFVGEPIQGAGGVIVPPATYWPEIERICRKYDVLLVADEVICGFGRTGEWFGHQHFGFQPDLFTAAKGLSSGYLPIGAVFVGKRVAEGLIAGGDFNHGFTYSGHPVCAAVAHANVAALRDEGIVQRVKDDIGPYMQKRWRETFSRFEHVDDVRGVGMVQAFTLVKNKAKRELFPDFGEIGTLCRDIFFRNNLIMRACGDHIVSAPPLVMTRAEVDEMLAVAERCLEEFEQTLKARGLA

SEQ ID NO: 5901 - protein, 468 aa, Rhodococcus sp. RHA1
MQEPTARPVGPYASGPPPAALTVHSASLDHFRAAELWRALVIGVVVVAYTLFALVTWPVRRRGRTLADAASEGLVNGFEVLGPTFVKVGQLMASSSGVFPAPLANACLRCLDDVPPVPAEEARRVIEADLGHPVDALFASFDDVPLAAASVAQVHGCVLPDGREAVIKVQRPDIFRRMVVDLRTAYWGARILEKLFEFFRIANATAIIRDLHAATMTELNSAVEADRQARFRTNIGAFGDNKGVTTPEVYWDYCGPHVICMERMYGLPLDRFPDLVHMDTRMLIRRGVKVWIESVILHGPFHGDVHAGNLWVLDDGRIAMLDFGIVGELPDSWRQILRDMFYATLIDGDFSRMARGIRSLGYATDNDATDDEIGLQVAAALAPLLGRDLGELRLSELIMALIGIGKKWGVASPEELVLFGKQLGYFERYATELAPGWVIGQDLFLFRNVFPDAVAAKALELGVELPDE

SEQ ID NO: 5902 - protein, 275 aa, Medicago truncatula
MSTLPEKKDQHSEENKNSNDSNTVVSSYWGITRPKVKREDGTEWPWNCFMPWESYSSDVSIDVTKHHVPKTFGDKFAFRSVKFLRVLSDLYFKERYGCHAMMLETIAAVPPMVGGMLLHLKSLRKFQHTGGWIKALLEEAENERMHLMTMVELVKPSWHERLLVITAQGVFFNAFFVFYILSPKTAHRFVGYLEEEAVISYTQHLNAIESGKVENVPAPAIAIDYWRLPKDATLKDVITVIRADEAHHRDVNHFASDIHHQGKELKEAPAPIGYH

SEQ ID NO: 5903 - protein, 353 aa, Aeropyrum pernix K1
MIPKYSPFSDSVRLYEVGFNEIVDFFYRLAEAGDKLREEGVWLAYGPEKLPEALEKPVNGTVAVKLGFPIYQKGGVVMDVTNVEQAGIAEDAGAVAVMVLDKLPYDVRKAGGVARMADVKVIEQVMSSITIPVMAKVRIGHYYEAMILESIGVDMIDESEVLTPVDEKHHINKWLFKVPFVNGARSLAEALRRIAEGASMIRTKGEAGTGNVAEAVRHMKLIMGDIWRLRGLSAEERLRVAREYGVPHQLVDLTARLGRLPVVNFAAGGIATPADAALMMWLGADGVFVGSGIFKSSDPSERAAAIVLATSMWDDPEAVAEAQRMVSEAKSMMGIDIRKLSPEELLQVRGAEA

SEQ ID NO: 5904 - protein, 306 aa, Arabidopsis thaliana
MISDSIPKELILEIMLRLPAKSIARFHCVSKQWASMLSRPYFTELFLTSSSTQPRLLFAIKRNGLWCFFSLPKHQSPYDNSSSSLVVAADFHMKFLPNKIQMYSSSENRKLSCCYASGLTYFYDMYSEVRVICNPITGRYASLPYLKRYRKELSFFGFDPIDKQFKEWLKYAYSLRDDKFFTHDVFVVRVTATEMNTIQRVEIQGFGECQHEYDYYRSRVVYVFADHVEDLDVNDPKLLESKEEEEEEEEEEEEEEEEEEEEEEEEEEEESKEREKEKKIETVIGGWIKQYWACFLRKSWELNPHR

SEQ ID NO: 5905 - protein, 232 aa, Bacillus anthracis str. Sterne
MIYSCYPIIIFRENREMTNNNQIGENKEQTIFDHKGNVIKTEDREIQIISKFEEPLIVVLGNVLSDEECDELIELSKSKLARSKVGSSRDVNDIRTSSGAFLDDNELTAKIEKRISSIMNVPASHGEGLHILNYEVDQQYKAHYDYFAEHSRSAANNRISTLVMYLNDVEEGGETFFPKLNLSVHPRKGMAVYFEYFYQDQSLNELTLHGGAPVTKGEKWIATQWVRRGTYK

SEQ ID NO: 5906 - protein, 184 aa, Arabidopsis thaliana
MKSRRQNVSVARQTILGRDENFEPIPIDLVIEIFSRSPVKSIARCRCVSKLWASILRLPYFTELYLTKSCARPRLLFACQKHRELFFFSTPQPHNPNESSSPLAASFHMKIPFDGRFNIISPIGGLVFVRYEQILKGRKTPEFVSAICNPSTGQSLTLPKPKTRKRIWGTSHFGYDPIEKQFKV

SEQ ID NO: 5907 - protein, 1094 aa, Francisella tularensis subsp. tularensis SCHU S4
MPKRTDIKSILVLGAGPIVIGQACEFDYSGTQACKVLKEDGYTVFLVNSNPATIMTDPTTTDKIFIEPITVESVGKIIARERPDAILPTVGGQTALNCALALDKAGILEKYNVEMLGAKADSIDKAENRERFNKAMAKIGLEVPRNVVVQSLEQAYKALEDIGLPAIIRPSFTLGGSGGGIAYTKEEFEKIVKNGLSLSPTNEVLIDESILGWKEYEMEVIRDKADNSIIVCSIENIDPMGIHTGDSITVAPALTLTDKEYQIMRDASIAVLREIGVETGGSNVQFAVNPKDGKLVVIEMNPRVSRSSALASKATGYPIAKVAARLAVGYTLDEIDNDITKVTPASFEPTIDYIVTKIPRFTFEKFPTTPSNLSSQMKSVGEAMAIGRSFIESLQKALVSLETGLTGLDQVEIPGVDESKSLKENKTAILKSLEELSPMRILRVAQALRYGISQQEIHDACKIDPWFIEQIAIIIDAEERLKKTGLPNSKEEFSVYKNLGFSDAKIAELVGRTERYIRNFRFGKEIYPTFKRVDTCAAEFESQSSYLYSTYEHYSYEEIVRDCESEISDKKKVIILGGGPNRIGQGIEFDYACVHAAKSLKEEGIETIMINCNPETVSTDYDTSDKLYFEPLMAENVLNIIKNEMRKGEVLGVIVQFGGQTPLKLVSALHENNIPILGTDPDKIDLAEDRERFKELLDKVGLKQPLNTIAYTINELKKKIVNVGYPVVVRPSNVLGGRAMEIIHSQEELDAYIKTNSKCILEGPILIDKFLEDATELDVDALADGGERVFVAGIMEHIEEAGIHSGDSACSIPTRSLSNEQIEEVKQATIKLARELNVIGLMNVQFAYQNGQLYVIEVNPRASRTVPFVAKATGNSIANIATKLMLGKKLSEFILNNPIPRHFSVKEAVFPFGRFADVDCYLGPEMKSTGEAMGIDRTFGVAFYKAQEMSFNKLPLKGNILISVSNADKPKIIEPVKELIELGFNIFATKGTERFLKENGIECKLFDKASDNIGNDQVHSTVKAIEAGEVDLLVNTSIRQELKISLALRRAAIMSRVSYVTTIGAFEAFVIAVRDMRKINNDFDVKTVKEWINS

SEQ ID NO: 5908 - protein, 402 aa, Burkholderia xenovorans LB400
MTLTFVRRPPGLQFGGLDVRQLADRAGRTPFFAYDRSAIDIRVRELRNLLPAGMHLHYSIKANPMPAVIHHLAQRVDGFDVASAQEMALALDAGTAPDAIGFAGPGKSHDDLRRAVASGINVHVESETQLRLVTALGWELGVQPSVAIRVNPDFQVGHSGMRMGGGAAPFGVDVDQVPALLRELEAREVALAGFHVFWGSQCLHAATIIKAQRQSADLILRLASGVPRPLRFVNLGGGFGIPYFPGETPLDVKAVCEAMQDWLPPLCERLPGTTPILELGRYLVGEAGIYVCRVIDRKVSRGRTFVVTDGGLHHHLAASGNFGQVLRRNFPVVIGNRPDGVPRERCHVVGCLCTPLDRLADEVELPEAHIGDFVVIMQSGAYGRSASPVRFLSHPEPVEMLV

SEQ ID NO: 5909 - protein, 395 aa, Rickettsia typhi str. Wilmington
MLNKLNKPALFALIFYPILIISLVVKYSFDYGIGLLEIIFIIASYYINNITVGIGLHRLWSHNAYKINKYAEFVLVMLSAGTLQGPALSWASNHYKHHAKTDTDQDPHSPLKFDNKVLGFLWSHIGWMLVGSGSYKFIDRITWAKLGKNNLLKWQLKYYWKIAAFMNIVVPLFTGYLIGGTIQSAYAGFLFIGLGRFLQQQATFSVNSLCHFVGSKKYYRGTAGDIWWMALFLLGENWHNYHHAFPSDYRNGVKWYHFDVHKWIIFLMSKIGLASELERTTKVRIQAKMQETLSYLSEKQKQKLSLMQTKIDNLLENLCLKSKEIEESSLIIKEQLKKSFVEIQESLKNLAEQVSSATQITEKPSEKLLKIVNKKIIDAEQSIYKLYNQLNTLKV

SEQ ID NO: 5910 - protein, 487 aa, marine gamma proteobacterium HTCC2080
MNIELTNPTLFRTEAFVNGEWIGADNGARLPVTNPATGALITDVAKTGAAETRRAIAAAETAMLSWRQQPAKQRAQVMRRWFDLIMANQEDLARIMTLEQGKTLAESRGEVAYGASYIEWFAEQAKRIDGDVIPAPSGDKRIICIKQPVGVCAAITPWNFPNAMITRKAAPALAAGCTIVIKPASETPLSALALAELAHQAGIPPGVLNVLAGSSSDIGAELTSNPTVRKLSFTGSTPIGKMLEAQCVPTLKKTSMELGGNAPFIVFDDADIDSAVQGALISKYRNSGQTCVCSNRLLVQAGIAEEFTAKLVAATESLKLGNGLDENVDLGPLVNAKAVNDVHELVQGSISAGAKLVLGGAPSNLGGCFYQPTILTGVRPEMPVFRNEIFGPVAPIISFETEAEAIELANDTEFGLASYFYTRDIGRVWRVAEALEYGIVGINEGIISNEMAPFGGVKESGSGREGSKYGIDDYLEIKYMLMGGLNQ

SEQ ID NO: 5911 - protein, 387 aa, Rickettsia typhi str. Wilmington
MKKILGIESSCDDTAISIITESRKILSNIIIPQNTEHAVFGGVVPEIAARSHLSNLDQALENVLTKSNTELTEISAIAATSGPGLIGGVIVGSMFARSLSSALNKPFIAINHLEGHALTVRLTDNISYPYLLLLASGGHCQFVAVLGLGKYKILGSTIDDAIGETFDKVAKMLNLSFPGGPEIEKRAKLGNPHKYKFPKPIINSGNCNMSFSGLKTAVRNLIMSLKEVNDSVINDIAASFQFTIGAILSSKMLNAIRLYQQILNYYYENVDYTTNLNLKSFRQDEFNLNHLQDITRPKSRIYLQNSFRSNLLNDTIVIAGGVAANKYLQEILSNCTQTYGYRLIAPPMHLCTDNAAMIAYAGLERYNNKLFSPLNFCPKAKWSLEDI

SEQ ID NO: 5912 - protein, 557 aa, Epichloe festucae
MAGQYGYRELIRKQFTTQKLFFHVLFWIFHWGIFAYGWWKQASEPRLAGLNTLKFSVWISRGAGLVLSVDGMLILLPVCRTIMRWLRPKLRFLPMDENLWFHRQLAYALLVFAILHVGAHYVNFFNVEQTQIRPVSALQIHYAQAGGITGHVMLLCMLLMYTTAHSRIRQQSFETFWYTHHLFIPFFLALYTHTVGCFVRDSVDAFSPFAGEQYWNHCIGYLGWRWELWTGGLYLVERLYREIRARRETQITRVVRHPYDVVEVQFNKPSFKYKAGQWLFLQVPSISKYQWHPFTITSCPFDPYVSVHVRQVGDFTRALGDATGAGGAQAKLYDGVDPMGMYEVALQNGQQMPGLRIDGPYGAPAEDVFENEIAVLIGTGIGVTPWAAILKNIWHLRNSPNPPTRLRRVEFIWVCKDTGSFEWFQTLLSSLEEQSIEAARVPGSSGVEFLKIHTYLTQKLDMDTTQNIVLNSVGADMDPLTELKSRTHFGRPDFNRLFTTMRDGILDRTYLNGLEGSMRTTVGVYFCGPSVAARDIKSACKSATAREVNFRFWKEHF

SEQ ID NO: 5913 - protein, 299 aa, Brassica napus
FVIVDDSGKAVGPIVDGDAVVTFNFRADRMVMLAKALENEDFDKFDRVRFPKIRYAGMLQYDGELKLPSHYLVSPPLIDRTSGEYLAHNGVRTFACSETVKFGHVTFFWNGNRSGYFNEKLEKYVEIPSDSGISFNEQPKMKALEIAEKARDAILSGNFDQVRVNLPNGDMVGHTGDLDATVVACEAADVAVRMILDAIEKVGGIYVVTADHGNAEDMVKRDKAGKPALDKEGKLQILTSHTLKPVPIAIGGPGLSAGVRFRQDLDTPGLANVAATVMNLHGFVAPGDYEPSLIEVVDK

SEQ ID NO: 5914 - protein, 200 aa, Haemophilus influenzae R2846
MLDYELFNPYEGLIFDMDGTLIDTMPVHAQAWTMVGKKFGYEFDFQIMYNFGGATVRTIAGEMMKAANMPLDRIEDVLAAKRELSYQLIPTQSKLLPTFEIVKSFHQKKPIALGSGSHRKIIDMLMDKLAIAPYFNAIVSADDVKEHKPHPETFLRCAELIQANPSRCIVFEDADLGVQAGLSAGMDVFDVRTREIISPR

SEQ ID NO: 5915 - protein, 326 aa, Oryza sativa (japonica cultivar-group)
MATASWPPTPRSPRPQAPSVERAKGPSGLDKVVLREAPGFSAEVHLYGGQVTSWKNDRGDELLFVSSKATFKPPKAIRGGIPICFPQFGTHGILEKHGFARNRFWAIDDNPPPFPTSTAAKAFVDLILKTSEEDLKIWPHSFEFRLRVALGPGGDLALTSRIRNTNTDGRPFSFTFAYHTYFSVSDIRGHKHDLCAFVPFKSAANYLSEVRIEGLETLDYIDCLRGKERSTEQGDAIVFESEVDKIYLDAPAKIAIIDHEKKRTFVLRKDGLPDAAVEKPITLKPGEEWKGKMDLSAVPSSYCSGQLDPNKEHLMSLILSGADAAS

SEQ ID NO: 5916 - protein, 147 aa, Epichloe festucae
MALKRINKELTDLGRDPPSSCSAGPVGEDLFHWQATIMGPGDSPYSGGVFFLAIHFPTDYPFKPPKVNFTTRIYHPNINSNGSICLDILRDQWSPALTISKVLLSICSMLTDPNPDDPLVPEIAHVYKTDRPRYEATAREWTRKYAV

SEQ ID NO: 5917 - protein, 504 aa, Nocardioides sp. JS614
MSLMRTKSVEQSIADTEDPDHKLRKELGALDLMVFGVGVTIGAGIFVLTGTVAASNSGPALALSFLIAAVACALAALCYAEFASTVPVAGSAYTFSYATLGELVAWIIGWDLILEFTIGAAALSTSFSGYLQELLDGTPFEVPTQFGSAADGFIDLPAVVIALLVMLVLIRGTKLSSMVNQVVVAIKLAVVAAVIVVGVAYVDPSNWTPFIPDSQPVGDAEGGFRQLPLITTLLGIEPAVFGIGGVIAGAAVVFFAFIGFDVVATTAEEARNPQRDIPIGILGSLAIVTVLYMAVSLVVTGVQSYQDIDPDDPAPLATAFSAAGVSWVGDLISVGACIGLVVVAMILMLGQCRVAFAMGRDGLLPRSVAKVHPSFGTPYRITLITGFVVAAIAGFVDLSTLADLVNIGTLFAFILVSLGVVVLRRTRPELPRSFRTPFAPVVATLATLLCFYLMLNLKGETWERFLIWMALGFVVYFVYGRRHSRVGRAEREERSGQPRDTEVR

SEQ ID NO: 5918 - protein, 472 aa, Bacillus cereus E33L
MNHLRGGSEVANKELKRGLEARHIQMIALGGTIGVGLFMGSASTIKWTGPSVMLAYAIAGIFIFFIMRAMGEMLYMEPSTGSFATFGHKYIHPLAGYMTAWSNWFQWVIVGMSEIIAVGAYMQYWFPDLPAWIPGVIAMVILGAANLISVKSFGEFEFWFAMIKIVTILLMIIAGFGLIFFGIGNGGEAIGISNLWSNGGFFTGGFSGFFFALSLVVGAYQGVELIGITAGEAKDPKKTLTRAIQSTIWRILIFYIGAIFVIVTVYPWDQLSTIGSPFVATFAKVGITAAAGLINFVVITAAMSGCNSGIYSAGRMLYTLGVNGQAPKYFTKLSGNGVPLFGTVGVIIGLAVGVVLSYIAPKNLFVYVYSASVLPGMVPWFVILISQINFRKEKEAEMKDHPFKMPFAPVTNYLTIAFLIMVLIGMWFNDDTRISLVVGIIFLVIVTISFYAFGIGKRTPLDVQNDQEISSK

SEQ ID NO: 5919 - protein, 995 aa, Listeria monocytogenes EGD-e
MGAKVSVQINGVARDVVEGTRMLDYLNAEGIQHPHICYSEQIGPIQSCDTCMCEVDGELMRACSTNLTDGMEIKTNSELAKDAQLEAMDRILENHLLYCTVCDNNNGNCKVHNTTELLGVEKQERPYREKGYLNDFSHPFYRYDPDQCILCGRCVEACQQVQVNETLSIDWERSQPRVIWDDDRPANLSSCVSCGLCATVCPCNALMEKSMLGQAGFMTGLDEDMLEPMIDMVKKVEPNYQTVFAVSEMEASMRETRTKKTKTVCTFCGVGCTFEVWTKDRKILKVEPTGEGPVNKFATCVKGKFGWDFVNSEKRITTPLIREGNEFVPASWEDAIHLVATKLREIQAKYGNDSLGFISSSKTTNEENYLMQKLARQVFETNNIDNCSRYCQAPASDGLTRTVGIGADSGTVEDIESAGLVIIVGASPADGHPVLASRIKRAQKTRGQKLIVSDLRKHEMAERSDLFIHPKQGTDFVWLTAVAKYMIDQGWHDEVFMENRISNVADYLAFLEPFTLEYAEKETGLSVETLKKVAQMVHEADGTAVCWGMGVTQNIAGSHTSSAIANLLLVTGNFGRHGAGAYPLRGHNNVQGACDMGSLPNVLPGIQPLGNDEVRARFEEAYGVSISSEPGLKNNEMLDAIEAGTLHSMYVIGEEMAWVDSNSNHVQEILASLDFFVVQDVFLSKTAQFADVVFPAAPSLEKEGTFTNTERRVQRLYEVLEPLGDSKPDWWIIQEVARACGRTDWNYDHPSEIMDEIASLAPFFAGVRYDRMQGFNSLVWPVSADGKDMPLLYEERFNFPDGKAQFSTLPYIAPITFPEEYNLTLNNGRLLEQFHEGNLTDKSKGLDYKLPEVFVEVSHELAKERDLESGSLVRLSSPYGRIKLRAVVTDRMKGNEVYVPMHSVSSETAVNLLTSSAGDVRTKTPAYKQTKVNLTVLEKTGKNPLPDHNPRNRKRFPQNGAEVARKWSREDYQPISKVNCACGGNCGCGGKGRNH

SEQ ID NO: 5920 - protein, 895 aa, Xanthomonas campestris pv. campestris str. ATCC 33913
MNWLNEVLHNDPNPLETQEWLESIKAVIDVEGPERAHQLLEGMVEQTRRAGAYLPFSPTTEYVNTISPANEAKNPGDSALEWKIRSIIRWNAMATVVRANRKPGDLGGHIASFASSATLYDVGFNHFWRAPSDQHPGDLLFIQGHSAPGIYARAFLEGRINEAQLDNFRMEVDGQGISSYPHPWLMPEFWQTPTVSMGLGPLAAIYQAQFMRYLENRGLIEKSDRKVWCFIGDGESDEPETLGAIALAGREGLDNLIFVVNCNLQRLDGPVRGNGKIIQELEGVFRGGGWNVIKLLWGGYWDALLAKDTDGVLRKLMMETVDGEYQNCKAFGGAYTRANFFGKYPETAAMVAGLSDDDIWRLNRGGHDPHKVYAAYNQAVNTKGMPTVILAKTVKGYGMGSAGEALNPTHQTKKLDDAAVKHFRDRFNIPVTDAQLEDGKVPFYHPGEDSPEVQYLKERRNVLGGFLPSRRPKASKSFVAPTLDKFERLLKDSGERSYSTTMSFVQSLNIALRDKELGPRIVPIVADEARTFGMEGMFRQIGIYAPFGQKYKPVDADQLMYYREDQTGQVLQQGISEPGAIASWMAAGTSYSVSDVPMLPFYIYYSMFGFQRVGDIAWQAADMRTRGFLLGGTAGRTTLNGEGLQHEDGFSQVIAGSIPNVRSYDPTFGFEVTVIMQHGMKAMMEDQIDEYYYITLMNENYAHPGMPDGAQEGIIKGMYLLKDAGKPKKGELRVQLLGSGTILREAIAAAELLDKDFGVTADIWSCPSFNELRRDGFDAERWNRLHPEAEQRKPYVTQLLEGRQGPAIAATDYVRLFADQIRAFVPMTYSVLGTDGFGRSDTRANLRRFFEVDRYYIAHAAIAALAKDGKMTGKDVSRAIKQYKIDPEKANPVGV

SEQ ID NO: 5921 - protein, 486 aa, Magnaporthe grisea 70-15
MVRLSGLAALVAMGCSSVVTAMEWNTFDGPGFPSCYNVTEVKDPKTVEEAAAMVKEAAAAGKLVRAAGKGHMWYDTQCSDDETVIIRTEGLGRIYDLDLAGGSVMIEGGVTFFTLAQYLHDRGASVNYALVNWNISLGGSIAMGAHRSSLREDAMVGAAAQELHIIDGNGDIRIVKRDANDDDWLAASTSLGLLGIIARIKMSVYPDTKLYAMQKTLEEKDVFEGDIEALIAPYATANLWWWPHKRKFHQRYYDVVDINSTTQQAFQNTFSVTKLEAEAIKAIFNSGKIAFTSNMIGEEILFSQWEKPNFREKTTQEPLTEWPVYGWNYDVLIGGLYPDQTPQWENGLRGYTLELAFPMTQANAVLKRIRALFDEEIWKVKPVTSTYRSGINIKFGKAYFDLLGQGTYNTADGADWSRGVIMFDWPSVVIDEFPCRPHWTKNTREVLKQGTKHLDPNHIARFKAVRQKFDPKGMFRSVVGEIIGVY

SEQ ID NO: 5922 - protein, 307 aa, Nocardioides sp. JS614
MDLTVFPVPGPGAEDVVVAGPGPDEGAVFTGTEDGSIFRVAHDGGRIDRVAHTGGRPLGIELDLDGRLLVCDARRGVLRVDPRGGAVEEVTDRLGGAPMMFCNNAAVASDGTVWFTDSSTRYGIDQWKDDFVQDTRTGRLGRLGTDGTVEVVLDGLAFANGVALAADESYVAVAETGARTVVRWWLTGERAGTRDLLTSDLPGYPDNIARGSDGLVWVSIASPTDPVVERLQRAPLPLRKAVTKIPERLQPKPKRTIRAQAFDDAGRLVHDIDLPGTAYHMVTGVREHDGRLWLGSLHEPAVAVVDI

SEQ ID NO: 5923 - protein, 196 aa, Oryza sativa (indica cultivar-group)
MAGRKRKAEAARAAEEEADRALYGAFRGAANSLSQLYALAGAHQRLSFHAGERHALEKLYQWMVRQHEIGLRLTVSDIASHIQHEIEYGGDNALTSPRSQHAFQNLQAPMHIPNTSTQQPPSCSITPSNPSKDSMIFSKALSSPVRQNLQLYHVQQGGDTGCFADGIFCPGNRDSDPAASNDSSVDMHSDSPGHDS

SEQ ID NO: 5924 - protein, 463 aa, Pseudomonas putida GB-1
MQTHKNNLSHGLKSRHVTMLSIAGVIGAGLFVGSGRAIAEAGPATILAYILAGGLVVLVMRMLAEMAVASPDTGSFSTYADLAIGKWAGYTIGWLYWWFWVLIIPIEANIAATIINSWVPQMEIWVLSLVITLLLTATNLFSVKNYGEFEFWLALVKVVAIVSFIALGVCAIFGLLPGAGVSGVSRLWDTGGFMPNGFGAVLSAMLITMFSFLGAEVVTIAAAESDEAGKHISKATNSVIWRITLFYILSIFIVIALVPWTDPRLATEGSYVTVLDTLGVANAKAIIDFVVLTSVTSCLNSSLYTASRMVYSLSRRGDAPACAQVTSRSGTPVVAVLLSTGAAFLAVIANYLVPAKVFGFLMASSGAIALLVYLVIAISQLRLRQRLTAQGKTLGYRMWLFPWLTWGVILFISGVLVLMLFRPDHRLEVVSTMVLAVLVVCSGLLVTRRRARAVVVGGVGQGA

SEQ ID NO: 5925 - protein, 149 aa, Streptococcus mitis
QPNWINRDRFILSAGHGSMLLYALLHLSGFEDVSMDEIKSFRQWGSKTPGHPEFGHTAGIDATTGPLGQGISTATGFAQAERFLAAKYNREGYNIFDHYTYVICGDGDLMEGVSSEAASYAGLQKLDKLVVLYDSMTSNLDGETKDSFT

SEQ ID NO: 5926 - protein, 431 aa, Nostoc punctiforme PCC 73102
MDAEELLEKYAEGQRNFQGAVLRKADLRNTDLMQIDLSNADLTAANFKGADLTKANLTNAKINGTDFSKASLSGANLSEVNGSELWENRNRVQSSANFNGANLTSVNFIRANLSSANLSHANLDKANLSNANLSNTKLREVSLVGADLSNSTLSSIDFNGVSLVGADLSRANLQGVNFQKANLQGAKLQAVNLQNFNLSGLNLTGSDLSGANLAQVNLKESSLQRANLERAVLQGADLKNVNLKETNLTRADLTDAATYGWLIEDADFSRAIMPDGEVYKPIAAEAEIGKQETSLEKVISMTRKVINTDNAPAPVGPYNQAIAASGQFVFIAGQIAIDPRLGDVVYTDDVKKQTEQVLANLEAILTAAGATFQDVVKTTVFLADMNDFAAVNAVYAKYFPENTAPARACVQVSRLPKDVLVEIDAIAVISG

SEQ ID NO: 5927 - protein, 134 aa, Rhodococcus sp. RHA1
MSDTTVIRTEGAPAPAHTFSQGIKKGNLLQVSGQGPMDPVTNKYIAEGDVREQTRRTLENVKAILEAGGASVEDVLMFRVYLTTRDDFAAMNDVYGEFIAANVPSGQLPCRTTVFVDLPHEVMLVEIDALAVTG

SEQ ID NO: 5928 - protein, 479 aa, Saccharomyces bayanus
MSAILSTTSKNFLSRNPARQCQSAQKALFALLSSRHYSSATEQTLKERFAEIIPAKAEEIKKFKKEHGKTVIGEVLLEQAYGGMRGIKGLVWEGSVLDPDEGIRFRGRTIPEIQRELPKAEGSTEPLPEALFWLLLTGEIPTDAQVKALSADLAARSEIPEHVVQLLDSLPKDLHPMAQFSIAVTALESESKFAKAYAQGVSKKEYWSYTFEDSLDLLGKLPVIASKIYRNVFKDGKITTVDPNADYGKNLAQLLGYENKDFVDLMRLYLTIHSDHEGGNVSAHTTHLVGSALSSPYLSLAAGLNGLAGPLHGRANQEVLEWLFKLREEVKGDYSKETIEKYLWETLNSGRVVPGYGHAVLRKTDPRYMAQREFALKHFPDYELFKLVSTIYDVAPGVLTKHGKTKNPWPNVDSHSGVLLQYYGLTEASFYTVLFGVARAIGVLPQLIIDRAVGAPIERPKSFSTEKYKELVKKIESKN

SEQ ID NO: 5929 - protein, 575 aa, Epichloe festucae
MSYYYPGGSDAGSERPSERSRWTPLTRMLLSGEMTQEKQQELSPREKFDRWMINEGYRRVFVFVFMLTHALIFSFASVHYALKDSLQSARDIFGFTFTIARASALVLHIDVGIILFPVCRTLISLMRQTPLNGIIQFDKNITFHITTAWSIVFFSWVHTIAHWNNFAQVAAKNKLGFYGWLLANFASGPGWTGYVMLIALMGMVITSVEKPRRANYERFWYTHHMFIVFFFFWSLHGAFCMIQPDVAPFCTSIGASAIGVFWQYWMYGGFIYLAERVAREIRGRHKTYISKVIQHPSQVCEIQIKKENTKTRAGQYIFFCCPAVSLWQYHPFTLTSAPEEDYISIHMRCQGDFTMAVSQALGCEWGKKEDTSKVVGIDGDSNGVDPALQKVLPRVYVDGPFGSASEDVFKYETAILVGAGIGVTPFASILKSIWYRMNYPQKKTRLSKVYFFWICRDFGSFEWFRSLLLAVEAQDVENRIEIHTYLTAKIKADDATNIMINDANADKDTITGLRSPTNFGRPNWDMIFRGIRKIHCPGEAGVFFCGPKGLGSSLHVYCNKYTEPGFSYVWGKENF

SEQ ID NO: 5930 - protein, 294 aa, Saccharomyces bayanus
MTVPYLNSGRNVASYLQTHSHQEKTLKERFSEIYPSHAQDVKQFVKEHGKTKISDVLLEQVYGGMRGVPGSVWEGSELDAEEGIRFRGRTIADIQKELPKAKGSSQPLPEALFWLLLTGEVPTQAQVENLSADLMSRSELPHHVVQLLDNLPKDLHPMAQLSIAVTALESESKFAKAYAQGISKQDYWSYTFEDSLDLLGKLPVIAAKIYRNVFKDGKIGEVDPNADYGKNLVNLIGSKDEDFVDLMRLYLTIHSDHEGGNVSAHTSHLVGSALSSPYLSLASGLNGLAGPLHG

SEQ ID NO: 5931 - protein, 576 aa, Yersinia pestis CO92
MNEKHPGPLVVSGKLSDGERMKSESNFLRGTIAEDLNNGLTGGFSGDNFLLIRFHGMYQQDDRDIRAERAEQKLEPRHAMMLRCRLPGGIITPQQWLGIDKFAADNTLYGSIRITNRQTFQFHGILKGNVKPAHQLLNELGLDALATANDVNRNVLCTSNPVESALHQEAYEWAKKISEHLLPRTRAYAEIWLDAEKVATTDEEPILGATYLPRKFKTTVVIPPQNDVDLHANDLNFVAVADKGKLIGFNVLVGGGLSIAHGDKNTYPRKASEFGYIPLKHTLAIAEAVVTTQRDWGNRTDRKNAKTKYTLERVGVETFKAEVEKRAGVSFSAIKPYQFIGRGDRIGWVKGVDKKWHLTLFVENGRLLDYPGRSLKTGVAEIAKIHQGDFRLTANQNLIVAGVPEKDKARIEALAREHGLMDDNVTSQRENSMACVSFPTCPLAMAEAERFLPEFVTRVEGILQQHGLADEHIVLRVTGCPNGCGRALLAEVGLVGKAVGRYNLHLGGNREGTRIPRMYRENITADEILLITDQLVGRWAKERHVDEGFGDFVIRAGVIAPVIDSARDFYDVQEAM

SEQ ID NO: 5932 - protein, 292 aa, Coccidioides immitis RS
MTEITHPTIKDGWFSEISDMWPGQAMTLRVNQILHHEKSKYQDILIFESTDHGTCLVLDNVIQCTERDEFSYQEMITHLAMNSHPNPKKVLVIGGGDGGVLREIVKHESVEEAILCDIDEAVIRASKKYLPGMSIGFQHPNVKVHIGDGFKFLEERKNEFDVIITDSSDPEGPAEVLFQKPYFELLYGSLREGGVISTQGSENQWLHIKLITDLKKLMKEVFPVVEYAYTSIPTYPSGQIGFLVACKDPNRNIREPVRSWTREEEDKLCRYYNQDIHRASFVLPGFARKALE

SEQ ID NO: 5933 - protein, 401 aa, Bifidobacterium longum
MKTLKDLGDLKGKRVLVRADFNVPLDGTTITDDGRIKAALPTIKTLREEGAKVILMAHLGRPKGKVVPELSLAPVAARLGELLGANVPLAKDTYGEDAQAKVAAMNDGDVVLLENVRFNPEETSKDADERAAYAKKIAALGEAFVSDGFGVVHRAQGSNYDVAADLPAAAGLLVEKEVKALSKATENPERPFTVVLGGSKVSDKLGVIENLLDKANRLVIGGGMVFTFLKAKGYEVGTSLLEEDQLEKVKGYIETAEKNGVELVLPTDVVVNAGFPAGDTPVAPEVVAADAIPADKMGLDIGPESQKLFHDKIVDSKTVVWNGPMGVFEVPEFAAGTKAVAQGLVDATAVGAFTIVGGGDSASAVRNLGFPEDGFSHISTGGGASLEFLEGKELPGLKVLE

SEQ ID NO: 5934 - protein, 688 aa, Coccidioides immitis RS
MGYTDLDRLAINTIRVLAVDATSKANSGHPGAPMGLAPTAHVLFNKFMSFNPKNPQWINRDRFVLSDTYRNGHGCMLQYALLHLFGYEVSLDDLKNFRQLDSITPGHPEAHDTPGVEVTTGPLGQGFANAVGLAIAQKHTAAVFNKPGYDLINNYTYCIFGDGCAMEGVASEAASQAGHLQLGNLICLYDDNHISIDGDTKIAFTEDVMKRFESYGWHTLHVKDGDHDLDAIEAAIEEAKKVTDKPTVIKVTTTIGFGSKLQGTGGVHGNPLKADDAQNVKKIFGFNPEQSFVVPQEVYDLYHKHSAEGAAKEQEWNILFQKYKSEYPELHADFTRRLTGKLPEGWEKNLPTYKPSDPPVASRKLSEAVLERIHDAVPELLSGSADLTGSNNTRWKNANDFQPPSLGIGDWAGRYLRYGVREHGMAAIMNGIAAYGTLIPAAGTFLNFVSYAAGAVRLSSLSQVRVIYIATHDSIGLGEDGPTHQPIETLAHFRALPNMMVWRPADGNETSAAYYSALTSKSTPSILALTRQNLPHLESSSIEKALKGGYVALEAENADITVVSTGSEVSLCIDAAKYLKEKHNITARVVSIPCFEIFDVQPKEYRLQVIPDGIPSLSVEVMSTMGWERYSHEQFGLNRFGASAPYKEVYKKFEFTPEGISKRALTTIDFYKGYKVRSPINRAFKQII

SEQ ID NO: 5935 - protein, 431 aa, Yersinia pestis CO92
MSKIVKVIGREIIDSRGNPTVEAEVHLEGGFVGLAAAPSGASTGSREALELRDGDKSRFLGKGVLKAVAAVNGPIAQAVIGKDAKDQANIDKIMIDLDGTENKSQFGANAILAVSLAAAKAAAASKGMPLYEHIAELNGTPGKFSMPLPMMNIINGGEHADNNVDIQEFMIQPVGAKTLKEAVRIGSEVFHHLAKVLKAKGLNTAVGDEGGYAPNLGSNAEALAVIAEAVKAAGYELGKDITLAMDCAASEFYKDGKYVLAGEGNKAFTSEEFTHFLEDLTKQYPIVSIEDGLDESDWAGFKYQTEVLGDKIQLVGDDLFVTNTKILKEGIEKGVANSILIKFNQIGSLTETLAAIKMAKDAGYTAVISHRSGETEDATIADLAVGTAAGQIKTGSMSRSDRVAKYNQLIRIEEALGDRAPFNGLKEVKGQ

SEQ ID NO: 5936 - protein, 311 aa, Idiomarina loihiensis L2TR
MQSIPHVDMRRYQNDFDAFTQDVGNGYEKYGFIALTQHGVDTALIERALDTCRELFALPEDVKKQYHRPGQGGARGYTPFGTEVAKDAKHVDLKEFWHVGREVEGEPAYPQLLPNVWPQELPKFKDDMLAIYAALDNLGNQVLEALSVYLGQPKDFFRNKVNNGNSILRPLHYPPIIDEDTPSVRAGAHEDINVLTLLVGSREPGLEVLAKDGTWVPVTIIEGAIICNVGDMLQRLTNHVLPSTTHRVVNPPAPFNEKSRYSIPFFLHFNPDVMITPLESCISDENPQRDEPITADDYLMQRLREIGLIKD

SEQ ID NO: 5937 - protein, 261 aa, Gloeobacter violaceus PCC 7421
MATPAPDLLALDFDGVLCDGLLEYFQTAWQVYRRLWTPPDNLAPPAAVAELFYRLRPVVETGWEMPLLVSAIVGGVEPEAILADWGGISQQLLAQSGVSAPQLAGEVDRTRDAWIARDLEGWLQLHRLYPGVAGRLRALCEHPQPAVFMITTKESRFVLLLLEQAGVDWPGERIFGKDTQQPKTETLAKLLGAGYERIWFVEDRLATLEKVARLAELASVQLYLADWGYNTPTERERVRADSRIRLLNLEQFADDFCNWPQ

SEQ ID NO: 5938 - protein, 501 aa, Triticum aestivum
MAMANSTVPPCLLLLTIVSLAAANGGGNNSTDSGQVRLSCGASASATDSDGRAWDGDSTSKFLTSTNAGVAARASYQDPSLPSSVPYLMARVFASSHTYTFLVRPGRVFLRLFFYPTDYGNRNASSALFGVTAGGVMLLRDFNASQSALALDATYLVREFSVIVNSRGRLDVTFAPSTAASSHYAFVNGIEIVPTPDVFTAPVPTFANGGRPDPMPIRADTAFQTMYRLNVGGTAVSPADDSGRFYRTWDTDFPYIFGAAVGVSSKKDSDVTIRYPPSVPPHIAPEGVYASARSMGPDPQINLKYNLTWILPVDAGFYYLLRFHFCEIQYPITKVNQRSFYIYINNQTAQEQMDVITWSGGIGVPVYTNYLVVTTGSGQTDMWVALHPDPSTRPQYYNAILNGLEVFKLQTYGSNNLAGANQRIPQKQLYQGEFKRKSAVAAVVGGVVARALLAALIGCVCACAICRRGRKYASVVVCDPESIPEQPAHGLPSPKERVKVW

SEQ ID NO: 5939 - protein, 151 aa, Musa acuminata
KLGVADGLTVEAILENWSQLKPIIMKEWDEERDALIDLFGRVRDEWIDNDLSGWIGANRFYPGVADALRFASSQLYIVTTKQARFADALLRELAGVTIPAERIYGLGTGPKVKVLKQLQEMPEHQGLSLHFVEDRLATLKNVIKEPSFEAM

SEQ ID NO: 5940 - protein, 425 aa, Oryza sativa (indica cultivar-group)
MAAASSFTAAAKFLAPVSARSAGDYKPPLPLPASASLRPGRKPAPRLRTALAVSSDVLPGNKAAPAAAAHSAVTREEALELYEDMVLGRIFEDMCAQMYYRGKMFGFVHLYNGQEAVSTGFIKLLNQADCVVSTYRDHVHALSKGVPARSVMAELFGKATGCCRGQGGSMHMFSEPHNLLGGFAFIGEGIPVATGAAFAAKYRHEVLKQSSPDGLDVTLAFFGDGTCNNGQFFECLNMAQLWKLPIVFVVENNLWAIGMSHLRATSDPEIYKKGPAFGMPGVHVDGMDVLKVREVAKEAIERARRGEGPTLVECETYRFRGHSLADPDELRKPDEKSHYAARDPITALKKYIIEQNLATESELKSIEKKIDDVVEEAVEFADASPLPPRSQLLENVFSDPKGFGIGPDGKYRCEDPLFTQGTAQV

SEQ ID NO: 5941 - protein, 435 aa, Ralstonia eutropha JMP134
MSSAAPTHTAGQKHALPSYLNADNLGPWGIYLQQVDRVTPYLGSLARWVETLKRPKRAMIVDVPIELDNGTIAHYEGYRVQHNLSRGPGKGGVRFHQDVTLSEVMALSAWMSVKNAAVNVPYGGAKGGIRVDPRTLSHAELERLTRRYTSEINIIIGPSKDIPAPDVNTNAQVMAWMMDTYSMNSGSTATGVVTGKPISLGGSLGRHEATGRGVFVVGSEAARNIGLEIKGARVAVQGFGNVGAVAAKLFQEAGAKVVAVQDHRVSLYNPAGLDVPAMMEYASHSGTVDGFQAETISSEQFWQVDCDILIPAALEGQITAKNAPQIKARLVIEGANGPTTPEADDILRERNILVAPDVIANAGGVTVSYFEWVQDFSSFFWTEEEINERLVRIMQEAFRAIWQVAQDNKVTLRTAAFIVACTRILQAREMRGLYP

SEQ ID NO: 5942 - protein, 337 aa, Rhodococcus sp. RHA1
MQESTPTPESGVACLGEAMVLVAPDSTLHLAGAEANVAAGLATLGVPAAWVGRLGDDEFGTLIRTELQARGVDVRAIEVDPDRPTGHYSKSTALDEHGEPRTDSLYSRAGSAASAMDPGFLDRPAVADLFGRAAVVHCSGITPALSDSCLALMRRLLRHRPGISGVVSFDVNWREQLWPDGDPRIVVELANLADLVLVGADEALRVLGTADPHELRLILPAPATVVVKDGAHRALAVDRSGRSVAVPALRVDVVEPVGAGDAFAAGYLSGVVRGEDQARCLRRGHIGAAATLTVAADSAPPPAAELLDELLRCSESDWAATSVTADGFSPRESGVNG

SEQ ID NO: 5943 - protein, 156 aa, Triticum aestivum
  misc_feature (56)..(56): Xaa can be any naturally occurring amino acid
LITVVDETTMAARPMLVVALLCAAAAAATAQQATNVRATYHYYRPAQNNWDLGAPXAVSAYCATWDASKPLSWRSKYGWTAFCGPAGAHGQASCGKCLQVTNPATGAQITARIVDQCANGGLDLDWDTVFTKIDTNGIGYQQGHLNVNYQFVDCRD

SEQ ID NO: 5944 - protein, 398 aa, Oryza sativa (japonica cultivar-group)
MAAAKHFTYVILGGGVAAGYAAREFAKQGVKPGELAIISKESVAPYERPALSKGYLFPQNAARLPGFHTCVGSGGERLLPEWYSEKGIELILSTEIVKADLASKTLTSSADATFTYDTLLIATGFSVIKLTDFGVQGAEANDILYLRDIEDADKLVAAMQAKKDGKAVIVGGGYIGLELSAALKTNNFDVTMVYPEPWCMPRLFTSGLAAFYEGYYANKGIHIIKGTVAVGFDADANGDVTAVKLKNGNVLEADIVIVGVGGRPLTHLFKGQVAEEKGGIKTDAFFETSVPGVYAIADVAAFPMKLYNEIRRVEHVDHARKSAEQAVKAIKAKEAGESVPEYDYLPYFYSRSFDLSWQFYGDNVGEDVLFGDNDPTAAKPKFGSYWIKDGKVVGVFLE

SEQ ID NO: 5945 - protein, 357 aa, Ralstonia eutropha JMP134
MSQYRIAVIPGDGIGTEVMPEGIRVMDAAARKFGIDFQWDHFDFSSCDYYARHGKMLPDDWFDTLVKYDAIYFGAVGWPDAVPDHVSLWGSLLQFRRSFDQYVNLRPVRLMPGIKSPLADRKPGDIDFYVVRENTEGEYSSIGGRMFPNTEREIVMQETVMSRVGVDRILKFAFELAKKRPKQHLTSATKSNGISITMPYWDERVEAMAANYPGIKVDKYHIDILTAHFVQHPDWFDVVVASNLFGDILSDLGPACTGTIGIAPSGNINPDRTYPSLFEPVHGSAPDIAGRGVANPIGQIWCGAMMLEHLGHDAAGAAVLGAIEKVLSEGPDHAPLTRDIGGKAGTEDLGRAIAEAL

SEQ ID NO: 5946 - protein, 297 aa, Nicotiana tabacum
MGEKPKSGGVWPTVKPFVNGGASGMLATCVIQPIDMIKVRIQLGQGSAVDVTKTMLKNEGFGAFYKGLSAGLLRQATYTTARLGSFRSLTNKAIEANEGKPLPLYQKALCGLTAGAIGACVGSPADLALIRMQADATLPLAQRRHYTNAFHALSRIVADEGVLALWKGAGPTVVRAMALNMGMLASYDQSVEFCRDNLGMSEAATVVGASSVSGFFAAACSLPFDYVKTQIQKMQPDAEGKLPYSGSFDCAMKTLKAGGPFKFYTGFPVYCVRIAPHVMMTWIFLNQIQKAEKKLGL

SEQ ID NO: 5947 - protein, 582 aa, Zea mays
MDPNGGGDTILGDPLLPLSQSSKQQQDPLAGVSDYLGRSVHRGSSGGWRSALFVVGVEIAGSFAYFGISANLITYLTGPLRQSNASAAASVNAWSGTACIMPLLGAFLADAYLGRYRSVIIACTLYVLGYGMLTLSATVPALQPSHMPCREDGVSSSSCQPGWPQVAFFYVSLYLIAIAQGADKPCGLAFAADQFDAEHQGERASRGSLFNWWFFCMAIGISVSVSVVGYIQEYVGWGLGFGVPCAIVLCAFLVFLLGTPTYRLYAPTPEAKSPFRRLARGLAANANKTGGLSASHSEEEEAAADARCVLRLLPIWAASLAYGVVYAQIMTLFNKQGRTLDRHIGDGLELPPAALQTLGPASILLFVPVYDRAVVPALRWATGNPSGLSMLQRVGAGMAVSLAGVAVAALVEARRLAMAREHGLVDDPSATVPMSWAWIVPQYAMMGVADVLAVVGLQELFYDQMPDGLRSLGLALYLSVMGIGGFISSLLISLIDGVTGSGGGDSWFADNLNRAHVDYFYWLLAGLSAVELALFVVGTVFACSCLFETGYPIGHNNPPPRLQINQASRSPVASPTSASLPT

SEQ ID NO: 5948 - protein, 295 aa, Nicotiana tabacum
EKPKSGGVWPTVKPFVNGGASGMLATCVIQPIDMIKVRIQLGQGSAVDVTKTMLKNEGFGAFYKGLSAGLLRQATYTTARLGSFRILTNKAIEANEGKPLPLYQKALCGLTAGAIGACFGSPADLALIRMQADATLPLAQRRHYTNAFHALSRIVADEGVLALWKGAGPTVVRAMALNMGMLASYDQSVEFCRDNLGMSEAATVVGASSVSGFFAAACSLPFDYVKTQIQKMQPDAEGKLPYSGSFDCAMKTLKAGGPFKFYTGFPVYCVRIAPHVMMTWIFLNQIQKAEKKLGL

SEQ ID NO: 5949 - protein, 528 aa, Arabidopsis thaliana
MYNKLQNLRHETRSVEEYAEEFYLLLTFNDINDSQTQLVSRLIGELRSQLQNSLSQFDPTTVSEAHRRAASFEKQMRSASWNFTNTRPRSLEQQTPPTNIASREGDEQIKIVTRNTNDEQGLRRSARTENGEILSLARKLSPPNPRRHCVRLLETAEFHMKFPPDGMQIYPRNDRRFSCGYASGMMYFYGMRIKEDDYDGVPVLCNPITGHYATLPAIARFRQAFSFFGYDPIDKQFKVLFMIMAYPCSPDHHKVLKLGSGEMSWRRLKRTLRHEIMSEGICINGVVYYLGDTSEVLTSFVVVCFDVRYETFSFLYPGSYCELINYKGKLGLVFYDDYDGDTIKLRLWVLEDEEKNEWSKYAYVLWDDIFLAHYVSVVGVTATGEIVLSMADYTSKQPFYIFYYNPEMNTLQCVEIRGFGEYHEASGNRSRVCVFVDNVFEKDCSRFYALADHVEDINVIDSKLLKSKIYEDTYPNLEDYEQSDHDETSDDEESLRSYNYSYKPYMYAGEEERRKRSRRTRRSTIRRR

SEQ ID NO: 5950 - protein, 267 aa, Medicago truncatula
MSHFGRQGPPDIADTYSLLVLNITFRTTADDLFPLFDKYGKVVDIFIPRDRRTGESRGFAFVRYKYADEASKAVDRLDGRMVDGREITVQFAKYGPNAERIHKGRIIETSPRSKSSRSRSPSRRRHHDDYRDKGYRRRSRSRSYDRYERDRYRGGRDRDYRRRSRSRSASPDYKRRGRGRYDDERRSRSRSRSVDSRSPARRSPSPKRSPSPKKSISPKKSPSPSPRRESPDTRSRDGRSPTSRSVSPRGRPEASQSPSPRNSDGDE

SEQ ID NO: 5951 - protein, 300 aa, Nicotiana tabacum
MGDKAKSTSSAGAWPTVKPFANGGASGMLATCVIQPIDMIKVRIQLGQGSAGEVTRTMLKNEGFGAFYKGLSAGLLRQATYTTARLGSFRVLTNKAIEANDGKPLPLYQKALCGLTAGAIGACFGSPADLALIRMQADATLPVAQRRNYTNAFHALYRIVADEGVLSLWKGAGPTVVRAMALNMGMLASYDQSVEFFKDNLGMGEAATVVGASSVSGFFAAACSLPFDYVKTQIQKMQPDAQGKYPYTGSFDCAMKTLKSGGPFKFYTGFPVYCVRIAPHVMMTWIFLNQIQKVEKKIGL

SEQ ID NO: 5952 - protein, 343 aa, Salmonella enterica subsp. enterica serovar Paratyphi A str.
MEVKTQSCVVAGKRAVAVTEQNIEWNNKGTLVQITRGGICGSDLHYYQEGKVGNFTVKAPMILGHEVIGKIVHSDSDLLREGQPVAINPSKPCGHCKYCLQHEENHCTEMRFFGSAMYFPHVDGGFTRFKAVDTAQCIPWPEQADEKAMAFAEPLAVAIHAAHEAGDLQGKRVFISGVGPIGCLIVSAVKTLGAAEVVCADISTRSLSLARQMGADTLVNPQHDSLDGWKAEKGYFDISFEVSGHPSSISTCLEVTRAKGVMVQVGMGGAVPNFPMMMLISKEISLKGSFRFTTEFNTAVSWFANRVINPLPLLSAEYPFTDLEAALIFAGDKTQAAKVQLVF

SEQ ID NO: 5953 - protein, 176 aa, Salmonella enterica subsp. enterica serovar Paratyphi A str.
MAGESYILMGVSGSGKSLIGSKIATLFSAKFIDGDDLHPAKNIDKMSQGIPLTDEDRLPWLERLNDASYSLYKKNETGFIVCSSLKKQYRDILRKSSPNVHFLWLDGDYATILQRMQRRAGHFMPPDLLQSQFDALERPCADEHDIARIDVNYDIEHVTEQCRLAVQAFRQALSAS

SEQ ID NO: 5954 - protein, 361 aa, Ralstonia solanacearum GMI1000
MKTYRIATIPGDGIGKEVVPAGREVMEALAAAGAGFRFEFENFDWGGDYYRQHGAMMPADGLDALRGKDAILFGSAGDAQIPDHITLWGLRLKICQGFDQYANVRPTRILPGIDAPLKRCGPQDLDWVIVRENSEGEYAGVGGRVHQGHPIEAATDVSMMTRAGVERIMRFAFRLAQSRPRKLLTVITKSNAQRHAMVMWDEIAVQVSKEFPDVQWDKELVDAATARMVNRPASLDTIVATNLHADILSDLAAALAGSLGIAPTGNIDPERRYPSMFEPIHGSAFDIMGKGLANPVGTFWSVVMLLEHLGEQAAARRLMQAIEAVTANPALHTRDLGGNATTVQVTRAVCECLAVSQAQAA

SEQ ID NO: 5955 - protein, 813 aa, Oryza sativa (japonica cultivar-group)
MKKAKFPGSSSSSSSAAAPGVTEKNGLHVDPTAAAARTGGRTNGEEDAEMVLADQEELAAPSASAPAGVAANLFRKKATLPQPSAARKPLRIKIGQPKLPTNFEEDTWAILKDAITAIFLKQKLSCDVEKLYQAAGDLCLHKLGANLYERIKKECEVHISAKISALVGQSPDLVVFLSLVQRTWQDFCDQMLIIRGIALLLDVKYVKNVANICSVWDMGLKLFRKHLSLSPEIEHKTVTGLLRLIESERLGEAIDRTLLSHLLKMFTALGMYSESFEKPFLECTSEFYATEGVKYLQQSDIPDYLKHVETRLQEEHERCILYLEANTRKPLITATEKQLLQRHTSAILEKGFTMLMEANRVKDLSRMYTLFQRVDAIELLKQALSSYIRGTGQGIIMDEEKDKELVPFLLEFKASLDRILEESFAKNEAFSNTIKESFEHLINLRQISSSPFFQQNRPAELIAKFLDEKLRAGNKGTSEEELEGILDKVLVLFRFIQGKDVFEAFYKKDLAKRLLLGKSASIDAEKSMITKLKTECGSQFTNKLEGMFKDIELSKEINESFKQSSQARTKLPSGIEMSVHVLTTGYWPTYPPMDVKLPHELNVYQDIFKEFYLSKYSGRRLMWQNSLGHCVLKAEFPKGKKELAVSLFQSVVLMLFNDAQKLSFLDIKESTGIEDKELRRTLQSLACGKVRVLQKMPKGRDVEDKDEFVFNEEFSAPLYRIKVNAIQMKETVEENTSTTERVFQDRQYQVDAAIVRIMKTRKTLSHTLLITELFQQLKFPIKPSDIKKRIESLIDREYLERDRSNPQIYNYLA

SEQ ID NO: 5956 - protein, 479 aa, Pyrococcus abyssi GE5
MCLIAGGFNVSREDAIKIINLGKHRGPDSFGFWSERQMLKSDNFSDVSEIEGGEIALIQCRLAMTGSKSYTQPFYNEIILVHNGEIYNHESLRKYLIERGVAFETDVDSEVILRLLEYLVFDRKLKVEEAIKLSMKMLRGDYAVAFFFNGKFYLFRDPLGVRPLYYSSRGHFASEKKVLWGLGEDAEPVLPGEIVSISKHGITRVRGFNVFSIRTQGKDYFNGLQNLLIDSVKVRASKKVGVLFSGGVDSSLIALIASRYSDVILYTSGTEDSKDVEWARRVAEELGLKLRESLFSREDIENEIERIMFAIEEPNPMNLAIAIPLYFSTKRAREDGVKVLLSGQGADELFGGYAKYLQNPGLMLKDVEELGERNLARDDKVAMLNGVETRYPYLDLPFAILALNVPLELKIRDGKRKFILREIAKSLGLPEWVAEREKKAAQYGSNAQKILEKIAKSRGVKLKGLADILFSKVFHGIQN

SEQ ID NO: 5957 - protein, 452 aa, Aeropyrum pernix K1
MAVDAPRIVVEPPGPRAREVLERDERVIMQSFTRWYPLVVKRGYGAVVEDVDGNRYIDFNAGIAVLNVGHNHPRVVEAVKRQLERFLHYSLTDFYYEEAVSAAERLARSVPISGGAKTFFTNSGAESIEASIKVVRAFFRGTRPYIISFLGGFHGRTYGAMSASASKPVHRARFYPLVPGFIHAPYPDPYRCPFPGLEGEACGEAAVSYIEDYIFSKLVDPGEVAAFLFEPIQGEGGYVVPPDSFLPSLQKLARKHGILLIADEVQTGFARTGRMFAVEHWGVEPDVMALAKAMGGGLPLGAAVGRSEVMSLPRGSHANTFGGNPVALAAFNAVMDVIEGERLWERSQRLGEKALKILGEAAEELSIVGHVRGKGLMIGVELVRDENTREPHKEALAWVLDRSFKRGLLVIGAGVSAVRIAPPLTIEEELFDRGLEILVEVLREADRRFSQV

SEQ ID NO: 5958 - protein, 325 aa, Gibberella zeae PH-1
MSQTFKQAAESARSKARGDSAAIANDLLHTPLMRAALPFINGGIAGMVATTVIQPVDMVKVRIQLAGEGTATGPKPSPLAVTRQIIASGKFLDLYTGLSAGLLRQAVYTTARLGMFDTLMGNLSARAKTEGRTVGFKERATAGLTAGGIAAMIGNPADLALIRMQSDGLKPLAERKNYKSVIDALSSIAKSEGVGALWAGAAPTVARAMALNFGQLAFFSEAKVQLKKNTDLSARTQTLTASAVAGFFASFFSLPFDFVKTRLQKQSKGPDGKLPYRSMIDCFSKVAKQEGLGRFYRGFGTYYVRIAPHAMVTLIVADYLGFITK

SEQ ID NO: 5959 - protein, 347 aa, Bacillus cereus E33L
MKDLIIIGAGQAGLTMGYYLKQEGYNFLLLEAGNRVGDSWRNRYDSLQLFTPRSYSSLPGMALIGEKNEFPYKDEIATYLEEYARHFQLPVQLQTEVLKIRKEKGIFELHTSTEILQTKKVIIATGGFQQPFIPSVSANLSSHVFQIHSSQYKSPSQIPKGKALVVGGGNSGMQIAVELAKTHEVTMSISHSLTFLPLHFFRKSIFNWLEKLGLLYAEVSTKRGKWFQKRKDPIFGFEGKELIRNGAIQLQEKVVSASENNIMFQNGETYSAESIIWSTGFIQNYNWIEIEKAVNENGLPNHIKGISPVRGLYYIGLPWQSQRGSALICGVGKDAAYLLSEIKKIDQ

SEQ ID NO: 5960 - protein, 426 aa, Yersinia pestis CO92
MSKSENLYAQAQQLIPGGVNSPVRAFTGVGGIPLFIERADGAYLFDVDGKAYIDYVGSWGPMILGHNHPAIRQAVIEAVERGLSFGAPTEMEVKMAQLVTDLVPTMDMVRMVNSGTEATMSAIRLARGYTGRDKIIKFEGCYHGHADCLLVKAGSGALTLGQPNSPGVPTDFAKHTLTCTYNDLASVRQAFEQYPQEVACIIVEPVAGNMNCIPPLPEFLPGLRALCDEFGALLIIDEVMTGFRVALAGAQDYYHVIPDLTCLGKIIGGGMPVGAFGGRREVMNALAPTGPVYQAGTLSGNPIAMAAGFACLTEISQVGVYETLTELTDSLATGLRHAAKEENIPLVVNHVGGMFGLFFTNADTVTCYQDVMNCDVERFKRFFHLMLEEGVYLAPSAFEAGFMSLAHSNEDIQKTVNAARRCFAKL

SEQ ID NO: 5961 - protein, 489 aa, Gibberella zeae PH-1
MALLSVNLRDGLILTAVITILLYIWEKKTAKITRNGEPLRKPPNTLPLVGNGIIFLQPRQKLFSWFHRCERLYGYETLHITVPSLPPGVIVNDPQNLDFIFRNEGVFEKGEFFKQRSWDLFGHGIINVDGEFWRLQRKAGLRFLSAAALKTLTNEKLPKYLDQAIGVLEAKTNTKEVVDLQAVVHEVTTQLMGRMAYNMEMHADDDFTVAFEHASGGTAERFQNPLWFVTEMFTGARMRRSITTVKAYGKRIVTSAVADRKEAEGKTQSDAPGSLIQSLLDSIGDETLVADAALNYLSAGRDTVAQALTWTLYLLMKNPHVATKLRQSVESLRDEDTSTGDDPELLTPVRLPYVLAVFYESLRLRPPIPFEIKQAQQATTLPDGTFLPAGAIVVWCAWAMGRSHTTWGPNADDFRPERWLTTSLAGDVTVAQRPAAEFPVFNGGPRTLARLVPLFKFEPAFEGERVSKSSLTLPMEGGLPVYVQHQTPS

SEQ ID NO: 5962 - protein, 285 aa, Oryza sativa (indica cultivar-group)
MPFWQNRSSSCIQQQSLIVNTHLLFPHDHSLSIVRLKQVYKILQYIEAYQEEHKLGPMPIILCGACSSYDTAHQYSDSEEDAHKWVSHRNHRGNICGVDFIWLLNPNKSRKPLKTSWNEAVFGIIKYLLLQVASLSEENAFALLKADSPDDQITYSSFCQALCQLGMVHPDRLNSEEIKDLWSEADHDGDDIVDYKEFQRCIWSPTCCSQEEEDDTEIDISDGSLVTFEANDEAFGFTVKEAVLFPPEVEKGMWPENYSLSDHAPLTVVFSPVRMPCSPRTPRTP

SEQ ID NO: 5963 - protein, 325 aa, Idiomarina loihiensis L2TR
MAKMNLLQAINSALDLAMAKHDNVYSFGEDTGGFGGVFRATSGLTEKYGKHRNFNTPLVEQGIIGFANGLASQGSYAIAEIQFGDYIFPAFDQIVNETAKFRYRSGNEFNVGGLTIRTPYGGGIAGGHYHSQSPEAYFAHTPGIKIVTPRNPYEAKGLLLSAIFDKNPVLFMEPKRLYRASTGDVPEEEYTIPLGKADVVKEGKDITVLGWGAQMEMIEKAVEKSEEDGVSCEVIDLRTISPWDVETVTESVLKTGRLVITQEAPITGGFASEIAATVQDKCFLYLESPIGRVCGIDVPYPLCHEKEYMADHLKIYEAIKRSMNY

SEQ ID NO: 5964 - protein, 365 aa, Emiliania huxleyi
  misc_feature (151)..(151): Xaa can be any naturally occurring amino acid
DNGSGMCKAGFAGDDAPRAVFPSIIGRPRQPGVMVGMGQKDSYVGDEAQSKRGILTLKYPIERGIVTNWDDMEKIWHHTFYNELRVAPEEHPVLLTEAPLNPKANREKMTQIMFETFNVPAMYVAIQAVLSLYASGRTTGIVMDSGDGVSXTVPIYEGYAVPHAILRLDLAGRDLTDWMVKLLTERGYSFTTTAEREIVRDIKEKLAYVALDFDQEMQTAASSSSLEKSYELPDGQVITIGNERFRCPEALFQPSFLGMESAGVHETTYNSIMKCDVDIRKDLYANVVLSGGTTMYAGIADRMSKEITALAPASMKVKIIAPPERKYSVWIGGSILSSLSTFQQMWISKQEYDESGPSIVHRKCF

SEQ ID NO: 5965 - protein, 443 aa, Leptospira interrogans serovar Copenhageni str. Fiocruz L1-130
MISPLRWLLPAKAKPLLSKELIDRSYPRFRWRILEATFIGYATFYLVRNNFPVISKEMGEALHYSQEQITNILAVTAITYGIGKFLMGILSDRSNPKYFMPLGLILTAICNLFFGASNQYEIHFYLWALNGLMQGMGWPPCGRSLGHWFGVSERGSKFAIWNIAHNVGGGLVGIIAAYSASWWGWRNAFYIPALIAIVTAIYLLFRLVDTPQSVGLPPIEEYQKDPEKEVRLSIQEQEKELSFREIILGSVLKNHYVWTFAFANFFVYVVRYGLTDIGPTYLKLSKGASLEKGGISTLIYEFAGIASTLLVGWGSDKLGGKRGMVSLLCMLPILFALISLLFTPLGFLWLDLVLFGIIGFFIYPPVMLLGVAGLDFTSKKAVGAAAGFIGLFGYLGRTILSKSVGWLSKQTGFHWEQPMYLMIGATLISIALLAITWNWKPKA

SEQ ID NO: 5966 - protein, 226 aa, Nicotiana tabacum
ELRQATDTTARLGSFRVLTNKAIEANDGNPLPLYQKALCGLTAGAIGACFGSPADLALIRMQADATLPVAQRRNYTNAFHALYRIVADEGVLSLWKGAGPTVVRAMALNMGMLASYDQSVEFFKDNLGMGEAATVVGASSVSGFFAAACSLPFDYVKTQIQKMQPDAQGKYPYTGSFDCAMKTLKSGGPFKFYTGFPVYCVRIAPHVMMTWIFLNQIQKVEKKIGL

SEQ ID NO: 5967 - protein, 459 aa, Neurospora crassa
MGQNQSGMGGGQDPSKSKKDKKDKPKYEPPPKPTTRIGRKKKRQGGASAAAKLPSVYPTSRCKLRLLRMQRIHDHLLLEEEYVENQERLRKAKTAKDSNAPASELESSDRMADERSRVDDMRGSPMGVGVLEELIDDDHAIVSSTSGPEYYVSIMSFVDKDLLEPGASVLLHHKSVSIVGVLTDDTDPAVSVMKLDKAPTESYADIGGLEQQIQEVRESVELPLLHPELYEEMGIKPPKGVILYGAPGTGKTLLAKAVANQTSATFLRIVGSELIQKYLGDGPRLVRQLFQVAAENAPSIVFIDEIDAIGTKRYDSTSGGEREIQRTMLELLNQLDGFDDRGDVKVIMATNKIESLDPALIRPGRIDRKILFENPDQNTKRKIFTLHTSKMSLNEDVDLEEFIAQKDDLSGADIKAICSEAGLMALRERRMRVQMADFRAARERVLRTKQEGEPEGLYL

SEQ ID NO: 5968 - protein, 381 aa, Medicago truncatula
MVNTNLEEIKQEHEHVYDRQKELKLLDESKEGVKGLVDAGLTKVPKIFIHDKIHEHNNKQTSSTNLSIPIIDFGPLFTNTSSSSRLEIIEKVKHASEKWGFFQVVNHGIPSTVLDEMIDGVVRFHEQDTEMKKKFYSRDITKRAYFNTNFDLYVTPAVNWRDSLSCVMGPQPLDPQDLPTVCRDITVKYSDYVNKVGMILLELLSEALGLNSNYLKDIDCAEGLFLISHYYPPCPEPELTFGTSAHSDSSFFTVLLQDQLGGLQVFHGNQWVDVTPIPGALVINLGDMMQLITNDKFLSVKHRVLAPKIGPRISVACFFRQHLPPENSKLYGPITELLTPENPPVYKETSVKGLVSHYYGKGLDGNSALDHFRIQAVKQEE

SEQ ID NO: 5969 - protein, 151 aa, Geobacillus sp. M10EXG
SLLNITSQQLEKTFRTNVFGYFYLAKAALPYLQKGSAIINTASITAYEGNDQLLDYSATKGAIVAFTRSLAKSLAGQGIRVNGVAPGPIWTPLIPSTFTSDQVATFGSNTPMKRPGQPCEVAPSYAFLASEEASYITGQMIHVNGGKIVNG

SEQ ID NO: 5970 - protein, 381 aa, Medicago truncatula
MVNTNLEEIKQDHEHVYDRQKELKLLDESKEGVKGLVDAGLTKVPKIFIHDKIHEHNNKQTSSTNLSIPIIDFGPLFTNTSSSSRLEIIEKVKYASEKWGFFQVVNHGIPSTVLDEMIDGVVRFHEQDTETKKEFYSRDNGKRVYYNTNFDLYVTPAVNWRDSLSCVMGPQPLDPQKLPTVCRDITTTYSEYVKKVGTILFELLSEALGLNSNYLKDIDCVEGLFLISHYYPPCPEPELTIGASAHSDSSFLTVLLQDQLGGLQVFHENQWVDVTPIPGALVVNLGDMMQIITNDKFLSVKHRVLAQSIGPRVSVACFFRQHLPPENTKLYGPIAELLTPENPPLYKETSVKGLVSKLYGKGLDGNSALDHFRIQAEQQEE

SEQ ID NO: 5971 - protein, 471 aa, Rhodococcus sp. RHA1
MSGTTDPQLQHTLKKRHLSMIAIAGVIGAGLFVGSGVAIRETGPGVLVAYALAGIVVILVMRMLGEMSTANPETGSFSAYADRAIGRWAGFSIGWLYAWFWIIVLGIEATAGAVIMNRWIPDVPQWSWALILMVLLTLTNIASVKSFGEFEFWFASIKVAAIVIFLVLGVLAICGALPGVEAPGLTNLTGHGGFFPNGAGAVFAAVLVVVFSFFGAEIATIAAGESANPVAAVRNAVRSVVWRILIFYIGSIAVVVTLLPWDDASVALSPYVAVMDSFGIPAAGNIMDVVVLTSVLSCLNSGLYTASRMIFSLSRRGDAPASLSKIGSSGVPRQAVLVSTVVGFLTVGLNYLYPDTVFLFLVNSSGAIALFVWLAISVSQLRMRRSLEAEGKDLSLKMWLFPYLTWCTIAAIIALCVGMLVLSETRSQMYVSMGLAVVVVGIGIYRQHTRGTTDETPDPSPSGEEVDALRP

SEQ ID NO: 5972 - protein, 511 aa, Rhodococcus sp. RHA1
MTPASDISRRKFLASAAAAGGAAFLSSWAGPVIDRAYAQDPGGSGSLNDIEHFVYLMQENRSFDHYYGTLSGVRGFDDPSPAWQQYGWTPGAGPTPTGFLNPFRLDTTQGAHLDGECINDPTHSWGPQHDAWNGGAMDRWMPVHIAHEGPLNGPATMGYYTRADIPVHYDLADAFTICDHYFCSVLGPTDPNRLYWMTGTIDPDGLAGGPLVETPTVIPKFVYSWRTYPENLQEAGVSWKVYANKDLGPVSSVALDGMLGCFTQYSDPNSELARRGLDPTYPNDFRADVANGTLPAVSWIVPNIFTCEHPALPPAAGAVGIVEVLDILTSNPAIWEKTALIISYDENGGFFDHVTPPTPPPGTPGEYLTVPLNTVSESENNPGPIGLGFRVPSLIISPYSRGGLVASDTFDHTSQLRLLEKRFGVPVPNLTEWRRGAVGDMTSAFDFSSAPNAGVPAMTDPGPRLQAAIAQCGPNVAAGTLNAGAPYPVPPNSMPVQEQSPLRRRPSGLIM

SEQ ID NO: 5973 - protein, 657 aa, Medicago truncatula
MACISIHNFMLLLLFLFHFTPTSAQVPIFLYSFCQNSTEKSLTASYKSNVNKLLLWINSDSAAGTEFNNNKIGSNNTTSDDVYGNYDCRADVTGSFCQFCINTAVKEIAQRCLNSDTAVIFYDVCIIRYSNKNFFGNVSITPSWNVTGSKKIKDSTELTKVEDYIGILIRKVTVETNQSWGASEFNSNETGKRYGFLQCARELDKEGCRQCLEAVLDLVPKCCGTKVAWEVVVPSCGIKFDDQKFFQLNDQSGSSSLKPNQAKQEGASNKKTLIIILVSVLMAVALLCCCVYYYWRKNGLCKASLVGGFLLRKTLNIDDTLNGDLPTIPFSVIQHATNYFSSSSKLGEGGFGPVFKGTLPDGTEIAVKRLAETSGQGSEEFKNEVIFIAKLQHRNLVRLLGCCIEGNEKILVYEYMPNSSLDFHLFDEEQHKKLDWTLRLSIINGIARGLLYLHQDSRLRVIHRDLKASNVLLDDEMNPKISDFGLARKFEKGQSQTKTKRVIGTYGYMAPEYAMAGLFSVKSDVFSFGVLVLEIVYGKRNGEFILSEHRQSLLLYTWKLWCEGKSLELIDPIHKKSYIESEVMKCIHIGLLCVQQDAADRPTMSTVVAMLGSDTMPIPKPKQPAFSVGRMTEDDPTLKSYKDNYVDEVPITIVSPR

SEQ ID NO: 5974 - protein, 253 aa, Rhodococcus sp. RHA1
MGTLDGKVALITGAGQGVGAGMAFALAKEGARIAVVGRTEAKLVDTCAGIADFGGVAEPIVCDVSKRDQLGPMVDRVVDEFGGIDILVNNANASALGPLLDITPKLLDRAMAVGPVATLLLMQLCYPHLKARGGGSIINLVSSSAVRWDTSGYGLYAATKEAMRSLTRTAASEWGPDGIRVNAIAPHALSPGLKWWTENNPEEAAEFVKSIPLGRIGDCEQDIGRAVVFLVGPDAGYLSGATIPLDGGQARWS

SEQ ID NO: 5975 - protein, 520 aa, Streptococcus pneumoniae TIGR4
MSNISTDLQDVEKIIVLDYGSQYNQLISRRIREIGVFSELKSHKISAAEVREVNPVGIILSGGPNSVYEDGSFDIDPEIFELGIPILGICYGMQLLTHKLGGKVVPAGDAGNREYGQSTLTHTPSALFESTPDEQTVLMSHGDAVTEIPADFVRTGTSADCPYAAIENPDKHIYGIQFHPEVRHSVYGNDILRNFALNICKAKGDWSMDNFIDMQIKKIRETVGDKRVLLGLSGGVDSSVVGVLLQKAIGDQLICIFVDHGLLRKGEADQVMDMLGGKFGLNIVKADAAKRFLDKLAGVSDPEQKRKIIGNEFVYVFDDEASKLKDVKFLAQGTLYTDVIESGTDTAQTIKSHHNVGGLPEDMQFELIEPLNTLYKDEVRALGTELGMPDHIVWRQPFPGPGLAIRVMGEITEEKLETVRESDAILREEIAKAGLDRDIWQYFTVNTGVRSVGVMGDGRTYDYTIAIRAITSIDGMTADFAKIPWEVLQKISVRIVNEVDHVNRIVYDITSKPPATVEWE

SEQ ID NO: 5976 - protein, 446 aa, Listeria monocytogenes str. 4b H7858
MAKFTYDVVIIGSGASGTTVAFEAQAAGLKVAIVEERSWGGTCVLRGCDPKKVLVGAREARNLSTRLRGKGIKQAATISWTDLMAFKETFVENVPESRLENFQEAGIETFFGAASFQDSHSLQVGDDLIQANKIVIATGATPSTLKVEGQEYIQTSDDFLSLEKLPDSVVFIGGGYISFEFASIALATGREVHIIHHNSEPLKKFDPDFVAALVSNMKEEGIHFHFDTDITKVENKGEKLHIHGKDGFSLQTDLIIGATGRKPNIAHLSLENANIDYTKKGIIVNEKLQTTNNPHIYACGDVAATKGAPLTPVVSMEAAFVAKNVIGGDEKMIYPAIPSVVFTSPKLASIGISAEEAKAHPEKYQIKNHDTTNWYTYKRTNEQIALAKIIEDRESGQIKGAHFLSEEADYMINYVAILMKANLTLADLQSVIFAYPSPASDLTALN

SEQ ID NO: 5977 - protein, 258 aa, Glycine max
MAINHETWAFVFGLLGNVISFMVFLAPLPTFYQIYKKKSSEGFQSLPYVVALFSSMLWIYYALVKKDASLLLITINSFGCVIETIYLAIFLIYAPSKTRLWTIKLLLMLNVFGFGAMLLSTLYLTTGSKRLTVIGWICLVFNISVFAAPLCIMKRVIKTKSVEFMPFSLSFFLTINAVMWFFYGLLLKDYYIALPNTLGFLFGIIQMVLYLIYRNAKPQGLEEPTKVQELNGHIIDVVKPNHVTKNGPVPVIETASNV

SEQ ID NO: 5978 - protein, 515 aa, Zea mays
  misc_feature (95)..(95): Xaa can be any naturally occurring amino acid
MRIPRRKGGAGPLAVGVPSRRAQVAAVFALATLLGVSVLYDAAHIAASLRRHGGPTAYAKLSSSDGAASVSGVAREEVAAVETLAPPARAVGSDXRRSDRPRPPHEQQEEPKEGAAKPGASLQQDAPLTEEVVEGGSGGHGGGGSQEQEQDQAQGTCDLYKGRWVYDESRAPLYKESECSFLTEQVTCTRNGRRDDDYQKWRWQPDGCDLPRFEAKLLLEKLRNKRLMFVGDSLNRNQWESMVCLVQSEAPWDKKSLVKNGSLNVFHLQEYNATVEFYWAPFLVESNSDDPDIHSISDRMIKPTSIAKHAANWEGVDYLIFNTYIWWMNTPQMKTVHGGSFSRKHVKYDEIERVEAYRKVLKTWSRWVEAHIDPKRSTVLFMSVSPVHMQSEGWGSPNAVKCFSETQPAINYTKKLEVGTDWDLFAAAQRVTRSMEKVPVRFVDVTALSEIRKDAHTSVHTLRQGKLLTPEQKANPRKFADCIHWCLPGVPDTWNQFVYGHIVSSPPPPQDQPHR

SEQ ID NO: 5979 - protein, 135 aa, Oryza sativa (indica cultivar-group)
MAKKQRREAAARRRREQQQQGREQRHHHHHRRRPLLLQPRDERCVSCTTFNILAPIYKRMDSENCRESQYRAYWFSRNEKIIDRLLADCSSIICLQEVWLGNDELVDMYEKRLGDANYSLFKLARTNNRGDGKPI

SEQ ID NO: 5980 - protein, 437 aa, marine gamma proteobacterium HTCC2080
MSFSTLGLSESLLKAVADEGYTTPSPIQAQAIPAVLEGRDVMAAAQTGTGKTAGFTLPLLHGLSKGQPAKANQVRALVLTPTRELAAQVAESVDIYGKYLNLRSAVVFGGVKINPQMMRLRKGVDILIATPGRLLDLYQQNAMSFQKLEVLILDEADRMLDMGFIHDIRRIMKALPNKRQNLMFSATFSEDIRDLAKTIVNNPVEISVTPRNSTAVSVTQWIHPVDKNQKRHLLVELINQHNWEQVLVFSRTKRGANRLAEFLDKKGIQAAAIHGNKSQGARTRALSEFKSGKLRVLVATDIAARGLDIEQLPQVVNLDLPEVAQDYVHRIGRTGRAGATGQAISLVSADEAQLLQDIERLIQTLLSRKLVAGYEPENPLPELALRPPAKPKKPKKPTTQRHAGSNVDGNKTGERDSRRTPTSTDPWKRRRSNNKAR

SEQ ID NO: 5981 - protein, 462 aa, Mycobacterium tuberculosis H37Rv
MGSTEQATSRVRGAARTSAQLFEAACSVIPGGVNSPVRAFTAVGGTPRFITEAHGCWLIDADGNRYVDLVCSWGPMILGHAHPAVVEAVAKAAARGLSFGAPTPAETQLAGEIIGRVAPVERIRLVNSGTEATMSAVRLARGFTGRAKIVKFSGCYHGHVDALLADAGSGVATLGLCDDPQRPASPRSQSSRGLPSSPGVTGAAAADTIVLPYNDIDAVQQTFARFGEQIAAVITEASPGNMGVVPPGPGFNAALRAITAEHGALLILDEVMTGFRVSRSGWYGIDPVPADLFAFGKVMSGGMPAAAFGGRAEVMQRLAPLGPVYQAGTLSGNPVAVAAGLATLRAADDAVYTALDANADRLAGLLSEALTDAVVPHQISRAGNMLSVFFGETPVTDFASARASQTWRYPAFFHAMLDAGVYPPCSAFEAWFVSAALDDAAFGRIANALPAAARAAAQERPA

SEQ ID NO: 5982 - protein, 582 aa, marine gamma proteobacterium HTCC2080
MIYAATLILAACSLLYELLIAQALATFAANTVTWYSVTVGLYLAGMGLGALLHDQHPTDNLWARFFKVEIALSAAGAIAVPLLHFSHTGALLLELYGLTFLGEVLFFGTGFLSITTIGILTGFELPVLIDLANTAKDKRRLTNRVLASDYTGSLLGGLAFPLILLPKLSLVAIGLIAATLNVFLAILALYFFLPKLHRSSFGFIVSGSLVIMLGLGLSLAPSLDRYFTKLYYFYWDQSEDFKQLFASMDNTEDVFRVRSPYQRIDLVHDKNGSGPSPVDDFYSSKFVDNPQQPKNYSLFLNGDFQLASNYEEYYHEFFAHIPIMTNGAVPRHVLVMGGGDGLLLRELVKYSDIKTIVHVDLDRELIEQATTHPVLLAMNEGALSDPRITRHFDDAYRFIRNSSEQFDAIYLDFPDPRDYNLSKLYSREFYHFVRQRLTSDGFIALDSPGLRHNKERREIYTSTLAAAGYKFVTPYISKIETINEAAYEFLLASGYEEEKARRLLASHAASMRLGFITARDNWPDRPIYQDPRVKLHVINDTRLYLTLRNLIPSLAPTDPDKINSIFRPTLPSGNIWHVRDPW

SEQ ID NO: 5983 - protein, 431 aa, Idiomarina loihiensis L2TR
MQERIVIVGGGAGGLELATMLGRKLGRKKKAKIMLIDRNSTHLWKPLLHEVASGALDSRLAELDYRGQSAREGFQFLVGTLEAVNKNEKSIQLAAIKDEQGNEVLAPRSIQYDRLILSIGSVTADFGTPGVSEHCYFLDSLRQADEFHEHLLNEFLRVNQSIEDGENTKLSLAIVGGGATGVELAAELIHSVSLLSIYGLSFLDQKHFEVRLVEAGKRLLPALPERLSASVEKKLKSLGVEVILGNPVTEVKENTLVLSEGENINANLMVWAAGVRAPDFVSEWGLKVRKNNQIEVNEYLQSVSDESIYAIGDCAGCRIDDERWVPPRAQSAHQMAECLYQNIVREYRNKPAKAFKYKDRGSLVSLSRFSAVGNLMQSKSLSMSLEGTLARWAYASLYRMHQRALHGWWKMFLLLMVDKLNHVVKPRLKLH

SEQ ID NO: 5984 - protein, 343 aa, Vibrio fischeri ES114
MKIKALSKLKPEEGIWLTEVEKPEMGHNDLLIRIKKTAICGTDVHIYNWDEWSQKTIPVPMVVGHEYVGEVVGIGQEVRGFEIGDRVSGEGHITCGHCRNCRGGRTHLCRNTTGVGVNRTGAFSEYLVIPAFNAFKIPAGISDDLASIFDPFGNAVHTALSFDLVGEDVLITGAGPIGIMAAAVAKHVGARHVVITDVNEYRLDLAKKMGVTRAVNVMNEKLEDVMSELGMTEGFDVGLEMSGNPSAFNSMLTNMNHGGKISLLGIPPSDMTVDWNQVIFKGLVIKGIYGREMFETWYKMASLIQSGLDLTPIITHHYKIDDFQAGFDMMRSGMSGKVILDWE

SEQ ID NO: 5985 - protein, 347 aa, Oryza sativa
MQHSDTDKYSYRISRGKFSVTAISLDDYLPMRSSEVKNRTSTGDITSLRVITAVKTPYLPDGRFDLEAYDSLINMQIEGGAEGVIVGGTTGEGHLMSWDEHIMLIGHTVNCFGTKIKVVGNTGSNSTREAIHATEQGFAVGMHAALHINPYYGKTSVEGLISHFEAVLPMGPTIIYNVPSRDWQDIPPPVIEAVSSYTNMAGVKECVGHERVKCYADRGISIWSGNDDECHESRWKYGATGVISVASNLIPGLMHSLMYEGENAALNDKLLPLMKWLFCQPNPIALNTALAQLGVARPVFRLPYVPLPLEKRVEFVRIVESIGRENFVGQKEARVLDDDDFVLISRY

SEQ ID NO: 5986 - protein, 226 aa, Vitis vinifera
VTIFHWDLPQTLEDKYNGWLDPQIIKDFALYAETCFQQFGDRVKHWITFNEPHTFTVQGYDIGLQAPGRCSIPLFLFCRAGNSATEPYIVAHHALLSHATVADIHHKKYKAKQQGSLGVAFDVIWFEPKTNSTEDIEATQRAQDFQLGWFIDPLMYGDYPKSLKDGVGSRLPNFTRDESALLKGSLDFVGINHYTTFYAEYDANNLTGMLLNDSLADNGTILHLAE

SEQ ID NO: 5987 - protein, 317 aa, Rhodococcus sp. RHA1
MPLDEQAETILRGLNENFPRVETMTGAQARAATRAGRKAVADPEPVGSVCDREIRGDAGPIAVRIYLPAGHRAESLPVVVFFHGGGFVICDLDSHDGFCRAMCNGIGAVVVSVDYRLAPESQWPAAADDAYTATCWVAQHAREFGGDPDRLLVAGDSSGGNLAAVAALMARDREAPAVAGQLLIYPVIEPVFDTESYELFAEDHFLTRSAMQWYWDQYLPTHRETVPAYAAPVRAEDLGGLPPAIVITAERDPLRYEGEKYAGALADAGVPVQCRRVEGMFHGFLTIDAMAAAQTARRELWPRLRTLVAEPASTPVD

SEQ ID NO: 5988 - protein, 431 aa, Thermus thermophilus
MTENAEKFLWGVATSAYQIEGATQEDGRGPSIWDAFARRPGAIRDGSTGEPACDHYRRYEEDIALMQSLGVRAYRFSVAWPRILPEGRGRINPKGLAFYDRLVDRLLASGITPFLTLYHWDLPLALEERGGWRSRETAFAFAEYAEAVARALADRVPFFATLNEPWCSAFLGHWTGEHAPGLRNLEAALRAAHHLLLGHGLAVEALRAAGARRVGIVLNFAPAYGEDPEAVDVADRYHNRYFLDPILGKGYPESPFRDPPPVPILSRDLELVARPLDFLGVNYYAPVRVAPGTGTLPVRYLPPEGPATAMGWEVYPEGLHHLLKRLGREVPWPLYVTENGAAYPDLWTGEAVVEDPERVAYLEAHVEAALRAREEGVDLRGYFVWSLMDNFEWAFGYTRRFGLYYVDFPSQRRIPKRSALWYRERIARAQT

SEQ ID NO: 5989 - protein, 172 aa, Chlamydomonas reinhardtii
MPNPIVFFDITADGAPVGRIEMELYADDVPKTAENFRALCTGEKGVGRSGKPLHFKGSTFHRVIPNFMCQGGDFTRGNGTGGESIYGEKFPDENFKHRHTGPGVLSMANAGPNTNGSQFFLCTVETAWLDGKHVVFGKVCKGMDVVKKVEGYGSSSGKTRATFAIADCAQLA

SEQ ID NO: 5990 - protein, 220 aa, Yersinia pestis CO92
MKEIEKLIANNRTWSNTICKDDPGFFEHLAQSQKPRFLWIGCSDSRVPAEQLTGLKSGELFVHRNVANLVIHTDLNCLSVVQYAIDVLQVEHIIICGHLGCGGVEAAIKGEEMGLIDNWLLHIRDLWYKHSSLLGELPQEERSNVLCQINVVEQVYNLGHSTIVRSAWKRGQKAMIHGWVYGIENGLLRDLEVSATSLGSLEMVYRKAMAELLQNNKEDH

SEQ ID NO: 5991 - protein, 303 aa, Oryza sativa (japonica cultivar-group)
MDPNQPLSALQDRKITIWLTSKSQVTIAKRQGEEGHASNWTEEENLRLLSSWLNNSLDSINGNDKKGEYYWRDVAAEFNGNTSSNNRKRTVVQCKTHWGGVKKDIAKFCGAYSRARRTWSSGFSDDMIMEKAHALYKSENNDKTFTLEYMWRELKDQPKWRRILEEDSKNKRTKISESGAYTSSSNQETEEETSRKEKRPEGQKKAKVKLKGKGKKHAPSPLGDQPSQDFVLLNEAVKLRAEAVLKSTEATTKSAEAKKEQTRMEKYQTYLKLLDKDTANFNDVKLKRHEAILEKLATELAEE

SEQ ID NO: 5992 - protein, 348 aa, Gloeobacter violaceus PCC 7421
MTTPLLGQSAEELRIWVESQGQPAYRAQQLHRWLYQRGVRSLMEITDWPKAWREQVHSVPVGRSQVVRQSAAADGTIKYLLAGADGETVETVGIPAAERLTVCVSSQVGCPMACRFCATGQSGFARNLGVHEIVDQVLTVQEGFGRRVSHVVFMGMGEPLLNLGAVVQALRVLNGDIGIGQRQITVSTVGVPGQIRRLGTYKLQITLAVSLHAPNQDLRLKLIPTAQHYPIEELLEDCRDYVETTNRRVSFEYTLLAGINDEPHHARELAAILRGFQSHVNLIPYNPIEGVEYERPGEARVRAFERELVRHKIAASVRHTRGLEEAAACGQLRRRSLSGEAQSASTRA

SEQ ID NO: 5993 - protein, 407 aa, Symbiobacterium thermophilum IAM 14863
MDSRVRVVVLGAGYAGLTCFLELQDRLARGHDLVLVSRDRHHWFTTELHTYAAGHDADAVRIPLRRLVRPPGRLIIDHVSALRPAARQVELKLSGTLAYDLLVFALGSEPEYFGLPGIPRHALTIGSPPAAREVRERVRALAAREGPPGHVLVVGGGLTGVELAAELADEYPGRLRVTILEAAPEIMAGFPPDLVQVARRILEGKGIRILAGSPIVTADASCVHLQGGGEVPYDLLVWAGGVRGHSLLARAGLALGGRGRARVDAFLRSVIDDRIYVIGDSAAFADPASGREIPPTGQAAVQMGRAAAENILRRLGGRPERPFAFRMRGQFASLGHHEGVGVLGEAPMAGLPAMAVKHFVEGLHAWEVGGGVMPLVRRLVAAPVGYLRGRRLRTFTRQPRPVSEQPP

SEQ ID NO: 5994 - protein, 681 aa, Oryza sativa
MLAAGYGVLAVAAAVVLTLPSAVRAAPSNICDMGVATYAANSTFEANLDRLGAELPANVSAARATGGYAVATVGAAPDLVYALALCRGDVNASACGACVAAAFADGKRSCPGIKGATVSGPGDGCVLRYSGQSFMNFLTTEQWHVSEILWYPDHATDSIKVPDVGWFNAAVAKILAALVEHTWATTTSNATAKKYFSTGEEEFNPKIYGFVQCVPDLSPEQCKECVRTLHDQAKIHYMGNSLPWASTYSVWCSLMYSVRPFFGGRAMLQLSPPLPPAVDTPVGTHEPGAGKKKSVAGLAAGLACSVGVLLILSVLVFVRFRRRTKAAETDHPLKKITRAQCMIFDLPTLQEATENFSENNKLGEGGFGTVYKGVLSDGQEVAVKKLLGTTGHGLDQLHNEVLLLAELQHKNLVRLQGFCLHQEQTLLVYEYIKNGSLDNILFDTTKGNSLNWEQQYNIILGIAKGILYLHEDSSLRIIHRDLKSNNILLGEDMEPKIADFGLARLLGEGHTHSRTTRVVGTFGYMAPEYVADGNVSTKIDIFSFGVLVLEIVTRRRNSDSGDHDNVNLLTDVWNSWTKGTISQFIDQSLDGYSRSQAMRCIHIGLLCVQPDPGERPHISSVIFMLTRENMELQPPAQPAFFFGTESASSSTSCGQRSYVYDRYGFASVSVNDVTLTEPYPR

SEQ ID NO: 5995 - protein, 314 aa, Schizosaccharomyces pombe
MPGYDDKRYFTSTAVLLNELIKLVVCFSVGYHQFRKNVGKEAKLRAFLPQIFGGDSWKLAIPAFLYTCQNNLQYVAAGNLTAASFQVTYQLKILTTAIFSILLLHRRLGPMKWFSLFLLTGGIAIVQLQNLNSDDQMSAGPMNPVTGFSAVLVACLISGLAGVYFEKVLKDTNPSLWVRNVQLSFFSLFPCLFTILMKDYHNIAENGFFFGYNSIVWLAILLQAGGGIIVALCVAFADNIMKNFSTSISIIISSLASVYLMDFKISLTFLIGVMLVIAATFLYTKPESKPSPSRGTYIPMTTQDAAAKDVDHKH

SEQ ID NO: 5996 - protein, 502 aa, Rhodococcus sp. RHA1
MTATIEPSQAELLPSVRNFLSGTKRFLVGGQWVESASGETFETIDPATGQVLTTVARGGAEDVDRAVRAARTAFDEGPWATMKPNERERLIWRVGDILSERAEEFGQLEALDNGKSAGIAAAVDVAWSADIFRYFAGWATKIEGSTVNVSMPFVPGGQFHAYTLREPVGVCGLIVPWNFPLLMAAFKLAPALAAGNTVILKPAEQTPLTAILLGEVFEEAGFPPGVVNIVTGYGDAGAALSAHDDVDKIAFTGSTEVGKKIVDAARGNLKKVSLELGGKSANVVFADADFDAAVTGSLNAWLFNHGQCCVAGTRMFVEDSIFDDFTAAVAEAASQVKIGPGLDPTTQLGPLVSQEQFDKVTGYLAAGLADGARALTGGKRWGDTGFYVEPTVFVDVKPEFSIVEEEIFGPVVAALPFNAEEGVAKAANSSIYGLAAGIWTKDLSKAHLTARQLKAGSVWINQYNGFDTAMPFGGYKQSGWGRELGATAIDLYTQTKAVNIAL

SEQ ID NO: 5997 - protein, 611 aa, Pyrococcus abyssi GE5
MCGINGFSWGDEELVKRMNDAIRHRGPDDEGVYVDDNVSLGHVRLAIIDLSPKGHQPMKYEKDGKEVWIVYNGEIYNFMEIRKELEEKGYTFTSNTDTEVILAAYLEWGFDCVERFNGMWAFVIYDKSKNILFLSRDRFGIKPLYYYYDGKNIIFSSEIKGILQHNIPRKPNDAVIFDFLYYNLLDHTEDTFFEGIKRLMPGYNAVFDLNTRKFEAWKYYDLRERIEKRKEISDPQGFKDLFLRAVKMRLVADVPVGSCLSGGLDSSSIVCAMRHLLPDGEIKVFSLVFPGKEIDESKYQRIVVDECRVSWYRTTFNVEDVLADIIDLIRTQEEPFSTLSIYGQYRVMKLARENGMKVLLDGQGSDEILAGYHYFFGYYFVELLRKFKWGKLLREILAYKRIHGSLVPLKNMVLYILPVWVTKRLWRRRFPYLREEFIEKFKKRPSKELIWKIKTLNEALLLAETYYSLPHLLRFEDKNAMRWSIESRVPFCDHELVEYVLSLPPESKVSAGITKVLLRKGLKGILPDEIRNRASKVGFATPDKDILKTNEGQKFALAVIDSESFKKRPYWDYRKVLRMFEEHVSGKKNWSQELWKVIIMELWLREWMDNG

SEQ ID NO: 5998 - protein, 296 aa, Yersinia pestis CO92
MSQKELWYETLHANFGQYFSVENVLFREKTEHQDLVIFENPELGRVMALDGVVQTTERDEFIYHEMMTHVPLLAHGQAKKVLIIGGGDGAMLREVSRHKNIEQITMVEIDAGVVEFCRQYLPNHSAGAYDDPRFKLVIDDGVNFVNQTTEKFDVIISDCTDPIGPGESLFTSVFYEGCARSLNEGGIFVAQNGVCFLQQDEAVNSHNKLSHYFSDVSFYQAAIPTYYGGIMTFAWATQNPALRQLDLATLQNRFAQAGLACRYYNPAIHVGSFALPQYLLDALTTIPKVIGVDSSE

SEQ ID NO: 5999 - protein, 374 aa, Kineococcus radiotolerans SRS30216
MSATTTATTTGSAAPLTFPVRPSAAPVAAERRAEILAAPGFGRFFTDHMAVATWTRGTGWHDAAVVPYGPLQLDPAAAVLHYAQEVFEGLKAYRHADGSVWTFRPRANAARMARSARRLALPELGEDAFLEAVTQLVRTDEAWVPSGGESSLYLRPFMVATEAFLGVRAAHEVKFLVIASPAGSYFPGGVKPVSIWLSQNYTRASLGGTGSAKCGGNYAASLVAQEEAGAHGCDQVCFLDAAEQRYVEELGGMNLYFVHDDGSIVTPELTGTILEGITRASIVELAADLGHEVRERRVSIDEWREGVASGRITEVFACGTAAAVTPVGKLVSADGELSHGTGQAGEVTLAIRERLLDIQYGRAEDTHGWLHRLV

SEQ ID NO: 6000 - protein, 861 aa, Kineococcus radiotolerans SRS30216
MRTSIRTTSHGVAATTRTASAPSEASATTCRSGWESRTMRNPARTSCWSSTRTTRIGLIAGSVTSGTVTSGTVGKGRPHGETPAGARTRRHRPPVQAGALGHPHQALPARAGLQHGRRAPPVVLDAEAQRVVVPADHDVGAGPGPGVLEDVGQGLLHDPVGGQADRGRQVARPPDHLGVDLQPAGPDLLDEVGDHPRVRLGGALVARALAQHPEQVAHVAQRLPPGAGDGLEDPHRHGRVRARGVAPPVGLGDDHRQGVRHDVVHLAGDALALGGGGEAGLVLPLDLQQPGALDEGELVLPARPAQAAQRPGGQDHDADEHRGHHHRGHPAGAEEPQRAQGRAEQPEGQPAEGGPAPGVGGQGVDRDEHGDVPERRRGREDLEEAKEGHQGAGDLGEAAPHGQGQAHRQAHEPGERPPADAVGGAEEPGERGEHQRAEGVEEQAVGPRPPHEAVEDVQRGFPRHGPSVGIPAVAVVGPQDDPRGPPTGGGVHPSRRGDRMPDVRGRASATLARMVDTLRLAVIPGDGIGQEVTVEALKVLTAVLGGGGRVATTEYDLGARLYHRTGETLPDSVLEELRGHDAILLGAVGDPSVPSGVLERGLLLKLRFALDHHVNLRPSKLHPGVPSPLGDPGEIDFVVVREGTEGPYVGNGGALRVGTPQEIATEVSVNTAFGVERVVRDAFARAAARPRRKLTLVHKHNVLVHAGHLWRRTVEAVGAEFPDVAVDYLHVDAATIFLVTDPARFDVIVTDNLFGDILTDLAAAVTGGIGLAASGNVNPDRTTPSMFEPVHGSAPDIAGQQIADPTAAVLSVSLLLAHLGRDDLAARVEAAVAADLARRATGEVGTRSTSAVGDALAAAVG

SEQ ID NO: 6001 - protein, 343 aa, marine gamma proteobacterium HTCC2080
MIRVAINGFGRIGRNILRAYYDRPELSQAIDIVAINDLGEPAINAHLLEFDTAHGRFGHEVTSGEDYLAVDGRRIAVLNERSPSALPWAELNIDLVLECTGLFTTRVSAAAHLDAGAQRVLVSAPTKDADATIVYGVNHGTLTNEHRVISNASCTTNCLAPVVQPLHAEIGLVSGLMTTIHAYTNDQNLNDVYHKDLFRARAAGQSMIPTATGAANAIGLVLPELQGRLDGLAVRVPTLNVSLVDLSFTAARETSVEEINSLMSKAATEDAFGILGYNERPLVSVDFNHDSHSANFDANHTRVAGSLVKVLAWYDNEWGFSNRMLDNALELSAIAGLSAKKAA

SEQ ID NO: 6002 - protein, 475 aa, Yersinia pestis CO92
MMSTEIKTQVVVLGAGPAGYSAAFRCADLGLETILVERYSTLGGVCLNVGCIPSKALLHVAKVIEEAKALAEHGIVFGEPKTDIDKVRVWKDKVINQLTGGLAGMAKGRKVKVVTGFGKFTGANTLVVDGENGPTTINFDNAIIAAGSRPIQLPFIPHEDSRIWDSTDALALRTVPERLLVMGGGIIGLEMGTVYHALGSKIDVVEMLDQVIPAADKDVVKVFTKRISKQFNLMLETKVTAVEAKEDGIYVTMEGKKAPAEPQRYDAVLVAIGRVPNGKLLDAGQAGVEVDDRGFIHVDKQLRTNVPHIFAIGDIVGQPMLAHKGVHEGHVAAEVIAGMKHYFDPKVIPSIAYTEPEVAWVGLTEKEAKEKGISYETSTFPWAASGRAIASDCADGMTKLIFDKETHRIIGGAIVGTNGGELLGEIGLAIEMGCDAEDIALTIHAHPTLHESVGLAAEIYEGSITDLPNPKAKKK

SEQ ID NO: 6003 - protein, 887 aa, Yersinia pestis CO92
MSERLNNDVDPIETRDWLQAIESVIREEGVERAQYLIDQVLGEARKGGVSVAAGSANRDYINTIPVEDEPAYPGNLDLERRIRSAIRWNAVMTVLRASKKDLDLGGHMASFQSSATFYEVCFNHFFRARNQKDGGDLVYFQGHISPGVYARAFLEGRLTEDQMNNFRQEVHGKGLSSYPHPKLMPEFWQFPTVSMGLGPISAIYQAKFLKYLSHRGLKDTSAQTVYAFLGDGEMDEPESKGAITIATREKLDNLVFVINCNLQRLDGPVTGNGKIINELEGIFSGAGWQVLKVIWGGRWDELLRKDTSGKLIQLMNETLDGDYQTFKSKDGAYVREHFFGRFPETAALVKDMTDDEIWSLNRGGHDPKKIFAALKKAQETQGKPTVILAHTIKGYGMGETAEGKNIAHQVKKMNMDGVRHFRDRFNVPVADAEIEKLPYITFEKDSEEYKYLHERRQALEGYLPTRMPKFTEKLEIPALSDFSSLLEEQNKEISTTIAFVRALNVMLKNKSIKDRIVPIIADEARTFGMEGLFRQIGIYSPNGQQYTPQDREQVAYYKEDEKGQILQEGINELGAASSWLAAATSYSTNDLPMIPFYIYYSMFGFQRIGDLCWAAGDQQARGFLIGGTSGRTTLNGEGLQHEDGHSHIQSLTIPNCISYDPAYAYEVAVIMHDGLERMYGEAQENVYYYLTTLNENYHMPAMPQGAEEGIRKGIYKLETVEGSKGKVQLMSSGAILRHVREAAQILAKDYGVGSDVYSVTSFTELARDGQDCERWNMLHPTETPRVPYVAQVMNDAPAVASTDYMKLFAEQIRNFIPASEFRVLGTDGFGRSDSRENLRHHFEVDSSYVVVAALGELAKRGDIDTSVVAEAITKFGIDADKVNPRLA

SEQ ID NO: 6004 - protein, 322 aa, marine gamma proteobacterium HTCC2080
MLGDIGGTNARFGICDDQKEPYQLIGSYEVAAFPTFSNVLEQLQSDLIKAGLSMADAGESCLAVAGRPDVQPVSFTNSAWRFDRELVMSTLGLQSVSIINDFAAAARALPLLSENHLEKVGGGRAEPGSPCVALGPGTGLGVATLATTHSGEPLVISGEGGHVDFAPVTNVEAAVLDFLRARFGRVSIERLCCGEGINNIYQALADYRNLKIKYSSAAEIGAAALSADDALSKETMAMFFAVLGAAAGNFALTLGAKGGIYIAGGIVPRYLDLLRRSDFRARFLAKGRFADYLSDIPTFVVTHSQLGLLGASASLNDPHIRG

SEQ ID NO: 6005 - protein, 1154 aa, Bradyrhizobium sp. BTAi1
MPKRTDISTILIIGAGPIVIGQACEFDYSGTQAVKALKEEGYRVVLVNSNPATIMTDPELADATYIEPITPEIVARIIEKERHVIPGGFALLPTMGGQTALNCALSLRRQGTLEKFDVEMIGATADAIDKAEDRQLFRNAMEKIGLQTPKSRLANASALKKQFRDKYLAEREKLSGPARDELDRQWSLGENERRKRYQEYALGEAMMALSEIGLPAIIRPSFTMGGTGGGIAYNKEEFLDIIERGLDASPTNEVLIEESVLGWKEYEMEVVRDKKDNCIIICSIENLDPMGVHTGDSITVAPALTLTDKEYQIMRDASLAVLREIGVETGGSNVQFGVNPADGRMVVIEMNPRVSRSSALASKATGFPIAKVAAKLAVGYTLDEIANDITGGATPASFEPTIDYVVTKIPRFAFEKFPGASTTLTTSMKSVGEVMAIGRTFQESLQKALRGLETGLTGLDEIEIDGLGRGDDKNAIRAALGTPTPNRILQVAQAMRLGWSDEEIFNSCKIDPWFLAQMRGIVEMEDKVRRHGLPPNANGMRTLKAMGFSDARLAVLANTTEAEVAAKRHALGVRPAFKRIDTCAAEFASPTAYMYSSYETLFAGQLADESAPSDKKKVVILGGGPNRIGQGIEFDYCCCHACFALADAGYETIMVNCNPETVSTDYDTADRLYFEPLTAEDVLEIIATERKNGTLHGVIVQFGGQTPLKLARALEAAEVPILGTSPEAIDLAEDRDRFKRILDKLHLKQPKNGIAYSVEQARLVAADLGLPLVVRPSYVLGGRAMQIIREDNQLSDYLLGTLPELVPADVKARYPNDKTGQINTVLGKNPLLFDRYLSDATEVDVDCLSDGKDTFVVGIMEHIEEAGIHSGDSACSLPPHSLDETTIAELERQTRELALGLDVVGLMNVQYAIKDGTIYVLEVNPRASRTVPFVAKVVGTPVAKIAARIMAGEKLADFGLTKRALKHVGVKESVFPFARFPGVDTVLGPEMRSTGEVMGIDRSFEVAFAKSQLGGGTRVPRKGTVFVSVRESDKARITEVVRMLHELGFKVVATSGTQRYLVDQGVPTEKINKVLEGRPHIVDAITNGDIQLVFNTTEGPQALADSRSLRRAALLHKVPYYTTLSGAVAAAQGIRAYLGGDLEVRTLQSYFSEN

SEQ ID NO: 6006 - protein, 535 aa, Oryza sativa (japonica cultivar-group)
MPAPTASSLAAAADPALPAAFLSLPSPLLPASPPLPAAPAPSSNAFCVPRGPARAVAVSVSVSAYGAGSTAAASRLHRMWAEFSRFVRLHGNQIAPLGFASLGLGVGGGGGGSGEGAGGGGGGGGGEVDGLVEEEGVARAEAPKKVLILMSDTGGGHRASAEAIKAAFIQEFGDDYQVFVTDLWTDHTPWPFNQLPRSYSFLVKHGPLWKMTYYGTAPRVVHQPHFAATSTFIAREVAKGLMKYQPDVIISVHPLMQHVPLRILRSKGLLDKIPFTTVVTDLSTCHPTWFHKLVTRCYCPSAEVSKRALKAGLQPSQIKVYGLPVRPSFVKPIRPEDELRRELGMDEYLPAVLLMGGGEGMGPIEATARALGDALYDEVLGEPTGQILVICGRNKKLTSRLQSINWKVPVQVKGFVTKMEECMGACDCIITKAGPGTIAEAMIRGLPIILNGYIAGQEAGNVPYVVDNGCGKFSKSPEQIAKIVADWFGPRSDELKMMSQNALKLARPDAVFKIVHDLHELVRQKCFVPQYACAS

SEQ ID NO: 6007 - protein, 141 aa, Oryza sativa (japonica cultivar-group)
MGGGKNKVQVCAVFVVALNMVISMQMGAVQACEPYCPTPTPPVTPPPSPPSGGGNKCPIDALKLGVCANVLNLLKLKVGVPASEECCPLLGGLVDLDAAVCLCTAIKANVLGININVPVDLVLLLNYCHKTCPSDFSCPLI

SEQ ID NO: 6008 - protein, 628 aa, Listeria monocytogenes EGD-e
MPEKNIVLIGAGYAGVHAAKKLAKKYKKDKDVNITLIDRHSYHTMMTELHEVAGGRVEPTAIQYDLRRLFNRTKVNLVTDNVTHVDHDKKVVTTEHGSYPFDYLVLGMGGEPNDFGTPGVGENGFTLWSWEDSVKLRNHIEETVTKASREQDVEKRKAMLTFVVCGSGFTGIEMVGELLEWKDRLAKDNKIDASEIKLVVVEAAPTILNMLERRDADKAERYMVKKGIEIMKNAAIVEVKPESIVLKSGEELPTSTLIWTAGVRANSDTKDYGMESARAGRLKVNQYMEAEGLKDVYVVGDLAYFEDEEGKPTPQIVEGAEQTALTAAKSIIVEMSGTGEKEPFQGKYHGVMVSIGAKYGVAHLGGMHLSGWFAILMKHMVNLYYFFGIRSGYYMWQYIMHEFFHIKDHRNIFRGWTSRYGNVLWVLPLRVYLGWFWIDEALSKIYGETTWDKVSITNLKPLFNGIGSDSWLTATTSKMPFEWLQTAATSGASQAAGDAAGAAATNVTTPILSHMPGWFQWIMELLMPNLDVALVMQKVVPFVELAIGLAMVVGLFTWLVSIGSAGFLVMFTLSAMLGWDKFWALPASIALLNGAGRTFGLDYWAVPWFQKHLGHWWYGKPRSVYRDK

SEQ ID NO: 6009 - protein, 419 aa, Oryza sativa (japonica cultivar-group)
MRRKKTGRRTILIVLTAAAAGLLLPCIYVLIWHGKGKQLRYFLYTKTSSTSERNIEALIISYGSIAPTRYKYSEVTKITSFLNYKLGEGGYGVVFKGRLQDGRLVAVKFLHDSKGNGEEFVNEVMSIGRTSHINIVSLFGFCLEGSKRALLYEYMPNGSLDDYIYSENPKEILGWEKLYGIAIGIARGLEYLHHSCNTRIIHFDIKPQNILLDQDFCPKIADFGLAKLCRTKESKLSMTGARGTIGFIAPEVIYRSFGIVSTKSDVYSYGMMLLEMVGGRKNAKSMVENSSEKYFPDWIYDHFALDDGLQACEVTSEVEQIAKKMTLIGLWCVQVLPMHRPTITQVLDMFERSLDELEMPPKQNFSELLEHPAQEINTESTSSTINTKAAQALSEVLRVEETSLVNSKDPTVTTNYAKR

SEQ ID NO: 6010 - protein, 306 aa, Bradyrhizobium sp. BTAi1
MTTTRTQLQGLWLPLITPFHNGALDEASLRNLIRHYAAKPIDGVVLGATSGEGLTLSWDERMCVVSVVHDEVAAAGRPLPLCLGIGGVATSDLIEALDRTTSWPIDFYLISSPPYVRPSQRGLLAHFTALADHAAHPIILYNIPYRSAVGIDNDTMLRLAEHPMIAGLKDCCANRAQTRDLIARRPAQFRILTGEDAQSFDALQAGADGAILLSAHLETETFAAILRHVKDGRHDHAAAGWAQVEDLTRLLFTEPSPAPAKYWLARTGVIASAEVRLPMVEVSPELAARLDQEIQHRTAMAQSRVA

SEQ ID NO: 6011 - protein, 326 aa, Listeria monocytogenes EGD-e
MQLHAMWDEYPALSKDLQEVLQTIEKNIQIRDKHVEQNVKDLIHAGGKLLRPAFALLSAQAGPDYDKDRAVSIAAALEVLHMATLIHDDVVDDSPLRRGIPTIHSKYGRNYAVYTGDYLFCICFKILSAHASSVENIEFNSKNIEKILMGELDQMRTSYKMNVTVREYLTRISGKTAQLFALSCYSGATGSKATRMTVAKCYNIGHYLGMAFQIIDDVLDYTSTDEGLGKPVLNDMKQGIYSLPLIYAMKGHLAEFEPLLSQKLDMTDEASEQVLALISKYKGVEQAFKLAKKYTNKALREIKKLPAGAYREDMYRLTKNILDRDI

SEQ ID NO: 6012 - protein, 472 aa, Haemophilus influenzae R2866
MPNANAIANVFKLIEENNVKFVLLRFTDIKGKEHGVSIPVSLVDEEMFEDGKMFDGSSVEGWKTINKADMLLMPMAETAVVDPFAQIPTLSIRCSVYEPTTMQSYDRDPRSIAIRAENYMRSTGIADQAFFGPEPEFFLFDDVRFNVSMNKASFSIDDIEAAWNTNKKYEEGNNAYRPLKKGGYCAVAPIDSAHDIRSEMCLILEEMGLVIEAHHHEVATAGQNEIATKFNTLTLKADETQIYKHVVQNVALEHGKTACFMPKPITGDNGSGMHCNMSLSKDGKNIFQGDKYAGLSETALYYIGGIIKHAKALNAFTNPSTNSYKRLVPGYEAPVLLAYSASNRSASIRIPAVTNPKAIRVEARFPDPLANPYLAFAALLMAGLDGVVNKIHPGDAMDKNLYDLPPEELKDIPAVASSLEEALNSLEKDYEFLTQGGVFAKDFIDAFISIKRKEVERLNMAPHPVEFEMYYA

SEQ ID NO: 6013 - protein, 95 aa, Zea mays
  misc_feature (3)..(3): Xaa can be any naturally occurring amino acid
  misc_feature (8)..(8): Xaa can be any naturally occurring amino acid
  misc_feature (10)..(10): Xaa can be any naturally occurring amino acid
  misc_feature (14)..(14): Xaa can be any naturally occurring amino acid
  misc_feature (37)..(37): Xaa can be any naturally occurring amino acid
  misc_feature (39)..(39): Xaa can be any naturally occurring amino acid
  misc_feature (45)..(45): Xaa can be any naturally occurring amino acid
  misc_feature (52)..(52): Xaa can be any naturally occurring amino acid
  misc_feature (57)..(57): Xaa can be any naturally occurring amino acid
  misc_feature (63)..(63): Xaa can be any naturally occurring amino acid
  misc_feature (66)..(66): Xaa can be any naturally occurring amino acid
  misc_feature (68)..(68): Xaa can be any naturally occurring amino acid
  misc_feature (72)..(72): Xaa can be any naturally occurring amino acid
  misc_feature (84)..(85): Xaa can be any naturally occurring amino acid
  misc_feature (91)..(91): Xaa can be any naturally occurring amino acid
  misc_feature (93)..(94): Xaa can be any naturally occurring amino acid
FFXNGCLXKXCNIXHSLIGVCSRLSSGCKLKDSVMMXAXIYKTKXEASKLLXAGKVXVGIGRXTKXRXCFIXMIARFGKTVVFXXRKGIHXAXXP

SEQ ID NO: 6014 - protein, 463 aa, Listeria monocytogenes str. 4b H7858
MTKVNSFFRKKSFHNPATDKHHLNKTLGAFDLTMLGVGAVVGGGIFILPGQVASVIAGPGIIISFIIAGIACCLAALCYSEFASKLPVAGSAYTYSYHVFGEGVAWILGWSLILEYGLAVAAIASGWSSYMKSLLAGFDLHIPTVISSAYDPSAGTYFDLLAFVVVMVIGILLSFGIRESTRVNNIMVLVKIAVVVLFILVGAFYVKPDNWTPFLPFGVQGVITGASTVFFAYIGFDAVSSAAEEVKNPQKNMPIGIISSLAICTLLYILLSAVLTGVVPYTDLVDVSAPVAFALQAINQNWIAGLLSVGAIVGMTTVVLVMSYGGTRLLFAMGRDGLLPKSFSKISKNDTPVRNTMIFATVMGLIASTVPMADLAQLINIGTLFAFAMVSIGIFFLRRNPDLNQKGFRTPFYPVVPALSFLLCVYLMINLSKTTWIAFGIWFVIGILVYTFYGRKHSALRVK

SEQ ID NO: 6015 - protein, 465 aa, Yersinia pestis CO92
MSDQQEGAELKRGLKNRHIQLIALGGAIGTGLFLGIAQTIKMAGPSVLLGYAIGGFIAFLIMRQLGEMVVEEPVAGSFSHFAYKYWGHFAGFASGWNYWVLYVLVAMAELTAVGIYVQYWWPEIPTWVSAAVFFLAINAINLANVKVYGEMEFWFAIIKVIAIIAMILFGGYLLISGRGGPEATVTNLWAQGGFFPNGIMGLVMAMAVIMFSFGGLELVGITAAEAEDPAKSIPKATNQVIYRILLFYIGSLAILLSLYPWGKVVEGGSPFVLIFDALDSNSVATVLNIVVLTAALSVYNSCVYCNSRMLFGLAKQGNGPKILLKVDGRGVPVIAIAVSAFATAFCVLINYLLPGRAFELLMALVVSALVINWAMISLAHLKFRAAKNRQGVIPKFKAFWYPFGNCLCLLFLTGILVIMFLTPSIRISVILIPVWVVVLAIGYILKNQSQRQNQQLSASSRKVTK

SEQ ID NO: 6016 - protein, 540 aa, marine gamma proteobacterium HTCC2080
MSSIMNIDPELQSLANQIATRRVTECFEGDANRASDFRCTSNGLVLDYSKHHIDAPSRQRLLEIAQQSALAADFEALTRGDAINITEERAALHTLLRGTRKEESPELYAEVHATNSKLAQLVAKIHSGAWSGFGANRFTDVVNIGIGGSDFGPKVVCRALRTETDLMKSHFVANVDPQDLDETLASLDPQSTLFIICSKSFTTEETLTNALRARAWLLAAGAKDTDVNKHMVAVTTNLEGASRFGISPENCFPMWDWVGGRYSLWSAVGLSIALQSGWETFLRLLTGAHEMDIHTLGSHDKNNLPLMMALLEFWNTVYLKTDTHVVLPYAQALEKLPDFLQQLSMESNGKRVDLSGSALTLPSAPVLWGSAGTIGQHSYYQLLHQGNRRFTADIILPLSHKEKDLDAQRKLAANALAQSRALLVGRDKSAAQQLAAERGQPESFAPHYEMPGNHSHSLIYFESLTPEILGALIAAYEHKTFFLSRLLGINAFDQWGVELGKVIGRQILTMLEHGEGLEVIDPATAIAVEAWRSANARSTS

SEQ ID NO: 6017 - protein, 338 aa, Oryza sativa (japonica cultivar-group)
MAAPSKPQHGAIGPVPFKDVIGDAMAQRSSPEEEYAGVVSSLPSYPKLRLRHYQGMWLMEYTLPGIMAIQRSFVPRRHGDVVLASPGKCGTTWLKALAFAVLARGAYSPASDRHPLLRLNPHDCVPFMEGAISEGWGGKIDELPSPRLMSTHMQHAALPKSIADEPGCKVVYICREPKDILVSAWHFFRIIEPDLSFQEVFEAACDGKFLTGAIWDHIIGYWNACKANPEKVLFLVYEDLLRDPANIVRKLADFLGQPFSSTEEEAGLVTDIVRLCSFENLKSLEVNKMGEASFAFPNASYFRKGKAGDWKIHMTPEMVECFDTIVKEKMHGSGLVFA

SEQ ID NO: 6018 - protein, 90 aa, Glycine max
PTLGDGALWLGSDNATWGLITYAVSYVKFVESGGARVIPLIYNESPENLNMNLDLVNGLLFTGGWAASGPYLDTLENIFKKALEINDAGD

SEQ ID NO: 6019 - protein, 1439 aa, Kineococcus radiotolerans SRS30216
MVHPAAGAGGGDRADGEVRAGRAGAVVGDGHRGVPSGPGVDCASATKLGRPRYSRSRAPLHLRDVVLTGPARRCEESAPRSQHGGNHRATASALTPSVTAPETPARVRSACSYCGVGCGVLLDVVTDPETGRRRVAGVTGDRQHPANAGRLCTKGATSADFMAAPGRLQQAAVRETRGGEPRPAPVRDAVGTVAQRFAEVVAEHGPDAVAVYVSGQMSVEAQYLANKLTKGFLRTNQIESNSRLCMASAGTGYKQSLGSDGPPGSYEDFDHADVFLVIGSNTADCHPILFLRMMDRVRAGAKLIVVDPRRTATAEAADLFLQVRPGTDLALLNGLLHLLVEAGAVDEEFIATATTGWEGMAGVVADHPPARVSELTGVAEADLRAAADLIAGAGEWMSCWTMGLNQSVHGTWNTNALVNLHLATGAICRRGSGPFSLTGQPNAMGGREMGYMGPGLPGQRSVLDPRDRDFTESVWGLEPGTLRTDVGTGTIDLFSRMAAGEVKACWIICTNPVASVANRSTVVEALRRCEFVVVQDAFAETETTAFADVLLPAALWAESDQVSVNSERTMTLLPQAADPVGDARPDWQLIADVARALGFGDHFAYGCAADVFEEIRRFSNPRTGYDLRGVDHERLRSGPVQWPAPPGDGVDRHPVRYLNDGVSQDLLVREDGTVPPLAFPTPSGRAVFWPRPFVPAAELPDDEHPFVLNTGRVQHQWHTRTKTGKVAKLEKLNPGPFLEVNPEDAARLGVAEGDRVEVVSRRGRVVLPAVVTDRVLPGCCFAPFHWNDAFGEDLAVNAVTHDAVDPESFQPEFKVCAVQLTRVEAAVPAAPALPATVGRGGPPVLDERQTRYLDGFLHALGEAPGFVPVLPASAPFADGDRAWVEGFLAGTFASPAPAVSAGSVGSAEPAPAPDVLVLWASQTGGAEEHARSAAAALEAAGVRVGVFGMDEVTPERLGAATTTLLVSSTFGDGGPPDNGESFWDALSGPAAPRLEGRGFAVLALGDSSYADFCGHGRRLDERLAELGAQRLLDRVECEPGEDQRAAEWSARVLDLLARRSPTPTAPAASTAPSPSTALVPAPRLAPTRPTRKDPYRSRLVRNVRLNAAGSTKEVRQIGLARDGGLEHHAGDSLGVWPENDPAVVEAFAAATGVDPAALTALDLTRPAPDLLRFVAQRSREEGLARVLAEGPARTAEWARERQTLDVLRQFPAHAEPAEWLNLLKPLQPRQYSISSAPEAHPGEVQLTVSTVRFGDPLRQGVCSTFLADRAAGKEVRVFVQPAPAFRPPADPDVPVVMIGPGTGVAPFRAFLQHRRAHGAGGPNWLFFGERSSATDWYYREEFEGWRDEGFLTRLSLAFSRDQPEKVYVQDRVLAHGAQLWRWIADGAHVYVCGDASRMAKDVDAALRRVVAEHGGMSEEDAALHVREMVAAKRYVRDVY

SEQ ID NO: 6020 - protein, 219 aa, Nitrosomonas europaea ATCC 19718
MTQDEQKRAVAQAALQYVPTGEIIGIGTGSTANLFIDELAKIKHRIEGAVASSEVTANRLKQHGIEVLDLNSVGELPVYIDGADEITRNMHMIKGGGGALTREKIVAAVARKFICIADQSKLVKVLGKFPLPVEVIPMARSYVAREITLLGGQPAWRQGFTTDNGNIILDVHNLNIMNPVELETALNQIAGVVTNGLFARRAANVLLMGTDQGVETITV

SEQ ID NO: 6021 - protein, 266 aa, Gossypioides kirkii
LSVEEIEVAPPQKNEVRVKIHFTSLCHTDVYFWEAKGQNPLFPRILGHEAGGVVESVGEGVKDVQLGDHVLPIFTGECNECPHCLSEASNMCDLLRINTERGGMLHDGKTRFSKDGKPIYHFLGTSTFSEYTVVHVGQVAKINPEAPLDKVCVLSCGMSTGFGATVNVAKPKKGGSVAVFGLGAVGLAAAEGARVCEASRIIGIDLNPNRFEEAKKFGCTEFVNPKDHDKPVQEVIAEMTGGGVDCSIECTGSIQAMISAFECVHD

SEQ ID NO: 6022 - protein, 451 aa, Mycobacterium sp. JLS
MSATYAVVGGGISGLVAAYRLRVTAGPDATITLFDPADRLGGVLRTERVGGQLLDVGAEAFVARRPEVPALLAELGLADRQIGTTGARPLIYSQGRLHPMPQGTLQGIPSGAATLAGLVDDATIARIADEPTRPLRWRPGADPTVADLVVDRFGEQVVSRSVDPLLGGVYAGSAATIGLRAAAPTLAAALDRGARNLTDAVGEALPPPAPGSVFGAVDGGYAVLLDALRHRARIHWAQVGVERLDLVGRGVEIVDDEGNRWPADAVVLAVPAPRLPRLVDHIAPRTAAAARRIPVASAAVVALALPGGTPLPQQSGVLVATGERLRAKAITLSSRKWGRRGNVELLRLSYGRFGDDLARSTGDEDLLAWAAADLGTVFGIDTEPVDALVQRWIDAMPQYGPGHADLVAELRAGLPRGVAVAGGYLDGIGVPACVASASRAVASLATSGVAR

SEQ ID NO: 6023 - protein, 186 aa, Glycine max
  misc_feature (7)..(7): Xaa can be any naturally occurring amino acid
  misc_feature (108)..(108): Xaa can be any naturally occurring amino acid
  misc_feature (110)..(110): Xaa can be any naturally occurring amino acid
  misc_feature (112)..(113): Xaa can be any naturally occurring amino acid
  misc_feature (116)..(117): Xaa can be any naturally occurring amino acid
  misc_feature (124)..(124): Xaa can be any naturally occurring amino acid
  misc_feature (129)..(132): Xaa can be any naturally occurring amino acid
  misc_feature (134)..(136): Xaa can be any naturally occurring amino acid
  misc_feature (139)..(139): Xaa can be any naturally occurring amino acid
  misc_feature (142)..(142): Xaa can be any naturally occurring amino acid
  misc_feature (144)..(144): Xaa can be any naturally occurring amino acid
PPPPPSXSPILFNEVFKSIGLNGVYLFLLVDDLANFLRTYSSTDFVGFSGTIPHKETALKCCDEVDPVAKSIGAVNCIVRRPTDGKLIGYNTDYVGAITAIENGLRGXHXWXXHIXXSITGKLXCRIGXXXXGXXXTYXAKXNXAVDYMTRELGPFRGSLFGPCPCYNCAPTPIPLSSYSLNNSLP

SEQ ID NO: 6024 - protein, 475 aa, Oryza sativa (japonica cultivar-group)
MRRERDATQIPENPMEGIPQTAAAAAAAAAAEASEPPRKRARVDGGGGGAGEEEEDRLSDLPDCLLEDILAHLGSRQAVQTSVLSRRWRNLWRGVRVVVIDVGSFRLPGADGDPPRFRLDRIEDFADGVLSPSLHPGAARELDALRMRLDEDAVTTNFQRWIRRALWRRPATVDLYYLPRRSFSWPPAVPLTPVTAVSRLKTLRIFGLRPTVVFGADEFPALEDLHIERCSYAHGTIASPTLKRLALVSPINGCFVREQRLTAPGLTSLRLVLPYSREEGVRVITDAPLTSLVDASITIVDTDPGDPRNRRVNQFKVDFLVAISNLLGRLTSVRNLDLTGLNATALLDNKSQEFPMFPYLTTLLLNECDIGYKYHVLRSILQNAPNLEQLRLHNCKFVGKSRRKAGQTQSKEKTSKCSSSTLSSACSSLKSVEIKHPRGEPSHDLLHEFLKEIPHNQWRKRSIDEETISIELNRK

SEQ ID NO: 6025 - protein, 323 aa, Triticum aestivum
  misc_feature (105)..(105): Xaa can be any naturally occurring amino acid
PPPVLGFKHIPAPSLLKEGPPSPSKKHRGGRAGFVPFFRFPRPGDQVPGHPRGPEKIGPFVDSPALFTKPLKALSPGGQRFPFNTAFSAHPEVPPRIRDTFFRRXHGNRHFPSASSPGESHPHLILDDLLKGLAAPSVTDIKIGACTWPPRAPEPYVTKCLAKDRGSTSVLLGFRVSGVMVSDASGAVWRPDRSELKGTDIPGVRRMLRRYVSSAGGDGGGEDCALAAAVYGGEGGVLAQLRELKAWFEVQTLFHFYSASVLLSYDANAVTAPGGAPRVKLVDFAHVVESEGVIDHNFLGGLCSLIKFIDDIVSSDKAPPVQV

SEQ ID NO: 6026 - protein, 870 aa, Kineococcus radiotolerans SRS30216
MTETTATATVPAQRRPQRRLVVVGNGMAGIRAVEELLERGGSDQFAITVFGDEPYGNYNRIMLSHVLSGEETEEGIFLNTLPWYAENGIDLRAGVRVDRIDRFAKVVHDADGGQTLYDVLLLATGSTPFFPTMEGLHRPDGTVLDGVFGFRTLDDARSLLTAARTHRRAVVIGGGLLGLEAAHGLATHGLEVHLVHSPQHLMNQQLGPEAGRVLRRKIEELGIRVHTGVRTRGLRGTDRVTGVELPDGTVLDADFVVVAAGIRPNTDVALRSGLEVQRGVVVDDRMQCSAGEEGEEGTADGIYAVGECVQHRGQTYGLVAPLWDQAGVLADHLTGSRPDAAYHGSRTSTKLKVAGVDVVAMGLAGPERDDDEFVVFSEPHRGVYLNVVIRDGRLVGATLLGDVRKTAFLTQAFDQGLPLPEERMSLLFDLGSPDEATSVAELADDVQVCNCNGVTKGKIVDAVAGGCTSVNAVMGKTKAGKGCGSCKTLVEQVTEWAAGGNLTVDESANWYVPAIPLAKPELMAAIRERRLKSVSAVFRELAPGGVEDAKSKMGLTSLLRMMWPEGLDQDERDGRFINDRVHANIQRDGTFSVVPQMKGGVTTAEQLRKIADVADKYDVGMIKVTGGQRVDLLGIRKEDLPKVWADLGMPSGYAYGKSFRTVKTCVGTDFCRFGLGDSTQLGIDLETRFQGVETPAKLKLGVVGCPRNCAEAYVKDIGVVAIGAGKWEVYVGGAAGASVRKGDLLATVDSPEEVITLTGRFIQFYREWGNWLERTYEFVPRLGLDRVKKVLLEDSDGLVAGLDERMQATVDNYRDPWLEGREPVTEGQFRPALPLVDLPLVPGRPAGAPGGTTVALPLPTARPDSLRVPR

SEQ ID NO: 6027 - protein, 141 aa, Triticum aestivum
  misc_feature (73)..(73): Xaa can be any naturally occurring amino acid
  misc_feature (84)..(84): Xaa can be any naturally occurring amino acid
  misc_feature (88)..(88): Xaa can be any naturally occurring amino acid
  misc_feature (91)..(91): Xaa can be any naturally occurring amino acid
  misc_feature (94)..(94): Xaa can be any naturally occurring amino acid
  misc_feature (96)..(96): Xaa can be any naturally occurring amino acid
  misc_feature (106)..(106): Xaa can be any naturally occurring amino acid
  misc_feature (111)..(111): Xaa can be any naturally occurring amino acid
  misc_feature (126)..(126): Xaa can be any naturally occurring amino acid
  misc_feature (133)..(133): Xaa can be any naturally occurring amino acid
  misc_feature (139)..(139): Xaa can be any naturally occurring amino acid
MAKKRKRTDAPAEAAGAEKPDDSAPARPERTLFGFKDLVPDAEPASAGAEAAVAPFRNREKVLITCSRRITYXYRHLMQDFCRXSPHXKKXSKXEXKQTKGNALNXSFNSXSCSNCFSSNARKKRXYLWMGNXLGGPSXNF

SEQ ID NO: 6028 - protein, 217 aa, Arabidopsis thaliana
MTMYDLTDSGKDMCSSLCLLAEVAVMVAEEEQFRRLLKTVSKEEDSDKSFFYRFPRKIRSSLVKRRYTQQNPNGASTSSAVMRYMNADAETPRLIFERTLFNSDVKSGLSRLLIPFQQLIRNDFLTPAECRAIQKDEDNEDDKNIGVGTILVNQRSKMWGLRFKIWAMEKDSGHGTLNYILNWGWNDVVKGNGLKAGDNISLWTFRCRGVLCFPLET

SEQ ID NO: 6029 - protein, 377 aa, Oryza sativa (japonica cultivar-group)
MDGDSCYVNSLVVKINSPEWDDGTMMGASPPEEQHSTVEEVVVVRRNQKRTKNFSGKEDEGLVSAWLNVSKDVVQGIEQSRCAYWKRIYDYFHANKDFTSDRSQNSLMHRWSTIQENVTKFEGCLSRIGDRKQSWVSSQDKIMHACALYKAEDENHRPFHMMHCWNLLRNQQKWIDRSSQLPSHKKQKITNNSSLGMSTTTTDDTAAAPPPPPGFELSKTPESINAPPRCELSERPESRNAPPRCELSERPENRKGEKEKLRRGGDVVFVEDLDDLLAKKKEADVEKELKKDERYIQSHALEQEKVALEQAKVANETKNLEMRSKELELKTKEIDLKRMLEEERIMTMDISAMSGLQQQYYKSLQEEIVTRRFNSSG

SEQ ID NO: 6030 - protein, 1131 aa, Ustilago maydis
MNASPHSKPSAALAPSPTAAFFPSTSRVYTSKAATVVDDDEALDEIRRYESFSTVDWVVDNTRERNRLARERQAASAHFVSSSSNAHLGNADAAWGHIGFGRGGVPPRWWSRGPWGRRAWLVWGIVKSASSAFTDSGVIVLVGILIGLNMGVISLATEWASDLKQGYCSSGWWLNQKFCCWEMMDQAGPGGAPLPAAAKALATATVTVTASIGAAAAATDSAPILPATPAATPTAAIRAVAQEAYNLTIRAIPDHQLWSRSAQDVIQDGFGTGLRLLSRAEGAASGAGDLSETCTDWVRWSKWSFPAWIIYMLFAGLLSFICAHLVKSFAPYAAGSGISEIKCILAGFVINGYLGFWTLAIKSLTLPLAIASGLSVGKEGPAVHVACCIGNVVASFFRSFNRSQAKMRELLTASSAAGVAVAFGSPIGGVLFSLEEMAYNFPASTMWRSFLCALAATVTLSFMNPFRTGKLVLFQVSYDRDWHYFEIMFYILIGIFGGLYGAFVIKYNLQVQSFRRSYLVKHGVSEVVVLATLTAFVGYANKFLRIDMTESLEILFRECEGGGDYDNLCQSWAQWRMVNSLLLATVLRTALVIVSYGCKVPAGIFVPSMAIGATFGRMVGILVKALYNAFPHWSLFSACQPDVPCITPGTYAFLGAAAALAGVTRITVAVVVIMFELTGALTYILPTMIVVGITKGVADWFSRGGIAEQMIKFSGYPFLDKDDHNFGIPVADVMRVCPQVLFASGMKLSELEGKLADGSYKGFPLVLAKHDATLLGYVGKVELRYAIGKARRARALDGDTLCLFSVGPNALDRADGVESSAHGAQQQQPDLLSVASLPTTAAADRAVREDMLSRFSGATGAGSASGLGSTSATGVASQRRHESESLIGQLDVEDDRSSAPSYRSRVDAGDNMSSSSDDDAVVGNAGGGVDGESDLDKLELGGWIDPTPLIVQPGMPLETVMDMFKNLGPRVILVVEYGRLSGLVTVKDVLKRIAMQEKAEAAARTAAAAGLPMSGSANSFTGEGAGAGGGELEALLKEAYEWAQEKWALISPRIERISARRASASRGGAPGSQAGQARYSHLRESTEDRYDDSDAVAEDMPMHSTRQTSATKNTRSEHHQFVLGAQDDDDE

SEQ ID NO: 6031 - protein, 356 aa, Rickettsia sp.
GFMSTASCRSTITYIDGDQGILRHRGYDIKDLAEKSDFLEVAYLLIYGELPNSKQYNDFTKKVAHHALVNERLHYLFQTFCSSSHPMAIMLAAVGSLSAFYPDLLNFFKEADYELTAIRMIAKIPTIAAMSYKYSIGQPFVYPDNSLDFTENFLHMMFATPCEKYKVNPVVKNALNKIFILHADHEQNASTSTVRIAGSSGANPFACVSTGIASLWGPAHGGANEAVINMLKDIGSVENIPKYIAKAKDKNDNFRLMGFGHRVYKNYDPRAAVLKETCKEVLKELGQLDNNPLLQIAIELEAIALKDEYFIERKLYPNVDFYSGIIYKAMGIPPQMFTVLFATARTVGWMAQWKEM

SEQ ID NO: 6032 - protein, 671 aa, Listeria monocytogenes EGD-e
MKKTLDRQAVDTIRSLSIDMIEKANSGHPGMPMGAAPMAYMLFAKHLVFNPANPEWFNRDRFVLSAGHGSALLYSMLHLFGYDVKMEDLKQFRQLDSLTPGHPEFGWTAGVDATSGPLGQGIGMAAGMALAESHLAAEYNQPNYPIVDHYTYAICGDGDLMEGVASETASLAGHLGLGKLIVLYDSNDICLDGDLSATFSENAADRFRAYGWQVLRVEDGNNLAAIQEKIVQAKLETSKPTLIEVKTVIGYGAPTKAGSSASHGAPLGEKEANGAKEHYEWAEEPFTVPAEVRDYLRNYKARGEKLEGAWNTMLANYKKEFPELARQLDRVLAGEVAADWNANLPTFEAGTNVATRSASGKMINAIAAELPELFGGSADLGCSNKTFIDASPAYSIQDPAGKNIWFGVREFAMGAMLNGMALHSGLRVFGSTFFVFSDYVRPAMRMAALMQLPVTYVFTHDSIAVGEDGPTHEPIEQLASLRAMPGLTVIRPADAKETRAAWEIAATNTNGPIALVLSRQDLPVLENDQEEVDAGIEKGAYIVAPANSSKPDAIIIATGSEVSLAIEAKAELAKKDIDVSVVSLSSWERFEKTTDAYKESILPKEVTARFAIEAGATFGWKEFIGSEGDMLGIDHFGASAPAKDLFNAYGFTPENVADRVEAVIAKAGVRV

SEQ ID NO: 6033 - protein, 71 aa, Glycine max
MSRSQDPHPSRSFFPFGNPFRMISPKGSRMSPQLLAVLQAFEATLAERLKNLMPKSKDEILTLSWMTLAMK

SEQ ID NO: 6034 - protein, 445 aa, Ralstonia solanacearum GMI1000
MKPAPHPLETTDLSYFWMPFTANRQYKAAPRLLVSAQGMYYRDADGREVLDGTAGLWCVNAGHCRKAIVDAITAQAAAMDFAPTFQMGHPVAFRAAEKVAEIMPAGLNRIFFVNSGSEAVDTALKIALAYHRARGEGQRTRFIGRERGYHGVGFGGISVGGIAPNRKAFSANLMPGVDHLPHTHAPEHNAFSKGQPAWGAHLADELERIVTLHDPSTIAAVIVEPLAGSTGVLVPPKGYLERLRALCDKHGILLIFDEVITGFGRLGAATASAFFGVTPDLLTMAKGINNAAVPMGAVAVRQSLHDAVIEAGAPGAIELFHGYTYSAHPLAAAAAVAAIDLYRTEGLFERARALSPAFEAAAHSLKGAPHVKDIRNLGLVAGIELEPRPGAVGARAYEVFLKCLERGVLVRYTGDTLAFSPPLIISEAEIARIFDTVRTVLQEVA

SEQ ID NO: 6035 - protein, 138 aa, Triticum aestivum
QGPREDVLEFFESVGFKCPERKGIADFLQEVTSKKDQKQYWAQGDEPYRFVPVKDFVRAFQSFHTGRAIRKELAVPFDKSKSHPAALTTTRYGVSGTELLKANIDREILLMKRNSFVYMFRTFQLILMSFIAMTLFFR

SEQ ID NO: 6036 - protein, 401 aa, Glycine max
MLVKKRWDIYEDETYHNNKPTKIFLTKVCFHSVFCFPNPTLVTTTLPPLSFETSFFLFPNQTSKRYSLIITEIMAPNITTVKTTITDAQAKVATDHGRAYVTFLAGNGDYVKGVVGLAKGLRKVKSMYPLVVAVLPDVPQDHRNILTSQGCIVREIEPVYPPENQTQFAMAYYVINYSKLRIWEFVEYSKMIYLDGDIQVFDNIDHLFDLPDNYFYAVMDCFCEPTWGHTKQYQIGYCQQCPHKVQWPTHFGPKPPLYFNAGMFVYEPNLATYRDLLQTVQVTQPTSFAEQDFLNIYFKDKYRPIPNVYNLVLAMLWRHPENVELDKVKVVHYCAAGSKPWRYTGKEENMEREDIKMLVKKWWDIYEDETLDYNNPLNVDKFTAALMEVGEVKFVRAPSAA

SEQ ID NO: 6037 - protein, 370 aa, Rickettsia typhi str. Wilmington
MSQDYYQVLGVSKTASQADIKKAYLKLAKQYHPDTTNAHDAEKKFKEINAAYDVLKDEQKRAAYDRFGHDAFQNQQARGGGNNSGFHHDINDIFGDFFSDFMGSGRRKQTSSKIRGSDLKYDLTIKLEEAFHGIEKNISFSSEVKCDACHGTGSEKGETVTTCDSCGGVGVTRIQQGFFTLEQTCHKCQGNGQIIKNPCKKCHGMGRYHKQRNLSINIPAGVENGTRIRHSGEGEAGIRGGNNGDLYVDIAIKPHDIYKIDGANLHCKLPISFVHAALGGEIEVPVIEGGKVKLTIPAGTQNGDQLRLRSKGMSKIRSTIRGDMLTHIHVEVPKNLSKRQRELLEEFKKESINEKENDSSFFNKMKSMWS

SEQ ID NO: 6038 - protein, 584 aa, Glycine max
MGKSPGKWIKTVLFGKKSSKSNISKGREKIVNKKAVVASNELENGLSLDPTPNEIATKEEDLELENEESENILPENQERDINGSVDPDAPPDPEKIRQEEAATKAQAAFRGYLARRAFRALKGIIRLQALIRGHLVRRQAVVTLCCMYGIVKLQALVRGGRIRQSNVGFEIHEKCNLFKPLDGKLGEPVGISTKISKLSANTFIRKLVASSITIMALRLQYVSGDPNSVLSWLERWSASYFWKPVPQPKKIRDSKSHRKHGNISNGEAQITKSKRTTRKLPIANFEPALVQTNPEFEKPKRNFRKIPHQVLDPELENPQSELEKVKRSLRKIHNPVVENAVQPEVEIETPKEHLEIATVIPSHAVSEQAIITPDDKIEQEETLTIFNVPDVEISPRPSVNMEVYDIPSNYQVSVESKPLSETPIKDRNTSHGKVKNELGNLPETIFKDENSLLTNGDLSYNDLTGNENQKPTRKASNLTKQENGDDGLKNSPKLPSYMAATESAKAKLRAQGSPRFGQDETEKNNTAGSGRHSLPSSTNKKISSYSPKTQRSVPAGGKGGNKSDRTVPSSKAGNGKVIQAEWRR

SEQ ID NO: 6039 - protein, 198 aa, Zea mays
MATGPRSLHALLGGGAVADLLLWRRRNASAAAVVGATTVWFVFERAGYSFPSVLSNALLLLVAILFFWAKSASLLNRPLPPLPNLEVSDAIVEKAANHALVWINRLLAVGHDIAIKRDRKVFIKVILILWVVSFIGMLFNFLTLIYIGVMLSLLVPPLYEKYQDQVDEKVGVAYSVLSRHIDTIITRAGQSAKQKKTE

SEQ ID NO: 6040 - protein, 476 aa, Stevia rebaudiana
MIQVLTPILLFLIFFVFWKVYKHQKTKINLPPGSFGWPFLGETLALLRAGWDSEPERFVRERIKKHGSPLVFKTSLFGDRFAVLCGPAGNKFLFCNENKLVASWWPVPVRKLFGKSLLTIRGDEAKWMRKMLLSYLGPDAFATHYAVTMDVVTRRHIDVHWRGKEEVNVFQTVKLYAFELACRLFMNLDDPNHIAKLGSLFNIFLKGIIELPIDVPGTRFYSSKKAAAAIRIELKKLIKARKLELKEGKASSSQDLLSHLLTSPDENGMFLTEEEIVDNILLLLFAGHDTSALSITLLMKTLGEHSDVYDKVLKEQLEISKTKEAWESLKWEDIQKMKYSWSVICEVMRLNPPVIGTYREALVDIDYAGYTIPKGWKLHWSAVSTQRDEANFEDVTRFDPSRFEGAGPTPFTFVPFGGGPRMCLGKEFARLEVLAFLHNIVTNFKWDLLIPDEKIEYDPMATPAKGLPIRLHPHQV

SEQ ID NO: 6041 - protein, 162 aa, Nitrosomonas europaea ATCC 19718
MERIKQFFKSFLLVEMLKGMKVTGRYLFAPKITVHYPEEKTPQSPRFRGLHALRRYPNGEERCIACKLCEAVCPAMAITIESEQRDDSTRRTTRYDIDMIKCIFCGFCEEACPVDAIVETRVLEYHGEVRGDLTYTKEMLLAVGDRYEEQIARDRAADAPYR

SEQ ID NO: 6042 - protein, 197 aa, Zea mays
MAVSDSLAHPGLAIVVMGVSGCGKSTVAAMLAEALGCSFIEADDYHSEANKAKMSAGVPLSDADRAPWLESVRDAIRGRLDGGEDVAVSCSALRLGYRDVLRAADRAYEPGRYAACRVRFVCLRAPAEVLAERVLRRSVEGEHFMPASLLRSQLDLLRVDPAEGVAEADATARPDDIVRDTVALFRDELAVSSGVPA

SEQ ID NO: 6043 - protein, 240 aa, Brassica napus
  misc_feature (218)..(218): Xaa can be any naturally occurring amino acid
MASLLGRFCRKLVVPGSAHGSRMTSTTACGSETVKSLNLYSAINQALHIALETDPRSYVFGEDVGFGGVFRCTTGLAERFGKNRVFNTPLCEQGIVGFGIGLAAMGNRAVVEIQFADYIYPAFDQIVNEAAKFRYRSGNQFNCGGLTIRAPYGAVGHGGHYHSQSPEAFFCHVPGIKVVIPRSPREAKGLLLSSIRDPNPVVFFEPKWLYRQAVEEVXEHDYMIPLSQAEIIREGSDITL

SEQ ID NO: 6044 - protein, 518 aa, Photobacterium profundum SS9
MRDKLMSAKKPLALVILDGWGYREDNSDNAIANANTPVMDSLIANEANTLISASGFDVGLPDGQMGNSEVGHTNIGAGRVVYQDLTRITKSIADGDFFENEALTTAMDKAINAGKAVHIMGLMSPGGVHSHEDHIAAAIEMAAKRGAEKIYLHCFLDGRDTPPRSAQNSLERFDALFAELGKGRTASLVGRYYAMDRDNNWDRVEVAYNLLSAAKADFTVDSAVAGLTDAYSRDENDEFVKATEIRAEGQESAAMVDGDTVIFMNYRADRAREITRAFEADFTSFVRTQTPALAEFVMLTRYAANIKLPAAFPPATLKNTLGEWLSKKGKKQLRISETEKYAHVTFFFNGGVEDEFDGETRSLVASPKVATYDLQPEMSAPELTEKLVAAIKGGEFDTIICNYPNGDMVGHTGVYDAAVKACEALDGCIGQVVEAIKSVGGQLLITADHGNAEMMINPETGGVHTAHTNLPVPLIYVGDKSLTLKDGGKLSDLAPTMLSLSDIEIPAEMTGQVLFDLK

SEQ ID NO: 6045 - protein, 575 aa, Schizosaccharomyces pombe 972h-
MSISSKDFQNVTSAGFADDTFAADTFAADKKSPFESSVFENKTQVLPVDSVSRLSNGARSRSNSNISLSEPHALNDTVEDQPVSKWVWVLAFAAGIGGLLFGYDTGVISGALVVIGTSLGGHELTNGGKEFITSATSLGALLGGIIAGALADFFGRKPVIAIASIIIIVGSIVQVTAHHLWHMIVGRFVIGWGVGIASLIIPLYLSEIAPSKIRGRLVIIYVLLITAGQVIAYGIDTAFEHVHNGWRWMVGLAMVPAAFQLFILIWLPESPRLLVKKERSQEAYNTLARIYPTAHPYEIKTKLYLIQEGVRDPFSGSRWQKIVKTFKELYFNPSNFRALILACGLQAMQQLSGFNSLMYFSSTIFEVVGFNNPTATGLIIAATNFVFTIVAFGVIDFFGRRILLLLTVWGMIAALIVCAVAFHFLPKDENGNYTSGQSNAWAIVVLISMIVYVASYASGLGNLPWQQSELFPMSVRGLGTGMSTAVNWAGNLGIGASFLTLMSEITPTGTFALYGGLCFLGWLGALFCYPDLTDYTIEEIGELLKHGFGVRESMRHLKRVRQERAWSREDKEQNN

SEQ ID NO: 6046 - protein, 187 aa, Schizosaccharomyces pombe 972h-
SLGRAERELDRERTKLDQRERALIQEIKGSAKAGNTGAARIQARDLMRLRNSRKKMMNAKTQLQAISLRLQTMRTSEQMMQSMRGATRLLTGMNKSMNIPAMARITQQFERENEIMEQRQEMIDENMDDALEEDDEEEADELVNKVLDEIGVDLSQGLPDAATQIGTVPELKTEDNLQARLDELAKR

SEQ ID NO: 6047 - protein, 746 aa, Pseudomonas fluorescens Pf-5
MTPQDAQAFEQLLANCADEPIRSPGAIQPHGVLLTLSEPELRIQQISANVEALLGQPAAQVLGQPLEQLLGDTDGQRIREVLQLPRLSDAPPLHLAVNGARFEGLLHRHQGVLMLELEIQLEHLQPQHLKEQTENLGRLLRRLQTAKTLNELYAISVSEIQAMTGYDRVLIYRFEEEGHGQVIAEATRPTMEVFNGLFFPASDIPQQARELYRSNWLRIIPNADYQPVPLLPALRPDTQQALDLSFATLRSVSPIHCQYMKNMGVLSSMSISLLKGDQLWGLISCGNRQPLLVPHELRIACQTIGQVLSLQISAMEALDISRQREEKVTALASLDQAMRDTPDSVFDGLAQVPQLLLDLTQAGGVAIIEDKQLHCFGNCPPQDEIRALHRWLQGTGQAVFASHHLANVYPPAASYQQVASGVLAMTLPKPVDNGVLWFRPEVKENINWSGNPQKPLDLENSDAGLRLRPRTSFEIWKVEMAGISTKWSHGDRFAANDLRRSALEHDLARQVLREQQAVRARDELVAVVSHDLRNPMTVISMLCGMMQKAFSSDGPHTSRRISSAIDTMQQAASRMNNLLEDLLDTSKIEAGRYSIAPQPLDVSQMFEEAYSLLAPLALDKAIDISFHAEPDLRINADPERLFQVLSNLVGNAIKFTPKQGKVGVVAMSDGEQIVFSVRDSGEGIPTDQLPFIFDRYWTMKEGNPNGTGLGLYITQGIIHAHGGKIEAHSEVGKGSEFRFSVPRASL

SEQ ID NO: 6048 - protein, 403 aa, Thiomicrospira crunogena XCL-2
MKPKLILVGTGMAGTRFLEHLLEEAPNRYEIEVFNKEPVGGYNRIMLSPVLAGEKTIPDIMTHDEAWFEERRIRLHTGKTVSAIDSVGQVLTTFCGETYFYDKLVIATGSNPFKLEIPGADLPGVVTFRDIRDVENMLSVSQNHNKAVVIGGGLLGLEAAHGLIKRGMDVTVIHRSEVLMNMQMDEESGQLLKSHLEQGSSHALGMKFRLGVNTTEILGQHQVEGVRLDDGSEIATDLVVMSIGIRPNTQLAKQANLDVNRGILVNDFLETSAENIYALGECNEHRGQTYGLVAPLYEQAKILAKRLAGQSVSYTGSITSTMLKVTGVQLFSAGEFKGENGADVIVFRDLAKNIYRKIVLKNNQVIGALLFGDTTGATWLFELLRQKQNISPMRDTLVFGPGY

SEQ ID NO: 6049 - protein, 311 aa, Oryza sativa
  misc_feature (292)..(292): Xaa can be any naturally occurring amino acid
SSHCCWVLALLLHAPNQGFGTANHQAIFALQHPSVRATPNSSFHGSESSTPCRLISAWLSNSVDPTDGNDKKGEYYWKDVADEFNNNRPTNGHKRTVKQLKTHWGNVKKDIGKFCGVYAQVRRTCTSGHSDDMIMEKAHLWYKNQSNQKKPFTLEYMWRELKDQPKWRSIIKKEENKNKRTKISESGAYTSSSNQETEEESSNKERHPEGQKKAKERLKGKGKGKAQSSPLGNQPSQNIVLYNEAMKIKAEALLKSAEATAKSAEAKREQIRMEKWQAYIKLEEKDTSNFSXKLRRHEAMLNKLSKELAEE

SEQ ID NO: 6050 - protein, 846 aa, Thiomicrospira crunogena XCL-2
MKQRIVVIGNGMVGHSFLEKLIASEGFENFEVTVFGEEPRKAYDRVYLSSYFSGKTAEDLSLVKPGLYEENGIQLYLKDKVIDIDRTQKTITSESGQKISYDKLILATGSYPFVPPIKGNDRDNCLVYRTIEDLEAIKAAASNGKTGVVVGGGLLGLEAAKALKDLGLDTHVVEFAPRLMPVQLDEGGAGLLKRKIENMGVHVHVSKATQEITDGENCFNKMVFSDGESLETDIVLFSAGIRPRDDLAKQAELAIGPRGGVEINDQCLTSDPNIYAIGECALHNGVIYGLVAPGYAMAQAVVDQLNLTSASFEGADMSTKLKLMGVDVGSIGDPHGNDESALSYVYENGPEEVYKKIVVSSDGQTLLGAVLVGDAEDFSNLLQIMLNDMTLPEHPDSLILPNRDGGGSDLFGPDALPETAQLCSCYDVSKGDIIQAVEAGCCTVSDVKASTQAGTGCGGCVQLVTNVLNNELEKRGVEVNTDLCEHFSHTRQELFHICQVEEIKTFEDLIQKHGRGHGCDICKQTTGNIFASLWNSYALEPDKIPLQDTNDNYLGNMQKDGTYSVIPRVPGGEITPQKLIVLGQVATKYKLYTKVNGGQRIVLFGAQMNDLPAIWKELIDAGFESGQAYAKALRTVKSCVGSTWCRYGLDDSVTMAIDMENRYKGLRSPHKIKMGVSGCTRECAEAQAKDIGLISTEEGWNLYVCGNGGMKPRHADLFATKLTQEEVFRYVDRLLMFYIKTADRLQRTASWLDNLEGGLTYLQEVVIQDSLGIGESLEDQMKRLRETYECDWKRAIANPSFTKRFRSFVNVDNKAEQLFVQERGQIRPATEQDKLNGIAVQVKEIA

SEQ ID NO: 6051 - protein, 907 aa, Thiomicrospira crunogena XCL-2
MNRPVFLNPEDVETTCPYCGVGCGMTVSSKAPSTESDSFEVKVKGSPSHRANYGKLCVKGSSAGETVDFSGRMLHPQIDGNIVDWETALNDVAKTFQKTISEYGPDSVAFYVSGQFLTEDYYVANKLIKGFMGTANIDTNSRLCMASAVVGYKRAFGSDTVPCCYEDLEHADLITLVGSNTAWAHPIIYQRIAAAKKKNPKLKIVVVDPRKTATCDIADLHLAIKPGMDAALFNGLLAYLNQQNALDLDYIQKHTEGFESALQKANELQGNVSDLATQCDLNETDLRQWLDWATYTPKMVTMYSQGINQSSSGVDKSNAIINCHLATGRIGKEGMGPFSITGQPNAMGGREVGGLANQLAAHMDFSDSENIDRVARFWQAENMAQQNGLKAVDLFHAVGEGKIKAIWIMNTNPVVSMPDADNVKRALEKCDYVVVQDCMQDTDTTRVANVLLPATTWGETDGAVTNSDRTISIQRQFMQGPENARPDWWILSEVAKKMGWAHAFNYDSAVDIFREHAQLSGFENNGSRDFDISAFANISKQEYAHFKPIQWPVNVSAPNGTQRMFSDGCFFTPSKKAQFIAITPYAPLSQQTKDKPYVLNTGRVRDQWHTMTRTAKTAKLMAHKNEPYITLHPDDARIQRLSEGDLVRVSNELGQLIGRVEVSDSQRRGEIFVPIHWTSQYASHGRVDSLIKANVDPLSGQPESKHATVTIERYSAQWQGFILSRTAINPELFDDDYWVKITGKHFYRYEIASERAIKNAHAWAKTILSSSENTEWIEYDDASCKQYRAALIKNDQLQKVFFMAEDHKMPSRDWLGHLFSATELSPIERRSLLAGKASGAKDPGRTICSCFGVGINTIIEAIEAQNLVSVEAIGQALKAGTNCGSCVPELTEILAVELSLDVSEKTG

SEQ ID NO: 6052 - protein, 352 aa, Triticum aestivum
EIVAIALVLVVIVALLVVATIYVFKRRRRTPRQPRRSGTGTGTRREREVKVFDGVDIGASLTYEAIVRATGNFNASNCIGFGGFGATYRAEVAPGVLVAVKRLSIGRQHGNKQFQAEVETLGRRHHPNLVTLMGYHISDQETFLIYNYLPGGNLERFIQERAKRQIGWRVLHKIALDIAHALAFMHDECSPRILHRDVKPSNILLDNDFNAYLSDFGLAKLLRNSQTHTTTSVAGTFGYVAPEYATTCRVSDKADVYSYGVLLLELISDKKVLDPSFSPYGNGFNIISWANKLIQSGRVCEFFVEGLWNKAPHDDLVEIMNLGLLCTVESLSSRPKMKHVVRRLRELRPPSY

SEQ ID NO: 6053 - protein, 425 aa, Gloeobacter violaceus PCC 7421
MLITSIEAHEILDSRGNPTVEAQVALENGTTGSAIVPSGASTGEKEAVELRDSDPKRYGGKGVLSAVANVNDSIAPEIIGMEVTDQRSIDRKMIEIDGTANKATLGANAILAVSMAVARTAALSLGLPLYRYLGGTNASLLPVPCMNVINGGKHADNTVDFQEFMIAPHNAPNFAEALRMGAETFHALKSILRGKGYSTGVGDEGGFAPDLKSNEEAVEVILLAIEKAGYRPGEDISICLDPATSEMWKDGKYLFFKSDQSTKTSEEMVDLWASWAGQYPIVSLEDGMGENDWEGWKMLTDRIGATVELVGDDLFCTNAKILAEGIEKGVANSILIKLNQIGSVSETLDTIELAVKHNYKCFVSHRSGETEDTTIADLTVATAAGQIKTGSGCRSERVAKFNQLLRIERQLGEAARFAGKSAFAR

SEQ ID NO: 6054 - protein, 417 aa, Nitrosomonas europaea ATCC 19718
MAEIRNYTMNFGPQHPAAHGVLRLVMELDGEVIRRADPHIGLLHRATEKLAENKTYVQSVPYMDRLDYVSMMVNEHAYVMAIEKLLQIEVPIRAQYIRVMFDEITRILNHLLWLGAHALDVGAMTVFLYAFREREDLMDCYEAVSGARLHAAYYRPGGVYRDLPDNMPQYQPSAIHDEKATRARNENRQGSLLDFIEDFTRRFPGYIDDYEALLTDNRIWKQRLVDIGVVSPDRAKALGFTGPMLRGSGVEWDLRKKQPYEVYDQVDFDIPVGANGDCYDRYLVRIEEMRQSNHIIKQCVEWLRKNPGPVITDNHKVAPPSRLAMKQNMEEMIHHFKLFTEGMHVPRGEAYAAVEHPKGEFGIYIVSDGANKPYRLKIRAPGFAHLAALDEMTKGHMIADLVAIIGTQDIVFGEIDR

SEQ ID NO: 6055 - protein, 558 aa, Trifolium pratense
MGCHGSKEAKKSAAEHSRHRHQSSAAAGGAATGGTNFQYQIVQPSSSHVQTSPPPKPKPESHSHSHSHASTVTTTTTSNPKPSASENVRTVQKPDTTILGKPFEDIKKFYTLGKELGRGQFGITYFCTENSTGLNYACKSILKRKLVSKADREDIKREIQILQHLSGQPNIVEFKGAYEDRFSVHLVMELCAGGELFDRIIAQGHYSERAAASICRAVVNVVHICHFMGVLHRDLKPENFLLSSKDEGAALKATDFGLSVFIEEGKVYRDMVGSAYYVAPEVLRRNYGKEIDIWSAGIILYILLSGVPPFWAETEKGIFNAILEGELDFVSEPWPSISDSAKDLVRKMLTQDPKKRITSTQVLEHPWMREGGEASDKPIDSAVLSRMKQFRAMNKFKKLALKVMAENLSEEEIKGLKAMFANMDTDGSGTITYEELKSGLARIGSRLSEPEVKQLMEAADVDGNGSIDYLEFISATMHRHRLERDEHLYKAFQYFDKDNSGHITREELETAMTKHGMGDEATIKEIISEVDTDNDGRINYEEFCAMMRSGMPHQAQLF

SEQ ID NO: 6056 - protein, 252 aa, Nitrosomonas europaea ATCC 19718
MGRAGFVAGNWKMHGSLVRNQELLDAVVSGTRSLQNVSCVVCVPYPYIAQTQSVLEGSHVLWGGQNVSQYHHGAYTGEVSADMLADLGCRYVIVGHSERRTLFGEGNQVVAEKFRAAQERSITPILCVGETLAQRESDETEQVIAMQLDAVIDLAGIEALGQSVIAYEPVWAIGTGKTATPQQAQDVHKFIRSRIAVHSGGIAENIQILYGGSVKADNARELFTMPDIDGGLIGGASLVAAEFISICLAAQN

SEQ ID NO: 6057 - protein, 638 aa, Glycine max
MYPDLDTCLHDEMAVTTFKVPPSECCGNKKMERKPSGRRRVFVQTETGCVLGMELDRRDNAHTVKRKLQVAFNVPTEASSLICGDMVLKNDLSVVRNDSPLLLTRTFLHRSSSTPCLSPTGRDLLQRDQSGPIEVIGCSDMFSGTKQLVKDIMKAIKVGIEPIPIQSGLGGAYYFRNSNGENVAIVKPTDEEPYAPNNPKGFVGKALGQPGLKRSVRVGETGFREVAAYLLDHDHFANVPFTALVKVTHSIFNVNDRVNGSMHHNKKQISKIASLQQFIPHDFDASDHGTSSFPVAAVHRIGILDVRILNTDRHAGNLLVRKLEGFGRFDQVELFPIDHGLCLPETLEDPYFEWIYWPQASIPFSDDELDYIYHLDPFRDSEMLRMELPMIREACLRVLVLCTIFLKEAAAFGLCLAEIGDMMSREFQGLHEEPSELELICIEAKKLLDQEELFSYEAEVGDKDVTQFQLDCEDQDLDFTTNIEEKLTVMPPFQVGARNGNIRNTLSRLEESMMEDEAESEGELPVGGGEYNGPVLNGVPNVSKLSVSLQNTRTSEKSWQQMGVKQKSDFLAGTSSGNTTVNELPASSSFVKLTDMDEERWNQFLENFQRLLIPDFVNYKRGNVSKKQRQRLGTSCQF

SEQ ID NO: 6058 - protein, 878 aa, Clostridium perfringens ATCC 13124
MNYLEVKKDIYWVGSLDPELRVFDIIMYTPYGTTYNSYVVKGSEKIAVFETVKEKCFDDYLSKLNSLGIDPKSIDYIVVDHTEPDHAGSVEKLLELSPKAKVIGSMQAIEFLKDIVNKDFEYIVVGDNDTISLGNKTLQFISAPFLHWPDSMYTYIPEDKALITCDSFGSHYSCEEIFNDLVPNEEEYLDALRYYYDCIFGPYKPYVLKAIDKIKDLDIELVCPGHGPILRQDPWKIINTYKEWSTPVKPKINGDKKVTIPYVSAYGYTKELAEEIAKGIQSEHNVEVKLYDLTYSKQEDVLADIGESDGILFGSPTIVGELLPPIRILLANLNPIIHGGKYAAAFGSFGWSGEAVPRIEARLKELKMNIFGPGLRIKFKPSTTELKEAFEFGRDFSRTMFGEKELDYAPNNATETKEVLTGNGKTRYWKCLVCGEIFESPVCPEVCPVCGAGKEQFIEVEMDTFEKNDTDDNFVIIGNGAAGFYAAKTIREINSTASVKLLSSEEVSSYSRPNLSDLLNEEMNLDTFYLAKSSWYKENNIEELLGVTVTSIDKDAKKVILKDGTEIPYTKLILANGSHNFIPPFKVKNNNEEVTLNCENIHEFKGIYSIKDLKDTFDVKEEMKEAKKAVVIGAGPLGLEAAWEMKLAGLDVTVVEFLPNLMNNQLDQEGADIFRNQVSDCGITFITSEECAEIIAKDGKLTSLNLKSGKTLDADILLVSTGIRSNIELAKETGIECNRGVIVNERMETSIKDIYACGDVAEFNGLVYGNWPAAIEMGKTAGANACEAEKAFENFTPSIILDALNTHVFSAGLIRFNDSSYEKISSKDESKGQYTKLFFKDNILVGGIIVGDISKAGQIIIAIDNKLSKAAALSNDLL

SEQ ID NO: 6059 - protein, 320 aa, Photobacterium profundum SS9
MIKKIGVLTSGGDAPGMNAAVRGVVRAALSDGLEVYGIYDGYQGLHQNRIEKLSRTSVSDVINRGGTFLGSARFPEFKDEKVRAQAIQNLKMHGIEALVVIGGDGSYMGAKKLTEMGFPCIGIPGTIDNDVAGTDYTIGYFTALNTVIDAIDRLRDTSSSHQRISIVEVMGRHCGDLTLMSAIAGGCEYIITPETGLHKEELIAKIKEGIYKGKKHAIVALTELMTDANELAKYIEDETGRETRATVLGHIQRGGQPTAFDRILASRMGAYAVELLIQGEGGRCVGVQNEKMVHHDIIDAIENMKRPVRKDLYELADKLF

SEQ ID NO: 6060 - protein, 262 aa, Photobacterium profundum SS9
MIWRKTMRHPVVMGNWKLNGSKEMVVNLLNGLNAELEGVTGVDVAVAPPALFIDLAEHTLTEAGSAIILGAQNSDLNNSGAFTGDMSPAMLKEFGASHIIIGHSERREYHNESDEFVAKKFAFLKENGLTPVLCIGESDAQNEAGETMAVCARQLDAVINTQGVEALEGAIIAYEPIWAIGTGKAATAEDAQRIHAQIRAHIAEKSEEVAKNLVIQYGGSVKPENAAAYFAQPDIDGALVGGAALDAKSFAAIAKAAAEAKA

SEQ ID NO: 6061 - protein, 347 aa, Sulfolobus tokodaii str. 7
MRAMRLVEIGKPLKLEDIPIPKPKGSQVLIKIEAAGVCHSDVHMRQGRFGNLRIVEDLGVKLPVTLGHEIAGRIEEVGDEVVGYSKGDLVAVNPWEGEGNCYYCRIGEEHLCDSPRWLGINYDGAYAEYVLVPHYKYLYKLRRLSAVEAAPLTCSGVTTYRAVRKASLDPSKTLVVIGAGGGLGTMAIQIAKAVSGATIIGVDVREEALEAAKRAGADYVINASSQDPVSEIRRITQGKGADAVIDLNNSEKTLSIYPYVLAKQGKYVMVGLFGADLKYHAPLITLNEVQFIGSLVGNQSDFLGIMSLAEAGKVKPMVTKTMKLEEANEAIDNLENFKAVGRQVLVP

SEQ ID NO: 6062 - protein, 135 aa, Debaryomyces hansenii
MLLKSLFLLFLTAIAFASELQIGILTSVPDDKCKVKSKPGDLISVHYEGKLEDGTVFDSSYSRGQPISFQLGIGQVIQGWDQGLTRMCIGEKRKLTIPSHLAYGDRGVGPIPAKATLVFVAELVDIAGSSKHDEL

SEQ ID NO: 6063 - protein, 249 aa, Nitrosomonas europaea ATCC 19718
MKKLVLLRHGESIWNQENRFTGWTDVDLTPKGLKEAEEAGRLLRENGFSFDIAYTSLLKRAIRTLWIALDEMDQMWTPIELNWRLNERHYGALQGLNKAETAKQYGDEQVLVWRRSYDIRPPSITINDERYPGFDLRYRNMSSGDIPLAESLKDTVARFLPYWNQSIAPQIKAEKKVIIAAHGNSLRALIKHLDNISDQDILNCNIPTGIPLVYELDDDLKPLNSYYLGDAGQIGEAISAVANQGKSGA

SEQ ID NO: 6064 - protein, 195 aa, Gibberella zeae
MKAALFLSALASTAVGVVAEELKIDVTLPVICERKTQKGDGVHMHYRGTLKDSGKQFDASYDRGTPLSFKVGAGQVIKGWDEGLLDMCIGEKRVLTIPPEFGYGQRAIGPIPAGSTLVFETELVGIDGVPKPEKIETKVVEGAESAAEAISEATEAAATASQKVAGKVAEAIVDAAKAAKTIIADTDDAPEHEEL

SEQ ID NO: 6065 - protein, 264 aa, Zea mays
MAMEPNMARRLWRVVRAVLFMLRKGMPKRKLAMDLHLLIHRGKIAGKALGNLMTAHGHNSDKAAAAEAAPPPQHFSCGRRGHDPSLAVYDPRGTREVEFSCSNTPSYPSLHLVPTGKRRRRNNNNNNSSRRRGTHRGANGAEPGWYNYDASDIARAFEILNNNEQLLSGGDGNSSDQPSPLALVATPSPALWASFGRTPAHARQLRITDSPFPLGDDDGDCGQVDLDAEDFIKKFYDQLRTQQALATATPDYCGGYARPVSGIA

SEQ ID NO: 6066 - protein, 77 aa, Zea mays
GASPSYTEFLKALEAGKIKKVPAPAIAIEYWQLPTYSPLKNVVVLVRPHKGPPRDVNPFGWGKHFQGMPPKEPPAPI

SEQ ID NO: 6067 - protein, 429 aa, Fulvimarina pelagi HTCC2506
MEKRKERIVVLGGGAGGLELACNLAGNNKALVTLVDVNGSHVWKPRLHEFAAGTVDSTLSEMSFYMLAAMRGFTFEQGKVVSIDRQAQTVRLAAVRSQHGAIEGPERDVAYDRLVVALGGVTPDFGTTGVAEHAVRLDEKADADDFRDLFVAAILRSRHSGKPAKVSIVGSGATGTELASHLRVSERGFINQAVLESHQRLLDVVILEAAPEIMPGASDGLRKAVLDRLALLDIDTHTNAKIAAVERDAVVAEGGERWPTDITVWAAGLVGNPCLEHLCDFAMDSKHRIAVDNRLRTTVDERIYALGDAASFKPTPDAVPLPPTAQCASQQAAYLAGAIPKTIAGGTPDHFEYNDQGRLLSLARGGSVGSISPFRSKNDFLVHGQFARAAYQSIQRRHQWSVLGYLRGSVAIFADAISPAKSPALKLHG

SEQ ID NO: 6068 - protein, 391 aa, Shewanella sp. MR-4
MSQFQSIDVADYYDAETFKRIEEFAKDKATPFVVIDTSIIAKQYDDMVNSFPYADVYYAVKANPAAEILTLLKNKGSNFDIASIYELDMVTNVGVTPDRVSYGNTIKKRQDVRAFYERGVRMYASDSEADLRMIAEEAPGSRIYVRILTEGTDTADWPLSRKFGCQNEMAYELLVLAKELGLEPFGISFHVGSQQRDIGAWDSAIGKVKSIFDRLRDEHNIVLKMINMGGGFPANYIDKTNQLGVYAEQITHFLKEDFGDDLPQIILEPGRSLISNAGVLVSEVVLISKKSYTALERWVFTDVGKFSGLIETMDEAIKFPIFTHKQGELDKCVIAGPTCDSADIMYEHYSYGLPNDLAIGDRMYWLTAGAYTTTYSAVCFNGFPPLKDYYL

SEQ ID NO: 6069 - protein, 293 aa, Glycine max
MVLLHLPRFPLYLVTLSPSLTPRAYSKTTLLRPPKSTLTASEPVSVNPSPTELSLEKLFVPPETTVSLESSRVLNGSNILLSNYANDALVLQAEFVKSSVKTEDCPSDGLAEFALVGRSNVGKSSLLNSLVRRKKLALTSKKPGKTQCINHFRINNSWYLVDLPGYGYASAPHELRMDWEKFTKNYFLNRSTLVSVFLLIDASIPAKQIDLDYASWLGQNQIPMTLIFTKCDKRKKKKNGGKRPEENVNDFQDLIRGFFQSVPPWIMTSSVTNQGRDEILLHMAQLRNYWLKH

SEQ ID NO: 6070 - protein, 397 aa, Symbiobacterium thermophilum IAM 14863
MRLSARARALTPSPTMAIDAMSKQMVAEGIDVVNFSVGEPDFDTPESIKAAGIAAIQQGETKYTPAAGTLELRKAICEKLERDNGLQYRPEEIVVSNGGKQSLYNAYQVLLDPGEEVIIQAPYWVSYPEIVRLAGGVPVVVETDESTGFRLTADMIREKLTNRTRVINLNSPSNPTGAVLSRRELEEIAALAVEHDLMIVTDEIYEKLLYDGAEHVSIASLGEEVKRRTITVNGLSKAYAMTGWRMGYTASERIYAKAMADLQSQSTSGPSSISQAAAVAALRGSQESVEQMRQEFDRRRRHMLERLNRLPGFSVKVAPAGAFYLFPNVSALFGETIAGRKITSSDDLAEVILEQAHVAVVPGTGFGAPHHIRFSYATSMERIDEGLDRIARLLARG

SEQ ID NO: 6071 - protein, 331 aa, Rhodobacter capsulatus
MAIELEGLGLSPELADVMTRLARVGADLARTIARNGVETDLAAGVGTNAGGDGQKALDVMADDAFREALTGTAVAYYASEEQDEVVTLGKGTLALAIDPLDGSSNIDVNVSIGTIFSIFPATDDPNTSFLRKGSEQIAGGYIIYGPQCALVCSFGRGVHHWVLDLDSRSFKRLPDIKALPQDTSEYAINASNYRHWPSPIRAFIDDLVAGAEGPRGRNFNMRWIASLVAETHRILMRGGVFLYPGDERKGYARGRLRHVYECAPIAFLITQVGGGATDGCEDILSALPDKLHARTPFVFGCAAKVARVTAYHDLPGQETSAPFNTRGLFRS

SEQ ID NO: 6072 - protein, 539 aa, Burkholderia sp. 383
MHDKILILDFGSQVTQLIARRVREAHVYCEIHPNDVSDDFVREFAPKAVILSGSHASTYEDHQLRAPQAVWDLGVPVLGICYGMQTMAVQLGGKVEWSDHREFGYAEMRAHGHTRLLDGIEDFKTDEGHGMLKVWMSHGDKVAELPPGFALMASTPSCPIAGMADEARGYYAVQFHPEVTHTLKGRQIIERFVLQIAGAKPDWIMKNHIEEAVAKIREQVGDEEVILGLSGGVDSSVAAALIHRAIGDQLTCVFVDHGLLRLNEGKMVLDMFEGRLHAKVVHVDASEQFLGHLAGVTDPEAKRKIIGREFVEVFQAEAQKLSKAKWLAQGTIYPDVVESGGTKTKKATTIKSHHNVGGLPETLGLKLLEPLRDLFKDEVRELGVALGLPPEMVYRHPFPGPGLGVRILGEVKREFADLLRRADAIFIEELRNTTATAHDAAAGLCGEADVGKSWYDLTSQAFAVFLPVKSVGVMGDGRTYDYVTSLRAVQTTDFMTAHWAHLPYALLGRASNRIINEVRGINRVVYDISGKPPATIEWE

SEQ ID NO: 6073 - protein, 413 aa, Sphingomonas sp. KA1
MTLSTQCFVIVGGGQAGAWIARTLRAEGYDGRILLIAKEIHLPYERPPLSKDILSGKTEIASAALLTADSVATHQIEVWTGTVATEIDRDARIVRCADGRSVTYDHLFLTTGSRVRTLPFTQKGEGPKRVHVLRDLDDAQGLRTAMKSSRRIGVIGGGWIGLEVAATARQMGLDVIVLEAAPRLCGRSLPEEISAYLALMHKDHGTDVRTGAAVEKVTATADGVQVDVAGEALHFDHVVIGIGIVPETDLAAAAGLAVDNGILVDECGRTLDPHISAAGDVTSHPNAFMGGHVRMESWANAQNQAIVAAKAAIGAEAVHADIPWVWSDQYDANFQIIGMPERAATLHKRGNEADGKCCWLAVDAAGKAIGAVSLNMPRELRLVRKALEQDKTPDLDQWQSDKIRITEVALLPA

SEQ ID NO: 6074 - protein, 805 aa, Gibberella moniliformis
MKSNESQHTEMVSNLRKSAYIAVNRIGTQELQLAALCYLIRICIIHYKDQQNSGHLASSPFYHQTSQSPLCTRFTLFVFSLLTMTTTVVLPSLPPTIPAAPKPGDILKHPSLDEKKKEASVSIKDAPFSDIDPGAFNSELVKLKIYAKPQKDLLAKPEIGKGNIVKGTYIGTQAAVTHAYGRIERSYESYFDVLQVERTLPRYVDLSQKKELFQWSAYPTEDGKPAQYPPHLQTIPKDEQVKKIFNALGLAETGLILKQVIPDTFFGKTALWITGLGTGNISGAPTAGNTIDAFVKYNAEHRKSGTDIEQGHNIGLLPDWFSDRRFADQSFTGTNPTTIEKVPKDLLAEFIETAKRDGWDYWAKTLPTIDSASLFVQDTRYFRKAFGAKPGDELKHKEPSSDENWACSAVTLYQLRDDGKLHPIAIVCGYKASMKDSVTIFNQRKDPSDSSVKEKDDYPWRYAKTCAQVSDWIRHEVGVHLTRAHMIEEALIVATHRTIPMEYTVFKILQPHWYKTLSLNAAVRDTLVPQVIKDLVGVSPDALYSYVKYEFENFDFVNNYVPNDLSKRGFPNTTEGLADKKYKNYAYAKNMVSMWNAIRSYVMKMLLMYYDQKTADKMVQEDPYVKEWCKEIQTSGWIKTFPTITTLDQLCDALTMSIHIAAPFHSAVNYLQSFYQSFVLAKPSTLCKPLPTSLADLKNYTENNLLDALPADRQREWLLSVQIPWLLSFKVPSDRSLINFAQSQWRAHKSGESDVDKSISKYSEAFYLDLKKLEVEFLITSKGMDEGAIPYMVLDPGNTAVSILI

SEQ ID NO: 6075 - protein, 637 aa, Thermococcus litoralis
MQIITCPYCGAGCRAYVKKELSHPFIIEYVTDINVPNDRGKLCPKGNAMFEYLLSKERLKTPLKAIERGKFVKISWKEAINEIASFIRGYMKDDPNRLMFIAGGKVSNESAYLFQKLARNIGTNNVDNTSHLCHGVSVRAILDANFERNWATYDDIEESNVIILWGANLAETAPLIFRRVLKAKNRSAKIIVIDPRKTKTTKFASIHVRPFPGTDIVLINALINLLLKRRNIKSAHFKASDLEIISKNTPEYAERITGVPVRDIEEIAREIGLARRGIILWGSGIAMHSNGYDVIRSIITLASIVDFKVLPLAGQNNSQGVMDMGVVPNFLPGYRTYDNVYIFREAWKNEELPTEVGLDIPKSIKEAQKRNVSAFYVMGANIALSFPEAEKALRRAEFVIVQDIFPTQTTELADIVLPAAAFLESNGSTTNAERRIQWSSRVKWPPGDAKPDWAILCELGNALGLRGFDFYFPEEILREISTLVPQYANANPRTLMRTPEGVMWNIVPDSQPTKVYVSNKMPLLEPPVMITVRYVGQFQTGTMTKRSPPLNIRWQDLLILVSEEDAQKWGIKDGDRVKLVSENGKYIGTVKVSKTVIPGTIKAPWHEGVNRIMGLKIDEKTGLPQLKACSCKLERVE

SEQ ID NO: 6076 - protein, 192 aa, Triticum aestivum
EPQGHLPRSLNTYIAQPCPPPVMASWATSVAPFQGVKSTAGLPVSRRSKGVSLGSVSHGGRIRCMQVWPMEGIKKFETLSYLPPLSTEALLKQVDYLIRSKWVPCLEFSKVGFIFREHNASPGYYDGRYWTMWKLPMFGCTDATQVINEVEEVKKEYPDAYVRIIGFDNMRQVQCVSFIAFKPPGCEESGKA

SEQ ID NO: 6077 - protein, 486 aa, Streptococcus pyogenes SSI-1
MKFTIITNYDTLSRKSFTIEGDNMTIFRKKKKYSNKTEMQRHFKVIDLIFLGLGSMVGTGIFTVTGIGAAKYAGPALTISIIISAIAIGILALFYAEFASRMPSNGGAYSYVYATLGEFPAWLVGWYIIMEFLTAISSVAVGWGSYLKGLLANYNIVLPNALNGTFNLKNGTYIDILPVLVMFFVTGIVLMNSKLALRFNSFLVILKFSALALFIFVGIFFIDHNNWFHFAPYGVGQITGGKTGIFAGASVMFFAFLGFESISMAVDEVKEPQKTIPKGIILSLIIVTALYIVVTTILTGIVHYTKLNVPDAVAFALRNIRLYWAADYVSIVAILTLITVCISMTYALARTIYSISRDGLLPKSLYTLTKKNKVPQNATLVTGLLAMICAGIFPLSSLAEFVNICTLAYLIILSGAIIKLRRIEGEPKANEFKTPLVPFLPMLAIIICLSFMSQYKAFTWIAFAIATIIGTLIYLAYGYTHSIENK

SEQ ID NO: 6078 - protein, 352 aa, Oryza sativa
  misc_feature (287)..(287): Xaa can be any naturally occurring amino acid
MGVYLSTPKTEKYSGEGGNDRLRYGLASMQGWRTTMEDAHTALPRLDECTSFFGVYDGHGGKAVSKFCAKHLHLQVLKNEAYSSGDLATSVLKSFFRMDEMMKGQRGWRELAELGDKGQKFTGMLEGIIWSPKPGESDKPEDTWTEEGPHSHFPGPTSGSTACVAIIRNDELIVANAGDSRCVLSRKGRAYDLSKDHKPDLDAEKERILNAGGFIVAGRVNGSLNLARAIGDMELKQNEFLPAERQIVTAEPELNTVKLSEDDEFIVLACDGIWDCMSSQEVVDFVXHKEMNTEDSLSAVCEKLLDHCLAPVSGGDGCDNMTVIIVKFKKPSKSAATSSTNQSVSSEEMRPK

SEQ ID NO: 6079 - protein, 644 aa, Nitrosomonas europaea ATCC 19718
MCGITGVFDTRSTSEIDRNLLHRMNETLTHRGPDEGEVYVESGLGLGHRRLSIMDVSSGQQPLFNEDGSVVVVFNGEIYNFQKLVGELTALGHRFRTHCDTEVIVHAWEEWGERCVERFSGMFAFGVWDRNRQTLFMARDRLGIKPFYYTLLDNGLFLFASELKALLVHPDFDKTFDHRAIEDYFAYGYIPEPKTIFKNAFKLNPGHLLSLQRGQQTVQSREYWDIPFTPHGSLSEEEAAEELILRLRNAVDSHLMSEVPLGAFLSGGVDSSAVVAMMGGLMKEPVNTCSIAFSDPAFDESDYARLVAERYQTRHFTEQVQQDDFDLIDRLAALYDEPFADSSAIPTYRVCELARKRVTVALSGDGGDENFAGYRRYRWHMIEERLRSKLPLGLRKPLFGLLGSVYPKADWAPKFLRAKTTFESLARDSVEGYFHSVSILDNKLRMQLFTRDFYRDLQGYRAVEVLRDYADKSPTKDALSLIQYLDMKTYLVGDILTKVDRASMAHSLEVRVPLLDHELVEWVSGLPASMKLRQQEGKYILKRSLEPYLPNEVLYRNKMGFSVPLASWFRGPLRERVRTALLGNTLAGTGIFDMGFIKKMLDQHQSGRRDYSAPIWTLLMFEAFLRNILSMGNMSYTGQDKKVA

SEQ ID NO: 6080 - protein, 118 aa, Frankia sp. EAN1pec
MHTLDSLDAESRRTDVPEFWPGDTLKVHVRVVEGNRQRIQVFQGVVIRRQGGGVRETFTVRKVSFGVGVERTFPLHSPIVSRVEVVTRGDVRRAKLYYLRQLRGKAAKIKEKREPVGR

SEQ ID NO: 6081 - protein, 534 aa, Emericella nidulans
MADGVVAGTRVEAPVTWKTYLMCAFAAFGGIFFGYDSGYINGVMAMDYFIHEFSGKVKAEYEAADNLSGYVISSSNKSLITSILSAGTFFGAIIAGDLADWFGRRTTIISGCGIFMVGVALQTASTTVALLVVGRLIAGFGVGFVSAILILYMSEIAPRKVRGAIVSGYQFCVTVGLMLASCVDYGTENRTDSGSYRIPIGLQLLWAIILAVGLFLLPESPRYYVRKGDVSSAAKVLARVRDQDVESDYVKEELAEIVANNEYEMSLIPQGGYFATWFNCFRGSIWSPNSNLRRTILGTSLQMMQQWTGVNFVFYFGTTFFTNLGTISDPFLISMITTIVNVFSTPISFYTMEKIGRRPLLLWGALGMVICQFIVAIAGVVDGSNNKTVSAQIAFICIYIFFFASTWGPGARVVIGEIYPLPIRSRGVALSTASNWLWNCIIAVITPYMVDEDKGNLKSKVFFIWGSLCACAFVYTYFLIPETKGLTLEQVDKMMEETTPRTSSKWKPHGTFAAEMGMTEKDVTQTVEDIAKKA

SEQ ID NO: 6082 - protein, 506 aa, Zea mays
  misc_feature (427)..(427): Xaa can be any naturally occurring amino acid
PNRHSGLEELCFGFNYFNTFYTTRNCIIPREQKVCYLNSGSYGLPLVGAVRDRLDFYYFQGQDKYFESRVERYGSTVVRMNVPPGPFMARDPRVVAVLDAKSFPVLFDMDKVEKRDLFTGTYMPSTSLTGGHRVCAYLDPSEPTHAKVKQLLFSLLLSRKDDVIPVFRSNFSSLLATVESDLAEGGKAEFNKLNDVTSFDFIGEAYFGVRPSATDLGKGGPTKAAKWLIWQLHPLLTLGLPMVLEEPLLHTFHLPPFFVKGDYGALYKYFSTVAKQALDTAEGLGLSREEACHNLLFATTFNSYGGLKVLFPGILANVASAGEKLHERLVAEIRGAVAEAGGKVTLAAVEKMELAKSVVWESLRLDPPVKFQYGHAKKDLQVQSHDAVFQVKKGEMLFGYQPCATKDPRVFGATAKEFVPGRFLGEXEGSKLLQYVYWSNGRETENPTVDNKQCPGKNFVVLVGRLFLVELFLRYDTFTADIGKDLLGSSVVFTSVTKATSGPGSE

SEQ ID NO: 6083 - protein, 308 aa, Arabidopsis thaliana
MSVTSTVEENHQKNPSTPAAVEEEKKKRRWVFWDRRWRRLDYVKFSASFTVHSLALLAPFYFTWSALWVTFLFYTIGGLGITVSYHRNLAHRSFKVPKWLEYLLAYCALLAIQGDPIDWVSTHRYHHQFTDSERDPHSPKEGFWFSHLLWIYDSAYLVSKCGRRANVEDLKRQWFYRFLQKTVLFHILGLGFFLFYLGGMSFVTWGMGVGAALEVHVTCLINSLCHIWGTRTWKTNDTSRNVWWLSVFSFGESWHNNHHAFESSARQGLEWWQIDISWYIVRFFEIIGLATDVKVPTEAQRRRMAIVR

SEQ ID NO: 6084 - protein, 290 aa, Clostridium perfringens ATCC 13124
MNINSLKEEVDQSLKAYFNKDREYNKVLYDSMAYSINVGGKRIRPILMLLSYYIYKSDYKKILTPAMAIEMIHTYSLIHDDLPCMDNDDLRRGKPTNHKVFGEAIAVLAGDALLNEAMKILVDYSLEEGISALKATKIIADAAGSDGMIGGQIVDIINEDKEEISLKELDYMHLKKTGELIKASIMSGAVLAEASEGDIKKLEDFGYKLGLAFQIKDDILDVVGNAKDLGKNVHKDQESNKNNYITIFGLEECKKKCVNITEECIEILSSIEGNTEPLKVLTMKLLERKF

SEQ ID NO: 6085 - protein, 396 aa, Solanum lycopersicum
MDGSVPQTDTMMSDVAAPPAQQPPPPSQPLAGMDNIPATLSHGGRFIQYNIFGNIFEVTAKYKPPIMPIGKGAYGIVCSALNSETNESVAIKKIANAFDNKIDAKRTLREIKLLRHMDHENIVAIRDIIPPPQREAFNDVYIAYELMDTDLHQIIRSNQGLSEEHCQYFLYQILRGLKYIHSANVLHRDLKPSNLLLNANCDLKICDFGLARVTSETDFMTEYVVTRWYRGPELLLNSSDYTAAIDVWSVGCIFMELMDRKPLFPGRDHVHQLRLIMELIGTPSEAEMEFLNENAKRYIRQLPLYRRQSFTEKFPHVNPAAIDLVEKMLTFDPRRRITVEDALAHPYLTSLHDISDEPICMTPFSFDFEQHALTEEQMKELIYRESIAFNPEYQRM

SEQ ID NO: 6086 - protein, 148 aa, Triticum aestivum
MARRHHVVVLLPLLALAVSFVAAFIDGAPHRYLRDQQDDQATSMSLDEVSAAVSVLLGFAPPAMLPAPSSAKLNKLLLPKPFDRPRAVFLMQIDGSHDSVDSFVSDAGSIYKTKIEGAQNAATGLTDKDELIVIRSDDTLLYSNVKMD

SEQ ID NO: 6087 - protein, 108 aa, Zea mays
  misc_feature (43)..(43): Xaa can be any naturally occurring amino acid
  misc_feature (63)..(63): Xaa can be any naturally occurring amino acid
  misc_feature (88)..(88): Xaa can be any naturally occurring amino acid
SIGPRRRRGGQERKTRDVYFDLDDIGNTTGQWDLYRSDASSPXYNPVQSKVFQTLATPCTKTXLLIKVLLLGGRSLLAYVRASGVTPXVLAIKNGPHESPHPGPRGEI

SEQ ID NO: 6088 - protein, 165 aa, Glycine max
  misc_feature (51)..(51): Xaa can be any naturally occurring amino acid
  misc_feature (146)..(146): Xaa can be any naturally occurring amino acid
MEDERSTQSYQGGEAAEQVEVTDRGLLGNLLGKKKAEEDKEKEEELVTGMXEKVSVEEPEVKKEEHEDGEKKETLFSKLHRSSSSSSSSSDEEEEEVIDDNGEVIKRKKKKGLKEKLQEKLPGHKDTDGEHVTVLPAPAAPASVQXHHDTDLDVEHIDEDVKTEA

SEQ ID NO: 6089 - protein, 147 aa, Synechococcus sp. CC9605
MSTRTHRRTTLRRLPGTGGLAIAHPTDLLDRRSRDRARRAIGCLPFSEALYRDLQQQGLDAGDLWSEPSRYGRKTHWFRNSEALEDDLRWLISVGVLRREVDGQGLTSRFRLTPLGRQLLDDDPALLQRSIPLLERMRHSLRRHWPL

SEQ ID NO: 6090 - protein, 210 aa, Glycine max
MDLQQSEFDRLLFFEHARKAAEAEYEKNPLDADNLTRWGGALLELSQFQSFPESKKMTQEAVSKLEEALAVNPKKHDTLWCLGNAHTSQAFLIPDQEEAKVYFDKAAEYFQQAVDEDPSNELYRKSLEVAAKAPELHVEIHKHGFGQQQQQQAAATAGSSTSASTNTQKKKKSSDLKYDIFGWIILAVGIVAWVGFAKSNLPPPPPPPPR

SEQ ID NO: 6091 - protein, 214 aa, Pseudomonas fluorescens Pf-5
MNELQDLIDNNERWAEAIKQEDPDFFSKLARQQTPEYLWIGCSDARVPANEIVGMLPGDLFVHRNVANVVLHTDLNCLSVIQYAVDVLKVKHILVTGHYGCGGVRASMQDRQLGLIDGWLRSIRDLYYEHREALGQLPTEEERVDRLCELNVIQQVANVGHTSIVQNAWHRGQSLSIHGCIYGIKDGRWKSLNATISGFEQLPPQYRLRPVGAV

SEQ ID NO: 6092 - protein, 338 aa, Tropheryma whipplei str. Twist
MLVSGIFLSDILDPSGSLSDDISPALDRVEDLLLETVGDCHEIVSHLLVSGGKRARPLLVLLTSCMGSGINDAVIRAAAGIELIHLGSLYHDDVMDNAYIRHGSITAHRLWGKSAAILAGDFLFAKAGVLGLNLDKRAIAVQTEAFQRMISGQLSETLGISDSLDPLEAYIEVSRGKTGSLIAASAQVGAILGDASPSTLEPLRDFGESIGVAFQLVDDVIDLSGKSGKTPGSDIRAGVMSLPILLLSNAAKDDRDSAVLLEEIERVRRHSGACGSDDYSSEMNAVLAHLRKHDVTARTLEIARTWGDKAKHALKKLPECAPRDALLAFVETVVSREF

SEQ ID NO: 6093 - protein, 88 aa, Petunia x hybrida
MADLRGSSAICDERCGCPSPCPGGVACRCASGGAATAGGGDMEHKKCPCGEHCGCNPCTCPKSEGTTAGSGKAHCKCGPGCTCVQCAS

SEQ ID NO: 6094 - protein, 238 aa, Festuca arundinacea
MCGIKREMSGESGLSCSGEYHSPSTSPEQQQGHSQKQTAWMKRPAGRTKFRETRHPVFRGVRRRGNAGRWVCEVRVPGRRGSRLWVGTFDTAEIAARAHDAAMLALAAGDACLNFADSAELLAVPASYRNLAEVRHAVTEAVEDFERRQELGEKDSLSGTSSSTPSSSSLTDDEEASSQADNSPFELEVLSDMGWDLYYSSLAQGMMLMAPPFLAASAAFGDYGEVNLADVPLWSYQS

SEQ ID NO: 6095 - protein, 392 aa, Heteropterys sincorensis
DLEPVNPADVPVTAAGALKSYKLASKAISRLQSLPSGNISLLCDVLVKEVRDLTGYDRVMVYKFHEDEHGEVVSECRRSDLESYLGLHYPATDIPQASRFLFMKNKVRMICDCLAPPVKVIQDERLPQPLSLCGSTLRSPHGCHAQYMTNMGTIASLVMSVTINEDDDMMDGDQQQMTRKLWGLVVCHHTSPRFVPFPLRYACEFLIQVFGVQINKEVELAAQVREKHILQIQTMLCDMLLRDAPVAIISQSPNVMDLVKCDGAALYFKNKAWFLGVTPTQEQIRDIAEWLLEYHSGNTGLSTDSLMEAGYPGASVLGDAVCGMAAVSITSRDFLFWFRSHTAKEIKWGGAKHDPDDKDDLRKMHPRSSFKAFLEVVKWRSMPWEDVEMDAI

SEQ ID NO: 6096 - protein, 148 aa, Rhodospirillum rubrum ATCC 11170
MQRRIVPDVVRDQTIFFVSAETTAREVARTLADNKIAAVVVMEDGVLKGIITERDVTARLVAKGGDPDSVMARAIMTPDPDTLAPEDTAEDALRMMRLRGYRHLPVVDGEGVVGMVSIRDLYAVVTDQLERDMKTHESFIYGEQYGIS

SEQ ID NO: 6097 - protein, 245 aa, Fulvimarina pelagi HTCC2506
MTRAHEPPPIDPASHAIFLDFDGTLAELVDDPDAVALPEGTLDPLIALQRACGGALAIVSGRKVSDLDRFLAPLSFAAAGVHGLERRVEPGGETTRLMTADELDPVREALNGLVEENPRLQLEDKGLALVVHYRTAPDLKDTARSAVKHAVKDRDDLLVMDGDNIVEVHPAGMNKGRALAAMMEDAPFKGRIPVYAGDDTTDEYALEEVKRRGGISIKVGSRNSAAEYRLADVEAVHRWIAETIG

SEQ ID NO: 6098 - protein, 392 aa, Heteropterys steyermarkii
DLEPVNPANVPVTAAGALKSYKLASKAISRLQSLPSGNISLLCDVLVKEVRDLTGYDRVMVYKFHEDEHGEAVSECRRSDLESYLGLHYPATDIPQASRFLFMKNKVRMICDCLAPPVKVIQDEKLPQPLSLCGSTLRSPHGCHAQYMTNMGTIASLVVSVTINEDDDMMDGDQQQLTRKLWGLVVCHHTSPRFVPFPLRYACEFLIQVFGVQINKEVELAAQVREKHILQIQTMLCDMLLRDAPVAIITQSPNVMDLVKCDGAALYFKNKTWLLGVTPTEEQIRDIAEWLLEYHSGNTGLSTDSLMEAGYPGASVLGDAVCGMAAVSITSRDFLFWFRSHTAKEIKWGGAKHDPDDKDDLRKMHPRSSFKVFLEVVKWRSMPWEDVEMDAI

SEQ ID NO: 6099 - protein, 461 aa, Tropheryma whipplei TW08/27
MSEDFILPALGESVSECVITRWLKEAGDRVEVDEPLVEVSTDKVDTELPSTLTGILEEILVQRDETAKPGQILARIAVDKDETKSNFDHGVKQSDVITGDSAGNLLGNTRPIEDNEWPVTLHTAESKPDLSAKADHIGDEGDKQGNLYAAHNAEIPYATPIVRQLARKLNIDLTNIVGSGVGNRILREDVLLASNRTTNTSTECAQNIPSSPEHDKSAASFDSEVSELRGTRIKMSRLRNIIAERAVHSMQNTAQLSTVIEVDLTRIVDYRNSIKEKFKEAEGVNLTVLPFIINATVQALRKYPVINSHIVDDQIVFPDYENISLAVDTERGLLTPVIKNAGDMTVAQFAKSVFDLARRARNNKLSPDELTGGTFTVTNTGSRGALFDTPVVFLPQLAILGIGAIARRPVIVLDAQGNECISIRSVAFFALSYDHRVIDGADAARFLGYIKSLLETGNCTV

SEQ ID NO: 6100 - protein, 392 aa, Heteropterys ternstroemiifolia
DLEPVNPADVPVTAAGALKSYKLASKAISRLQSLPSGNISLLCDVLVKEVRDLTGYDRVMVYKFHEDDHGEVVSECRRSDLESYLGLHYPATDIPQASRFLFMKNKVRMICDCLAPPVKVIQDERLPQPLSLCGSTLRSPHGCHAQYMTNMGTIASLVMSVTINEDDDMMDGDQQQMTRKLWGLVVCHHTSPRFVPFPLRYACEFLIQVFGVQINKEVELAAQVREKHILQIQTMLCDMLLRDAPVAIITQSPNVMDLVKCDGASLNFKNKTWLLGVTPTEEQIRDIAEWLLEYHSGNTGLSTDSLMEAGYPGASVLGDAVCGMAAVSITSRDSLFWFRSHTAKEIKWGGAKHNPDDKDDLRKMHPRSSFKAFLEVVKWRSMPWEDVEMDAI

SEQ ID NO: 6101 - protein, 392 aa, Heteropterys trichanthera
DLEPVNPADVPVTAAGALKSYKLASKAIARLQSLPSGNISLLCDVLVKEVRDLTGYDRVMVYKFHEDEHGEVVSECRRSDLESYLGLHYPATDIPQASRFLFMKNKVRMICDCLAPPVKVIQDERLPQPLSLCGSTLRSPHGCHAQYMTNMGTIASLVMSVTINEDDDMMDGDQQQMTRKLWGLVVCHHTSPRFVPFPLRYACEFLIQVFGVQINKEVELAAQVREKHILQIQTMLCDMLLRDAPVAIITQSPNVMDLVKCDGAALYFKNKTWLLGVTPTEEQIRDIAEWLLEYHSGNTGLSTDSLMEAGYPGASVLGDAVCGMAAVSITSRDFLFWFRSHTAKEIKWGGAKHHPDDKDDLRKMHPRSSFKAFLEVVKWRSMPWEDVEMDAI

SEQ ID NO: 6102 - protein, 392 aa, Jubelina wilburii
DLEPVNPADVPVTAAGALKSYKLAAKAISRLQSLPSGNISLLCDVLVKEVRDLTGYDRVMVYKFHEDEHGEVVSECRRSDLEPYLGLHYPATDIPQASRFLFMKNKVRMICDCLAPPVKVIQDERLPQPLSLCGSTLRSPHGCHAQYMTNMGTIASLVMSVTINEDDDTMDGDQQQMTRKLWGLVVCHHTSPRFVPFPLRYACEFLIQVFGVQINKEVELAAQVREKHILQIQTMLCDMLLRDAPVAIITQSPNVMDLVKCDGAALYFKNKTWLLGVTPTVEQIRDIAEWLLEYHSGNTGLSTDSLMEAGYPGASVLGDAVCGVAAVSITSRDFLFWFRSHTAKEIKWGGAKHDPDDKDDGRKMHPRSSFKAFLEVVKWRSMPWEDIEMDAI

SEQ ID NO: 6103 - protein, 416 aa, Photobacterium profundum SS9
MSEDFRQQALNYHAYPVPGKTAIALTKPADTVQDLALAYSPGVAEPVREIAQNAENVYKYTGKGNMVAVITNGTAILGLGNLGPLASKPVMEGKSLLFKRFAGLDSIDIEVKHRTIDEFVDTVANIADTFGGINLEDIKAPDCFEIEKRLIERCSIPVFHDDQHGTAIVTAAGMLNALEIQGKEISESVIVCLGAGAAAVACMELLIKSGAQREKIYMLDRKGVIHTRRDDINEYKQLFANNTDKRTLEDVIDGADIFVGVSGPNLLAPEALKLMADKPVVFACSNPDPEIKPELAHAVRDDLIMGTGRSDYPNQVNNVICFPFIFRGALDVRASEINDEMKLAAVKAIRELTKEPVPAEVMKAAGVDELEFGINYIIPKPMDPRLLPRVAKAVAQAAIDSGVAQIDMPVGYMEDK

SEQ ID NO: 6104 - protein, 541 aa, Aspergillus oryzae
MAETPELEPHNAFDTILTLDFGSQYTHLITRRLRELNVYSEMLPCTQKLADLKFKPAGVILSGGPYSVYEEGAPHVDPAYFDLGVPILGICYGLQEIAYRLDSTNVIAGTSREYGLAQLKAKKVGGHVDHLFDGLEDEFNVWMSHGDKLGKLPEGFHTIATTPNSEYAGIAHETKPIYGLQLHPEVTHTQNGTKLLKNFAVNICGCKQNWTMARFVDQEIARIRKLVGPTGQVLGAVSGGVDSTVAAKLMKEAIGDRFHAVLVDTGFMRLNECEQVKQTLAEHLGINLIVADASQVFMEGLKGISDPEQKRKFIGNKFIDVFEEEAKKIEDAAAHSETAGKIGFFLQGTLYPDVIESISFKGPSATIKTHHNVGGLPKRMTEGQGLKLIEPLRELFKDEVRDLGRQLGIAHEMVMRHPFPGPGIAIRILGEITPERVEMARKADHIFISMIREAGLYDKIGQAFAALDPSRAVGVMGDKRVYENIVLLRAVETTDFMTAIAYPFEHEFLTRVSTRIVNEVSGVCRVAYDYTSKPPGTIELE

SEQ ID NO: 6105 - protein, 691 aa, Mycoplasma pulmonis UAB CTIP
MLYQDNKWCFILENIITNMIYFRGIKKSFAQRIDYIDKNFATNAKLGIWKKDKNFIINFWQPFALSVDLIIYDKLDNDKVVEKINFVKKQKIWQVKIPLKFEDYYYHIKVQDENKKSKLVLDPYAKSLSVFNWEGKTNKTPKAAIIDWQKHFKNESFSDKNFDIKKDQNLVIYEMHIRDFSSLVDKKLENRKGTFKAAQECQIFSYLKKLGITHIQLLPVQSIYTLDDSNLEIIEKGNGQKWSTNYNWGYDPLNYFSLAGWYFSKPEDPSNRIIEFRDFIEEAHKNGIAVIMDVVYNHMMTNMLMNNILKDYFFRENSQILPVDDFALNTESKMVRKLIIDSLVYFVEYFKVDGFRFDLSTFIDKKTLNLIFKKLKKINPNIILHGEAWEFSDLNYENSYTKGTNTNSKGFAYFNDTTRNAIKGSDDLDLIEKSYGLIQGNLDYFDHYLFSIVGNVKKYPLFQKSNLEKKNYHLFSKDYNMNLQYSACHDGFSLWDKIITTTNKSFSDSIKIYRQALMMQFSTQGKQLILAGTEFCHSKPTDFSGYDSARSLKILNSENNLVDKSNFWVNENSYKTSDYTNGLKWQNLNNDLVKKHVFNFLTRLIHFYKNSNFFKLDNNFEKVNFLKIKKGFVFYEIQHQEEKLFIAHNFSNENIYLKELENKKILFNSDFDDSNDKSDFWVLKNSSIIFQ

SEQ ID NO: 6106 - protein, 483 aa, Oryza sativa
MTTPHGLLQYSSGAFSDQVPADDSAEEHGVKDHAMLAPFTAAWQTAISPPLVIERSEGCYVYDVNGTKYLDALAGLLSTALGGSEPRLVKAATEQLNKLPFYHSFWNHTTRPSLDLAKELISMFTAREMGKVFFTNSGSEANDSQVKIVWYYNNALGRPKKKNIISRTQSYHGTTFISASLSGLPTLHQDFDLPGRFVLHTDCPHYWRFHLPGETEEEFATRLADNLENLILKQGPETIAAFIAEPVIGAGGVILPPKTYFEKIQAVVKKYDNLFIVDEVITGFERLGTMFGSDLYNIKPDLVSLAKALSSAYAPIGAILVSPEISDVIHSHSNKLGTFAHGFTYSGHPVSCAVALEALKIYRERDIPGHVTHVAQRFQEGIKAFAAGSPIVGETRGVGLLIATEFTDNKSPYELFPFEWGVGEIFGQECKKRGMMVKVLGNLIAMSPPLIITREEIDKLVSIYGEALKATEERVAELKSKKN

SEQ ID NO: 6107 - protein, 517 aa, Bradyrhizobium japonicum USDA 110
MIGSPLATSCEPGSLPLVRPSNAMELQQSQALNYGPAVSAVATDRIIETSIPSRLDALPWSGFHTRVVLALGITWILDGLEVTLAGALSGALKQSPSLQFSNLDLGIANSAYLAGAVLGALGFGWLTDRIGRKKLFFITLALYLSATAATALSWDIASYALFRFLTGAGIGGEYTAINSTIQELVPARYRGWTDLVINGSFWIGAAMGAVAAIVLLDPALIGPDLGWRLAYLIGASIGLVVLLMRMWIPESPRWLMIHGRPDQAHAIVDEIERSVIGHDQDASDRRFTRIRLKMRDHTPIREVMHTLFTVYRQRALVGLVLMGAQAFFYNAIFFTFALVLTDFYGISADHVGWYLLPFAAGNFLGPLLLGRLFDTLGRRAMIMFTYGASGLLLALSGYLFSIGALSAQGQTIAWMVIFFFASPAASAAYLTVSETFPLEVRALAIAVFYAVGTGIGGVIGPALFGALIDTGSRTSVFAGYLLGAFLMIAAAIVAWRYAVSAERKSLEQIARPLAFME

SEQ ID NO: 6108 - protein, 392 aa, Mascagnia rigida
DLEPVNPADVPVTAAGALKSYKLAAKAISRLQSLPSGNISLLCDVLVREVRDLTGYDRVMVYKFHEDEHGEVVSECRRSDLESYLGLHYPATDIPQASRFLFMKNKVRMICDCLAPPVKVIQDERLPQPLSLCGSTLRSPHGCHAQYMTNMGTIASLVMSVTINEDDDMMDGDQPQMARKLWGLVVCHHTSPRFVPFPLRYACEFLIQVFGVQINKEVELAAQVREKHILQIQTMLCDMLLRDAPVAIITQSPNVMDLVKCDGAALYFKNRTWLLGVTPTEEQIRDIAEWLLEYHSGNTGLSTDSLMEAGYPGASALGDAVCGMASVSITSRDFLLWFRSHTAKEIKWGGAKHDPEDKDDGRKMHPRSSFKAFLEVVKWRSKPWEDIEMDAI

SEQ ID NO: 6109 - protein, 409 aa, Sphingomonas sp.
MRSADVVIVGAGHAGAQCAIALRQAGYEGSIALVGRENEVPYERPPLSKEYFSREKSFERLYIRPPEFWREKDIHLTLGIEVSAVDPGSKVLTLSDGSAFAYGQLVWATGGDPRKLACPGAELSGVHAIRTRADCDRLMAEIDRGLTQVVVVGGGYIGLEAAAVLTKLNCHVTLLEAMPRVLARVAGTELSTFYENEHRGHGVDLRTGITVAALEGQESVTGVRLGDGSVLPAQAVIVGIGIVPAVAPLIEAGAAGDGGVTVDEYCRTSLPDVFAIGDCASFSCSFADGRVLRVESVQNANDQASCVAKTICGDPQPYRAFPWFWSNQYDLRLQTAGLSLGYDQTVVRGDPAVRSFSVLYLKQGRVIALDCVNMVKDYVQGRKLVEANVCVSPEQLVDTGLALKDLIPV

SEQ ID NO: 6110 - protein, 553 aa, Trifolium pratense
MQINTQTITTDFHNTRVRVLPEYDVFIHTSDGTRIPAHTSILASVSPVFENILEQPRKQRSSERIIKINGVPSTAVTAFISFLYSSRCTEDEMDKYGIHLLALSHVYNVPQLKQKCIKGLVQRLTVENVVDVLQLARLCDAPDLRLRCMKLLANHFNAVQKSEGWKFLTKHDPWLELDILHFMDESETRREKLRRHREEQGLYAELSEAMECLEHICTEGCTDVGPYHVEVDRERKPCSKFSTCQGLQLLIRHFATCKRRVKGGCWRCKRMWQLFRLHSYVCQQIDDSCNVPLCRNTFFMENLQQWIYSNLSKGAKGRIDSAWCDYWATACHCFWTWRNKEIHDAEFTRPIYAMQHVYRRVNDYYQANKTNRLMRIKNDMLVYISWKPPCGSYVKLNTDGACKDQNRGGCGGIIRGSQGEWLGGFARGLGNCSAIIAELWGVAEGLSYARRLGFTAVELNVDSVVVVQAIKTGRFSSSVGLPLVKHIRRMLDLDWEIKIEHAYRESNKCADAMANIGCHLDRETIFYDSCPISIKELLLADELGITTPRIISM

SEQ ID NO: 6111 - protein, 448 aa, Pseudomonas aeruginosa PAO1
MFGIFRPAPHQAPLPDAEVDSTYRRLRWQIFAGIFIGYAGYYLLRKNFSLAMPYLIEDGYSRGQLGVAMSAIAIAYGLSKFIMGLVSDRSNPRVFLPFGLLVSAAVMFIFGFAHWATSSVAIMFVLLFINGWAQGMGWPPSGRTMVHWWSQKERGSVVSVWNVAHNVGGGLIGPLFLLGLALFGDWRSAFYVPAIVAVGVAVFAYFAMRDTPQSCGLPPIEKHKDDYPEGYDEHHERELSTKEIFVTYVLRNKLLWYIALANVFVYLLRYGVLDWAPTYLKEAKHFNVDKSSWAYFFYEWAGIPGTLLCGWLSDKLFKGNRGATGVVFMILVTVGTLIYWLNPAGNPAIDMAALIMIGFLIYGPVMLIGLQALELAPKKAAGTAAGFTGLFGYLGGSVAANALVGYTVDHFGWDGGFKLLIGACLLAILFLCLTLRKPAVQAAPQQAG

SEQ ID NO: 6112 - protein, 392 aa, Philgamia glabrifolia
DLEPVNPADVPVTAAGALKSYKLAAKAISRLQSLPSGNISVLCDVLVKEVRDLTGYDRVMVYKFHEDEHGEVVSECRRSDLESYLGLHYPATDIPQASRFLFMKNKVRMICDCLAPPVKVIQDERLPQPLSLCGSTLRSPHGCHSQYMTNMGTIASLVMSVTINEDDDTMDGDQQQMTRKLWGLVVCHHTSPRFVPFPLRYACEFLIQVFGVQINKEVELAAQVREKHILQIQTMLCDMLLRDAPVAIITQSPNVMDLVESDGTALYFKNKTWLLGVTPTEEQIRDIAEWLLQYHSGNTGLSTDSLMEAGYPGASALGDSVCGMAAVSITSRDFLFWFRSHTAKEIKWGGAKHDPDDKDDLRKMHPRSSFKAFLEVVKWRSMPWEDIEMDAI

SEQ ID NO: 6113 - protein, 392 aa, Sphedamnocarpus sp. Davis 39-01
DLEPVNPADVPVTAAGALKSYKLAAKAISRLQSLPSGNISVLCDVLVKEVRDLTGYDRVMVYKFHEDEHGEVVSECRRSDLESYLGLHYPATDIPQASRFLFMKNKVRMICDCLAPPVKVIQDERLPQPLSLCGSTLRSPHGCHSQYMTNMGTIASLVMSVTINEDDDTMDGDQQQMARKLWGLVVCHHTSPRFVPFPLRYACEFLIQVFGVQINKEVELAAQVREKHILQIQTMLCDMLLRDAPVAIITQSPNVMDLVKSDGTALYFKNKTWLLGVTPTEEQIRDIAEWLLQYHSGNTGLSTDSLMEAGYPGASALGDSVCGMAAVSITSRDFLFWFRSHTAKEIKWGGAKHDPDDKDDLRKMHPRSSFKAFLEVVKWRSMPWEDIEMDAI

SEQ ID NO: 6114 - protein, 608 aa, Fulvimarina pelagi HTCC2506
MSETLERLQTQEKSEARKKAEAWFEDFEKALAAGDAEAAANMFAATSFWRDLVTFTWNIKTVENPAGVKDMLSATLDRVRPKNFQLSDEPTEDGGVTTAWFTFETDIARGEGLARLQDGKAWTFLTAMTELKGYEENRGTQRPLGAVHGHGSDQLNLRQRIDHEKETLGYEKQPHVVIVGGGQGGIALGARLRQLGVPTIILERRNRPGDSWRNRYKSLCLHDPVWYDHLPYLKFPENWPVFAPKDKIGDWLEFYTKVMELNYWEKSEATSAQYDGSKGEWVIEVNRDGKKLTLRPKELVFATGMSGKANLPKLPGQDTFKGEVQHSSQHPGPDAYKGKKVVVVGSNNSSFDICGALYEAGADVTMVQRSSTHIIRSEPLMEHGLGDLYSERAVESGVDTHTADMIFASLPYRILHEFQKPVYDKVKELDKAFYDGLEKAGFKLDWGDDGSGLFMKYLRRGSGYYIDIGAAQLIIDGKVKLASGQVKEFTETGIRLEDGTELPADLVVFATGYGSMNGWVEDLVDRETALKIGKVWGLGSDTTKDPGPWEGEQRNMWKPTQVEHLWMHGGNLHQSRHYSLYLALQLKARYEGIPTPVYGLQDVHHAGI

SEQ ID NO: 6115 - protein, 392 aa, Tristellateia sp. Davis 19-01
DLEPVNPADVPVTAAGALKSYKLAAKAISRLQSLPSGNISLLCDVLVKEVRDLTGYDRVMVYKFHEDEHGEVVSECRRSDLESYLGLHYPATDIPQASRFLFMKNKVRMICDCLAPPVKVIQDGRLPQPLSLCGSTLRSPHGCHAQYMANMGTIASLVMSVTINEDDDTMDGDQQQMARKLWGLVVCHHTSPRFVPFPLRYACEFLIQVFGVQINKEIELAAQVREKHILRIQTMLCDMLLRDAPVGIITQSPNVMDLVKCDGAALFYKNKFWLLGITPTEAQIRDIAEWLLEYHSGNTGLSTDSLMEAGYPGASVLGDAVCGMASVSITSRDFLFWFRSHTAKEIKWGGAKHDPDDKDDGRKMHPRSSFKAFLEVVKWRSLPWEDMEMDAI

SEQ ID NO: 6116 - protein, 314 aa, Geobacillus stearothermophilus
MDVVTIGESMAVFTPTSVGLMRQATTFTMRIGGRESNVAVGLARLGHRVGWISKVGSDEFGKAILSFLKGEGVDVSRVKWMGNTDRHLLKEQRRLNDTRVYYYRKGSAASRLTPADLDEKYIAEAKYLHITGITPALSENCRDTVFAAMAMARRHGVKIVFDPNLRLKLWNEADRAKEVMLRMAAESDVVLPGEAEASFLFGKHSVEEWGSRLLDMGASLVVIKLGANGAHYFTNAHHEYVQGFLLKGYDPVGAGDGFVEGYPDCLKDFVLTEAVQRANAVGALVTMVEGDADGMPERDDVERLINQRRKMLRR

SEQ ID NO: 6117 - protein, 409 aa, Trifolium pratense
MGVCLSAQIKAESPYNTGLNSKNSNSAGNDLSSTNSKVSTGSVPQTPRSEGEILKSTNVKSYTLAELKSATRNFRPDSVLGEGGFGSVFKGWIDENSLAPAKPGTGIVIAVKRLNQESFQGHREWLAEVNYLGQFSHPHLVRLIGYCLEDEHRLLVYEFMPRGSLENHLFRRGSYFQPLSWSLRLKVALDAAKGLAFLHSSETKVIYRDFKTSNILLDSDYNAKLSDFGLAKDGPTGDKSHVSTRVMGTYGYAAPEYLATGHLTTKSDVYSYGVVLLEMLSGKRAVDKNRPSGQHSLVEWAKPYLANKRKVFSVLDSRLEGQYSSDESYRVATLALRCLSTESKYRPNMDEVVRILEQLKVPNVNVGNQRRYRRKSADDVTHARTHKKSCASARAHTSYPRPSASPLYA

SEQ ID NO: 6118 - protein, 392 aa, Tristellateia sp. Davis 29-01
DLEPVNPADVPVTAAGALKSYKLAAKAISRLQSLPSGNISLLCDVLVKEVRDLTGYDRVMVYKFHEDEHGEVVSECRRSDLESYLGLHYPATDIPQASRFLFMKNKVRMICDCLSPPVKVIQDERLPQPLSLCGSTLRSPHGCHAQYMANMGTIASLVMSVTINEDDDTMDGDQQQMARKLWGLVVCHHTSPRFIPFPLRYACEFLLQVFGVQINKEIELAAQVREKHILRIQTMLCDMLLRDAPVGIITQSPNVMDLVKCDGAALFYKNKFWLLGITPTEAQIRDIAEWLLEYHSGNTGLSTDSLMEAGYPGASVLGDAVCGMASVSITSRDFLFWFRSHTAKEIKWGGAKHDPDDKDDGRKMHPRSSFKAFLEVVKWRSLPWEDVEMDAQ

SEQ ID NO: 6119 - protein, 102 aa, Oryza sativa
  misc_feature (19)..(19): Xaa can be any naturally occurring amino acid
MALVEGNNSMSGGAGTFSXEQEALALKSWAIMKKDTDNIGLRFFLKIFKVAPSASQMFSFLRISNLPLQMNPKLKTHTMSVFVMTCEADAHLQKARNVTVRD

SEQ ID NO: 6120 - protein, 154 aa, Triticum aestivum
  misc_feature (117)..(117): Xaa can be any naturally occurring amino acid
  misc_feature (126)..(126): Xaa can be any naturally occurring amino acid
  misc_feature (135)..(135): Xaa can be any naturally occurring amino acid
MAPTVMASSATSVAPFQGLKSTAGLPVSRRSNGASLGSVSNGGRIRCMQVWPIEGIKKFETLSYLPPLSTEALLKQVDYLIRSKWVPCLEFSKVGFIFREHNASPGYYDGRYWTMWXLPMFGCTDXTQVINEVRXKKEYPEGVGPALSGFENME

SEQ ID NO: 6121 - protein, 503 aa, Tropheryma whipplei str. Twist
MRPVLVVDFGSQYSQLVVRAIRECGYYAEFASPSISAAECLALSPIAIFLSGGPASAYKDNAPKLDEEILNCGIPVFGICYGFQLLAQAFGGSVKKANAPEYGPADITIVNKAFFSGQPDRQTVWMSHGDSVIRAPKNFCILSTSQDAVLSFCNRDRTIAGVQWHPEVKHSRFGKHTIKAFLSSFAAPNWDPEQTICGTVDSIRKTVGCKRVLCALSGGVDSVVAATLTHRAIGDRLRCVFVDHGLLRLNEREQVEEYCSSLGLNVSTYDASDCFLSALSGIRDSEQKRKVIGREFIACFSKLQERFDIKPHFLLQGTLYPDLVESGATPGGATIKSHHNVGGLSDNLGFELLEPLKYLFKDEVRKIGLQLGIPKHIVHRQPFPGPGLAIRIIGEVTNKKLSILRAADAIVRHELRDWTDIWQCPVILLSDVQSVGVRGDSRSCGFPIVIRPVSSDDAMTADWYRLPYDVLARISGRITNEIPEIVRVVLDITPKPPATIEWE

SEQ ID NO: 6122 - protein, 392 aa, Verrucularia glaucophylla
DLEPVNPADVPVTAAGALKSYKLAARAISRLQSLPSGNISLLCDVLVKEVRDLTGYDRVMVYKFHEDEHGEVVSECCRPDLDAYLGLHYPATDIPQASRFLFMKNKVRMICDCLAPPVKVIQDQRLPQPLSLCGSTLRSPHGCHAQYMANMGTIASLVMSVTINEDDNIVDDNQLRMERKLWGLVVCHHTGPRFVPFPLRYACEFLIQVFGVQINKEVELAAQVTEKHILRTQTLLCDMLLRDAPVAIITQSPNVMDLVKCDGAALYYRKKFWLLGVTPTEAQIRDIAEWLLEYHSGNTGLSTDSLMEAGYPGASVLGDAVCGMASVKISSRDFLFWFRSHTAKEIKWSGAKHDPGDKDDIRKMHPRSSFKAFLEVVKWRSLPWEDMEMDAI

SEQ ID NO: 6123 - protein, 351 aa, Oryza sativa (japonica cultivar-group)
MRPPRGRGFGRGGGGRGDGGGRGGGGGRGFGRVGDSGGRGGRGGRGGRTPRGRGGGRGGGGRGGMKGGSKVVVVPHKHDGVFIAKAKEDALCTKNMVPGESVYGEKRISVQNEDGTKVEYRVWNPFRSKLAAAVLGGVDNIWIAPGTRVLYLGGASGTTVSHVSDIVGPSPRYAILPFANQVILQTGLVYAVEFSHRSGRDLVNMAKKRTNVIPIIEDARHPARYRMLVGMVDVIFSDVAQPDQARILALNASYFLKNGGHFVISIKIITLIEVEIGEILDVILGIGLKLFEQANCIDSTMPAEAVFASEVEKLKADQFKPSEQVTLEPFERDHACVVGGYRMPKKQKGTS

SEQ ID NO: 6124 - protein, 291 aa, Frankia sp. EAN1pec
MTSMARGSVTLAAPDPDLREPARPREITGTTRLYAVVGDPVEQVQAPMLVNPVFAEAGLDAVLVPAHARPRDFPTVLAGLCAMANLDGILITIPHKVAAAELADVRSAAARISGSANALRREPDGRWLADNFDGAGFVRGLARAGHRVAGARVHLAGAGGAGSAIAVALLEAGCASLALHDPDTARSGELLGRLDAHWPGRAGPAAAPTPAGQVDLIVNATPLGLRPADPLPFDPAMLPAGCVVADIIMKPARTRLLQAAAERGLPAHPGIHMLAEQVDLYRTFFGLPGAR

SEQ ID NO: 6125 - protein, 214 aa, Frankia sp. EAN1pec
MGTHAIVFDLDGVIVDSHAVMREAFMIAYAEVVGPGPAPFEEYNRHLGRYFPDIMRIMGLPLEMEEPFVRESYRLSRKVLLFEGVRELLGDLRERGLRLAVATGKSGPRARALLTELEIVDYFERVIGSDEVAHPKPAPDIVLLALDVLGAAPGEAMMIGDAVTDIQSARGAGVRAVAAMWGETDEAELLAAGPDSVLRSPRELLGLLGDHRAV

SEQ ID NO: 6126 - protein, 458 aa, Trifolium pratense
MDQQNKQSFQNPKHIIFDKYEMGKVLGQGNFAKVYHCRSLSTNESVATKVIKKEKLRKERLVKQIKREVSVMRLVRHPHIVDLKEVMATKGKIFLVMEYVKGGELFAKVAKGKLKEDVARKYFQQLISAVDFCHSRGVTHRDLKPENLLLDENEDLKVSDFGLSALPEQHREDGMLLTPCGTPAYVAPEVLKKKGYDGSKADLWSCGVILYALVCGYLPFQGENVMRIYKKAFKGEYEFPEWISPQAKILISNLLVADPKKRYSIVDIMNDPWFRIGFVRPIAFSMNGSSIEDNDKDINIDFNEVGEDNVDVPELIMVKPSRPFYNAFEIISSLSHGFDLRNLFETRKKLPSMFISKFSASTVLEKLEVMAKKLNFRMTGKKEFVVRFEGTKDGRKGKVAVTMEVFGVAPDVAVVEFSKCGGDTLEYVKLCDEQLRPSLKDIVWSWQGDDNHNDNNSQ

SEQ ID NO: 6127 - protein, 282 aa, Xylella fastidiosa Temecula1
MPVSRFAVFGHPIAHSLSPRIHTEFGRQMGVVLDYLAFDVAPDAFRVSLEHFVAEGGCGANVTLPLKEAAFEVCTTLSARARRAGAVNTLSRVDGVWHGENTDGTGLVRNLTERHGLDLRGRRALLLGAGGAARGVAPALLDAGITEMVIVNRSPERADMLCDALGEPGKVSARYWGDLGDLGNFELIINATSIGNTSDMRTFSLPRSLLDSMTAAVDLNYGSAAVPFLAWAHAVETRYAIDGLGMLVEQAAESFSLWHGRRPDTDPVYTVLHSEYGVPGRS

SEQ ID NO: 6128 - protein, 342 aa, Mesorhizobium sp. BNC1
MAYSTDHDVVLDFPILIGDIGGTNARFAIVVDSYAEPREFPVVQTADFATIEDAIQTAILDQTHLIPRSAVLAVAGPVNGDEIDLTNSNWVVRPREMMAHLGFSDIVVLNDFEAQALAVVALGEEHLEKIGGNVAETVGSRVVLGPGTGLGVAGLVHARRTWIPVPGEGGHMDLGPRTARDEQIFPHLERIEGRVSGEQVLCGRGLVNLYRAIAKADAKEAAFSSPAEITTAGLAQADEIAVETLNLFVTYLGRVAGDLGLVFMSRGGVFLTGGIAQKIVPALKNSLFRAAFEDKAPHNELMASMPVYVITHPLAALHGLAAYARTPARFGVETAGRRWRLR

SEQ ID NO: 6129 - protein, 543 aa, Oryza sativa
  misc_feature (81)..(81): Xaa can be any naturally occurring amino acid
MAMEAEALLPEPEPESPPLLAVDHLGGPASRGSSGRWPAAFFLIGAEVGERFAYSGIMGNLVIYLTGPLRQPTAAAAAAVXNVWMGTSMLLPLLGSAVADSWLGRYRTIVCASLLYILGLGMITVSSVLAPEESSESSNLAAHVAFFYFSLYVVAFAQGGHKPCAQALGADQFDENDPGELASRSSFFNWWFFASYGGNTVTVPILNYVQEKRSWQLGFAIPCIAMAVSLAIFLIGTRSYRFYPPKSKGNPFGEVAEWIRRWIASSCSKLPDSSDELLPSSSSEGDVSNSSSEFVPKEAAELVKLFPIWASSLIYAAVMAQCITFFTKQASTLDRRVGSLVLPAASNGALFNATIMVFLPIYDRIFIPVARRYTKNPSGITTLQRIGVGLVLSIITMIVAAMVEMRRLRIARDFGLVDKPEAVVPMSFLWIVPQNILAAISDMFAVIGLQEFFYGEAPESLRSFSMALFLSIIGVGNFISSFIVYAIDRVTSSFGDSWFSNNPNRGHVDYFYLLITVLNALSLACFLYFAKMYEHRKKVISVQ

SEQ ID NO: 6130 - protein, 325 aa, Polaromonas sp. JS666
MHSTIQGSTDVYLISGDPVEQVRAPEVFNLIFRTLGINAVLVPVHVPLQDIEAFVRTAFLAKNIKGMLLTIPHKSRVMGLLARCNDAGRVAGAVNGIRRNAAGELEGALFDGKGFVLSLDYFGVAYAGKRVLILGAGGAAAAIAVSLAMAGSRAPAGIALYDPAPGKAQALASQLAAAAQTPLKKVVAATSSDPSAYDLVVNASPLGLRAGDPLPCDVSRLAPHAAVVDILMKNQPTPLVQAARARHLVAQPGFEMLIQQAPDYLAFFGYAEAAQAVRNNATFIRELLYPAAMQGEINRPGQRIPSSEFASVPVPGVGESRLPAH

SEQ ID NO: 6131 - protein, 390 aa, Pseudomonas fluorescens Pf-5
MAQPYSARSRAIEPFHVMALLARANELQAAGHDVIHLEIGEPDFTTAEPIIKAGQAALSAGKTRYTAARGIPELRGAISGFYQQRYGLDIDPERIMITPGGSGALLLTSSLLVDPGKHWLLADPGYPCNRHFLRLVEGAAQLVPVGPDVRYQLTPDLVERYWDQDSVGALVASPANPTGTVLSRDELAGLSTAIKARNGHLVVDEIYHGLTYGTDAASVLEVDDSAFVLNSFSKYFGMTGWRLGWLVAPPAAVGELEKLAQNLYISAPSMAQYAALACFEPQTLEILEERRAEFGRRRDFLLPALRELGFGIAVEPEGAFYLYADISAFGGDAFAFCRHFLETEHLAFTPGLDFGRHQAGHHVRFAYTQSLERLQEAVERIARGLQSWHA

SEQ ID NO: 6132 - protein, 445 aa, Synechococcus sp. CC9605
MLLLSDSAPIGLLPRRLAWDVLQAVAAGAYADVALERVLRERDLKPSDRGLVTELAYGAIRQRRTLDAWLDRLGKVPALKQPPKLRWLLHVGLYQLLLMERIPDSAAVNTAVELAKTSKGLARLAPVVNGVLRAALRAREAGETLQLPNDLPAQLALAHSLPDWFTQLLIEWRGVEGAAAVASACNRVPDLDLRVNRLRSSPAQVQQDLAAAGISSESIVGCPDGLRISGHSGDLRHWPGYAEGHWCVQDCSAQWIAPVLDPKPGDRILDACAAPGGKATHLAELVGDQAEIWAVDRSAGRLKRVAANAARLGLASINALAADAANLLEQRPQWRESFQRILIDAPCSGLGTLARHPDARWRVTPQSIRGLLPQQQALLDGLLPLLAPQGVLVYATCTIHPDENQAQIQALLKRHPTLRLEQESQLWPDQASGGDGFYSAVLQRA

SEQ ID NO: 6133 - protein, 598 aa, Magnetococcus sp. MC-1
MCGICGVMYFQPQTPQPAMLEKMVEKLHQRGPDGGGIEIDGQLGLGHRRLKVIDLSENGHQPMQDDALGLTIVFNGCIYNYQALRQSLLELGYSFFSTSDTEVILKAYHAWGWQCVQRFNGMFAFAIYERQSGRVVLARDRLGIKPLYIHQDKSHLRFASSIPSLLAGGGITTTLDPIALHHFLSFHSVVPAPRTLLQQVQKLPPATVRIVEKNGSETNHTYWNLQMGPQAGDAERTEAEWQQLLDQALRAAVSRRLVADVPVGLLLSGGLDSSLMAGLLVESGQLSRGGLSTFSIGFEQAGGEEGDEFQYSDIVAAHFGTDHHKIFIETNNLPELLRETVRAMSEPMVSHDAVGFYLLSREVAKHVKVVQSGQGADEVFAGYHWYPKVDAGQDAFQDYRKAFFDRSHEECCEMVHRDIAAAWQQDYSSAFVESWFAHPHSGTAAVDKALHLDQNIMLVDDPVKRVDNMTMAWGLEARVPFLDHELVELAARIPGHLKLQQGGKGILKEVARPIIPHAVIDRAKGYFPVPALKHMDGPVLKLAKEVLTSPRATQRGLIQPSYINRLLDHPTQHITPLHGSKLWQLTLLELWLQTHDIH

SEQ ID NO: 6134 - protein, 206 aa, Triticum aestivum
MDTCGIIPPSSEEYPIMGANLLRLLVQNRIAEFHTELELLPAKALDNAYIKHGVELEQSFMEGAYNRVLSARQTAPHETYIYFMDLLVKTVRDEIAGCSEKGYDYLSINDAKQMFKFSSDKELQQYIAEEHPEWDVKDGRVLFQKAKESQPCKEIPAAPVINQTLGYARELERIVIVWLFFLHLWTEFPMKRWIIGLPCDSAVLFC

SEQ ID NO: 6135 - protein, 485 aa, Oryza sativa (indica cultivar-group)
MIPARSRIIVNAWAIGRDPRYWDDAEEFKPKRFEKNMVDFTGSCYEYLPFGAGRRMCPGVAYGIPILEMALVQLLYHFDWSLPKGVVDVDMEESSGLGARRKTPLLLFKPKPRFLRVNTLRTSTDSVIEELNKIHKGKASCMVAVALCPEPGWKVIDACAAPGNKTVHLAALMNGEGSITACELNKERTKTLQNTIRRSGANSILSLSFCVSPDVYRALMKELAQTLDKQFSGNSESRAAGMIINTMGWVENLGLELLHNSIEIFKANEKLWKMLKDAAKNKPNIDVVKLHKSEGVVPRNPKYRQKTRSFRIKEYFYGIANDLAPHSNVVNFSDVSVYKIGTHQAPKSALPIGAEPVADPTRLVAVNISTDMVHTVLAVSYAKEPDEIVSSNVAGFIHVTDVDIQRYPQQPRKLACTFLWIRGRSSHTLHHAQGTCQVEKQQQNLQTKELRDIQPGSWNPYLRTEDLQTPTPRRRGASTQWHQFN

SEQ ID NO: 6136 - protein, 113 aa, Synechococcus sp. RS9916
MRALFSVVAALILLISAPVSAFAGDAVNGAKVFSANCAACHAGGGNVVNGEHTLQQDDLKAYLAQYNNGHESAIVAQVTYGLNEMPAFIGTLTENQISDVAAYVEEQASNGWG

SEQ ID NO: 6137 - protein, 369 aa, Oryza sativa (japonica cultivar-group)
MRPGGPPSLRAGLQQQQQQQPGTPGRSRRRPDLTLPLPQRDLTSLAVPLPLPLPPSSAPSSTSSSGSSSLGGVPTPPNSVGSAPPAPPPLSELERVRRIGSGAGGTVWMVRHRPTGRPYALKVLYGNHDDAVRRQITREIAILRTAEHPAVVRCHGMYEQAGELQILLEYMDGGSLEGRRIASEAFLADVARQVLSGIAYLHRRHIVHRDIKPSNLLIDSGRRVKIADFGVGRILNQTMDPCNSSVGTIAYMSPERINTDLNDGAYDGYAGDIWSFGLSILEFYMGRFPLGENLGKQGDWAALMCAICYSDSPAPPPNASPEFKSFISCCLQKNPARRPSAAQLLQHRFVAGPQQQQQPQPQPLAPPPS

SEQ ID NO: 6138 - protein, 136 aa, Tropheryma whipplei TW08/27
MEQTLVIIKPDGIRRGLIGQVLSRIEAKGYQIVDIRMLVPDRQSVEEHYLEHRDRHFYLPLVDFMTSGPIVLVRAEGHGVVDALRTLVGVSDPTLALPGTIRGDFGRNWGLDVIQNIVHASDSVKSAKRELDIWFP

SEQ ID NO: 6139 - protein, 549 aa, Shewanella sp. MR-4
MTLASIRRGYHVIKTLLQYGLDDVLPPKMTPWYFKLARNSLFWIRNKHKGKSGGERLKLAMQELGPVYIKLGQMLSTRRDLLSDEWANELAMLQDKVPPFDGALARQAIETELKAPIESFFDDFNETPLASASISQVHTATLKSNGKAVVLKVLRPNVEAKIQADLLLMSQTAKIIDYLLGEGNRLRPSEVIEDYRVTILGELNLKLEALNAIKLRNNFLDSDALYIPYVYEEFCYPRLMVMERIYGIPVSDIAALKAQGTNFKLLAERGVELFFTQVFRDNFFHADMHPGNIFISRDHPENPYYIGLDCGIMGTLSEVDKRYLAENFLAFFNRDYHRIAQLYIESGWVSEKTDLQAFEQAIKVVCEPMFNKPLDEISFGHVLLELFRTARHFDIVVQPQLVLLEKTLLYIEGLGRQLYPQLDLWQTAKPFLEQWMAEQVGPKAMFKKVSTKLPYWSDKLPEFPELIYDNLKLGRKLLSSQQQMLDKYLKYQQQAHKSNYLLITSAILLICGTLLFNQDATLWSPYVCLISGAALWIIGWRSRPKNRKF

SEQ ID NO: 6140 - protein, 426 aa, Schizosaccharomyces pombe 972h-
MDNEIVALCGFFVAIALVLSCISIITHLKNYKKPVLQRSVVRILMMIVIYSSVSFLSVYNEKIGSIFEPFREIYEAFALYCFFCLLIDYLGGERAAVISLHGHLPRPRLWPLNYLQDDIDLSDPYTFLSIKRGILQYTWLKPFLVIAVLLTKVTGVYDREDQPVYASADLWIGLVYNISITLSLYSLTTFWVCLHEELAPFRPFPKFLSVKAIIFASYWQQTVLSITNWLGLLNGTGWIYSLLNQNVLMCLEMPFFALSHWYAFRIEDYDTPTWLSCARLPLLKAFKDVIGLKDVWCDSLQTLHGDRYVYQNFEPGENLIPSRNDGRINRTSHGLRYSQGGQSKYWISRYDQSRVRLINNSQNSPQSNKSYFSIPGMSTSHFENGLQFEIDDEMEPLYNQAKQMRYGDYNYPVLLVNNTHASSSYT

SEQ ID NO: 6141 - protein, 486 aa, Mycobacterium sp. MCS
MISANLIINGREETSDRTIDVVSPADIRVLLGSVPDAAPGQVDEAVAAAAMAFPEWSSRPLEERQGALLAAAGTIHDMIEEYAPILSRENGKILEESHVDLEFASGICGYTAGISAEILADQQIRDTGGTTLIRRRPIGPVAAITPWNFPVVLAFMKLAPALVAGNTVVLKPAANSPLVLAEVIRALQQHFPPGVLNMVTGGDAVGEALVAHPRIRKIGFTGGIDTGRKVMAAAARDIKRVTLELGGNDPAILLDDVDLSPETMRQIVKGAFGTTGQVCFGLKRIYVPTRIHDRFVEAFSAAVDEIVVGPGDDPRVTMGPLNNAQQKNLVEKIVDDARSSGATVTTLGQRLDSAAWDHGHFMMPSVVTEADPRLAIVEEEQFGPVVPVLKYDELDDVIRLVNQSQYGLAASIWTSDEERAFLLGRRFDTGSVFINSHTFTSLDPRAPFGGAKASGLGREFSPASLDSYTELQTISRRIGPPGPPLS

SEQ ID NO: 6142 - protein, 395 aa, Arabidopsis thaliana
MNGEENSDSIPIDLILEILSRLPAKSITRFHCVSKLWGSMLCRPYFNELFLTISSARPRLLFAFSKHGEWRFFSSPQPQNPYGKSSFVATADFHTKFSQNLNICNYTSGLVYFSAMWITKADVICNPSTGHYAMLPKLLLTYGETRSFFLFDPVGKQFKVLLMNKINNNETKDIHILTLGTRKVRWRKIQQCPLIHIVSHEWICINGALYYIAYNIDDFLGYIVCFDVRSEKFKCLNLNQDCFSERSTKLIYYKGKLGVVNLKYAHGGGFPLKLCMWVLEDVEKQEWTTSVYTLRDEDRVVKVYYDLFIVGITATGEIVLAKKKVCKPFYVFYFNLERNTLLSVEIQGFGEYQSCCSVHAFVDHVEDLNVYAFVEHMKKTYEYDATSISPSEQKL

SEQ ID NO: 6143 - protein, 99 aa, Oryza sativa (japonica cultivar-group)
MSAMETDINAPPPPAPAPAGAGEGSSSAAGPSSRKPNKRFEIKKWNAVALWAWGIECQANQASATSEECTVAWGYQVSVIMLFTSIASAGGSRLAKCAR

SEQ ID NO: 6144 - protein, 189 aa, Lupinus luteus
RVFTQKIHDLIGTHVDVPAPDMGTGPQTMAWILDEYSKFHGYSPAVVTGKPIDLGGSLGRDAATGRGVLFAAEALLNEYGKSVSGQSFVTQGFGNVGSWAAQLISEKGGKVVAVSDVTGAIKNSNGIDIPSLLKHSSEHKGVKGFRGADPIDPKSILVKDCDVLIPAALGGVINKENANEIKAKFIIEA

SEQ ID NO: 6145 - protein, 189 aa, Lupinus luteus
RVFTQKIHDLIGTHIDVPAPDMGTGPQTMAWILDEYSKFRGYSPAVVTGKPIDLGGSLGRDAATGRGVLFATEALLNEYGKTVSGQRFVIQGFGNVGSWAAQLISEKGGKVVAVSDVTGAIKNSKGIDIPSLLKHSREHKGLKGFHGADPVDPNSILVEDCDVLVPAALGGVINRENANEIKAKFIIEA

SEQ ID NO: 6146 - protein, 438 aa, Agrobacterium tumefaciens str. C58
MLWLAHAPCASFGRQRHMQEHHVVVVGGGFGGLQLVHGLEGAPVRITLIDRRNHHLFQPLLYQVATTALATSEIAWPIRHLYRDRKEVTTLLAEVTGVDRAARTVQLNSGQVIGFDTLVLATGARHAYFGHDEWERSAPGLKTLEDATTIRRRLLLAFERAELATSEEERQALLTFVIIGAGPTGVEMAGMIAELAHRALPAEFRNVDTRKTRVLLVEAGPRVLPVFTEDLSTYAKEALEKLGVEVLLGTPVTACTDEGVTVGETYYPCRTVVWAAGVQASPAAKWLNAAGDRAGRVIVGPQLHLEDDADIFVIGDTAAVNQENGKPVPGIAPAAKQQGAYVAKVIKARLEGKPIPAPFRYSHQGNLATIGKRAAVIDFGRFKLKGVLAWWIWGLAHIYFLIGTRSRLAVAWSWLWIYLSGQHSARLITQKETLKDEA

SEQ ID NO: 6147 - protein, 189 aa, Lupinus luteus
RVFTQKIHDLIGVQRDVPAPDMGTNAQTMAWILDEYSKFHGHSPAVVTGKPIDLGGSLGREAATGLGVIFATEALFAEYGMSISGMTFAIQGFGNVGTWAAKSIYDRGGKVVAVSDISGAITNPNGIDIPALLKHKESNGNLTEFSGADAMDPNDLLVHECDVLIPCALGGVLNKENAADVKAKYIIEA

SEQ ID NO: 6148 - protein, 576 aa, Triticum aestivum
  misc_feature (136)..(136): Xaa can be any naturally occurring amino acid
  misc_feature (234)..(234): Xaa can be any naturally occurring amino acid
  misc_feature (252)..(252): Xaa can be any naturally occurring amino acid
  misc_feature (267)..(267): Xaa can be any naturally occurring amino acid
  misc_feature (375)..(375): Xaa can be any naturally occurring amino acid
  misc_feature (405)..(405): Xaa can be any naturally occurring amino acid
  misc_feature (416)..(416): Xaa can be any naturally occurring amino acid
  misc_feature (424)..(424): Xaa can be any naturally occurring amino acid
HYRTSLYKKAGWYRSGIPGISSTHASVETSSRAPLNYTQGGPRRHNPQAASRGASSTMDRAALPAAVEPKKKGNVRFAFACAILASMTSILLGYDIGVMSGASLYIQKDLKINDTQLEVLMGILNVYSLIGSFAAXGRTSDWIGRRFTIVFAAVIFFAGALIMGFSVNYAMLMFGRFVAGIGVGYALMIAPVYTAEVSPASARGFLTSFPEVFINFGILLGYVSNFAFARLSLXLGWRIMLGIGAVPSVLLXAFMVLGMPESPRWLXVMKGRLADAKVVLAKTSDTPEEAAERLADIKTAAGIPLDLDGDVVAVPKNKGSSEEKRVWKDLILSPTKAMRHILIAGIGIHFFQQSSGIDAVVLYSPLVFKSAGITXDNRLLGTTVAVGATKTVFILVATFLLDRIXAGRPLLLSSTXGGMIVSLXGLATGLTVISRHPDEKITWAIVLCIFCIMAYVAFFSIGLGPITWVYSSEIFPLHVRALGCSLGVAVNRLTSGVISMTFISLSKAMTIGGAFFLFAGIASFAWVFFFAYLPETRGRTLEDMSSLFGNTATHKQGAAEADDDAGEKKVEMAATN

SEQ ID NO: 6149 - protein, 490 aa, Helianthus tuberosus
MDFLIIVSTLLLSYILIWVLGVGKPKNLPPGPTRLPIIGNLHLLGALPHQSLAKLAKIHGPIMSLQLGQITTLVISSATAAEEVLKKQDLAFSTRNVPDAVRAYNHERHSISFLHVCTEWRTLRRIVSSNIFSNSSLEAKQHLRSKKVEELIAYCRKAALSNENVHIGRAAFRTSLNLLSNTIFSKDLTDPYEDSGKEFREVITNIMVDSAKTNLVDVFPVLKKIDPQGIKRGMARHFSKVLGIFDQLIEERMRTGRFEQGDVLDVCLKMMQDNPNEFNHTNIKALFLDLFVAGTDTTSITIEWAMTELLRKPHIMSKAKEELEKVIGKGSIVKEDDVLRLPYLSCIVKEVLRLHPPSPLLLPRKVVTQVELSGYTIPAGTLVFVNAWAIGRDPTVWDDSLEFKPQRFLESRLDVRGHDFDLIPFGAGRRICPGIPLATRMVPIMLGSLLNNFDWKIDTKVPYDVLDMTEKNGTTISKAKPLCVVPIPLN

SEQ ID NO: 6150 - protein, 394 aa, Oryza sativa (indica cultivar-group)
MESRDAERAGGDTSRGARRTRCSRRVIRGDASRRAAGSIKSLVYSPSVRNKRATFALVCQTLKYLPILKEVLASTGVLTSKWKKQEELVFVTAYDILFGQETAASGSVEQLIMLHKDTIMAALEKMCIRRKVRSVEDLVSKKRTVKPKPRFLRVNTLRTSTDSVVEELNKIHKVDKDELVPDLLVLPPGTDLHNHHLVSEGKVFLQGKASCMVAVALCPEPGWKVIDACAAPGNKTVHLAALMNGEGNIETINGDFLDIDSNDPSYAEVRAILLDPSCSGSGISTERLDHLLPSHSRGNQDDASTSSRIRKLSAFQRKALSHALSFPSVERVVYSTCSIHQAENEDVVSSVLPLASSLGFELATPFPQWRRRGLPVFEGCRCSIPQISTMISPG

SEQ ID NO: 6151 - protein, 333 aa, Triticum aestivum
QRSGTAARRRPWAASTASRLSPPCLHAAPHHPLRRSRFSPLRAAKLEAVLSIGTHVIPHPRKVETGGEDAFFVGGDGGGVFAIADGVSGWAEKNVNPALFSRELMANSSTFIKDEEVSQDPQILLMKAHAATSSIGSATVIVAMLEKTGTLKIASVGDCGLKVIRKGQVMFSTCPQEHYFDCPYQLSSEAIGQTSQDALVCTVNLMEGDMIVSGSDGFFDNIFDQEILSVINESPGTDEAAKALAELARKHSVDVTFDSPYSMEARSRGFDVPWWKKLLGAKLVGGKMDDITVIVAQVKTVVIPDDEGSGVELEKVGGEQLAAAGVASTEQNE

SEQ ID NO: 6152 - protein, 554 aa, Pseudomonas fluorescens Pf-5
MAYYRTPHDVTALPAWQALKDHRQAMQDFSMREAFNADPQRFSQFTLSSCGLFLDYSKNLITSETRDLLVNLAKEVGLSDAIKSMITGELVNASEGRPALHTALRRPVGDKLSVNGVNVMPEVHKVLNQITELVGRIHDGLWRGYTEKPITDVVNIGIGGSFLGPELVSEALLSYAQKGVRCHYLANIDGSEFHELSAKIRAETTLFIVSSKSFNTLETLKNAQAARAWYLAQGGSEAELHRHFIAVSSNNAAAVAFGIREENIFPMWDWVGGRYSLWSAIGLPIALAIGMSNFKELLSGAYTMDQHFQSAPFEQNMPVLLALLGVWYGNFWGAQSHAILPYDHYLRNITKHLQQLDMESNGKSVRQDGTPVATDTGPVIWGGVGCNGQHAYHQLLHQGTQLIPADFIVPIVSFNPVADHHQWLYANCLSQSQALMLGKTRAEAESELREKGLSEAEIAKLAPHKVIPGNRPSNTLVVERISPRRLGALVALYEHKVFVQSVVWGINAFDQWGVELGKELGKGVYNRLVGSDETLADDASTQGLINYFRGRHRG

SEQ ID NO: 6153 - protein, 368 aa, Ralstonia metallidurans CH34
MKTKAAIAWKAGAPLTIEEVDLDGPRAGEVLVEIKATGICHTDYYTLSGADPEGIFPAILGHEGAGIVTDVGPGVTSLKPGDHVIPLYTPECRQCKFCLSRKTNLCQAIRATQGKGLMPDGTSRFSIDGKPIFHYMGTSTFANHIVVPEIALAKIRPDAPFDKVCYIGCGVTTGVGAVIFTAKVEAGANVVVFGLGGIGLNVIQGAKMVGADKIIGVDLNPAREAMARKFGMTHFVNPKDVDNVVDHIVQLTDGGADYSFECIGNTQVMRQALECCHKGWGKSIIIGVAEAGAEISTRPFQLVTGREWKGSAFGGARGRTDVPKIVDWYMDGKLNIDDLITHTLPLDRINEGFDLMKRGESIRSVVLY

SEQ ID NO: 6154 - protein, 298 aa, Oryza sativa (japonica cultivar-group)
MATDGTGVVTVYGSGTNGAALLEPSNHKSATFSVKVGLAQMLRGGVIMDVVTPEQARIAEEAGACAVMALERVPADIRAQGRRRPHARIGHFVEAQILEAIGVDYVDESEVLTLADDAHHINKHNFRVPFVCGCRDLGEALRRIREGAAMIRTKGEAGTGNVVEAVRHVRSVMGDIRALRNMDDDEVFSYAKRIAAPYDLVMQTKQLGRLPVVQFAAGGVATPADAALMMQLGCDGVFVGSGIFKSGDPARRARAIVQAVTHYSDPKILAEVSSGLGEAMVGINLSDPKVERFAARSE

SEQ ID NO: 6155 - protein, 721 aa, Synechococcus sp. CC9605
MTISAPPVIASLRGNPLEPQGTAFRRYTGSPHPFGSTVEADGVNFSLFSGSATGVQLLIFTRPEDLEPVKVITLSATENRSFNIWHAFIEGVKPGMGYAYRVDGPREPWNGHRFDPEKVLVDPYSKGNSLALWNRGAACTPGNNLHSSMRSVVIDTGDYDWEGDQPLKRPMADTVVYEMHVGGFTKSPTSGVKHPGTYLGLIEKIPYLKSLGVTAVELLPCFSFDHTDVTKEHEGRKLVNYWGYSTMGYFAPHQGYCVSADVGTHIKEFRDMVKALHNAGIEVILDVVYNHTDEGNHQGPMFSFRGIDNSTYYYLTGANGSKEYYYDYTGCGNTFNCNHPVGEKLILDSLRFWVDEMHVDGFRFDEGSVLSRGEDGSPLEHPPVIWAIELDDILGKSKVIAEAWDAAGLYQIGYFPGARWAEWNGKYRDCIRRFIKGDAGIISEVASRITGSADLYQWHHHEPVNSVNFVTAHDGFTLYDLTAYNEKHNWANGEDNNDGIDENLSWNCGVEGETDDQWINDMRKRQVKNFAAIHMLSMGVPMIVGGDEYMRSQGGNNNTYCHDNEINWYNWDQIESKESQEMIRFWSLLIGKRKMYIDHFRGRYFTGESNKFGLSDISWHGTQLNNPGWDNSEARCLAMTLGDTAEDTDQTHNVHVMFNMFWDAIEFEIPQIPGLVWYRAIDTALPSPQDIASPDQQVAVQGNSYLVTGRSIVTLVSRAST

SEQ ID NO: 6156 - protein, 493 aa, Oryza sativa (indica cultivar-group)
MAPPPVNSGDAAAAATGEKSKLSPSGLPIREIPGGYGVPFFSPLRDRLDYFYFQGAEEYFRSRVARHGGATVLRVNMPPGPFISGDPRVVALLDARSFRVLLDDSMVDKADTLDGTFMPSRALFGGHRPLAFLDAADPRHAKIKRVVMSLAAARMHHVAPAFRAAFAAMFDAVEAGLGAAVEFNKLNMRYMLDFTCAALFGGEPPSKVVGDGAVTKAMAWLAFQLHPIASKVVRPWPLEELLLHTFSLPPFLVRRGYADLKAYFADAAAAVLDDAEKSHPGIPRDELLDNLVFVAIFNAFGGFKIFLPHIVKWLARAGPELHAKLATEVRAAADDGITLAAVERMPLVKSVVWEALRMNPPVEFQYGHARRDMIVESHDAAYEVRKGEMLFGYQPLATRDAKVFDRAGEFVADRFVAAGDRPLLEHVVWSNGPETRTPSEGNKQCPGKDMVVAVGRLMVAEMFRRYDTFAADVVEAPVEPVVTFTSLTRAASG

SEQ ID NO: 6157 - protein, 514 aa, Oryza sativa (indica cultivar-group)
MAPPRANSGDGNDGAVGGQSKLSPSGLPIREIPGGYGVPFLSPLRDRLDYYYFQGADEFFRSRVARHGGATVLRVNMPPGPFLAGDPRVVALLDARSFRVLLDDSMVDKADTLDGTFMPSLALFGGHRPLAFLDAADPRHAKIKRVVMSIAAARMHHVAPAFRAAFAAMFDAVDAGLVAGGSVEFNKLNMRYMLDFTCAALFGGAPPSKAMGDAAVTKAVKWLIFQLHPLASKVVKPWPLEDLLLHTFRLPPFLVRREYGEITAYFAAAAAAVLDDAEKNHPGIPRDELLHNLVFVAIFNAYGGFKIFLPHIVKWLARAGPELHAKLASEVRAAAPAAGGEITISAVEKEMPLVKSVVWEALRMNPPVEFQYGRARRDMVVESHDAAYEVRKGEMLFGYQPLATRDEKVFDRAGEFVPDRFVSGAGGAARPLLEHVVWSNGPETGTPSEGNKQCPGKDMVVAVGRLMVAEMFRRYDTFAADVEELPLEPVVSFTSLTRAAAPAAAGEGAARRGV

SEQ ID NO: 6158 - protein, 638 aa, Oryza sativa (japonica cultivar-group)
MAASRVALSVPVAAAVALLLLALPRAAVSYPWGLCNDTAGEFPARRSSYLASINLIAATLPGNASASPDLFATAEGVGAPPDQVSALALCRGDANASTCLACLTQAFLDLPNACAYHKVAAIFYDSCLLAYSNATIAAGDFSSEKIPIYGFYSNANATTEQARFNRLVAALVNATADYAARNSTRRRYASGEADFNAEFPKVYSWAQCTPDLTPASCRSCLAQIIGTYIGFFENRVGGFVRAVWCSFQYSTTPFLDGPMLVRLQGTSGASPAPSPAAVVPAVNQTPPAATPTLEGDANYSTEAEDIENLDSMLIDISILRSATGDFAESNKLGEGGFGAVYKGVLPDGYEIAVKRLSKSSTQGVEELKNELALVAKLKHKNLVSLVGVCLEQQERLLVYEFVPNRSLDLILFDTEKSEQLDWEKRYKIINGIARGLQYLHEDSQLKVVHRDLKASNILLDVNMNPKISDFGLARIFGRDQTQAVTKNVIGTYGYMAPEYLTRGNYSVKSDVFSFGVMVLEIVTGRKNNHSYNSQQSEDLLTMIWEQWVAGTVLEMVDPSMNSFFSESDVMRCIHIGLLCVQGDPANRPVMSSVVLMLGTDTVELHAPAKPTLFARKGGGDESGVASGGMSIVSLEEQS

SEQ ID NO: 6159 - protein, 589 aa, Neisseria meningitidis Z2491
MTVQTKTKGLAWQEKPLSDNERLKTESNFLRGTILDDLKDPLTGGFKGDNFQLIRFHGMYEQDDRDIRAERAEAKLEPLKFMLLRCRLPGGIIKPSQWIELDKFARENSHYRSIRLTNRQTFQFHGVPKAKLQTMHRLLHKLGLDSIATAADMNRNVLCTSNPIESELHRQAYEYAKKISEHLLPRTRGYLDVWVDGKKVQSSDDFLQEDEPILGKTYLPRKFKTAVVIPPLNDVDCYGNDLDFVAISDGNGQLAGFNVLAGGGLSMEHGNTKTYPNISLELGFVPPEHALKAAEAVVTTQRDFGNRSDRKNARTRYTIQNMGLDNFRAEVERRMGMPFEPIRPFKFTGRGDRIGWVKGIDGNWHLTLFIESGRLVDEGGKQLLTGVLEIAKIHKGDFRITANQNLIVANVPEGGKARIEQLARSYGLIHDGVSKLRENAMSCVSFPTCPLAMAEAERVLPDFIGELDKIMAKHGTSDDYIVTRITGCPNGCGRAMLAEIGLVGKAVGRYNLHIGGDREGVRIPRLYKENITLPEILAELDDLIGKWAAERNIGEGFGDFAIRTGIVKPVLNAPVDFWDASKAVAIARA

SEQ ID NO: 6160 - protein, 286 aa, Pseudomonas syringae pv. syringae B728a
MSDYQETLYEGYGQRFRMEKMLHEVRTDHQHLVIFQNPRMGRVMALDGVIQTTEADEFIYHEMLTHVPILAHGAAKRVLIIGGGDGGMLREVAKHMSVEHITMVEIDATVVEMCKEYLPNHSSGAFDDSRLNLVIDDGMRFVATTEEKFDVIISDSTDPIGPGEVLFSENFYQACHRCLNEGGILVTQNGTPFMQLSGVQTTAGRMNGLFADWHFYHAAIPTYIGGAMTFAWGSTDKSYRKLPLETLRQRFSGSGIVTRYYNPEVHIGAFALPQYVLQAVGKASND

SEQ ID NO: 6161 - protein, 869 aa, Arabidopsis thaliana
  misc_feature (771)..(771): Xaa can be any naturally occurring amino acid
MNILGFTVNFLIRCKVLPRRSNTSSLSRNISVLASYDQEEVSPGRYSNEFSNRNLVHEILQLCARNGAVMEAKACHGKIIRIDLEGDVTLLNVLINAYSKCGFVELARQVFDGMLERSLVSWNTMIGLYTRNRMESEALDIFLEMRNEGFKFSEFTISSVLSACGVNCDALECKKLHCLSVKTCIDLNLYVGTALLDLYAKCGMIKDAVQVFESMQDKSSVTWSSMVAGYVQNKNYEEALLLYRRAQRMSLEQNQFTLSSVICACSNLAALIEGKQMHAVICKSGFGSNVFVASSAVDMYAKCGSLRESYIIFSEVQEKNLELWNTIISGFAKHARPKEVMILFEKMQQDGMHPNEVTFSSLLSVCGHTGLVEEGRRFFKLMRTTYGLSPNVVHYSCMVDILGRAGLLSEAYELIKSIPFDPTASIWGSLLASCRVYKNLELAEVAAEKLFELEPENAGNHVLLSNIYAANKQWEEIAKSRKLLRDCDVKKVRGKSWIDIKDKVHTFSVGESGHPRIREICSTLDNLVIKFRKFGYKPSVEHELHDVEIGKKEELLMQHSEKLALVFGLMCLPESSPVRIMKNLRICVDCHEFMKAASMATRRFIIVRDVNRQNEEHNKAALREAKIKELKALIGQLSGRSSLYCSDACLKRYLEARNWNVGKAKKMFEETLKWRSSEGEAGKVYKAGFHDRHGRTNTKSLYLIANAILNLPEDQEQMSWLIDFTGWSMSTSVPIKSARETINILQNHYPERLAVAFLYNPPRLFEAFWKXVKYFIDAKTFVKVKFVYPKNSESVELMSTFFDEENLPTEFGGKALLQYNYEEFSKQMNQDDVKTANFWGLGHSNNNQLHASNGFSGAEIAPEPIQNHP

SEQ ID NO: 6162 - protein, 352 aa, Hordeum vulgare
MAASDEMPMVQDLVSAGVQEPPSRYLVHEQDRHGDLLAAHEMPEPIPLIDLSRLMDADEADKLRAALQTWGFFLATNHGIEDSLMEAMMSASREFFRQPSEEKQKCSNLVDGNGKHYQVEGYGSDKVESEDQVLNWNDRLHLRVEPEDERNFAKWPSHPESFRDVLNEYASKTKKIRDLVLRSIAKLLEIDEDYFVNQISNKASGFARLYYYPPCPRPDLVLGLTPHSDGNLLTILFVDDDVGGLQVQRDGKWYNVPAKPHTLVINLADCLEIMNNGIFRSPVHRVVTNTEKERLSLAVFYAVDEETVLEPAPGLLDEKRPPRYRKMMAKDFVVGLFEHFLQGKRFIDTLKM

SEQ ID NO: 6163 - protein, 526 aa, marine gamma proteobacterium HTCC2143
MSVDIHAQRILILDFGSQYTQLIARRVREIGVYSEVRAFDMDADEIKAFQPRGIILAGGPESVTEGQSPRAPAIVFELGVPVLGICYGMQTMAEQLGGKVASSELREFGYAQIKVQGSSALLHDIKDHVDSKDGAALLDVWMSHGDKVSEMPVDFQLMASTESCPIAGMYHPEKNFYGIQFHPEVTHTLQGKRIFEHFVLELCDCDVLWTPANIVEDAVDTVRSLVGTDKVLLGLSGGVDSSVVAALLHRAIGSQLTCVFVDNGLLRKNEGDQVMDMFAKNMGVKVIRADAADIFLGNLVGESDPEKKRKIIGNTFIDIFDQQAALIQDVNWLAQGTIYPDVIESAAGKTGKAHVIKSHHNVGGLPDDMQFKLIEPLRELFKDEVRKIGLELGLPYDMVYRHPFPGPGLGVRILGEVKKEYADILREADAIFLEELHAADWYHKTSQAFVVFLPVKSVGVVGDGRRYEYVVALRAVETVDFMTARWAHLPYELLEKVSNRIINEISGISRVAYDVSSKPPATIEWE

SEQ ID NO: 6164 - protein, 239 aa, Triticum aestivum
  misc_feature (101)..(101): Xaa can be any naturally occurring amino acid
  misc_feature (159)..(159): Xaa can be any naturally occurring amino acid
  misc_feature (182)..(182): Xaa can be any naturally occurring amino acid
  misc_feature (199)..(199): Xaa can be any naturally occurring amino acid
  misc_feature (218)..(218): Xaa can be any naturally occurring amino acid
MAGAAAAAAAVASGISIRPVAAPKISRAPRSRSAVRAAVSIGEKAYTVQKSEEIFNAAKELMPGGVNSPVRAFKSVGGQPIVFDSVKGSHMWDVDGNEILXYVGSWGPAIIGHADDEVNAALIETLKKGTSFGAPCALENVLAQMVISAVPSIEMVRFXNSGTEACMGALRLVRAFTGREKXLKFEGCYHGHADSLLVXKQGSGVGTLGLPNFPGSGXGATVGTLTAPYMMVRELKAVE

SEQ ID NO: 6165 - protein, 508 aa, Arabidopsis thaliana
MPSVGIVIGDGKKEYPGKLTLYVTVTCIVAAMGGLIFGYDIGISGGVTTMDSFQQKFFPSVYEKQKKDHDSNQYCRFDSVSLTLFTSSLYLAALCSSLVASYVTRQFGRKISMLLGGVLFCAGALLNGFATAVWMLIVGRLLLGFGIGFTNQSVPLYLSEMAPYKYRGALNIGFQLSITIGILVANVLNFFFSKISWGWRLSLGGAVVPALIITVGSLILPDTPNSMIERGQFRLAEAKLRKIRGVDDIDDEINDLIIASEASKLVEHPWRNLLQRKYRPHLTMAILIPAFQQLTGINVIMFYAPVLFQTIGFGSDAALISAVVTGLVNVGATVVSIYGVDKWGRRFLFLEGGFQMLISQVAVAAAIGAKFGVDGTPGVLPKWYAIVVVLFICIYVAAFAWSWGPLGWLVPSEIFPLEIRSAAQSITVSVNMIFTFLIAQVFLMMLCHLKFGLFIFFAFFVVVMSIFVYLFLPETRGVPIEEMNRVWRSHWYWSKFVDAEKNLTKVVI

SEQ ID NO: 6166 - protein, 509 aa, marine gamma proteobacterium HTCC2143
MENNQTHRTRPLWLPDAKKLVDRIDVLQPVAELIGSTSLEGDLKTLKTVGLKLRHFTQSVSRGTIYDNPTVRHELRNLTSAIIGYSEFVLEEMEQTVDGLLYDSLQTILALCHQLSAYDDREDPLADTTGPSIKTIGGTILIVDDQIESRDLLKRYLQLNKTTVLEASNGTSMFAVLTENEVDLILLDLILPEMDGDELLELLKQDEKLRAIPVIVVSGNKETDRVIRCIEAGAEDYLFKPFNPILLQARISAGVERKRWHNKELQYRRELERNQDFIRSVFGRYLSEDIVTRILENPEGLDLGGSQRKVTVLMADIRGFSSIAEQLPPQRVVRLLNNYLGVMSDVVMRYGGTVDEFIGDAILAIFGAPTTSDDDSDRAVQAAIAMQQAMVLINQQNRADQLPEISMGVSINTGLVVAGNIGSEKRAKYGIVGHTVNLTSRIGGYCQAGEILITEATRNDCRSSLAVGPAQHIQAKGILTAIQVYRLEGASPAKTKNSDTSAKNPEAIG

SEQ ID NO: 6167 - protein, 352 aa, Arabidopsis thaliana
MEEVEVSPPQPLEIRIKVVCTSLCRSDLSAWESQSLLPRIFGHEAAGIVESIGEGVTEFEKGDHVLAVFTGECGSCRHCISGKSNMCQVLGMERKGLMHSDQKTRFSIKGKPVYHYCAVSSFSEYTVVHSGCAVKVDPLAPLHKICLLSCGVAAGLGAAWNVADVQKGSSVVIFGLGTVGLSVAQGAKLRGAAQILGVDINPAKAEQAKTFGVTDFINSNDLSEPIPQVIKRMTGGGADFSFECVGDTGIATTALQSCSDGWGMTVTLGVPKAKPEVSAHYGLFLSGKSLKGTLFGGWKPKSDLPSLIDKYMNKEIMIDEFITHNLSFDEINKAFVLMREGKCLRCVLHMPK

SEQ ID NO: 6168 - protein, 357 aa, Malus x domestica
MVSSDSVNSRVETLAGSGISTIPKEYIRPKDELVNIGDIFEQEKNNEGPQVPTIDLKEIESDNEKVRAKCREELKKAAVDWGVMHLVNHGISDELMDKVRKAGKAFFDLPIELKEKYANDQASGKIQGYGSKLANNASGQLEWEDYFFHCVYPEDKRDLSIWPQTPADYIEATAEYAKQLRELATKVLKVLSLGLGLDEGRLEKEVGGLEELLLQMKINYYPKCPQPELALGVEAHTDVSALTFILHNMVPGLQLFYEGKWVTAKCVPNSIVMHIGDTLEILSNGKYKSILHRGMVNKEKVRISWAVFCEPPKEKIILKPLPETVSEEEPAMFPPRTFAEHIQHKLFRKSQGALLPK

SEQ ID NO: 6169 - protein, 552 aa, Nicotiana langsdorffii x Nicotiana sanderae
MASTCLQPLYNPTVTLSKPPLLSLSKKQIVTARSLSQCTRRNCSFMARNNERKLPLLPLGRLRLKVSASSGEEAESNNAESAYLEEFSWSSVILPFLFPALGGLLFGYDIGATSGATISLQSAELSGTTWYNFSAVQLGLVVSGSLYGALFGSILAYPFADFLGRRRELIIAALLYAAGGSLTAYAPGLGALLLGRLVYGLGIGLAMHGAPLYIAETCPPQIRGTLVSLKELAIVLGILLGYFVGSYEINVVGGWRYMFGLSAPIALLMGLGMWSLPPSPRWLLLRAIQSKGPLQEYKEKAMGALSKLRGRPAGDKVSEKQIEDTIISLKTAYSDEEAEGNFLEVFQGPSLKAFIIGGGLVLFQQITGQPSVLYYAGSILQSAGFSAAADAARVSVVIGIFKSLMTAVAVLKADDLGRRPLLIGGVSGIALSLFLLSAYYKFLGSFPFVAVAALLLYVGCYQISFGPISWLMVSEIFPLRTRGKGISLAVLTNFGSNAIVTFAFSPLKEFLGAENLFLLFGAIALLSLLFVVTSVPETKGLSLEEIESKILK

SEQ ID NO: 6170 - protein, 438 aa, Borrelia garinii PBi
MGFHIYEIKARQIIDSRGNPTVEADVILEDGTCGRSAVPSGASTGINEAVELRDGDKSVYMGKGVLKAIENIKNIIAPELEGMSALNQVAIDRKMLELDGTPTKEKLGANAILAVSMATAKAAAKYLGLKVYQYLGAYKANILPTPMCNIINGGAHSDNSVDFQEFMIMPVGAKTFSEAIRMAVEVFHTLKGILNGKGYATSVGDEGGFAPNLKSNEEACEMIIEAIKKAGYEPGKDIAIALDPATSELYDPKTKKYVLKWSTKEELTSEQMVEYWSKWVEKYPIISIEDGMAEEDWDGWKKLTDKIGHKIQLVGDDLFVTNTSFLKKGIEMGVANSILIKVNQIGTLTETFEAVEMAKKAGYTAIVSHRSGETEDTTIADLVVALGTGQIKTGSLSRTDRIAKYNQLIRIEEELETTAEYHGKNVFYSIKQKQIKSL

SEQ ID NO: 6171 - protein, 296 aa, Neisseria meningitidis Z2491
MFPVFHLSGESRRRMLQAALRFPHVFKARAEDSHKGTFGTLAVVGGAVGMSGAPVLAASAAMYLGCGKVWAGFNQETLPFAVIAGFPEIMLDTADGLTKRQGINAWTAGCGLGTDKAAVGTLAGILTEHTDKPVLLDADALNILSTDAETRNLARGCKNLILTPHPAEAARLLGTTVAQVQADRTAAVRKIGAIFGATVVLKGHKTLVAASDTEIYVNESGNAGLATAGSGDVLGGIIGSLLAQGVPVFEAACAGAWLHGAAADVIKESAGIAAGLLAGEIAPAARWLRNRITESM

SEQ ID NO: 6172 - protein, 203 aa, Wigglesworthia glossinidia endosymbiont of Glossina brevipalpis
MNNIKFLLSANNLFNLPKDNGLEIAFFGRSNSGKSKAINALFDKKKISISSKKPGRTNFINVFIMNKKLRIIDLPGFGYSKISKKKSKIKYLLDDYFKSRKSLKILIILEDIRRSVSEFNEKLIYLSFNLKIPVLILLSKSDKINFEKRKKKLSLFKKYIEKTTHTKNIYIEVLTFSSISRDGILFTKKILNKWTNIKLFKLN

SEQ ID NO: 6173 - protein, 229 aa, Helicobacter pylori
MKNLVILSGAGISAESGIKTFRDADGLWEGHDIMEVASPYGWKKNPQKVLDFYNQRRRQLFEVYPNKAHKALAELEKHYQVNIITQNVDDLHERAGSSRILHLHGELLSVRSEKDPNLVYRWEKDLNLGDLAKDKSQLRPDIVWFGEAVPLLKEAISLVKQAHLLIIIGTSLQVYPAASLYTHAHKDALIYYIDPKAKNAHLPQNVQCINESAVHAMQDLMPKLIEMAS

SEQ ID NO: 6174 - protein, 101 aa, Triticum aestivum
YADLSSKPFFAGLVEYIVSGPVVAMVWEGKSVVSTGRKIIGATNPLASEPGTIRGDFAVDIGRNVIHGSDSVESARKEIALWFPEGIAEWRSSQHNWIYEA

SEQ ID NO: 6175 - protein, 142 aa, Kluyveromyces lactis NRRL Y-1140
MFSRFLATKSPLLRPAFRSHLSFQRFISQETKKAIEDAIESAPVVLFMKGTPEFPQCGFSRATINMLGQQGVDPVKFAAYNVLEDPELREGIKEISEWPTIPQLYVNKEFVGGCDIVMNMAQTGELAKLLEESDALVPEEED

SEQ ID NO: 6176 - protein, 594 aa, Triticum aestivum
  misc_feature (331)..(331): Xaa can be any naturally occurring amino acid
  misc_feature (530)..(530): Xaa can be any naturally occurring amino acid
MESTMKEIRGGGAPCVLDMDDAATVGGGVEDTYGEDRATEEQLVTPWTVSVASGYNLLRDPRYNKGLAFTEKERETHYLRGLLPPTVISQELQERKIMHNIRQYQLPLQRYMAMMDLQEGNERLFYKLLIDNVEELLPIVYTPTVGEACQKYGSIFSRPQGLYISLKEKGKILEVLKNWPERSIQVIVVTDGERILGLGDLGCQGMGIPVGKLSLYTALGGVRPSACLPITLDVGTNNEELLNDEFYIGLRQRRAIGQEYADFLHEFMAAVKQNYGEKVLIQFEDFANHNAFDLLARYGTTHLVFNDDIQGTASVVLAGLVAALKLVGGTXAEHTYLFLGAGEAGTGIAELIALEMSRQTKTPIHECRKKIWLVDSKGLIVSARKESLQRFKKPWAHEHEHVGNLLDAVNAIKPTVLIGTSGKGQTFTQEVVEAISSFNEMPIILALSNPTSQAECTAEQAYTWSKGRAVFATGSPFDPVQYNGKIYVPGQANNAYIFPGFGLGVVMSGAIRVHDDMLLAASEALAQQVXTQENFDKGLIYPPFSNIRKICAHIAANVAAKAYELGLASRRPRPKDLVKYAESCMYSPIYRNYR

SEQ ID NO: 6177 - protein, 130 aa, Schizosaccharomyces pombe 972h-
MVRQSVLADCLNNIVNAERRGRRQVLIRPSSKVIVKFLTVMQKHGYIDEFTEIDDHRSGKIVIQLNGRINKCGVISPRFNVKLKDIEKWVNQLLPSRQVGVIVLTTSRGIMSHNEARAKDAGGKILGFFY

SEQ ID NO: 6178 - protein, 167 aa, Triticum aestivum
MATLRPLTVEDVLRVNGSRRFAAALAAASPFDSLADALLAARRIWLNEVDVTGWLEAFAAHPPIGTTSSSVSKWSKEEQSAALSTATDSTAQELSEWNAKYREKFGFVFMICASGRTAPEVLAELKRRYANRPIVELEAAAEEELKISELRLTKLFSAETAAPPTSW

SEQ ID NO: 6179 - protein, 492 aa, Zea mays
  misc_feature (7)..(7): Xaa can be any naturally occurring amino acid
  misc_feature (64)..(64): Xaa can be any naturally occurring amino acid
  misc_feature (309)..(309): Xaa can be any naturally occurring amino acid
  misc_feature (319)..(319): Xaa can be any naturally occurring amino acid
  misc_feature (335)..(335): Xaa can be any naturally occurring amino acid
MEVVSPXEHATTVSSKVQRDKLIGGLLAPGFDEQSCLSRYQSALYRKESHHLVSTYLLERLREXEVLQKKCGPYTDSYKKAIEQLNSGQDIMVGDCNYLVWVSYSGLGNRILTIASAFLYAILTNRVLLVDGDKGTADLFCEPFPETSWVLPPDFPITKFKNFSIGSPESYGNMAKTEAIHSDGSFKGPKPAFLYLHLAHDYDDHDKLFFCEHSQQHLQKIPWLILRSDNYFVPSLFLISSYQEELTRLFPQKDVVFHHLGRYLFHPTNAVWGLITRYYDSYRPRARVRLGIQIRVFDTETGPFQHVLXQVLHCTLKEXILPEINAQQPIISTGXGGRSIFFLITSLNSGYYERIRNMYWEHPTENGEMISFHQPSHEEHQDSDKTMHNMKAWAEIYLLSLSDAMVTSAWSTFGYVAQGLSGSKTWLLFKPENRTAPNPPCRQVMSIEPCFHAPPFYDCKTRKGTDTGKLVPHVRHCEDMSWGLKLVDTGEL

SEQ ID NO: 6180 - protein, 296 aa, Clostridium perfringens ATCC 13124
MNPYCDNSINFEKLPKKFPPQHQSVQPGIESIMVPSPIFDNPDYKGSEKLKGKSVLITGGDSGIGRAVSIAFAKEGANIVISYLYENDDAETTKKYVEKYGGKCYLVPGDISNKNFCEKLVRFTVETLGGIDVLINNAGVQFPQNNINCISQEQLELTFKINIFSMFYLTQEALKYMKRGSTIVNTTSVTAYQGKENLIDYSSTKGAVVTFTRSLSQSIVKNGIRVNAVAPGPIWTPLIVSSFSEEEVARFGSDVPMKRAGQPFELAPAYVYLASDDSSYVTGQVLHVNGGTMVDS

SEQ ID NO: 6181 - protein, 174 aa, Zea mays
MASSSDPWIKEYNEASRLADDISSMIADRGSLPQSGPEIMRHTSAIRRKITILGQSKKSDDMSRVAGLDNQGIVGLQRQIMKEQDEGLEKLEETVLSTKHIALAVNEELTLHTRLIDDLEDHVDVTNSRLQRVQKRLAILNKRTKGGCSCTCLLLSVVAIVILAVIVWLLVKYL

SEQ ID NO: 6182 - protein, 309 aa, Crocosphaera watsonii WH 8501
MSIVIFGSINMDMIAQTPHLPQPGETVIGDHFITLPGGKGANQAVATAKLGRLTYFVGRVGGDSFGRELLKRLETLKINTQGVFIDQKTFSGVAMINVETSGENTIIVIPGANGNIDESDITRLEKILSKTSLLLLQLEIPLAAVEMAAREAKELGVTVMLDPAPAPEKLPDRLYPLIDIITPNQNEAEKLVGFPLDNEEEIKKAANVLLKKGVKIVVIKLGDKGAFYATDKEQDFVPAIKVKTIDTVGAGDGFNGGIAAALDRGLCLKEALKWGTIVGALTTTKEGAQTALPDLDVVHSLLLSDNSSV

SEQ ID NO: 6183 - protein, 429 aa, Bacillus halodurans C-125 [sequence omitted]

SEQ ID NO: 6184 - protein, 510 aa, Bacillus halodurans C-125
MSKKPVALIILDGFAMRDEAKGNAVAQANKPNFDRYWNQYPHALLKADGEAVGLPEGQMGNSEVGHLNIGAGRIVYQSLTRVNLSIREGEFFENETFLNAMNHVKEKGSSLHIYGLVSDGGIHSHINHLYALLELAKREQVERVYIHGFLDGRDVGPTSAESYLVDLEAKMKELGVGELATLHGRYYAMDRDKRWDRVEKSYRAMVYGEGPAYSSALDVIKDSYENSIHDEFVIPSVITNEDGSPVATIEDDDAIIFFNFRPDRAIQMSQVFTNKDFRGFDRGEKLPQNVYYVCLTHFSETVQGDVAFKPTNLDNTLGEVLAQQNYKQLRIAETEKYPHVTFFFSGGREEPFPGEERILIDSPKVATYDLKPEMSAYEVTDALLNEIEADKHDVIILNFANPDMVGHSGMLEPTIKAVEAVDECLGKVVDAILAKGGAAVITADHGNADEVVTLEGKPMTAHTTNKVPVIVTEEGLNLREDGILADLSPTVLDLLGGKQPAEMTGKTLIK

SEQ ID NO: 6185 - protein, 172 aa, Methanococcus maripaludis S2
MDLRKKIRIVENFPIEGISFKDVTPILKDPKAMKHTTKEIAKYLEDKNVDVVVGPEARGFLFGVPVAHELDIGFVPVRKPGKLPYKTFSVDYALEYGSDSLEIHSDGIEKGQNVAIVDDLLATGGTVLGVSKLVEKLGGHVSALNFVIELTELKGRDKLKGYDIQSLVKYDL

SEQ ID NO: 6186 - protein, 411 aa, Mesorhizobium sp. BNC1
MDTQTAISDASFRPATRVASLGVSEILQIGARAAQMKRAGEDVIVLGAGEPDFDTPENVKDAATRAMARGETKYTHLDGSPAMKEAVRHKFLSENRLDFTTDEITVSAGAKQIIYNAFMATLDPGDEVILPAPYWTSYMDVVRICGATPVVVACDAENGFRATAEQIERAITPRTRWLLLNSPSNPSGAAYGAEDYRPILDMLMRNPHVWLMADDIYEHIVYDGFEFVTPLALEPRLRGRTLTINGVSKAYAMTGWRIGYGAGPQPLVKAMSVIQSQSTSNPCSISQAAAIEALTGPQEFLAERRESFRERRDLVVTGLNTIEGIECRVPEGAFYAFAGCGGLLGRRTSDGSEIVSDRDLANYLLKDAKVAVVPGSAFGLSPFFRISYATSKSELTEALRRIGEACRRLVS

SEQ ID NO: 6187 - protein, 503 aa, Mesorhizobium sp. BNC1
MALKQETLEILSRLGVAAELLTGGDLVVRSPVTGEEIAALRTVSAAEANAAIEKADVAFREWRMVPAPKRGELVRLLGEELRAAKADLGRLVSIEVGKIPSEGLGEVQEMIDICDFAVGLSRQLYGLTIATERPGHRMMETWHPLGVVGVISAFNFPVAVWSWNAALALVCGDAVVWKPSEKTPLTALACRAIFEKAAARAGGVPEGLLAVLVGARDVGEALVDHPKVPLVSATGSTRMGRDVGPRLAKRFARAILELGGNNAGIVCPTADLDMALRAIAFGAMGTAGQRCTTLRRLFVHESVYGQLVPRLRKAYESVSVGSPLTTNALVGPLIDKAAYDGMLKALEAARALGGKVVGGQRVENGHADAYYVRPALVEMPEQAGPVLEETFAPILYVMKYSDFNEALRLHNAVGAGLSSSIFTRDIQESERFLSVEGSDCGIANVNIGTSGAEIGGAFGGEKETGGGRESGSDAWKAYMRRATNTVNYSTALPLAQGVSFDIE

SEQ ID NO: 6188 - protein, 346 aa, Brassica napus
  misc_feature (158)..(158): Xaa can be any naturally occurring amino acid
  misc_feature (246)..(246): Xaa can be any naturally occurring amino acid
  misc_feature (335)..(335): Xaa can be any naturally occurring amino acid
  misc_feature (339)..(339): Xaa can be any naturally occurring amino acid
MQTSAAPAIVSLAISVVLLWIWRTLKWVWFKPKMLESYLRRQGIAGTPYTPLVGDMRRDNSMSKEARSKPIKLTDDIISRVLPFSSHMLKTYGRTFFSWRGTIPSITITDPEQIKEVFNKVYDFPKPPSFPLAPPLISGLFSYDGDKWAKHRKNHQPXAFHLEKIKNMVPVFHQSCNEVVDKWDKMVSDKGSSCEVDVWPGLMSITEDVISRTAFGSSYKEGQRIFELQTELAQLIIQAFRKSYIXPGYRYLPTKDNRRIKAAAKETHDILRGLVNKRLRAREAGEAPNEDLLGILLESNLGQAKGNGMSIDDVIEECKLFYFAGQETTSVLLVXWTMXLLSQHQD

SEQ ID NO: 6189 - protein, 569 aa, Ustilago maydis 521
MGKDKVKKDANENTVEDDIPNFYCRRNPTIPRQDQPRPYAFLQRILSEHRVRTNDDGDQYEELDMLDGSLHRTGDPNLSDAGESMAVQAGSGIITAVQNGLSLRGTAGTLAETSASSDASTSAAQATTDPADLLGSSQSRIVSSGAAQVEEELPWFSQLSSYPQLRSAGIPLLPDDASSSKVGALSAVSNKKRPTTSASIVSASLSSLNGSSRPSSSSSAAGAFLSSSSAPLSRVTSPKTASTSTMEFAFQGSGSPASLSEAVSRAHRPNSSLLIPITSTLSSTGSTSSNVSTGRSPPEPRNTMYATAGPLKALPMSASTTTSIGTASSAPHTIPSTLSKFALTSGSGASNNPPSDFQEDLLPPDNFAMVNSHVYRSSFPKKKHFPFLRTLGLRSVLTLILEEYPETNSTFLDQNGITFFQFGIPGNKEPFVSIPTDKITSALVTILDRRNHPILIHCNKGKHRTGCLIGCLRKLQQWSLTTIFDEYRRFSWPKSRSMDQEFIELYDERAVWRDIDVRWLPKWTVLPLASLNLHGSRKIEDLEDEIDGVNDSEQGAEENQDQMTIWRGM

SEQ ID NO: 6190 - protein, 589 aa, Arabidopsis thaliana
MGVVEDTEPPLKRAKRLADEPNGFSANSSVRGSSVNSNSLGDLMARPLPSQGDDETIGSKGVIRKSEFVRIITRALYSLGYDKTGAMLEEESGISLHNSTIKLFLQQVKDGKWDQSVKTLHRIGFPDEKAVKAASFLLLEQKFLEFLKVEKIADALRTLRNEMAPLRINTKRVHELASSLISPSSFISHTTSTPGKESVNSRSKVLEELQTLLPASVIIPEKRLECLVENSLHIQRDSCVFHNTLDSDLSLYSDHQCGKHQIPSQTAQILESHTDEVWFLQFSHNGKYLASSSKDQTAIIWEISADGHISLKHTLVGHHKPVIAILWSPDDRQVLTCGAEEVIRRWDVDSGDCVHMYEKGGISPISCGWYPDGQGIIAGMTDRSICMWDLDGREKECWKGQRTQKVSDIAMTDDGKWLVSVCKDSVISLFDREATVERLIEEEDMITSFSLSNDNKYILVNLLNQEIRLWNIEGDPKIVSRYKGHKRSRFIIRSCFGGYKQAFIASGSEDSQVYIWHRSTGKLIVELPGHAGAVNCVSWSPTNLHMLASASDDGTIRIWGLDRINQQNQKKKLVQGSSSNGVIHRCNGN

SEQ ID NO: 6191 - protein, 276 aa, Staphylococcus aureus subsp. aureus Mu50
MGGYITMETLNSINIPKRKEDSHKGDYGKILLIGGSANLGGAIMLAARACVFSGSGLITVATHPTNHSALHSRCPEAMVIDINDTKMLTKMIEMTDSILIGPGLGVDFKGNNAITFLLQNIQPHQNLIVDGDAITIFSKLKPQLPTCRVIFTPHLKEWERLSGIPIEEQTYERNREAVDRLGATVVLKKHGTEIFFKDEDFKLTIGSPAMATGGMGDTLAGMITSFVGQFDNLKEAVMSATYTHSFIGENLAKDMYVVPPSRLINEIPYAMKQLES

SEQ ID NO: 6192 - protein, 230 aa, Nicotiana tabacum
MAAILARKSLSALRSRQLVLAGQAWQQGANTSNGTLLGTRTFATNDSFSTDKDDEEREQLAKELSKDWNSVFEQQINTLFLTEMVRGLMLTLKYFFEKKVTINYPFEKGPLSPRFRGEQPLRRYPTGEERCIACKLCEAICPAQAITIEAEAREDGSRRTTRYDIDMTKCIYCGFCQEACPVDAIVEGPNFEFATETHEELLYDKEKLLENGDRWETEIAENLRSESLYR

SEQ ID NO: 6193 - protein, 368 aa, Arabidopsis thaliana
MNEVTQLDGRGGLASAGNGVEGGVFVRSDHTSFMITDDLKVEITSVRLTLNVLKDLGYVDCEKLDEKIHDVNLEEVPTLLECLSTSDNPLTDTFLKKKSSYSTKRIQKLPSPGLCEDREESTPDQTITLNVVKKEGNILFVECGDDFVDLLFTFLAIPLESAWGIAGDGIIIGCIGNLSKSFKDLSVDPGREAKCVLPHYYKCQKQLLDAVTTHKPPTFYLYVSSMASNHIREYRLSEDSSKPLVYFWDELMPMISIDPKSKGSTNTTDESTIPSGGFMKRGTKFMITDDLIITPLNSTSTIGLVKEKQIRLDDVEVQEIIIRKEEAIRLLQASLVTCSALSTGLLAIESASTSVPQSANLKKPKIET

SEQ ID NO: 6194 - protein, 415 aa, Pseudomonas aeruginosa PAO1
MDTFSYRDAELFAEGVALSRIAERFGTPTYVYSRAHIEAQYRAYADALAGMPHLVCFAVKANSNLGVLNVLARLGAGFDIVSRGELERVLAAGGDPAKVVFSGVGKTRDDMRRALEVGVHCFNVESGEELERLQRVAAELGVKAPVSLRVNPDVDAQTHPYISTGLKENKFGIAIDEAEAVYARAAELDHLEVIGVDCHIGSQLTQLEPFLDALERLLGLVDRLAGKGIGIRHLDLGGGLGVRYRDEQPPLAGDYIRAIRERLHGRDLTLVFEPGRSIVANAGVLLTRVEYLKHTEHKDFAIVDAAMNDLIRPALYQAWMDVQAVRPRDAAPRRYDLVGPICETGDFLAKDRDLALAEGDLLAVRSAGAYGFVMSSNYNTRGRAAEVLVDGEQTHEVRRRETVQELYAGESLLPQ

SEQ ID NO: 6195 - protein, 478 aa, Yarrowia lipolytica CLIB122
MLPQYLINVATWSTFIAIFISTISILLQLYTYTRPADQRLVIRILFLVPLFALSSWLSLLETQDQISRPLARFNIVLSALKEIYEAFTLYTFFSLLTNLLGGERNIIFTTQGRAPLHTLFGKVNISDPHEFLTVKRAVLQYVWIKPVISVAIFICKILGVYKQGEISLTSGYTWIGIVYNVSVSLSLYALGIFWMCLHTDLQPYNPWPKFLCIKLIIFFSYWQGVVLALAQLMGIIQPESSAPLQDWFMCLEMTPFALLHMWAFPHDEYCQRDCGFARLPVWLALRDVLGIGDLMYDFKSTFWGKGYTYRNFDSVESVIVDHPDADSRVRKIMSGLRYTDGGRGKYWLSDESRDDHEGSGDSSSSSRDATEHSGLLAGQQSHVAASDQLLQIASIAEIDDSFDQWRNEDDSSKARDYGATDLATHIVEPVSEQELYDDDDLYYDAREQRFGDFNYRVKTVKEQRTWRSEHNGGLRREL

SEQ ID NO: 6196 - protein, 396 aa, Thiomicrospira crunogena XCL-2
MTGDFQRIKRLPPYVFNIVGDLKAEARRRGEDIIDFGMGNPDQDTPKHIVDKLIEVVQREGTHRYSVSQGIPRLRKAICNWYKTRYDVDLDMDTEAVVTIGSKEGLAHLALATVEKGDTVLVPNPAYPIHPYGFVIAGADIRHVRMTPDVDFFEELEKAIKESWPTPKMLVLNFPGNPTTQTVDLEFFEKVIAIAKEHDIWVIHDLAYADIVFDGYKAPSILQVEGAKDIAVEFYTLSKSYNMPGWRVGFMVGNPTLVHALKRMKSYLDYGTFTPIQVAAIAALEGPQECVQEICEMYKVRRDVLCQGLNSIGWEVEPPKATMFVWAPIPEAYRELGSLEFSKKLLTEAKVAVSPGIGFGDYGDDYVRFGLIENEHRTRQAIRGIRDMFRKDGLIG

SEQ ID NO: 6197 - protein, 137 aa, Physcomitrella patens
MRWIVGGGVQRTIASPGRGILAIDESNATCGKRLASIGLENNEVNRQAYRQLLCTTPGLGEYISGAIMFEETLYQSTSDGKKMVDCLVEGGIVPGIKVDKGLVPLAGSNEESWCQGLDGLASRTAAYYKQGARFAKW

SEQ ID NO: 6198 - protein, 1518 aa, Kluyveromyces lactis NRRL Y-1140
MSSESTTGRKTNEDGRNSIHSTDSYAQSVNSFHYEEDNESQNAASQLSRQITTILSQENGADRIESLARVISTKTKKQMESFEVDQLDFNLKALLDYLRNSQISQGIESGDSGVAFNDLTAVGVDASAAFGPSVEELIRSWGHLPVHLWKKMTGKKDDVPLRNIIQHCVGVVESGEMLFVVGRPGAGCSTLLKCVSGETSELVEVTGDFSYDGLSQAEMMEKFKGYVIYCPELDFHFPKITVKETIDFALKCKTPRVRIDHLSRNQYVDNMRDLWCTVFGLRHTYATNVGNDVVRGVSGGERKRVSLVEALAMSASIYSWDNATRGLDASTALEFAQAIRTATNLMNNSAIVAIYQAGENIYELFDKTTVLYNGKQVYFGPATEAVGYFERMGYIKPNRMTSAEFLTSVTVDFANRTLAIKDGYEEKMPKSSTEMEAYWHNSEEYQRAVEYYHQYCAAHPEEETRQRLELAKHQRLQKGQRAKSQYVVTFWSQVWYCMMRGFQRTKGDFTYTKVYLSSFLTKGLIVGSMFHKIDPKSQSTTDGAYSRGGLIFYVLLFAAVTSLAEISNSFHNRAIVVKHKTYSMYHTSAESLQEIFTEMPTKFVAVLTLSLVSYWIPVLKYDAGSFFQFLLYLFTTQQCTSFIFKLVATLTKDGGTAHAIGGLWVLMLTVYTGFVLPIGEMHHWIRWFHYLNPLTYAYESLMSTEFHGRQMLCSQLIPSGPGYEGVSISNQICNAAGAIAGNLYVSGDTYVLKKYHFSYNHAWRDWGINIVWTFGYIVMNVVMSEFLKPLEGGGDLLLYKRGHMPELGSESVDTKVASREEMMASLNGPDVDLAKIIESKDVFTWNHLNYTIPYDGATRQLLSDVFGYVKPGKMTALMGESGAGKTTLLNVLAQRISVGVITGDMLVNAKDLPLSFNRSCGYVAQSDNHMGELSVRESLRFAAELRQPKSVPLQEKYDYVEKIISLLGMEKYAEAIIGKTGRGLNVEQRKKLSIGVELVAKPSLLLFLDEPTSGLDSQSAWSIVQFMRALADSGQSILCTIHQPSATLFEQFDRLLLLKKGGKMVYFGDIGENSGTLLNYFERQSGVKCGISENPAEYMLNCIGAGATASASEDWHDLWLKSPECAAAREEVEELHRKLASRPVTDDKELSGKYAANYLTQLKCVFGRTWLQFWRSPVYIRAKFLECVLCALFVGLSYVGVNHSIAGANQSFASIFMMLLIALAMVNQLHVFALDSRELYEVREAASNTFHWSALLLCHCTVEIIWSTACEFICWICYYWPAQYTGRASHAGYFFLIYVIMFPAYFISYGCWVFYMSPDVPSASMINSNLFAAMLLFCGILQPREKMPGFWKRFMYNVSPFTYVVQSLVAPIVQGKKVVCGRNEFAVMDPPEGQTCGEYLSTYIEDNTGYLTNPNDTQSCQYCPYSYQQEVVARFNVKWVYRWRNFGFLWAYIIFNFFAMLFCYWVMRVKNYSVTSIFKIFKIGTWKNAIKPKDRHEKDTTIFQEKPGDAENVNRTKN

SEQ ID NO: 6199 - protein, 753 aa, Magnetococcus sp. MC-1
MQGWDTIYEGVISYHAEADLSPLKRVVDLFEEIQWPAETIDRDSPIHPLVIAKTLLKMRMDVASLACALLVHPYSQRRFELDTVKQRFGDDIAFLLEGISRISLLSLRTPEKKQKETTIEEPEEGASLEDGPPTPRSVGEMIGEIHHGTILVRDENQAEGFRKLVLAMAKDIRVILIRLVLCLHQLRLAMRMGPVASVANLSHEVMEIYAPIAHRLGVYWLKNELEDLAFRMQWPGQYDAIRAKVLERRKGGEDVVQKVIAILGDKLVSHHIQGQVFGREKHLYSVWSKINRKQITLDDMFDLIAYRIIVPNKEDCYRTLGMIHSEFKPIPGRFKDYVAIPKRNGYQSLHTVVFGPFGNRIEIQIRTEKMHQIAESGVAAHWSYKGKGGGGNSTTGYAWLKDLLALQESVDDPGQFVENVRFDLFPEEIYVFTPNGEIITLPSKATPVDFAYAVHSQVGNSCQGAKINGRIVPLKTPLVTGDTISIITGKNREPNPNWLQFVVTSKAKYWIGRFVKEKQRQQSIGLGREILEREGRKVGSSITEKQLRVVLETFRCENIDDLYYNIGISRVSALQVVHKLFPGSAPAFTERKNQVARAGVERRGDKLALTGALEGIAVQAARCCSPLPGDVVVGIINTGRGITLHRISCNNLKSMEDQPERWVEDINWGGDKLLAHTARIRAMVSNRRGLLTPISQVITEAKANLLDVHVQDRDRDPCMVVLEVEVINHDHLERVLANLRSVPEVRSVDRMNA

SEQ ID NO: 6200 - protein, 581 aa, Zea mays
MDQKKAMRSHHSHMSPWQRGLAARRGWCQQAAARPTTVLVIVVTVFAALLLAVVLFGVRLTPLGANNTWVSAGVRVVLKAVSDSDHGTGPLATVPDPSDRLLGGLLSPDFDESSCLSRYSAALYRRPSLHAVSTYLVSALRRYESLHRRCGPGTPGYARAVELLRANASAAASSSSGSCSYAVWAPIEGLGNRMLSITSAFLYALLTDRVLLLHSSGGGGDLDGLFCEPFPGSTWILPAAPGDTGFPIRGIERLTDRYHHQSLGSVLRRGEDPGAAPWLYVHLRHDYTKDSRDQQFFCDDVQARLGAVPWLVFRSDNYFVPGLFLVPRHEAELARMFPRRDVVFHHLGRYLFHPSDTVWGMVTQYHDSYFASADERVGIQVRRFYWAPISTDDLFAQILNCSQREDILPSVGVPAAKGGSDGQQPAKQKAVVVVSLHGEYSEKLRDLYQGHGGAAGGQEAVSVHQPTHLGSQRSGEQQHNQKALAEMVLLSFSDALVTSAVSTFGYVGQGLAGLRPWVLTSPVDRKGPGMPLPCRRAATVEPCFHAPLDYDCRAKAKGDAGRRVRHIRHCEDFPRGVQLVE

SEQ ID NO: 6201 - protein, 251 aa, Bacillus halodurans C-125
MRKPIIAGNWKMNKTVGEAKAFVEEVKGAIPSSDKVDSVVCSPALFLEGLVQKAEGTELRIGAQNMHFEESGAFTGEISPVALSDMKVDYVILGHSERRDMFAETDELVNKKTHAAFAHGLTPIVCVGETLEEREANQTYDVVKTQVEKGLEGLTDEQVKVTVIAYEPVWAIGTGKSSSAEDANDVCSYIRKVVTEKFSQEAADAVRIQYGGSVKPANIAEYMAQSDIDGALVGGASLDPQSFLQLLEAVK

SEQ ID NO: 6202 - protein, 394 aa, Bacillus halodurans C-125
MNKQSVRDVELQGKKVFCRVDFNVPMKDGVVTDDTRIRAALPTIQLLAEKGARIILASHLGRPKGEVVEELRLDPVAARLQELLGKPVAKVNVAHGPEAEQAANELKDGDVLLLENVRFYPGEEKNDPELAKAFASLADVYVNDAFGAAHRAHASTEGIAHHVTAVAGLLMEKELEVLGKALSNPERPFTAIIGGAKVKDKIGVIENLLDKVDNLIIGGGLAYTFIKAQGHEIGKSLLEADKMDLALSFMEKAKEKGVNFYVPQDAIVADDFSNDANTKAVDIDQIPADWEALDIGPKTRETYRNVIQSSKLVIWNGPMGVFELDAFAGGTKAVAEALADANDTYSVIGGGDSAAAVEKFGLANQMSHISTGGGASLEFMEGKALPGVVALNDK

SEQ ID NO: 6203 - protein, 335 aa, Bacillus halodurans C-125
MATKIGINGFGRIGRNVFRAALNNPNVEVVAINDLTDANMLAHLLKYDSVHGKLDAEVKVDGDSLVVNGHSVKVKAERDPAQLGWGDLGVEVVVESTGRFTNREDAAKHLEAGAKKVIISAPAKDEDITVVMGVNENKYDPANHHVLSNASCTTNCLAPFAKVLNDKFGIRRGMMTTVHSYTNDQQILDLPHKDYRRARAAAENIIPTTTGAAKAVALVLPELKGKLNGGAMRVPTPNVSLVDLVAELDKEVTAEEVNAALKEAAEGDLKGILAYSEEPLVSGDYNGNPASSTIDALSTMVMEGNMVKVISWYDNESGYSHRVVDLVDYIAKQGL

SEQ ID NO: 6204 - protein, 356 aa, Oryza sativa (japonica cultivar-group)
MERLISKSVAARIPLPGGGSPSRRLAVAGLGGGGGVEPWAGRLRAQPRLGPIAARPHDGVSAPPREAAPAAAVGPPWKLLWSLLPKASRAALFLLVALVTGTLQSSIPYPAHASVQSITKTGGLFTSEILSSGWAGFIAGCLHTLSGPDHLVALAPLSIGRSRLESGLVGALWGCGHDAGQVIFGLLFLLLKDRLHIEILRTWGTRVVGLTLLIIGGMGIREATEVQESSLALEGVDCNITSSEPLQTPAAPRKKKVGFATFATGVVHGLQPDALLMVLPSLALPSRFAGAAFLGMFLMGTVFSMGSYTAFVGSCSEALKEKVPRITEKLTWAASLVAICMGIALLVGQFFGFSLY

SEQ ID NO: 6205 - protein, 295 aa, Kluyveromyces lactis NRRL Y-1140
MSELTNYKRLEKVGEGTYGVVYKAVDLRHQNRVVAMKKIRLESEDEGVPSTAIREISLLKELKDDNIVRLYDIVHSDAHKLYLVFEFLDLDLKRYMESIPKDQPLGGNIIKKFMMQLCKGIAYCHAHRIIHRDLKPQNLLINRDGNLKLGDFGLARAFGVPLRAYTHEIVTLWYRAPEVLLGGKQYSTGVDVWSIGCIFAEMCNRKPLFSGDSEIDQIFKIFRVLGTPNERTWPDIIYLPDFKTTFPKWNRRNLSEVIPSLDANGIDLLDKLITYDPIHRISAKRAVQHPYFKEE

SEQ ID NO: 6206 - protein, 421 aa, Oryza sativa
  misc_feature (29)..(29): Xaa can be any naturally occurring amino acid
  misc_feature (403)..(403): Xaa can be any naturally occurring amino acid
AAGFGTSLLDLIVGHGVAMLSAATVPLQXGGGLSDFSGLRSSSSLPLRRDATSDNFMNPVSFRTHAVGTNGGARRAPTEAKLKVAINGFGRFGRNFLRCWHGRGDDSPLNIIPINDTGGVKQASHRLKYNSTLGIFDADVKPVGENPLSVEGEVIKVVSDRNPSNLPWGELGIELLIEGTGLFFNANGAGKHIQAGAKKVLITAPGKGDIPTYVVGVNADQYSPDEPIISNASCTTNCLAPFVKILDQKFGIIKGTMTTTHSYTGDQRVFDGSHRDLRRARAAALNIVPTSTGAAKAVALVLPNLKGKLNGIALRVPTPNVSVVDLVVQVSKKTLAEEVNQAFRDSAANELKGILEVCDVPLVSVDFRCSDVSCTIDASLSMVMGDDMVKVIAWYDNEWGYSXQRVVDLADIVANPVEVRT

SEQ ID NO: 6207 - protein, 557 aa, Rhodobacter sphaeroides 2.4.1
MAVQTDIEIARAARKKPIQEIGAGLGIPAEALIPYGHDKAKVGQGFIRGLEGRPDGKLILVTAINPTPAGEGKTTTTVGLGDGLNRIGKKAVICIREASLGPNFGMKGGAAGGGRAQVVPMEDMNLHFTGDFHAITAAHNLLAAMIDNHIYWGNALELDARRITWRRVMDMNDRALRDTVVNLGGVANGFPRQTGFDITVASEVMAILCLADDLEDLERRLGRIVVGYRRDKSPVYCRDLKAAGAMAVLLKDAMQPNLVQTIENNPAFVHGGPFANIAHGCNSVIATRTALKLADYVVTEAGFGADLGAEKFFDIKCRLAGLKPSAAVVVATVRALKMNGGVAREDLGREDVAALRRGCANLGRHIANVKGFGVPVVVAINHFTTDTEAEIEAVRAYAAGQGAEAFLCRHWAEGSAGIEDLAQKVVELAETPSMFAPLYPDDMPLFEKMETVARRIYHAHDVIADHVIRDQLRTWEEAGYGALPVCMAKTQYSFTTDAAIRGAPEGHSIPIREVRLAAGAGFVVAICGEIRTMPGLPSQPAAELIHLDEEGRIEGLF

SEQ ID NO: 6208 - protein, 709 aa, Ralstonia metallidurans CH34
MSRLTRLWPLAAIAAASLTACGGSDSGTASTPAATTSGVVTGSYFEHAKVCIDANANAQCDSGEASTYTDAKGAFTLTGQGAVVAEIGTDAFRNDDTGAHNAVTRKLVFRAPAGANAVVSAISTELAALMDSNGGKLDDARNQLATRLGVTADKLLEDHNKETDSNIKATLQAEIEQAIDLIATAVASGGDIGTAIRDGVTKRVALQNIKNVVVIYAENRGFDNLYGLFPGANGIPGVNPTAVGTVEPQKDFDGSTLASLPPTWGGFTASGQTVTLPQASTVGWANKPFRIDDPAGVNGTGVVVGQNVITRDLVHRFYNNQMQINGGKNDKFTAFSDAGGLVMGYYDGSAMSMWKLAQQYTLADNFFMGAFGGSFLNHQYLVCACAPVYPNAETSVASGSISVVDTDANGNFKSLSLKPTSPASIQTGTAQYVNDSTLTAKDGTGVYYAVNTMQPPYQPSGNAPASTDSTKLLADPTKATTLPAQTQDTIASLLDRRGISWAWYSGAWSAVTANSALIYNNTTPNFQPHHQPFNYYSAFSPIDHADYRAAHLKDYDSSFLADAAAGKLPAVSFYKPQGNLNQHAGYANVTDGDAHIANVIAQLQKSPQWNNMLIVVTYDENGGFYDHAPVPKADRWGPGTRIPAIVISPFAKRGFVDHTQYDTASVLRFITHRFALPTLPGLKLRDDSLIANGKPAMGDLTNALTFPAQ

SEQ ID NO: 6209 - protein, 130 aa, Magnetococcus sp. MC-1
MHQKIAIATPHAPQAIGPYSQAIQQNGWLYISGQIALDPTTGVVVGQGDVGAETHRVMQNLAAILEAAGGGFKDVVKCQIFLADMDDFATVNEIYASYLSEPFPARATVQVAKLPKGVKVEIDATAFVGG

SEQ ID NO: 6210 - protein, 466 aa, Arabidopsis thaliana
MLYEGYLKYMKAKYGERSQGTYFMAGEDLISKLPDSLITQILLYLPIKDIVRTSSLSSRWKSLWLLIPRLDLDSEEFQDYNAFVGFMNKFIDFSGEEKICLDKLKLSSRKTVNDLPCVTRWIDFVVRRKLKHLDVECLVNRKFLEEMPLSLYVCDTLVNLRLHRVLLGKFEAVSLPCLKTMRLEENVYANDVVLESLISSCPVLKDLIILRMFEDNVKVLRVHSLTLTSLNIDFNFGEGDDFVDGFDKKVSGVLIDAPRLKYLKFQDDLSGSKIITNSGSLAKVNVVYVFNENDCADVVDIPRRNMVRNFLTSISGVSDMKISQHFVEFLYYYKDFDPLPQFCNLSRLKAEISLYFLEILPTILESCPNLKSLVMVLEFYLQEEDEPIIFSSVPRCLVSSLESVEIKKFNGRPAKMEVARYFLENSGVLQKLVLHLRCSTHEDGFYILKDLLALPRGSSTCRIVVC

SEQ ID NO: 6211 - protein, 72 aa, Glycine max
SSSQVLRTRNRAGAGMGAPFTGLKSMAGLKTRKTNDDITYIASNGCRVQCMHETTPIGMKNLETLDYLPDDL

SEQ ID NO: 6212 - protein, 136 aa, Glycine max
HASDHAYGCELRRRSKWLPSMISSPAVTTVNRAGAGMVAPFTGLKSMAGFPTTKTNNDITSIASNSGRVPCMQVWPPACTKNFETLSYLPYLDDAQLAKAVVYLPKKAWISCWAFELEHVYLYREHIMSPGYYYGR

SEQ ID NO: 6213 - protein, 368 aa, Triticum aestivum
MEMLSMLKVGYTVLRSETPATDLVNTFMDWAARRSLLLLALFMPPYYVYKLTASAAATVAPQDVAGKVVLVTGASSGIGEQIAYQYAKKGARLALVARREGSLREVAAKATDLGSPDVLVVPGDVARPEDCKAFVQATVERFGRLDHLVNNAGLVNVCWFEEMPDVATFKQVLDVNFWGTVHPTHAALPHLTRSRGKIFVNSSAAAVLAMPRMSFYNASKAAVLSFADTLRMELGDEVGVTVATPGWIESEMTKGKHLSKGGRVEVDQDTRDAQVGLFPVVRAERCAEAIVDAVCRGRRSVTVPLWYRALFLWRSLAPEVGDVLQRVFYRRSSGDGGRQMRARRVLEVTGAKRVLQPPSLHTSDIKRE

SEQ ID NO: 6214 - protein, 201 aa, Schizosaccharomyces pombe 972h-
MSENYSFSLRKFKLVFLGEQSVGKTSLITRFMYDQFDNTYQATIGIDFLSKTMYLEDRTVRLQLWDTAGQERFRSLIPSYIRDSSVAIIVYDITNHNSFVNTEKWIEDVRAERGDDVIIVLVGNKTDLADKRQVTQEEGEKKAKELKIMHMETSAKAGHNVKLLFRKIAQMLPGMENVETQSTQMIDVSIQPNENESSCNC

SEQ ID NO: 6215 - protein, 107 aa, Glycine max
PKLEELNLSRSGVDDEMLSVISKCCRGLLHLDLENCSGVTANGVRQVVGKCTRLREINLGSCDEVGANVVAWMVFSRPSLRRIMAPPSFDLSDGQKELLLRHGCLVC

SEQ ID NO: 6216 - protein, 1473 aa, Schizosaccharomyces pombe 972h-
MSVKASINNSQEAVSRIAFRCSDALYVVHPNNSILNGALTESLKDLKKFETLNVSGKVPHVLPLKSHADPFAHIADAILAEEEVASTQPKQITSVVASADALFFATPHLYKLAHEPLVAHVAIESTEAFDFASVRDTGFVILFSGNRPGDSSEAALEDTLETASLAHRLALKLNTGVLHFYSPVYDTTAALENIETLPSKEDAQHARVAHIPIEEKQEDSEKEGNIKEAFVPPKFDQPERDAATSEYLESLSIKPFEYSGSDDATDVLLVFGSAASELAKAAVTSSVAVAIVRVLRPWLPSKLQEVLPTSTKRLTVLEPITSLPRKWDPLYLDVLSSFVASGSSIELFAVRYGLSSSEQATEIIKAVRDNLSGALKPSLVCDFTDGVSQVFVPTPPSIEEAYHKLLHRVFKSRLNIVNDPASSATKQNIPSRLIISPQFALGSVLEYENQRRAFCDEVATLLKEKNSSVSSESLEVLSNWIVSVDNLESPVDPELVISELKKDSSAPIKSLLDRSEFFTNVSHWIIGSDAWAYDLGNSALHQVLCLEKNVNLLIVDTQPYSTREAVRSSSRKKDIGLYAMNFGNAYVASTALYSSYTQLISALLEADKFKGPSVVLAYLPYHSADDDAITVLQETKKAVDIGYWPLYRWTPALEDGEYSDFKLDSERIRRELKTFLERDNYLTQLTLRVPSLARTLTQSFGAEVRHQQNVDSRNALNKLIEGLSGPPLTILFASDGGTAENVAKRLQNRASARGSKCKIMAMDDFPIEELGNEKNVVVLVSTAGQGEFPQNGREFWEAIKGADLNLSELKYGVFGFGDYEYWPRKEDKIYYNRPGKQLDARFVELGAAPLVTLGLGNDQDPDGWETAYNLWEPELWKALGLDNVEIDIDEPKPITNEDIKQASNFLRGTIFEGLADESTGALAESDCQLTKFHGIYMQDDRDIRDERKKQGLEPAYGFMIRARMPAGVCTPEQWIAMDDISTKWGNHTLKITTRQTFQWHGVLKKNLRNTIRNIVKVFLTTLGACGDVARNVTCSSTPNNETIHDQLFAVSKQISNELLPTTSSYHEIWIEDPETVEKRKVAGEAVQDVEPLYGPTYLPRKFKVGVAAPPYNDVDVYTNDVALIAIIENDKVLGFNVGIGGGMGTTHNNKKTYPRLATVVGYVLTDKIMEVVKAILIVQRDNGDRENRKHARLKYTVDTLGVSTFVEKVEEVLGYKFEEARDHPQFIKNHDDFEGWHKTEKNKYWRSIFVENGRIENNGILQFKTGLRELAERLYTEKSEAEFRLTANQHVILFNVAENELGWINEHMAKYKLDNNAFSGLRLSSAACVALPTCGLAMAESERYLPKLITKVEEIVYEAGLQKDSIVMRMTGCPNGCSRPWVAEIACVGKAPNTYNLMLGGGFYGQRLNKLYRSSVQEKEILNLLRPLIKRYALEREDGEHFGDWVIRAGIITAVENGGANGAVHEGVSPEAF

SEQ ID NO: 6217 - protein, 549 aa, Zea mays
MARRAASSLVSRCLLARAPAGAPPAAPSAPRRTVPADGMHRLLPGVLQRFSTAAAVEEPITPSVHVNYTKLLINGNFVDSASGKTFPTLDPRTGEVIAHVAEGDAEDINRAVAAARKAFDEGPWPKMTAYERSRILLRFADLIEKHNDELAALETWDNGKPYEQAAQIEVPMVARLMRYYAGWADKIHGLIVPADGPHHVQILHEPIGVAGQIIPWNFPLLMYAWKVGPALACGNTLVLKTAEQTPLSALYISKLLHEAGLPEGVVNVVSGFGPTAGAALASHMDVDKIAFTGSTDTGKIILELAAKSNLKTVTLELGGKSPFIIMDDADVDHAVELAHFALFFNQGQCCCAGSRTFVHERVYDEFVEKAKARALKRVVGDPFRKGVEQGPQIDDEQFKKILRYIRYGVDGGATLVTGGDRLGDKGFYIQPTIFSDVQDGMKIAQEEIFGPVQSILKFKDLNEVIKRANASQYGLAAGVFTNSLDTANTLTRALRAGTVWVNCFDVFDAAIPFGGYKMSGMGREKGVDSLKNYLQVKAVVTPIKNAAWL

SEQ ID NO: 6218 - protein, 373 aa, Arabidopsis thaliana
MVPPELEFNKYLGKGSYGSVSLFKYSKPRTTLYTAVMTCNYKNAESLEKEFGILSEFKGCSRIVQCYENRVIENLDVEGNKEYMMLMEYAAGGSLRTFMKRSEDKKLPDPLIREFTRMILEGLATIHGQGYVHCDLKPDNILVFPRCVYKKRAWRSSYELKISDFGLSKRDGDSKWWHPHRPFVGTAIYMSPGSVSHGETGRGLDLWSLGCVVLEMYTGKKPWWHNNYDLKDLKNWYAPMIPSDLPCDAKHFIMACFALNTNERRDALTLLEHSFLRGVVNKITKPHVKNENPKEIALALGRVVRRPSKVLTSIFKRAGELMKIIKKQPRAPRSNLLPVHICHLAQPSQKICFFIYCSLCVVFIILTVVCMFR

SEQ ID NO: 6219 - protein, 318 aa, Arabidopsis thaliana
MVALDLEFERYPGERSFGSVSLFKYKRQRDGETQYAAVKTSSDENAKSLYKEFQILSQFKGCSRIVQCYGNGVKEIFNDKGYVEYKIAMEYAFGGSLSDFMDRFKDRKLSDSMIREFTRMLLEGLATIHRHGYVHCDLKPENILVFPSSVYKNGAWIRSYELKISDFGMSKRDGDTQWWQPRKPYVGTPIYMSPESISHGEIGKGLDLWSLGCVVLEMYTRKKPWWHTNYELEELMKCYEPLFPRNLPCDAKLFLMTCFASEPDERKDALTLLRQSFLHGDVNKFTNRQMNVKIDSADDFTLQLEKVSQMLSEIRTMC

SEQ ID NO: 6220 - protein, 882 aa, marine gamma proteobacterium HTCC2143
MQDIDPTETAEWLEALSDVLGQADGPDRATFLLKTMAERMAQSGSQVPAAITTPFRNTIKPTDERRMHGDLFMERRIRSLIRWNALAMVMRANDNDDGLGGHISSFSSAATLYDIGFNYFFHGNDDSPGDLIYYQGHSAPGMYARSYLEGRITEEQLDNFRREVGGNGLSSYPHPWLMPDYWQFPTVSMGLGPIQAIYQAHVMKYQQSRELVDHSGRKVWAFLGDGECDEPESLGAIALAGRERLNNLIFVVNCNLQRLDGPVRGNGKIIQELEGVFRGAGWNVIKVIWGRHWDILLEKDQTGLLKKRMNEVFDGELQNYKANGGAYTREHFFGKYPELLELVKDLSDDDIMYLNRGGHDPYKVYAAYAEAVEQTDKPTVVLAMTVKGYGMGASGEAQNETHSLKKLDIESLKTFRDRFAIPVSDDELKDVPYYRPAQDSPELVYMRTRREELGGNIPSRNSDFDALTVPSLEDLKSQLKSSGKRKISTTMSFVRTLSTLTKDKTIGHRVVPIVPDEARTFGMEGMFRQLGIYSSQGQRYTPHDADQIMYYKEDKKGQILEEGINEAGAFSAWLAAATSYSNHRFPMIPFYIFYSMFGFQRIMDLAWAAGDSQARGFLMGATAGRTTLNGEGLQHQDGHSLLMANMIPNCVAYDPTYAYELTVIIQNGLKRMYTEKENCFYYITIENENYVHPDMPADCEEGIIQGMYLLERSAGDMPHTVQLMGSGAILREVREAAKLLRDNYSINADVWSMTSINQLRREGLECERWNLINPEQPAKTAFVARQLEQHMGPVICATDYIKSYGEQIAPFIRRQYRVLGTDGFGRSDTRAKLRYHFEVDRYFIVLAALKSLVDEGSIDVSIATAAAKKFGITGDKTSPMHC

SEQ ID NO: 6221 - protein, 130 aa, Magnaporthe grisea 70-15
MVRTSVLNDALKSINNAEKAGKRQVMIRPSSKVITKFLSVMQKHGYIGEFEELDDHRSGKIVVQLNGRLNKTGVISPRYNVRLADLEKWVVKLLPARQFGYVILTTSAGIMDHEEARRKHVAGKIIGFFY

SEQ ID NO: 6222 - protein, 211 aa, Bacillus halodurans C-125
MNVDDLTFDDKGLIPAVVQDAQSKEVVTVAYMNRESFEKTVETGETWFYSRSRQELWHKGATSGHTQKVVDIRYDCDGDALVVLVELKGPACHTGKYSCFFESVFGKKIYGASDRFGIIATLEALIAEREAEMPEGAYTTYLFEKGVDKILKKVGEEATEVVIAAKNRDAEELKWEVADLLYHLLVLLREQKLPVDEVLAVLEERHRPKEE

SEQ ID NO: 6223 - protein, 413 aa, Methanococcus maripaludis S2
MKRIALGFQHVLAMFGATVTVPLVVGYAIGLSMSEIALLLQAVLLAMGVATLLQTFAGSRFPIVQGSSFAFIPGLIAVGSGMGLAAVEGALIIGGVIEAITGALGLIGKLKKLFSPIVTGVTIMLIGFSLADVAVQYSFNYFADPTGSSIVTSILVAALTFITTILVSLQGKGTLKAMPVIIGAVVGYVISIFLGLVDFSMMNQLSWFALPKLMPWGMPVFDVNAIIILLFAFMVSIIESVGDYHAISTIADLKIDDNKINRGIASEGFSCTLAGLFGACGTTSYSENIGLVALTKVSSVQVVQIGAVILVLLSMIPKFSGLLASIPAPVLGGLTTALYGMISITGLKLIKDKVELNDRNTLILASALVLGLGAPQLPAEFLSLFPKIISSILESGMAVGAITAILMDQLLKK

SEQ ID NO: 6224 - protein, 515 aa, Magnaporthe grisea 70-15
MKNPISSLDVPTPPATTIPTLSSPAPLLRPAIPGARSAGARTPRLGLAIPPSPNVKPVGGAPGRPPLPTLHLATPMGSSVTPHEQPPGRPSIVTQQGQSASGGSESSAAHSRSGSFGPLDGRTSNPTSAGSQYSALSFASHFGIGSTRPQGTPDPASAVGSIYSERSDGGAGMDKDGNLKGLENFDKLTIDKARTADVEDLDVEGWKIASMEKRIVELGGLGEGAGGAVTRCKLTGGKTVFALKVITANPDPDVKKQIMRELDFNIQCASEHICRYYGAFEDPSTATISIAMEFCEGGSLDSIYKEVKRLGGRTGEKVLGKIAEGVLRGLTYLNSKKIIHRDIKPSNILLCRNGDVKLCDFGVSGDFGTKGEANTFIGTSYYMAPERITGQSYTITSDVWSTGVTLLEVAQHRFPFPADGTEMAPRAGLIDLLTYIVRQPIPKLKDEPSAQISWSENFKYFIECCLEKDPQRRASPWRMLEHPWMVDMKSKRVNMTRYLAQVWGWDDKGEAKPAE

SEQ ID NO: 6225 - protein, 373 aa, Aspergillus oryzae
MAPLVPSQAELDRRRLVDINLETVSNIPSTDFPGHWPGESHEWNLEKFRNEFNVEFHRNERFESSFSLIGVDASIANAFRRIVMAEVPSVAIEFVFVHNNTSVIQDEVLAQRLGLIPLKGSVDGINWMRWFKKATEDDPEGSDPSDYNTIVLRLDIECTKNPNADATENDPRKLYKNAHVYARDITFHPVGRQEQFFTGEDAIQPVNPDILIAKLRPGQKIDLEMHCIKGIGADHAKFSPVATASYRLLPDIQILRPILGEDAKKFAKCFPKGVIGLEPVTREEAAKQGSGYEGHEGETKAVVRDAFKDTVSRECLRHEEFQGKVKLGRVRDHFIFNIESTGQFDSDVLFLESVKVLKLKCARWKRGLADLMR

SEQ ID NO: 6226 - protein, 476 aa, Aspergillus oryzae
MAASFTRLAGSAPKRLCLRPSTFTKYNAIPRSRSIATTLPRRQAEPTSYQATRLIPTDPTFTSLANKEGPQEADVAAGLESESEGVGRKIRHYTVNFGPQHPAAHGVLRLILEINGEEIVRADPHVGLLHRGTEKLIEYKTYMQALPYFDRLDYVSMMTNEQCYSLAVEKLLNIEIPDRAKYIRTMFGEMTRILNHLMSVLSHAMDVGALTPFLWGFEEREKLMEFYERVSGARLHAAYVRPGGVSQDIPLGLLDDIYQWATQFGDRIDETEELLTDNRIWKARTQGVGVVSAADALNMSFTGVMLRGSGVPWDIRKSQPYDAYDKVEFDVPVGVNGDCYDRYLCRMEEFRQSLRIIHQCLNQMPAGPVKVEDYKLSPPPRAAMKENMEALIHHFLLFSKGYAVPPGETYSAIEAPKGEMGVFLVSDGSERPYRCKIRAPGFAHLGGFDQISRGHLLADAVAIIGTMDLVFGEVDR

SEQ ID NO: 6227 - protein, 990 aa, Glycine max
  misc_feature (86)..(86): Xaa can be any naturally occurring amino acid
FGSRLFLLLSLPPTLSLNQDGLFLLQAKLQLSDPQNALSDWNHRDATPCNWTAVTCDAATGGVATLDFSNLQLSGPVPATTLCRLXSLASLNFSYNNLNATLPAAAFSACAALLHLDLSQNLLSGAIPATLPDSLVTLDLSCNNFSGDIPASFGQLRQLQSLSLVSNLLAGTLPSSLGNISTLKILRLAYNTFDAGPIPKEFGNLKNLEELWLAGCSLVGPIPPSLGRLSNLLNLDLSQNNLVGDIPEQLVSGLRNIVQIELYENSLSGALPRAAFTNLANLERFDASTNELTGTIPEELCGLKKLGSLNLYENKLEGSLPETIVKSLNLYELKLFNNSLTGSLPSGLGKNSKLQSLDVSYNRFSGEIPARLCDGGALEELILIYNSFSGRIPETLEECKSLRRVRLGNNNFSGVVPEGLWGLPHLYLLELVYNSLSGSISNSISGAWNLSMLLISGNKFSGSIPEGVGELGNLEKFVANNNSLTGRIPKSVFRLSQLDRLVLGDNQLFGEIPVGVGGCKKLNELDLANNRLGGSIPKELGDLPVLNYLDLSGNQFSGEIPIELQKLKPDLLNLSNNQLSGVIPPLYANENYRKSFLGNPGLCKALSGLCPSLGGESEGKSRKYAWIFRFIFVLAGIVLIVGVAWFYFKFRDFKKMKKGFHFSKWRSFHKLGFSEFEIIKLLSEDNVIGSGASGKVYKVALSNGELVAVKKLWRATKMGNESVDSEKDGFEVEVETLGKIRHKNIVRLWCCCNSKDSKLLVYEYMPNGSLADLLHNSKKSLLDWPTRYKIAIDAAEGLSYLHHDCVPSIVHRDVKSSNILLDDEFGAKVADFGVAKIFKGANQGAESMSVIAGSYGYIAPEYAYTLRVNEKSDIYSFGVVILELVTGKLPLDPEYGENDLVKWVQSTLDQKGLDEVIDPTLDIQFREEISKVLSVGLHCTNSLPITRPSMRGVVKKLKEVTELPKSLSGKLSSPYFQEEASDIDHEGSLV

SEQ ID NO: 6228 - protein, 413 aa, Ralstonia metallidurans CH34
MTPPVSSHAKPRLVVVGNGMAGMRTVEELLKLAPDLYDITVFGAEPHGNYNRILLSPVLAGEKTVDDIMLNTRAWYGQHGIELLAGDPVVAIDRPRRLVRSASGKEVRYDRLLLATGSKPFIIPVPGHTLDGVIAFRDIQDVETMLHAARNHRHAVVIGGGLLGLEAANGLMRQGMDVTVVHLADSLMERQLDKPAAELLKAALERKGLRFLLSAQTAAVLGSERVTGVLFKDGTQIPADLVVMTAGVRPNIELAASAGLRCERAIVVDDTLQTFDPRIYAVGECVQHRQATFGLVAPIWDQARVCAAHLAGAGHRRYVQQATATKLKVTGVDLYSAGDFIGGDNSEDLVLRDPRRGVYKRLVLQGGRLVGAVLYGDVQDGPWYFDLIQTGQPVAALRQRLLFGKAQCEALAA

SEQ ID NO: 6229 - protein, 915 aa, Ralstonia metallidurans CH34
MNLSDIAVVATTPTKTISTTCPYCGVGCGVRATVRADGLVDIAGDADHASNAGRLCVKGSALGETLDLNGRLLHPQVRDADGSLRRVDWDEALDKVARGFTEIIARHGPDAVALYVSGQLLTEDYYVANKLMKGFIGTANIDTNSRLCMSSAVAGHKRAFGEDLVPCSYEDLELADLVILVGSNTAWCHPILFQRLTRAKEARPEMKIVAIDPRRTATCELADLHLPLRAGTDVRLFNGLLSYLARHGHGDDVFVADHTAGLNDALAVADADGADIAAVARACKLAPQDVQAFYELFAATTKVVTAFSMGVNQSSAGTDKVNSIINCHLLTGRIGRPGMGPFSLTGQPNAMGGREVGGLANMLAAHMELGDPRHRDIVQDFWHSPAMADKPGLKAVDLFQAIEQGKVKAVWVIATNPVVSLPDADQARRALARCELVVTSDIVTRTDTNDAAHILLPALGWGEKDGTVTNSERRISRQRAFLPAPGEARADWDILCDVARRMGFAGFDYAGQHEIFDEHARLSAWRNGDDSGDDAAHAPRMFDIGGLAGMDQAAYDAMLPVQWPLPVMASSGKQRLFENARFAFADGRARFVATAARAPVHATDDEFPLILNTGRVRDQWHTMTRTGKAARLSDHLPEPFVDMHPQDALLCGVGEGKLARVTSRWGMMIGRVRFGGGIPRGSVFVPIHWNDQFSSDARVGAVVNPAVDPVSGEPEFKHTPVRVEEFRVSWHGFVLSRKVLPADALTWWTRIQGKHFHRHEFAGRDVITDRAAWARERLGAQAPDADWLEFEDRAAGVYHAGYIVDDRLEACVYLSTRPDLPSRAWLSQLFGQARLEDSDRIGLLLGQPLEKTADAGPTVCSCFGVGRNTICDAVRQHDLKTPAEITACVKAGGNCGSCVPELRKLLVEIRVVEAA

SEQ ID NO: 6230 - protein, 151 aa, Triticum aestivum
  misc_feature (81)..(81): Xaa can be any naturally occurring amino acid
MAPTVMASSATSVAPFQGLKSTAGLPVSRRSNGASLGSVSNGGRIRCMQVWPIEGIKKFETLSYLPPLSTEALLKQVDYLXSAPKWVPCLEFKQRVWVHLPLSNKRNPPGVTNDWPGYWDNVGNCLCSGLQPDANTRSNEVGKKVKERNYP

SEQ ID NO: 6231 - protein, 153 aa, Oryza sativa
VNYGLVTYNFGYIIHPFGCGIWFRESFPDVLVLPFSFVLQLMCLADLEFDYINPFDSSSRINKVVIPEFVLQAALSVLFLLSGHWAMFLLSAPMVYYNYTLYQRRQHLVDVTEIFNHLGREKKRRLFKIVGLIILLFLSLFWMIWTVLLEEDE

SEQ ID NO: 6232 - protein, 562 aa, Oryza sativa (japonica cultivar-group)
MELAVGAGGMRRSASHTSLSESDDFDLSRLLNKPRINVERQRSFDDRSLSDVSYSGGGHGGTRGGFDGMYSPGGGLRSLVGTPASSALHSFEPHPIVGDAWEALRRSLVFFRGQPLGTIAAFDHASEEVLNYDQVFVRDFVPSALAFLMNGEPEIVRHFLLKTLLLQGWEKKVDRFKLGEGAMPASFKVLHDSKKGVDTLHADFGESAIGRVAPVDSGFWWIILLRAYTKSTGDLTLAETPECQKGMRLILSLCLSEGFDTFPTLLCADGCCMIDRRMGVYGYPIEIQALFFMALRCALQLLKHDNEGKEFVERIATRLHALSYHMRSYYWLDFQQLNDIYRYKTEEYSHTAVNKFNVIPDSIPDWLFDFMPCQGGFFIGNVSPARMDFRWFALGNMIAILSSLATPEQSTAIMDLIEERWEELIGEMPLKICYPAIENHEWRIVTGCDPKNTRWSYHNGGSWPVLLWLLTAACIKTGRPQIARRAIDLAERRLLKDGWPEYYDGKLGRYVGKQARKFQTWSIAGYLVAKMMLEDPSHLGMISLEEDKAMKPVLKRSASWTN

SEQ ID NO: 6233 - protein, 495 aa, Escherichia coli B
MNFHHLAYWQDKALSLAIENRLFINGEYTAAAENETFETVDPVTQAPLAKIARGKSVDIDRAVSAARGVFERGDWSLSSPAKRKAVLNKLADLMEAHAEELALLETLDTGKPIRHSLRDDIPGAARAIRWYAEAIDKVYGEVATTSSHELAMIVREPVGVIAAIVPWNFPLLLTCWKLGPALAAGNSVILKPSEKSPLSAIRLAGLAKEAGLPDGVLNVVTGFGHEAGQALSRHNDIDAIAFTGSTRTGKQLLKDAGDSNMKRVWLEAGGKSANLVFADCPDLQKAASATAAGIFYNQGQVCIAGTRLLLEESIADEFLALLKQQAQNWQPGHPLDPATTMGTLIDCAHADSVHSFIREGESKGQLLLDGRNAELAAAIGPTIFVDVDPNASLSREEIFGPVLVVTRFTSEEQALQLANDSQYGLGAAVWTRDLSRAHRMSRRLKAGSVFVNNYNDGDMTVPFGGYKQSGNGRDKSLHALEKFTELKTIWISLEA

SEQ ID NO: 6234 - protein, 460 aa, Xanthomonas axonopodis pv. citri str. 306
MPMSDPSAPDHLQRSLSNRHLQLIAIGGAIGTGLFMGSGKTISLAGPSILFVYLIIGAMLFFVMRAMGELLLSNLEYKSFIDFSTDLLGPWAGFFCGWTYWFCWIITAIADVIAIAAYAQFWFPGLAPWIPAILCVLLLLGLNLVTVKLFGEMEFWFALIKIIAIAALIVTGAGLVVWGFRSPSGNVASLSNLWNDGGMFPMGIGGFFAGFQIAVFAFVGIELVGTTAAETADPRRNLPKAINSIPVRILIFYVLALIAIMAVTPWRQVVADKSPFVELFVLAGVPAAASLINFVVLTSATSSANSGIFSTSRMLYGLAEEQHAPKGFAKLSRAAIPARGLLFSCLCLLLGAMLVYLIPNLVTAFTLVTTLSAVLFMFVWSLILCAYIAYRRKRPEQHAASAFKMPGGVLMCYVCLAFFAFVIVLLTLQDDTRQALLASPVWFLLLAIGYAVKRRGNRQR

SEQ ID NO: 6235 - protein, 201 aa, Oryza sativa (indica cultivar-group)
MAGKAAATTATTANNDSGSGGGGGGYIRTVTLRGFDGIRVRVSAGTMAAASATARARLDEAIRRTPRHAAVPDDVLINVPGVARPVLARVADYCDRHYGGGGEGGEFAAPEGYGFDDPLARFDDELMDGADVGTVVDLLRAATFLRVERLADLASREVAACMRGRTVEGIRQVFGIANDYTDEEEQDVRKENSWAFDAYND

SEQ ID NO: 6236 - protein, 139 aa, Brassica napus
FAYHTYLSVSDISEVRVEGLETLDYLDNLSKRELLTEQGDAITFESEMDRTYLRSPKVVAVLDHERKRTYVIGKEGLPDTVVWNPWEKKSKTMADFGDEEYKSMLCVDGAALERPITLKPGEEWTGKLMLTAVKSSFCF

SEQ ID NO: 6237 - protein, 200 aa, Synechococcus sp. RS9916
MRTGEIHRATGETDVRVRLDLDGTGQCHAVTGVPFLDHMLHQISSHGLIDLHIDATGDTHIDDHHTNEDVGIAVGQALSQALGDRRGIHRFGHFVAPLDEALVQVALDCSGRPHLSFGLQIPSQKIGTYDTELVKEFFVAVANNSGLTLHIRQLDGVNSHHIVEACFKAFARALRMATEIDPRRAGTVPSSKGVLEQAGS

SEQ ID NO: 6238 - protein, 283 aa, Streptococcus suis 89/1591
MDLQELCRKVIQARPRNSHKGSYGRVLLIGGLYPYGGAIIMAALATVNSGAGLVTVATEKDNIPALHSHLPEAMAFSFDDQALLISSLENADLVLIGPGFGENSRAEQLLDFVFEHLSDQQILVLDGSALTLVAKQNRKNFPCKQVILTPHQKEWERLSSIPIADQTSQRNLEALQSFQENTILVAKSSATQILKTQPNQVTPIGAGGPYQATGGMGDTLAGMIAGFAVQFPHVQLYERILVATYLHSYIADQLAQDYYLVKPTDVSRNIQKTMLQFQTQTTA

SEQ ID NO: 6239 - protein, 194 aa, Bacillus halodurans C-125
MRKATIERKTGETQISLTFAVDGEGQSNLTTGVPFMTHMLDLFTKHGHFNLTIDAKGDTEVDDHHTTEDLGICLGLALKEALADKKGIRRYGSAFVPMDETLAQVVVDLSNRPHLEFRADMPSEKVGTFDTELVHEFLWKLALEARMNLHVIVHYGENTHHIIEAIFKALARALDEATTIDPRVKGVPSTKGML

SEQ ID NO: 6240 - protein, 230 aa, Streptococcus suis 89/1591
MVKLVFARHGESEWNKANLFTGWADVDLSEKGTQQAIDAGKLIKEAGIEFDLAFTSVLKRAIKTTNLALEAADQLWVPVEKSWRLNERHYGGLTGLNKAEAAAEFGDEQVHIWRRSYDTLPPEMAKDHEHSAHTDRRYAHLDDSVIPDAENLKVTLERALPFWEDKIAPALKDGKNVFVGAHGNSIRALVKHIKQLSDDEIMDVEIPNFPPLVFELDENLNIVKEYYLEA

SEQ ID NO: 6241 - protein, 682 aa, Magnaporthe grisea 70-15
MRKGVMPSFARWQVGYDDGSRRMHEEEFSSTDMCKQSGGLQTHHVVYETVIVCRPGHFATHLPLRCYFLSHYLKISYGQVSQFKINMAKIKSQRQLVSMTKDSSPRQPASEPHSSDSDSSDEESDHLDAVSSRKKRKLSVDFSQEEGDDEDDNQDESDDDDDVDEDGGKMKQPVAKPTFAFNAPSRIKRHPAKGDSERIGKGQPVTDAEMEDAVQSVAQAAGKKRILAPTDQNTTFESLGVEPWLVQSLANLAVKRPTGIQKGCIGEILKGRDCIGGSRTGSGKTIAFAVPILQKYAQDPSAIFAVVLTATRQVSYPLLLCTPLDIYRPELALQIYEQFKAVSSPHVLKAALIIGGSDMRSQAIALAQRPSIVIATPGRLADHIRSSGEDTICGLRRVKFLVLDEADRLLSSKGPGSMLPHIDECMAVLPPPEDRQTLLFTATVTPEVRALKEMPTRPGKEPVHVCEVDTQVLAIPDSLKQSYIQLTVTHREHFLHEFLLTAANTERSIIIFVNRTSTAQFLHHLLRLLDHRVTSLHSKLRQQQRIDNLGRFRASAARILVATDVASRGLDIPEVSVVVNYDLPRDPDDYIHRVGRTARAGRKGEAVNFVGQRDVELVLAIEKRVGRPMEKWEEEGVNLETRVIRDSLKLVSEKKREALLNIEENREVGGRRKRQKLKLGAE

SEQ ID NO: 6242 - protein, 219 aa, Haemophilus influenzae 86-028NP
MNQLEMKKLAAQAALEYVTADTIVGVGSGSTVNCFIEALGTIKNKIQGVVAASKASEELLRKQGIEVFNANDVSSLDIYVDGADEINPQKMMIKGGGAALTREKIVAALAKKFICIVDSSKQVDVLGSTFPLPVEVIPMARSQVGRKLVALGGAPEYREGVVTDNGNVILDVHNFSILNPVEMEKELNNVAGVVTNGIFALRGADVVIVGTPEGAKIID

SEQ ID NO: 6243 - protein, 428 aa, Streptococcus suis 89/1591
MSTFSGFYKKSRQERIDILRQNRSLSEDSLDILYKDENLPEAIAGKMAENHLGTFSLPFSVLPELLVDGQTYSVPMVTEEPSVVAAASFGAKIIAKSGGFTTTIHNRIMIGQVALYDISDHSRATQAILDHKESILETANQAHPSIVKRGGGARELTVESKDEFLIVYLQVDVQEAMGANVLNNMLEAIKDDLEELSKGQALMGILSNYATESLVTAQCHIAISSLATSSAIAQETAQKIALASKLAQVDPYRAATHNKGIFNGIDAVVIATGNDWRAVEAGAHAYASRDGQYKGLSTWSIDGEHLVGSITLPLPIASVGGSIGLNPKVAVAFDLLQQPKARQLASIIASVGLCQNFAALRALVTSGIQAGHMKLHAKSLALLAGAEEHEVDQLAQLLRKEKHSNLETAQNLLAKMREHWEWERTRPR

SEQ ID NO: 6244 - protein, 215 aa, Bacillus halodurans C-125
MEINTVLFDLDGTLINTNELIISSFLHTFETYYPGKYGRKDAIECIGPPLTDSFKRLDPERVEEMVATYRKHNHAHHDKLVEPYEGVYETVKTLHEQGFKLAIVTTKIRETAMKGLKLFGLDEFFDVIVALDDVENVKPNPEPLEKAMNALGAKKEETIMVGDNSHDILGGKNAGVKTAVVGYAIRGEDYVRQFDPDYVLRSMPDLLDIVGVKAR

SEQ ID NO: 6245 - protein, 205 aa, Zea mays
PRVRQGLDSEPPFVDLSVGTPQEDVNDSEEPGTTMEPEDLPETEDNASTPEKFESESDKSSAQVNSEPKLESPGDTAVPNSDLTEPRDGELNKSSPSHGKGEAKKTTTDNASNPDSVHQDQAASIPMIRESIWEGAIQLNVSSLSNVVAIFKSGEKPSLKVWRSFVEIKGRVKLSAFQEFVEQLPKSRSRAIMITELCWKEGSSE

SEQ ID NO: 6246 - protein, 336 aa, Magnaporthe grisea 70-15
MEKAAVSAEGLLIPLIDFSKFLNGNDAQRQETAKAILHGFQTAGFIYLKNLPLEPEVLSHVFATSAKFFTVPLETKMDLAWTTPASNRGYSAPGREKVTQLADIDEVKKLKDGNPDMKESFEIGREGVPEYPNQWPKDDTDATSEFKPTMLDFFDRCKAIHVEVMRAIAVGMGLEDPGYFDRFVDVGDNTLRLLHYPAVDRNVFQINPGQVRAGEHSDYGSITLLFQDARGGLQVKGPNGAFVDATPIPGTCVVNAGDLLARWSNDTIKSTIHRVVEPPSGEGDVYPPRYSIAYFCNPNSDAYIETIPGTYQTEADKKYEGINSGKYLEQRLAATY

SEQ ID NO: 6247 - protein, 316 aa, marine gamma proteobacterium HTCC2143
MSNKLEQLKAMTDVVADTGDIEAIQRFKPMDATTNPSLLLKAAQLPQYQALIAQAKDWANLQGGDAAQQLSNCSDKIAVAIGSEILKIIPGRISTEVDSRLSFNTDATVRKAHRLIELYSQAGVEPNRVLIKIAATWEGIRAAEILEREGINCNLTLLFGFSQAAACADAGVFLISPFVGRILDWHKAKSGQTDYAPHEDPGVISVSKIYSFYKQHNYSTVVMGASFRNTGEIEHLAGCDRLTISPQLLNELEQDMGQLQRKLSPDTSIGNVEKSDNGEDSFRWAMNEDAMATEKLAEGIRNFTIDQIKLEKLLRS

SEQ ID NO: 6248 - protein, 130 aa, Nostoc sp. PCC 7120
MIVSFLNKQTMSAQEIIRSIEAEQLKSNLPEIYIGDTVRVGVKIKEGEKYRVQPYEGVVIARRNGGINETITVRRVFQGVGVERVFLLHSPRIDNIKVLRRGKVRRAKLYYLRGRVGKATRIKQRFDRSL

SEQ ID NO: 6249 - protein, 194 aa, Chlorobium tepidum TLS
MTQRIASHSRKTAETDISATVNLDGSGTSAIETGVVFLDHMLTNFSRHSGIDVQLRCSGDLEVDDHHTVEDVALVLGKAIVDALGDKKGIGRYGWAIIPMDEALAQCSIDLGGRSYCVFRAEFQRPVIQGLSTEMVEHFFVSLSRTMNANLHLAVLEGRNTHHMIEALFKSLAYAMKQAVKVESTEIKSTKGAI

SEQ ID NO: 6250 - protein, 453 aa, Rhodopirellula baltica SH 1
MNSRSRTSTSKQPSPLLTGRRNSKDSIGSWKIHAFASLELSEPILMSIKRVGILTAGGLAPCLSSAIGALIEAYTEQAPEIEILCYRSGYKGLLLGDSFVVDAHSRKNAAILHQHGGSPIGNSRVKLTNVADCVKRGLVSEGQDPLQVAAERLQSDEVDVLHTIGGDDTNTTAADLAAYLAKHEYQLTVVGLPKTIDNDVIPIKQSLGAWTAAEEGAKFFENVVGEHNANPRMLIIHEVMGRNCGWLTAATAAKYRERLQKLNFLPEMGLSQERRDVHGVFVPEMSFDLEEEAKRLRAIMDEIDCVNIFISEGAGVDTIVKEMESRGESVPKDAFGHYKLDAVNPGKWFGKQFADMLGAEKTLVQKSGYFSRAAAANAEDIALIGRCAKKAVECAMQGIGGVVGEDEDQNNELRAIEFERIAGGKPFDINVEWFGDLLSQMGQPKGEVLETSH

SEQ ID NO: 6251 - protein, 395 aa, Synechococcus sp. RS9916
MTSSSLPTHARVVIVGGGMAGLSCAAALAKRGVSDVVLLEARTLAHAGASSYGETRMFREMYSDPVLCRLAQEANRLWREEESQAGEQLRETHGLLFYGESWDEETIEGSIPGARRVMDDQGIPYEALNAEQIADRFPLKPKADFTGLFEPTAGAVRSDKVVAHWIRSARNAGHQLIEHTSVQQLDADGGGVTLENGHHIAADQLVVACGIWSQLLLAPLGLAPKLEVWPMLWAHYTVDPALADRYPQWFCFQQERGDDGGLYYGFPVLSTTSDGRPRIKCGIDWAPKDLRVAEPNAMVSEPPARLVELLDTFLFNELEGVQERVETVISPYSMTSDVNFVLDRITPQLSLFCGGSGQSFKFAPLIGDSLARLACGEQPGVNLSCWSHKRPAVRA

SEQ ID NO: 6252 - protein, 486 aa, Synechococcus sp. RS9916
MASAPLPLAATAIKFGTDGWRGILGVDITVERLLTVAAASAQELAHRAAAGNTSNTVVIGYDRRFLAPELAEAIAAAVRGCGLQPLLASTPVPTPACSWAVVERQALGALVITASHNPPEWLGLKIKGPFGGSVEGDFTAAVEQRLAAAGVTPPIEGETERFDARLEHLNGLRSKLDLDGLRRGLEAMGLQVIVDPMHGSAAGCMAELLGGISGPVREIRSDRDPLFGGNPPEPLAPYLQELITAVKAAGSSGQPAVGLVFDGDGDRIAAVDESGTFCSTQQLMPLLIDHLARARQLPGSVVKTVSGSDLMRLVAEDLGREVLELPVGFKYIASEMLEGEVLIGGEESGGVGFGMHLPERDALFAALLVLEALVEGGQPLGARVSALQQRCGGSSHYDRVDLRLPDMATRHRLEQLLAQQPPREIAGSVVQEVITTDGVKLRLGPSHWLMLRFSGTEPLLRLYCEAPNAERVAEVLSWAQALATSI

SEQ ID NO: 6253 - protein, 313 aa, Pseudomonas syringae pv. syringae B728a
MTSKLDQLKKFTTVVADTGDFGAIKSLEPEDATTNPSLLLKAASDANNAKMLGEAFDGSKGDIGLACDRFAVAIGQEILKVVPGRVSTEVDARLSFDTNALIERSERLIGLYDAAGIKRDRVLIKLAATWEGIRAAEKLEKDGIQTNLTLLFSFAQAVACAEAGVFLISPFVGRIYDWYKKSTGTDYTGAEDPGVQSVTRIYNYYKANDFKTVVMGASFRNLNQIEQLAGCDRLTISTDLLKKLAEDTGTLERKLTPDKAGEKRSDTVKNLTESQFRWASNEDAMATEKLAEGIRQFARDQEKLEALLSAKKA

SEQ ID NO: 6254 - protein, 227 aa, Pyrococcus horikoshii OT3
MVEVKKHKFPGVYTVIDDDGSERIATKNLVPGQRVYGERVIKWEGEEYRIWNPNRSKLGAAIMNGLKNFPIKPGKSVLYLGIASGTTASHVSDIVGWEGKIFGIEFSPRVLRELVPIVEERRNIVPILGDATKPEEYRALVPKVDVIFEDVAQPTQAKILIDNAEVYLKRGGYGMIAVKSRSIDVTKEPEQVFREVERELSEYFEVIERLNLEPYEKDHALFVVRKT

SEQ ID NO: 6255 - protein, 600 aa, Zea mays
  misc_feature (73)..(73): Xaa can be any naturally occurring amino acid
  misc_feature (78)..(78): Xaa can be any naturally occurring amino acid
MSDVAALPETVAEGKMTTTMNDAWDYKGRPAVRASSGGWSSAAMILVVELNERLTTLGVGVNLVTYLIGTMHXGGAAXANAVTNFLGASFMLCLLGGFVADTYLGRYLTIAIFTAVQAAGMCVLTVSTAAPGLRPPACADPTGPSRRSSCVEPSGTQLGVLYLGLYLTALGTGGLKSSVSGFGSDQFDESDDGERRSMARFFGWFFFFISIGSLLAVTVLVYVQDHLGRRWGYGACVAAILAGLLLFVTGTSRYRFKKLVGSPLTQIAAVTAAAWRKRALPLPPDPDMLYDVQDAVAAGEDVKGKQKMPRTKQCRFLERAAIVEEAEGSAAGETNKWAACTLTDVEEVKQVVRMLPTWATTIPFWTVYAQMTTFSVSQAQAMDRRLGSGAFEVPAGSLTVFLVGSILLTVPVYDRLVVPLARRFTANPQGLSPLQRISVGLLLSVLAMVAAALTERARRSASLAGATPSVFLLVPQFFLVGVGEAFAYVGQLDFFLRECPRGMKTMSTGLFLSTLSLGFFFSTAIVSAVHAVTTSGGRRPWLTDDLDQGSLHKFYWLLAAISAVDLLAFVAVARGYVYKEKRLAAEAGIVHDDDVLVHAT

SEQ ID NO: 6256 - protein, 269 aa, Mangifera indica
NHGISHDLMDGVEKVNKEQYNKCREQKFNEFANKALENADSEIDHLDWESTFFLRHLPVSNISEIPDLDDQYRKAMKEFAAAIEKLAERLLDLLGENLELEKGYLKKAFSNGSKGPTFGTKVSSYPPCPRPDLVKGLRAHTDAGGIILLFQDDQVSGLQFLKDGEWLDVPPMRHAIVVNLGDQLEVITNGKYKSVVHRVVAQTDGNRMSIASFYNPGSDAVIFPAPALVEKEAEEKKEVYPRFVFEDYMKLYVGHKFQAKEPRFEAMKA

SEQ ID NO: 6257 - protein, 453 aa, delta proteobacterium MLMS-1
MRRLFGTDGIRGVANLYPMTTEIAMQVGRGIAFVVKRQGRRHRIVIGKDTRISGYMIENALAAGICSMGVDILLVGPLPTPGIAFITTSMRADAGVVISASHNPFPDNGIKIFAADGYKLPDAQELEIEELIFSQKMASLRPTAEEIGKASRIDDARGRYIVFLKNTFPAEYTLDDFHIVLDCAHGATYGVAPAVFAELGARVSCLGVEPDGTNINHDCGALQPQAMAARVRELGADLGIALDGDGDRLMVADETGQILDGDQVMAICAADLLKRKKLNKKTLVATVMSNIGLEHFMKGLGGRLERSQVGDRYVVEKMRAKGYNFGGEQSGHLIFLDHNTTGDGILAALRLLAVMIGENRRLSELASRLQLLPQVLRNVRLEQPVAVKAIGGLKSLVKKLEAELGSDGRILIRASGTEPLLRVMIEGPHRERIEAMAEEICQHIQQRLAGNKR

SEQ ID NO: 6258 - protein, 362 aa, Haemophilus influenzae 86-028NP
MQPTLFIDRDGTLIDEPKTDFQIDSLEKLKLEPKVIPALLRLKAKYRFVIVSNQDGLGTDAFPQTNFDKPHNVMMALFESQGITFDEVLICPHKPEENCLCRKPKIKLLDHYIRKNLFDIDRSFVIGDRETDVQLAENLGIRAIQYDPQKMNWDLIAEKLLGETVTNCGKRPPRFAEVIRQTKETDIKVQIWLDEAGVNEIKTGVGFFDHMLDQIATHGGFRMNVQCKGDLWIDEHHTVEDTALALGQALKQAIGDKRGIARFGFVLPMDECKAECALDLSGRPWIKFNACFKRDKVGDFSTELTEHFFQSLAFSMLATIHLNVTGNNDHHKIESLFKAFGRTLRQAIRIEGNEMPSSKGVL

SEQ ID NO: 6259 - protein, 130 aa, Brassica napus
MVRISVLNDAVKSMFNAEKRGKRQVMIRPSSKVIIKFLIVMQKHGYIGEFEYVDDHRSGKIVVESNGRLNKSGVISPRFDVGVKEIEGWTARLLPSRQFGYIVLTTSAGIMDHEEARRKNVGGKVLGFFY

SEQ ID NO: 6260 - protein, 462 aa, Zymomonas mobilis subsp. mobilis
MAIELKMPALSPTMEEGTLTRWLVKEGDSIKAGEILAEIETDKAIMEFEAVDEGVITKILIPEGSENVKVGTAIAYLGTDANDVTLEGASAETKAEESAPVASPAKTEAAALEEAATPSLGKVINSAPEIPEGTEFFQQTLREALRDAMAEEMRRDDRVFVMGEEVAEYQGAYKVTQGLLQEFGARRVVDTPISEYGFSGIGVGAAMEGLRPVIEFMTMNFSMQAIDHIINSAAKTHYMSGGQVRCPIVFRGPNGAAPRVGAQHTQNFGPWYAAVPGLVVLAPYDAIDAKGLLKAAIRSDDPVVFLECELLYGKTFDVPKMDDFVLPIGKARIIREGKDVTIVSYSIGVSFALTAAEALAKEGIDAEVIDLRTLRPLDKETILQSLAKTNRIVTVEDGWPVCSISSEIAAIAMEEGFDNLDAPVLRVTNADTPTPYAENLEKKGLVNPEAIIEAVRKVCYRK

SEQ ID NO: 6261 - protein, 276 aa, Thermotoga maritima
MYVAALFFLIPLVALGFAAANFAAVVRKPEGTERMKEISSYIRSGADSFLAHETKAIFKVAIVIAILLMIFTTWQTGVAFLLGAVMSASAGIVGMKMATRANVRVAEAARTTKKIGPALKVAYQGGSVMGLSVGGFALLGLVLVYLIFGKWMGQVDNLNIYTNWLGINFVPFAMTVSGYALGCSIIAMFDRVGGGVYTKAADMAADLVGKTELNLPEDDPRNPATIADNVGDNVGDVAGLGADLLESFVGAIVSSIILASYMFPIYVQKIGENLVH

SEQ ID NO: 6262 - protein, 519 aa, Zea mays
  misc_feature (472)..(472): Xaa can be any naturally occurring amino acid
  misc_feature (499)..(499): Xaa can be any naturally occurring amino acid
MQFSSVLPLEGKACMSPVRRGSGGYGSERMRINCCSIRRNKALRRMCFSARGAVSSTQCVLTSDAGPDTLVVRTSFRRNYADPNEVAAVILGGGTGTQLFPLTSTRATPAVPIGGCYRLIDIPMSNCFNSGINKIFVMTQFNSASLNRHIHRTYLGGGINFTDGSVEVLAATQMPGEAAGWFQGTADAVRKFIWVLEDYYKHKAIEHILILSGDQLYRMDYMELVQKHVDDNADITLSCAPVGESRASDYGLVKFDSSGRVIQFSEKPKGAALEEMKVDTSFLNFAIDSPAEYPYIASMGVYVFKRDVLLDLLKSRYAELHDFGSEILPKALHEHNVQAYVFTDYWEDIGTIRSFFDANMALCEQPPKFEFYDPKTPFFTSPRYLPPTKSDKCRIKDAIISHGCFLRECAIEHSIVGVRSRLNSGCELKNTMMMGADLYETEDEISRLLAEGKVPIGVGENTKISNCIIDMXCQGWKERLHNKQRGRPRSRPAGRRILXIRSGIVVVLKNATIKDGTVI

SEQ ID NO: 6263 - protein, 181 aa, Mesorhizobium loti MAFF303099
MKPSLEDTLLASIRTIPDYPKPGILFRDITTLLGNARAFRRAIDELVHPYAGQKVDKIAGIEARGFILGGAVAHQLSAGFVPIRKKGKLPFDTVRVAYSLEYGLDEMEMHKDGVAPGEKVILVDDLIATGGTAEAAVKLLRQIGADILAACFVIDLPDLGGRAKLEALGVPVRTLIGFEGH

SEQ ID NO: 6264 - protein, 119 aa, Triticum aestivum
MEEGREGWPCAAAGEAVAAEEGEEEDQFDRLPDAVLLDVFNRIGDVKALGRCALVSRRFHGLVPLVDSVFVRVDCVIPDEPAPSSAGSPQAAAPSRGRGALAHIARLVLGGIVRPIQAL

SEQ ID NO: 6265 - protein, 139 aa, Glycine max
  misc_feature (26)..(26): Xaa can be any naturally occurring amino acid
  misc_feature (81)..(81): Xaa can be any naturally occurring amino acid
  misc_feature (96)..(96): Xaa can be any naturally occurring amino acid
MRGDHEGHRPCQALQYGGFFLLPETXQDKPYISETLLAMIIISLVWWTFHPFIWQNRKIYSVLILCTVLSLLLASQVLRIXITFYYTQLPAPNYHXHQGSKLATLPHTDTDLEVLLIYYPRGVVYGYSDLILSSHMIFT

SEQ ID NO: 6266 - protein, 325 aa, Triticum aestivum
  misc_feature (170)..(170): Xaa can be any naturally occurring amino acid
  misc_feature (210)..(210): Xaa can be any naturally occurring amino acid
FSERAARAGSGINAEPKANDQYLPPFVIVDESGKSVGPIVDGDAVVTFNFRADRMVMLAKALEFPDFDKFDRVRVPKIKYAGMLQYDGELKLPSKYLVSPPLIERTSGEYLVKNGVRTFACSETVKFGHVTFFWNGNRSGYFDETREEYVEIPSDSGITFNEQPKMKALXIAERTRDAILSGKFDQVRINLPNGDMVGHTGDIEATVVAXCKAADEAVKMVLDAVEQVGGIYLVTADHGNAEDMVKRNKAGQPMLDKSGSIQILTSHTLQPVPVAIGGPGLHPGVRFRSDIQTPGLANVAATVMNLHGFQAPADYETTLIEVIDK

SEQ ID NO: 6267 - protein, 403 aa, Lactobacillus delbrueckii subsp. lactis
MAKLIVSDVDVKDKKVLVRVDFNVPIKDGVIGDDNRIVAALPTIKYIIENGGKAILLSHLGRIKSDEDKKSLSLAPVAKRLGELLEKPVTFVPSNEGKEVEDAINNMKDGDVVVLENTRFQDIDNDFGKRESKNDPKLGEYWASLGDVFVNDAFGTAHRSHASNVGIATAMKAAGKPVAAGFLLEKEIKFLGNAVANPVHPFVTILGGAKVSDKIGVITNLIPKADHIIIGGGMAYTFLKAQGHNIGKSLVEDDKVEFAKELLEKAGDKLVLPIDHVAATEFNNDAASEVVGQDIPDNEMGLDIGPKTIELFKKTLEGAKTVVWNGPMGVFEMPNFAKGTLEVGRALADLPDATTIVGGGDSTAAAKQLGIAPKLTHISTGGGASLEYLEGKELPGIACVSDK

SEQ ID NO: 6268 - protein, 234 aa, Wigglesworthia glossinidia endosymbiont of Glossina brevipalpis
MSIIKLVLMRHGSSIWNDQDRFTGWTDIDLSEKGKNEVKYAGKMLKSFGYSFNFAYTSLLKRAIHSLWVILKEINQSWIPVEKSWRLNERHYGALQGFSKYEIEKKYGKNQLNEWRRGFSISPPKINEKDNYFILNDKRYLNLKTKKLLPFSESLKSTIDRIMPYWDGNIFPRLQNKEKIIIVAHGNSIRAIIKILCNLNEKEIIKINIPTGIPLIYEFDYNMVFKKKYFLFDR

SEQ ID NO: 6269 - protein, 271 aa, Crocosphaera watsonii WH 8501
MKKLIEGLQKFQSGYFLSHRELFEELSQGQHPRILFITCSDSRVDPNLITQAEVGDLFVIRNAGNIIPPFGAANGGEGAAIEYAISALDIQQAIVCGHSHCGAMKGLLKLNSLQEKMPLVYDWLKHAEATRRLVKDNYSHLEGEELLEVTVAENVLTQLENLQTYPVIHSRLHQKKLTLHGWIYRIETGEVLEYDRASHDFIAPQSSITDTEPEYSFHPRNHAPGSTPFKRPATTRASSNGNGKNGSNRSSLPGYEQFSPEQAQRIYRGSY

SEQ ID NO: 6270 - protein, 111 aa, Novosphingobium aromaticivorans DSM 12444
MPKFDANGLVTAVAVDHATGALLMLAHMDAQAIAKTRETGFAHFHSRSRGRLWMKGESSGHVLRIVEIRVDCDQDALELRVEAAGPACHTLAPTCFYRRLDHRGQLERIVD

SEQ ID NO: 6271 - protein, 887 aa, Novosphingobium aromaticivorans DSM 12444
MTAYVFHFGGGATSSEPRAKDKTIVGGKGANLAEMAGIGLPVPPGFTISTEVCTAYNASGKTFDDALRAGVAAGVSHIEKATGRTFGDAANPLLVSVRSGARVSMPGMMDTVLNLGLNDATVEGLAAGSGDPRFAWDSYRRFIQMYSDVVLGLDHHRFEDALEIVKEDNGFFNDVELGANHWQALVGEYKSIVEDQLGRPFPQDVHEQLWGAIGAVFDSWESDRAKVYRKLNDIPHDWGTAVNVQAMVFGNMGDTSATGVAFTRDPATGEKAYYGEWLVNAQGEDVVAGIRTPQYLTLAARERAGAKPLSMEEAMPGAYAELAAVFELLEKHYRDMQDIEFTVEQGKLWMLQTRSGKRTAKAALKMAVDMVGEGLIDEATAIKRIDPMALDQLLHPTLDPKAARDVLTKGLPASPGAASGTVVFDADTAQAKAERGDAVILVRVETSPEDIHGMHAAKGILTARGGMTSHAAVVARGMGRPCVSGASALSIDMASRTARIGNREIREGDVITLDGSNGDVMAGKVPTVEPELVGDFGTLMAWADKHRRMKVRTNAETPLDCQVARQFGAEGIGLCRTEHMFFEAGRISAVRQMILAEDEAGRRAALAKLLPEQRSDFQSIFEVMAGLPVTIRLLDPPLHEFLPHGETEFAELAEATGLGIEHLKRRAGELHEFNPMLGHRGCRLGITFPEIYEMQARAIFEAACDVAEQSGDAPIPEVMIPLVATKKELEILRALVDRVAAEVFAEKGRTLEYMVGTMIELPRAALMAGEIAEEAKFFSFGTNDLTQTTLGVSRDDAARFLNPYVDQGIYPRDPFVSLDIEGVGQLVELAAERGRKTRPDIKLGICGEHGGDPASIAFCEKTGLDYVSASPYRVPIARLSAAQAALA

SEQ ID NO: 6272 - protein, 746 aa, Candida albicans
MSVIAGHHVPRSNDQRQYDTPSVPINIAPDSEGHIHEMSRLKDYEVIEKLGQGTFGVVQKAKSKKDGSLVAIKQLINHSAKEGFPITAMREITILKQLNHKNILTIQDMIFEEPKMSNRTDIITMRGSFYTVTPYMSSDLVGLLENPKIKLELGQIKCIMQQLLKGIQYVHNQKFLHRDIKAANILIGQDGVLKIADFGLARIYHGNVPRLGMGPGGGEKAYTGLVVTRWYRPPEILLGERKYTTAVDQRGIGCVFAELFTGKPILVGKSDSHQAQIVFELVGSPLTWTDAAKLPNKNEYSCGLACKRSLEAKFASIMPTEAIDLLSGLLTLDPFKRLNALDALNHKFFSTDPLPLLPTQMPKFEESHEIDKERFKKLKDKEQAVSELKPPTEIRYDNHSESRYNADHSTFGGGGVGGKETSFSSGKSDYIDHYEPRARRDHYEPRIRNDNKDSNDVRGEFESATRQEQRRRDIQNRLDAGGMDTYIPKTTTGKLREHSGTESLSQKYDNYQPINVSRGSKSPSPSKLSSISQSKADLISKPSAPKVASRESSLERKQVSNGIRTTTDVEPPRARARRPTDMFGRPLTSNSTQAQPTRNKSVERPKDLEKPTNGVTEDRNKKPVLEEKKEVVKPNLAIPKIKKSSSLVSLSSRSSTTPVISNPSKVTKRAASSVTPPVLPKKPKISKTSSESEVSDLEEDSDFTGENATVFERFMALEQLQKSPVYKRIINEKMRFEKLSGGHKSM

SEQ ID NO: 6273 - protein, 337 aa, Photobacterium sp. SKA34
MTDIRTLGEFIVEKQSDFPHASGELSSLLGSIKLAAKIVNREINKAGLVDITGTVGENNIQGEEQQKLDVYANDKFKAALEARDQVCGIASEEEDEAVGFDKPLNLNAKYVVLMDPLDGSSNIDVNVSVGTIFSIYRRVSPVGSPPTKEDFLQTGNQQVAAGYVIYGSSTMLVYTTGNGVHGFTYDPSLGSFCLSHENMTIPQDGVIYSINEGNYIRFPTGVKQYIKYCQEAVPEEKRPYTSRYIGSLVADFHRNLLKGGIYLYPSTASYPNGKLRLLYECNPMAFIIEQAGGKATDGFQRILDIEPTELHQRVPFFVGSTNMVEKVESLLRDYPEN

SEQ ID NO: 6274 - protein, 483 aa, Ralstonia metallidurans CH34
MTATRPDLPKHDLLIDGKRLPPGSGEYSTDINPATEEPIALVAQGSAADVDTAVLAARAALKSWAGMRAADRGRILNRFADLLEAHAEELITLESLDAGKPLAAVRRQDLPAVVDTVRYYAGWCDKIHGAVIPTRPDALTYTVREPVGVVAAIIPWNFPLMIGMWKIAPALACGCTLIVKPAEITPLTALRVAELALEAGVPPGVFNVVTGKGSVVGNALVAHPGIDKVTFTGSPGVGRGIMQGAASNFKRVTLELGGKSANVIFADADIDAATRAAASGIFFNSGQVCSAGSRILAQRKVYDEVVERLTTRARAIRVGDPASPDTTMGPVVSAAQMKTVLDYVEIGKREGASAVTGGARIGQRGFFVEPTVFANVEHEMRISQEEIFGPVASVIPFEDEAEAVRIANGTAFSLAAGVWSADIARVHKVAGELRAGTVWINTYGYTDVRLPWGGAGDSGLGREHGDAAIENFTEPKAIWLSLR

SEQ ID NO: 6275 - protein, 290 aa, Glycine max
MAKGKHTHTRAQGKKWSTFSLVLWALFFLTLILVVLLALGIVYLPTTDDDFPTTDLSAFRRKTSQSAESLVENPPEQWTEILSWEPRAFIYHNFLSKEECEYLIELAKPQMVKSSVVDSKTGKSTESRVRTSSGMFLKRGKDKIVQNIEKRIADFTFIPEENGEGLQILHYEVGQKYEPHYDYFLDEFNTKNGGQRIATVLMYLSDVEEGGETVFPAANANFSSVPWWNDLSQCARKGLSVKPKMGDALLFWSMRPDATLDPSSLHGGCPVIKGNKWSSTKWMHLREYKV

SEQ ID NO: 6276 - protein, 352 aa, Leptosphaeria maculans
MPPTGSGSSRKISFNVSEQYDIQDVVGEGAYGVVCSALHKPSGQKVAIKKITPFDHSMFCLRTLREMKLLRYFNHENIISILDIQKPRNYETFTEVYLIQELMETDMHRVIRTQELSDDHCQYFIYQTLRALKAMHSANVLHRDLKPSNLLLNANCDLKVCDFGLARSAASTEDNSGFMTEYVATRWYRAPEIMLTFKEYTKAIDVWSVGCILAEMLSGKPLFPGKDYHHQLTLILDVLGTPTMEDYYGIKSRRAREYIRSLPFKKKIPWKAMFPKTNDLALDLLERLLAFNPVKRITVEEALKHPYLEPYHDPDDEPTADPIPEEFFDFDKNKDNLTKEQLKLLIYQEIMR

SEQ ID NO: 6277 - protein, 323 aa, Photobacterium sp. SKA34
MDFKAIQALTANDMAEVDAKIQAQLNSEVVLINQLGFYIVSSGGKRLRPMLAVLAARALGYDGDKHTTAAAFIEFIHTATLLHDDVVDESNMRRGKETANAAFGNAASVLVGDYIYTRSFQMMTSLRSLKILDIMSEATNVIAEGEVLQLMNCNDPNTTEDSYMQVIYSKTARLFEASTQIAAIIAQAPAEIELALQEYGRYLGTAFQLIDDVLDYIADGKEMGKNVGDDLAEGKPTLPLLHAMNHGNAEQSTMIREAIEKANGMEKLDAILAAMHEHGSLEYTQQRAEEEAEKAIAALAPIADSQYKEALVALAHMAVQRNK

SEQ ID NO: 6278 - protein, 250 aa, Pyrococcus furiosus
MLGEVSKILAKSSMAIAFTGAGISAESGIPTFRGKDGLWRKYRAEELATPEAFKRDPKLVWEFYKWRIKKILEAKPNPAHIALAELEKMGIIKAVITQNVDDLHREAGSKNVIELHGNIFRVKCTSCSYREYLKESDRIGWLLSQELPRCPKCGSLLRPDVVWFGEALPEKELTTAFSLAKKADVVLVVGTSGVVYPAAYIPYIVKESGGIVVEINIEPSAITPIADFFLRGKAGEVLPKLVEEIRRISK

SEQ ID NO: 6279 - protein, 158 aa, Ustilago maydis 521
MVSLTTSDNEQFTVDRDVAERSVLIKQMLEDIGDTEQPIPLVNVSSNVLKKVLEYCSHHRNDPPAPADDAEESRRRTTDISDWDAKFIQVDQEMLFEIILAANYLDIKPLLDVGCKTVANMIKGKTTEEIRKLFNIQNDFSPEEEAQIRKENEWAEDR

SEQ ID NO: 6280 - protein, 474 aa, Mycobacterium sp. MCS
MRRSHSPGSRADGSARDDGWVVTDLDLDLQALPLAPKNPLPYRQLLPLVRHFHTGQEVLRQAAGPVIRLKLGPKWMIPEIVVVTSPAGIRDVLGRNHASAERCRVHDEVRDLGGESLFVLPNDPWIPRRRALQPVFTKPSVRGFGGHMSRAAEMVGERWGQTAQVNLDEECRRLTMRSLGRSILGLDLDAKADLIAGPLPVAAGYAADRALKPVRAPRWLPTPQRRRANAAVATMKAVTNDILQACRADPARDAPLVHALINASDPETGRSLSDDDICNELLVFMLAGHDTTATLLTYALWALGHHPDIQDRVAAEACALGDRLPTPDDVGRLGYTVQVLNESLRLCPPAAGVGRMALRDVEVDGYRVEAGSLVGIGIYAVHRDPELWDRPLEFDPERFSPENVKDRDRWQFIPFAGGPRACIGQHFAMLEATLALATLIRSHEIRSIDDDFPLETPYTTVAAGPIWARVHRRT

SEQ ID NO: 6281 - protein, 332 aa, Escherichia coli K12
MKTLGEFIVEKQHEFSHATGELTALLSAIKLGAKIIHRDINKAGLVDILGASGAENVQGEVQQKLDLFANEKLKAALKARDIVAGIASEEEDEIVVFEGCEHAKYVVLMDPLDGSSNIDVNVSVGTIFSIYRRVTPVGTPVTEEDFLQPGNKQVAAGYVVYGSSTMLVYTTGCGVHAFTYDPSLGVFCLCQERMRFPEKGKTYSINEGNYIKFPNGVKKYIKFCQEEDKSTNRPYTSRYIGSLVADFHRNLLKGGIYLYPSTASHPDGKLRLLYECNPMAFLAEQAGGKASDGKERILDIIPETLHQRRSFFVGNDHMVEDVERFIREFPDA

SEQ ID NO: 6282 - protein, 514 aa, Agrobacterium tumefaciens str. C58
MLASMKGYSRECNMRDGPSALTFIHLCDSFASGTRVRRKEQPWFSTGAAGGGINTATPMRIETIIFDCFRQAAEKPQEISIFRHKFTLHLHAAVASICQTCLWVYAKRRAMMAKQKVAMLTAGGLAPCLSSAVGGLIERYSDIAPEIDIIAYRSGYQGVLLGERIEITKDMREKAHLLHRYGGSPIGNSRVKLTNAADCAKRGLVKEGDNPLRVAAERLAADGITILHTIGGDDTNTTAADLAAYLGANGYDLTVVGLPKTVDNDVVPIKQSLGAWTAAEVGAAFFDNVSNEQSAAPKTFVIHEVMGRHCGWLTAATARAYIQKTRGNDYVEGLMMNTQMKNIDGIYLPEMAFDIEAEAERLKEVMDKHGYVTLFVSEGAGLDAIVAEREAAGEAVKRDAFGHVKIDTINVGGWFQKQFAGLIGAERSMVQKSGYFARSAPANGDDLRLIQGMVDLAVESALNKVSGVTGHDEDQNGKLRTIEFPRIKGGKHFDLSAKWFTEVMEHVGQPFTAA

SEQ ID NO: 6283 - protein, 455 aa, Rhizobium leguminosarum bv. viciae 3841
MPDTYPPSNLAAIDAAHHLHPFADMKKLNAEGARIIQRGEGVYIFDNHGRKYLDGFAGLWCVNIGYGRREIADAATRQMNELPYYNTFFGTTSTPATLLAQKVTSHAGERFNHIFFTGSGSEANDTWFRMARVYWSAVGKSSKKIVISRKNGYHGSTVAGASLGGMKYMHEQGDLPIPGIVHIGQPYWYGEGGDLSPAEFGLKVARELEAKIDELGEENVAAFVAEPVQGAAGVIIPPETYWREIDRICKARNILLVTDEVICGFGRLGAWFGHQYFGVEPDLAPIAKGLSSGYLPIGGVLVSDRVADVLINEVGDFNHGFTYSGHPVCAAAALENLRIIEEERLVERVRDDIGPYFGKAWAALADHDLVGEAVSIGLMGGLQLAAEKSTRTRYAKPDQVGALVRNHALANGLVLRATGDRMLASPPLVISHAEVDEMARITRLALDLAWKELKP

SEQ ID NO: 6284 - protein, 368 aa, Chlorobium tepidum TLS
MVLSMGPQHPSTHGVLRLECITDGEVVVEAEPYLGYLHRCFEKHCEKIDYPAIVPYTDRMDYLAGMNNELAYCITVEKLLDIEIPRRVEFIRVIVAELNRIASHLVAIGTYAIDLGAFTPFLFCFRDREHIMSLLEWISGARMLYNYIWIGGLAYDVPADFKTRVAEFVTYFRPKAKELYQLLTENEIFVKRTYDIGIMPADVAINYGWSGPMLRGSGVKWDLRRNDPYSVYPELDFDVPVPDGKFSVVGDCLSRHLVRALEMEESLKIIEQCLDKMPEEPNFNSRALIPKKIRPKAGEVYGRAENPRGELGYYIVSDGKSTSPVRCKARSSCFVNLSAMKDLSKGQLIPDLVAIIGSIDIVLGEVDR

SEQ ID NO: 6285 - protein, 546 aa, Escherichia coli CFT073
MTPGEVRRLYFIIRTFLSYGLDELIPKMRITLPLRLWRYSLFWMPNRHKDKPLGERLRLALQELGPVWIKFGQMLSTRRDLFPPHIADQLALLQDKVAPFDGKLAKQQIEAAMGGLPVEAWFDDFEIKPLASASIAQVHTARLKSNGKEVVIKVIRPDILPVIKADLKLIYRLARWVPRLLPDGRRLRPTEVVREYEKTLIDELNLLRESANAIQLRRNFEDSPMLYIPEVYPDYCSEGMMVMERIYGIPVSDVATLEKNGTNMKLLAERGVQVFFTQVFRDSFFHADMHPGNIFVSYEHPENPKYIGIDCGIVGSLNKEDKRYLAENFIAFFNRDYRKVAELHVDSGWVPPDTNVEEFEFAIRTVCEPIFEKPLAEISFGHVLLNLFNTARRFNMEVQPQLVLLQKTLLYVEGVGRQLYPQLDLWKTAKPFLESWIKDQVGIPALVRAFKEKAPFWVEKMPELPELVYDSLRQGKYLQHSVDKIARELQSNHVRQGQSRYFLGIGATLVLSGTFLLVSRPEWGLMPGWLMAGGLIAWFVGWRKTR

SEQ ID NO: 6286 - protein, 198 aa, Gossypium barbadense
MCGGAIISDFVAPKYDRKLTGDDLWSELDIFSDLLGFDNNGKSFVNHQFHNNNNNKLINPKDNQLNKERSETIQKTSQVTKKVEKTQRTRKNFYRGIRQRPWGKWAAEIRDPQKGVRVWLGTYNTAEEATRAYDEAAKRIRGDKAKLNFPQTPTKNQAASPALTLLPPAKKRCIVPGVNSTEFTRLDSPPISLWVLGV

SEQ ID NO: 6287 - protein, 470 aa, Pseudomonas syringae pv. syringae B728a
MSVATRFIDDQPTRVAPAAAETLYQFDESPLLARQSRQESNARSYPRRIPLALKRAKGIHVEDVEGRRFIDCLAGAGTLALGHNHAVIIEAIQQVIADELPLHTLDLTTPVKDQFVQDLFGLLPPALADDAKIQFCGPTGTDAVEAALKLVRTATGRSTVLSFQGGYHGMSQGALSLMGSLGPKKPLGALLGTGVQFLPYPYDYRCPFGLGGEQGVRANLHYLENLLNDPEAGVQLPAAVILEVVQGEGGVIPADLDWLRGVRRITEKAGVALIVDEIQSGFARTGKMFAFEHAGIIPDVVVMSKAIGGSLPLAVVVYRSWLDTWLPGAHAGTFRGNQMAMATGSAVMRYLQEHSICEHATAMGARLSGHLRALQRDFPQLGDIRGRGLMLGVELVDPSGARDAQGHPPLFSRLAPLIQRECLKRGLILELGGRHASVVRFLPPLIITAEQIDEVAEIFGRALNAAVAQV

SEQ ID NO: 6288 - protein, 250 aa, Sulfolobus tokodaii
MECDKVGDLLLTSTYAIAFTGAGISTASGIPDFRGPNGLWKKYSPELATIEYFKKDPKGFWEFYRLRMRGLFTALPNRAHYALAELEKMGLIRAIITQNIDGLHQLAGSRNVIELHGNMRKCYCVNCLKTYDSDTVLDKIDKEGLPPKCECGGVIRPDVVLFGEPVYNISSALEIAREADLVLAIGSSLTVYPANMIPLTVKEMGGKLIILNAEETPLDNIADIVVRERVEEFLPCVVDYIKSQTLHRSS

SEQ ID NO: 6289 - protein, 319 aa, Gossypium barbadense
MSNVYLWFMYPYDIKFFFLCSIIEGSNSEKSMQFDGQAEKCAKRKRKNQYRGIRQRPWGKWAAEIRDPRKGVRVWLGTFNTAEEAARAYDAEARRIRGKKAKVNFPNETPRTSPKHAVKTNSQKPLSKSNLSPVQLNLDQNYNYLSQPEQEYFDTMGFVEEKPLVNQFAYVDPVPTSIDAGSNQSDNAPLYFNSDQGSNSINCSDYGWGEQGARTPEISSILEASVVGEEFLEDANPSKKLKPSSDNVMPAEDNSAKTLSDELLALDNQMKYFQMPPFIEGNWDATIDAFLNGDATQDGGNPMDLWNFDDFPTMAEGVF

SEQ ID NO: 6290 - protein, 198 aa, Gossypium hirsutum
MSASRFIKCVTVGDGAVGKTCLLISYTSNTFPTDYVPTVFDNFSANVVVDGNTVNLGLWDTAGQEDYNRLRPLSYRGADVFLLAFSLISKASYENVAKKWIPELRHYAPGVPIILVGTKLDLREDKQFFIDHPGAVPITTAQGEELRKLIGAHFYIECSSKTQQNVKAVFDAAIKVVLQPPKKKKKKKRKAQKACSIL

SEQ ID NO: 6291 - protein, 128 aa, Coccidioides immitis RS
MSAKQVVLTDKAPAPLPVLSQGIIHNGIVYCSGQVGIDPASNQMVEGTVQDRTAQIFRNLSAVLEKAGSSLEKVIKVNVFLANMDDFSAMNEIYSQFLNQEPKPVRTCVAVKSLPLGTDVEIECSAYI

SEQ ID NO: 6292 - protein, 344 aa, Nicotiana tabacum
MGMIIQEALFFLSCIYILLRSYSAVEAAVGVCYGRVGTNLPPPSEAINLIKSIGVSRIRLFNPDPEALQPFAGTGIELLVGVPNEILPTLANSPVTISMEWLQTNIFAHVSPPQVKYLAVGNEIFLKDPFYSPHIVPAISNLYQALQTLGLATTIKLSSSHASTILSNSYPPSSGVFNSTIRPFLLPFLQFLRHTSSPLMVNVYPFFAYINNPQYVSLDHAVFRSSYVEYDQNLAYDNMFDASIDAFVYAMEKEGFEGIPVMVTETGWPTAGIDGASIDNALSYNGNVVRRALTNVGTPKRPGVGLDVFLFDLFDENKKSGEEFERHFGILGDNGIKAYDIRFN

SEQ ID NO: 6293 - protein, 212 aa, Zea mays
GNIDWNEAHFAYDLLHEDKDLTLDTRDSAPFTPKCRVIDTNAFDWQDHNRPSIPWSSTVIYETHVKGFTQLNPAIPAEMRGTYDGMSHKSTVDYIKSLGVTSVELLPVHWFPDDQHLLDRGLKNFWGYNSLAFFAPASRYFGPRGIQGFRDMVRAFHDAGIEVILDVVYNHTAEGNELGPTLSFKGIDNFSYYRTLPDQHRYYINDTGTGNT

SEQ ID NO: 6294 - protein, 482 aa, Rhodococcus rhodochrous
MSMQYDSLFIGGDWIAPSSSKRITAISASTEQPIGSVPEAQEADVDAAVAAARRALDDPAGWAHWAPAARAAAIERLADVLERRAEDVVQCVSAQNGMPVAVARQLEGVFPVVLLRYYAGLARDTATEETRPGLFGGSTLVCREPLGVVGAIVPWNFPQTLAAFKYAPALAAGCTLVIKPSPETVLDAFVFAEAVAEAGIPAGVVNVVPGGREVGAYLVEHPGVDKISFTGSTAAGRSIGEVCGRLLRPVTLELGGKSAAIVLDDAGLDLQTMSEKLFAATLLNNGQTCFLGTRVLAPRSRYSEIVDLFTDLAGTLKVGDALDDTTQIGPMATAAQRDRVEQYIAKGLGDGARITIGGGRPADQDKGWFVEPTIFADVENNHTIAQEEIFGPVLSVIPYSDEDEAVRIANDSDFGLGGTVWTNDPDRGLALAKRVQTGTIGINGYLPEPTAPFGGVKASGLGRELGPEALSNYQQLKSIYLD

SEQ ID NO: 6295 - protein, 300 aa, Chromobacterium violaceum ATCC 12472
MAKHWGKVLTAMVTPFDGDGRLNLDAARALARHLADNGSDALVLAATTGEAPTLDDAERFDLIRAVSDAVTIPVLAGTGSNDTRHALAMTARAEAAGAAGVFLVSPYYNRPPQAGIEAHFRALAAATRLPVMIYDVPGRTGRRIAHDVLLRLFREVDNIVAFKDATCDPAAAARLVAEAGEHFELYSGDDALTLPLLAVGAVGVVGTSTHWTGPEFAEMIAAFERGDAGRAREINAALMPSYAYSNTDDSVYSMSVKAMLRALGLAVGECRLPLPATPAGVEARAAEIWRELEAWRAAQR

SEQ ID NO: 6296 - protein, 358 aa, Chromobacterium violaceum ATCC 12472
MSSMKATVFVGPGRIELREKPIPAVGPGDALVKITTTTICGTDVHILKGEYPVASGLTIGHEPVGVIEKLGADVKGYREGQRVIAGAICPSFTSYGCQDGHPAQDGGCECHGYKPMGGWRFGNTIDGTQAEYVLVPDAQANLAPIPDGLSDEQVLMCPDIMSTGFAGAEAANIRIGDVVVVFAQGPIGLCAVAGARLRGASCIIAVDGLDERLGISRRLGADVTLNFKQVDVIAEIMKLTGGRGVDASIEALGTQGTFESALRVLKPGGTLSSLGVYSSDLRIPLDAFNAGLGDKRIVSSLCPGGKERMRRLMNVLESDRLDLSPLVTHRYKLDQIVEAYDLFSHQRDGVLKVAIQPF

SEQ ID NO: 6297 - protein, 263 aa, Triticum aestivum
  misc_feature (148)..(148): Xaa can be any naturally occurring amino acid
MEDERSTQSYQGGEAAEQVEVTDRGLLGNLLGKKKAEEDKEKEEELVTGMEKVSVEEPEVKKEEHEDGEKKETLFSKLHRSSSSSSSSSDEEEEEVIDDNGEVIKRKKKKGLKEKLQGKLPGHKDTEGEHVTGLPAPAAPASVQTHGXGHHDTDVVVEKIDGDVKTEAAPAVPEEEKKGFLEKIKEKLPGGHKKPEDAAAVPVTHAAPAPVHAPAPAPEEVSSPDAKEKKGLLGKIMDKLPGYHKTGEEDKAAAATGEHKPSA

SEQ ID NO: 6298 - protein, 1087 aa, Nostoc punctiforme PCC 73102
MPRRDDLRKILLLGSGPIVIGQACEFDYSGTQACKALREEGYEVVLVNSNPATIMTDPETADRTYIEPLTPELVEKVIEKERPDALLPTMGGQTALNLAVALAKNGVLEKYGVELIGAKLPAIEKAEDRKLFGEAMARIGVAVCPSDTAETLEEAKAVARQIGSYPLIIRPAFTMGGSGGGIAYNQEEFEEMAQVGIDASPVSQILIDQSLLGWKEYELEVMRDLADNVVIICSIENLDPMGIHTGDSITVAPAQTLTDKEYQRLRDMAIKIIREIGVETGGSNIQFAVNPLNGDVVVIEMNPRVSRSSALSSKATGFPIAKMAAKLAVGYTLDEIKNDITKKTPASFEPTIDYVVTKIPRFAFEKFPGSDPVLTTQMKSVGEAMAIGRTFNESFQKALRSLETGRAGWGCDKAEKLPSGEQIRAQLRTPNPDRIFAVRHALQQGMTIEEIYELTGIDRWFLDKLQQLLDVEKFLKRTPLQQLTKEQIYEVKRDGYSDRQIAYATKTTEDEVRAYRKSLGIIPVYKTVDTCAAEFEAFTPYYYSTYEEETEVMPATKPKVLILGGGPNRIGQGIEFDYCCCHAAYALKDAGYETIMVNSNPETVSTDYDTSDRLYFEPLTKEDVLNIIETENPVGIIIQFGGQTPLKLAIPLQEFLNNDTSGLNTKIWGTSPDSIDMAENRERFEKILQELNIAQPPNGIARSYEDALIVAKRIGYPVVVRPSYVLGGRAMEIVYSDAELERYMSFAVLIEPEHPILIDKFLENAIEVDVDAIADHTGRVVIGGIMEHIEQAGIHSGDSACSLPSISLSPAVLNQIRTWTVQLAQALSVVGLMNIQFAVVGASSYSPQVYILEANPRASRTVPFVSKATGVQLAKLASLIMSGKTLEELGFTEEVIPTHIAVKEAVLPFNKFPGTDTILGPEMRSTGEVMGIDSDFGRAFAKAELGAGERLPLTGTVFVSMSDRDKAAAGAVVKEFIDLGFTVMATLGTRRVLLEQGLNIELVLKLHEGRPHVLDAIKNQKIQLIINTPSGEEAHTDARLIRRTALAYKIPIITTIAGAKATVAAIRSLQNTTLDVKTIQEYCPIAR

SEQ ID NO: 6299 - protein, 642 aa, uncultured bacterium 463
MSGIVGLVRYDQQGVTRNQIESLLQQMAYRGPDGMHCWVDGQVGFGHAMLHTTPESLHEVQPLHVPERNLTLVMDGRLDNGLELRGRILSLGMSVPRLTDADLVLAAYLVWGEACVDHLEGDFALVLWDSSSQRLFCARDRIGHRPFYYHHSDGLFAFASELHLLLTLPEVSRRPDTVYRTEHLATEWHSRERTLWADIKRLPAAHILSLRGCELEKKEYWQPDFNAQLYYPSYEDYVEHYREVHDTTVQRMSRSHKPLACTVSGGLDSSAIFATSKWLEGQGRLRAPGVQAYTLDFSHDEDANELAYARAVTDYLGCELNAVLPSDYPLDWYLQRAEHRAEAYCIPTSTMSNKLRQQVASGGNRALIGGLGGDQWLGFGENCYMELLANRQWRSLHSIWREDAKARGAARAGYYIARYGLVPLLPRVIKRPLQRWRDNREHLATGRHWLGPGGADSLERGAQMAWRKPRNGFRWAGQQADWSRLLNGRVANGLEMTQQFTAEAGLELRSPYWSEAMIQLSISLPKHLLYGQLLDRPLHRRAMVGRLPERVLQRDSKAEFSVTYTGIMAQATALVSASMTQSVALGLQEPYIHKAVEAEHAEPVGDECDGLWELCNVLAATQSLPPRGDSDTDPHSVDYASR

SEQ ID NO: 6300 - protein, 145 aa, Triticum aestivum
  misc_feature (90)..(90): Xaa can be any naturally occurring amino acid
  misc_feature (100)..(100): Xaa can be any naturally occurring amino acid
MAPAVMASSATTVAPFQGLKSTAGLPVSRRSGSAGLSSVSNGGRIRCMQVWPIEGIKKFETLSYLPPLSTEALLKQVDYLIRSKWVPCLXFNKVGFVFRXEHNNSPRATKNSILDKCGKLPNVRGATERKRKAQTKGWKAKKRYP

SEQ ID NO: 6301 - protein, 421 aa, Thermococcus kodakarensis KOD1
MVEIDPFEMAVQQLERAAQFMDISEEALEWLKRPMRIVEVSVPVEMDDGSVKVFTGFRVQHNWARGPTKGGIRWHPAETLSTVKALATWMTWKVAVVDLPYGGGKGGIIVDPKKLSEREQERLARSYIRAVYDVIGPCTDIPAPDVYTNPKIMAWMMDEYETIMRRKGPAFGVITGKPPGVGGIVARMDATARGAAFTIREAAKALGWDDLKGKTIAIQGYGNAGYYLHKIMSEEFGMKVVAVSDSKGGIYNPDGLPPADEVLKWKKEHGSVKDMPGTQNITNEELLELEVDILAPSAIEGVITKENADNVKAKIVAEVANGPVTPEADEILHEKGILQIPDFLCNTGGVTVSYFEWVQNINGFYWTVEETRKRLDDKMTKAFWDVFNTHKEKNIHMRDAAYVVAVSRVYEAMKHRGWVKK

SEQ ID NO: 6302 - protein, 205 aa, Solanum lycopersicum
MFYSDPRIESCSSFSDSIRANHSDEEVILASNNPKKPAGRKKFRETRHPVYRGVRKRNSGKWVCEVREPNKKTRIWLGTFPTAEMAARAHDVAAIALRGRSACLNFADSAWRLPTPDSSDTKDIQKAAAQAAEIFRPLKSEEEESVVKDQSTTPDDMFFMDEEALFCMPGLLTNMAEGLMVPPPQCTEMGDHVEADDMPLWSYSI

SEQ ID NO: 6303 - protein, 540 aa, Geosiphon pyriformis
MNPETSDKNEPIISSQPAADDDDDNNNTEVKEKQDTKPTLDISTVGKNPDSKTAALPTFCLFVALVSVIGAFENGWNTSVSNVPEKIIRDCKNGQKHVNIGVLPDCLPMENLLWGFAVGSYAIGGLIGGISAGYLQTRFGRIRTLVGNNFSFILGALILGSAVNPGMFIIGRILTGVGSGISTVTVPTYLGEIATVKARGALGTIYQLFLVIGILFTQIIGLLLSSVPGWRILLALTAIPALIQLILLRFCVETPRYLISQNKLDEAQQSLQLLRPGFDVTNEYKEIYDGQQEAETVESRDPEKNPKTKDPKAISSGARKSLSFAQLFRDPMCRKMTIICVTLSVIQQLSGINGVIFYSTSIFSEVFADNAKYATVGVGVINLIFTMVSVILIDRQGRKRLLLASEIGIVVTSILVVLGSIYSINLLVVVAVLLFVSSFAIGLGPIPFLIIPELLPTYGVSAAASLAMGLNWLSNFLVGLIFPVLKDALKNYTFLVFAIITSFGAIFTLLFVPETKGRTLEEIHNENSKDTKNLDSQMKS

SEQ ID NO: 6304 - protein, 275 aa, Debaryomyces hansenii CBS767
MSKAYDGSLPYPCKFRLSITFYRKKINSRYEFKTILLPLLYFTMEEDKDNDNNKISIDQYGRKTWNVDAYAKEAKSKSSKKAISSTPNLSNSTINADKPLSYLTHRDKLLNELLSAVNQHTIINPLNTASYGKNKKFGFFCLVCDLSFRDNLALIDHINSPLHVQRSQSLVTKHDGEDTEILDGNVRRATVDEVRLTLESLITKLTQDKNSGNNKTNIKERIARRQEFEKNQQAKRKEKRLKSKQNKIAQKNKTDEGNNDIASMMGFGDFGSTKK

SEQ ID NO: 6305 - protein, 540 aa, Geosiphon pyriformis
MNPETSDKNEPIISSQPAANDDDDNNNTEVKEKQDTKPTLDISTVGKNPDSKTAALPTFCLFVALVSVIGAFENGWNTSVSNVPEKIIRDCKNGQKHVNIGVLPDCLPMENLLWGFAVGSYAIGGLIGGISAGYLQTRFGRIRTLVGNNFSFILGALILGSAVNPGMFIIGRILTGVGSGISTVTVPTYLGEIATVKARGALGTIYQLFLVIGILFTQIIGLLLSSVPGWRILLALTAIPALIQLILLRFCVETPRYLISQNKLDEAQQSLQLLRPGFDVTNEYKEIYDGQQEAETVESRDPEKNPKTKDPKAISSGARKSLSFAQLFRDPMCRKMTIICVTLSAIQQLSGINGVIFYSTSIFSEVFADNAKYATVGVGVINLIFTMVSVILIDRQGRKRLLLASEIGIVVTSILVVLGSIYSINLLVVVAVLLFVSSFAIGLGPIPFLIIPELLPTYGVSAAASLAMGLNWLSNFLVGLIFPVLKDALKNYTFLVFAIITSFGAIFTLLFVPETKGRTLEEIHNENSKDTKNLDSQMKS

SEQ ID NO: 6306 - protein, 111 aa, Vitis vinifera
KVLVIGGGDGGVLREVARYSSIEQIDICEIDKMVVDVSKQFFPAVAVGYEDPRVKLHVGDGVAFLKAVPAGTYDAVIVDSSDPIGPAQELFEKPFFQTVANALRPGGVVTT

SEQ ID NO: 6307 - protein, 102 aa, Vitis vinifera
ECAYQEMIAHLPLCSIESPKRVLVVGGGDGGVLREISRHSSVELIDICEIDKMVIDVCKKFFPQLYVGFEDPRVQLHVGDAVEFLRHVPEGKYDAIIVDSSD

SEQ ID NO: 6308 - protein, 821 aa, Pyrococcus horikoshii OT3
MDKMAYKFIKWFEELRKDDVPLVGGKGANLGEMTNAGIPVPPGFCVTAEAYKYFVENVKVSKEDVKKILGEKANKGTIAEVLASAPDEPRTLQEWIMDIINRTNVDDSKQLQENTAIIRELIESLEMPNEIADEIKQAYKELSQRFGKDEIYVAVRSSATAEDLPEASFAGQQETYLDVLGADDVIDKVKKCWASLWTARATFYRAKQGFDHSKVYLSAVVQKMVNSEKSGVMFTANPVTNNRNEIMINASWGLGEAVVSGAVTPDEYIVEKGTWKIKEKVIAKKEVMVIRNPETGKGTVQVKVAEYLGPEWVEKQVLTDEQIIEVAKMGQKIEEHYGWPQDIEWAYDKDDGKLYIVQSRPITTLKETTTEEVEEVEEAEVILKGLGASPGIGAGRVVVIFDASEIDKVKEGDVLVTTMTNPDMVPAMKRASAIITDEGGRTSHAAIVSRELGIPAVVGTKEATKKLKTGDYVTVDGTRGLVYKGIVKSLVEKKKKEEAAAAPGAAVAAAPLVTGTLVKVNVSMPEVAERAAATGADGVGLLRAEHMILSIGQHPVKFIKEGKEDELVERLAEGIEKVAAAFYPRPVWYRTLDAPTNEFREMPGGEDEPEERNPMLGWRGIRRGLDQPELLRAEFKAIKKVVEKGYNNIGVMLPLVSHPEQIRKAKEIAREVGLEPHKDVAWGIMIEVPAAAIIIEDLIKEGIDFVSFGTNDLTQYTLAIDRDNERVAKLYDETHPAVLKLIKHVIKVCKKYGVETSICGQAGSDPKMARILVRLGIDSISANPDAVQLIRQVVAQEERKLMLEAARKKLLEEEEEEEDLF

SEQ ID NO: 6309 - protein, 83 aa, Arabidopsis thaliana
  misc_feature (4)..(4): Xaa can be any naturally occurring amino acid
  misc_feature (10)..(11): Xaa can be any naturally occurring amino acid
  misc_feature (19)..(19): Xaa can be any naturally occurring amino acid
  misc_feature (26)..(27): Xaa can be any naturally occurring amino acid
  misc_feature (51)..(51): Xaa can be any naturally occurring amino acid
  misc_feature (59)..(59): Xaa can be any naturally occurring amino acid
ASSXLSSPPXXTCPTKATXVSPFTLXXSSPAFPVTLKTNNDIPSHPNNPAXQISPLNKXPPIRNKNLETLPYLPDLNDAQSSN

SEQ ID NO: 6310 - protein, 446 aa, Zea mays
MAATIQSVKARQIFDSRGNPTVEVDVFCSDGTFARAAVPSGASTGVYEALELRDGGSYYLGKGVSKAVNNVNSVIGPALIGKDPTAQTEIDNFMVQQLDGTKNEWGWCKQKLGANAILAVSLAVCKAGASIKRIPLYQHIANLAGNKQLVLPVPAFNVINGGSHAGNKLAMQEFMILPTGAASFKEAMKMGVEVYHHLKSVIKKKYGQDATNVGDEGGFAPNIQENKEGLELLKTAIEKAGYTGKVVIGMDVAASEFYSDKDQTYDLNFKEENNDGSQKISGDSLKNVYKSFVSEYPIVSIEDPFDQDDWVHYAKMTEEIGEQVQIVGDDLLVTNPTRVAKAIKEKSCNALLLKVNQIGSVTESIEAVKMSKRAGWGVMTSHRSGETEDTFIADLAVGLSTGQIKTGAPCRSERLAKYNQLLRIEEELGAIAVYAGAKFRAPVEPY

SEQ ID NO: 6311 - protein, 208 aa, Zea mays
RKVVHVLSGVLFMSSWPLFSNSTEARYFAAVVPFLNSMRLLIYGLRLYTDEALVKSVTREGKPEELLRGPLYYVLVLLFSVLVFWRESPIGIVSLSMMSGGDGFADIVGRRYGSAKLPFNRKKSWAGSISMFISGFLLSAMMMLYFSSLGYIDVIWEEALGKLALVALAATVVECVPVTEVVDDNISVPLATMLVAFLLFSSNRTIVN

SEQ ID NO: 6312 - protein, 487 aa, Kineococcus radiotolerans SRS30216
MTTTEERSTTPAPSAAERTFPPGFVWGTATASYQVEGAVAEDGRTPSIWDTFSHTPGRVVAGDTGDVADDHYHRFREDIALMKRLGMASYRFSVAWPRITPQVSADELGPVNPAGLAFYSTLVDELIAAGIEPAVTLYHWDLPQALEDAGGWTARTTAERFAEYAEVVAGALGDRVRTFITLNEPWCSAYLGYASGVHAPGRTEPASALAAVHHLNLAHGLGAAAVRRAAPGARVALTLNLAWVRTEGTSEADADAVRRVDGLQNRVFLDPVLRGTYPADVQADTSSVTDWSFVREGDLALIHQPLDVLGVNYYSPTVVRAWDGSAPRAENDGHGNSAHSPWVASTDVEFPELPGEKTAMGWSIDPRGMTELLLRIHREHPGLELLVTENGAAYDDVVVAGQVHDVERTRYLRDHLAAVLDAVEAGAPVTGYYLWSFLDNFEWGYGFSKRFGVVHVDYATQERTVKDSALWYADVVSRNALPAADAD

SEQ ID NO: 6313 - protein, 247 aa, Aeropyrum pernix
MAVEAVWESARILANSRFAVAFTGAGISAESGIPTFRGKDGLWSRFDPRDLATPEAFNRDPRLVWEWYSWRIERVLAAKPNKAHRLLARLEDSGVLKAVITQNVDGLHRRAGSRRVLELHGNVLRARCTRCGSKLEWREKPSNLPPSCPRCGGVLRPDVVWFGEPLDTSLLEEAFGLARRSDVMIIIGTSGAVDPAGLLPLAAKESGATLINVNPEPNRYSGVADIELRMRAVEFAERLSRAMGIDI

SEQ ID NO: 6314 - protein, 115 aa, Wigglesworthia glossinidia endosymbiont of Glossina brevipalpis
MNLINIIENSQKKSNITKLFSGDIVKINIWVLEGNKKRIQIFEGIIIAIKNKGISSSITVRKISNGEGVERMFPLHSPIIESIIVNRHSLVRKSKLYYLRNKKGRSSRIKQRLKK

SEQ ID NO: 6315 - protein, 208 aa, Aggregatibacter actinomycetemcomitans
MKPICVVLSGAGISAESGIPTYRAEDGLWAGHKIEDVCTPEALQRNRKQVLAFYNERRRNCAEAKPNAAHKVLVELERSYNVQIITQNVEDLHERAGSTNVLHLHGELTKARSSFDPDYIVPCMGDQSVNDKDPNGHPMRPHIVFFGESVPVLEPAIDLVSQADIVLVIGTSLQVYPANGLVNEAPKNAQIYLIDPNPNTGFNPVTGW

SEQ ID NO: 6316 - protein, 181 aa, Brucella suis
MESGFKVTLKDAIRTIPDYPKPGVQFRDVTTLMGNAQAFRRAVDELVYPYAGNRIDKVAGIEARGFILGGAIAHQLSAGFVPIRKKGKLPRDTVRIAYSLEYGVDEMEMHRDAIEKGERVVLVDDLIATGGTAEAAAKLLLQMGAEIVAACFIIDLPDLGGRKKLEALGLPVRTLVAFEGD

SEQ ID NO: 6317 - protein, 382 aa, Chromobacterium violaceum ATCC 12472
MTEVVLTGKPKKSVALSGVAAGNTALCTVGRSGNDLHYRGYDILDLAGHCEFEEVAHLLVHGKLPNKAELAGYKKKLKSLRGLPASVKAALEALPAAAHPMDVMRSGVSALGCALPEKDDHNLAGARDIADRLMASMGSMLLYWYHYSHNGKRIEVETDDDSIGGHFLHLLHGVKPSYEWVRAMHTSLNLYAEHEFNASTFTARVIAGTGSDMHSAITGAIGALRGPKHGGANEVAFEIQQRYENPDEAEADIRARVERKEVVIGFGHPVYTISDPRNKVIKEVARELSRSNSDMKMFDIAERLESVMWDVKKMFPNLDWFSAVSYHAMGVPTAMFTPLFVISRTSGWAAHVIEQRQDGKIIRPSANYIGPEDQAFVPLEKR

SEQ ID NO: 6318 - protein, 154 aa, Nostoc punctiforme PCC 73102
MPKTVADVMSRDPIVVRAETPLKEAIQILAERHISGLPVVDDVGKLVGIISETDLMWQETGVTPPAYIMFLDSVIYLKNPATYERDLHKALGQTVGEVMSKNPIAISPDKTLKEAATIMHDRSVHRLPVLDGTDQVIGILTRGDIIRAMAASQE

SEQ ID NO: 6319 - protein, 220 aa, Solanum lycopersicum
MDIFESYYSNSFVESLLSSSLSISDTNNLNHYSPNEEVIILASNNPKKPAGRKKFRETRHPVYRGIRKRNSGKWVCEVREPNKKTRIWLGTFPTAEMAARAHDVAAIALRGRSACLNFADSVWRLPIPASSNSKDIQKAAAEAAEIFRSEEVSGESPETSENVQESSDFVDEEALFSMPGLLANMAEGLMLPPPQCLEIGDHYVELADVHAYMPLWNYSI

SEQ ID NO: 6320 - protein, 188 aa, Clostridium tetani E88
MWEVIKVKKIVVMLAKGFEEIEALTVVDILRRVGVDCKTCSITEEKMVKGAHNIYVKSDTLLKDFKEYGFSGIVLPGGMPGATNLRDNKEVIGIIKEFNDENKLIAAICAAPIVLKEADIVENKNITSYPGFEEELKGSNYKEDKVVQHGNIITSRGPSTAIDFTFKILENIIDEKELEELKKSMLYL

SEQ ID NO: 6321 - protein, 362 aa, Photobacterium sp. SKA34
MAGSYNIAVLPGDGIGPEVMQQAHKVLNAIETKFNLTFNRTEYDVGGIAIDNHGCPLPDATLKGCEQSDAVLFGSVGGPKWEHLAPNDQPERGALLPLRKHFQLFCNLRPAQIHRGLEKFSPLRTDISERGFDIAVVRELTGGIYFGQPKGREGEGAQEKAFDTEVYYRYEIERIAKIAFESARLRSKKVCSIDKANVLQSSILWREVVEEIAKDYPDVTLTHMYIDNATMQLIKDPSQFDVMLCSNIFGDIISDECAMITGSMGMLPSASLNQDKFGMYEPAGGSAPDIAGKNIANPVAQILSAALMLRYSLGEETAARAIEQAVSQALEAGELTADLASDKPALTTSEMGDKIAAYIQQA

SEQ ID NO: 6322 - protein, 278 aa, Zea mays
MVEAAGVRIERGRGGRTPRGGRGGGGRGGRGGGMKGGSKAVVVAHKHAGVFISKSKEDALCTKNMVPGESVYGEKRVSVQNEDGTKVEYRVWNPFRSKLAAAVLGGVDNIWIAPGTRVLYLGAASGTTVSHVSDIVGPDGLVYAVEFSHRSGRDLVNMAKKRTNVIPIIEDARHPARYRMLVGMVDVIFSDVAQPDQARILALNASYFLKNGGHFVISIKANCIDSTLPAEAVFAAEVEKLKADQFKPAEQVTLEPYERDHACVVGGYRVPKKQKATS

SEQ ID NO: 6323 - protein, 860 aa, Ustilago maydis 521
MDPIDLKPKTADSDTSSDKLKQDLTEKDDIQVSNVGYVLKSNRADVEYAGETPLLEEDKVVHNAADIVTQVISLEDDASLNPWTFRMWFLGLGLAIFGATLQEIFYFKPQVIYVSLVFLTVIAYAIGEFMAAVIPKHGFIGRWLNPHPFNLKEHAAITLMASAGTQSALATEALAAQQLFYGGYPSKAAGIFLVLSSQLLGMTVAGLLRNVLVRPVKLLWPGNLPMTSLLESFHGSKGVDAKLIVKKRMKVFWLVAGTLFVWELFPEYIFPVLEGVSVFCLSRQNDLVFTNLFGGASGNEGLGFLSICFDWNYIAGLGSPMWVPLETMFNNLVGYIGCIVLFIGLYYGNIFRAQDFPFLSQELFDGTSNGTNAFIYNQTSIMTPEFLIDQEALKAQGTPWITATYLGYLITSNIGLTACFTHMMLWNYDDIKAGWSWAYPSELKKLFANPHWYKFWRASTEEEEAEWAQKMMADERCDPHYKVMMKNGYKEAPMWWWGASLLVSWAVGLICLYVMKSTLPWWGFILSTLFTFVFMLFFGAQAGITGFGFNLQPICQMLAGYLFPGRPLANLYFTCYTYNTMSMGLMLAKDLKLGQYVHLAPMCTFTVQIVGCLVGAMMNWVMMSEIVENQATILKSVLGTNIWSGQNIQQFNTLAIAWSIAKDMFSIGAKYQWVTIAYLIGFFVPLPMYLGNKIWPHRAWSYFNFSIIAWYMGWLFVGINASITSYFIIGFFAQFYLRKYRPGWFNKYNYIVSAALDGGTQTMVFILTFAVFGGSGKARPFPTWAGNPDAKLHNLDYCAISPIAVDFDLQSRITNLRDTVKFTIPHSSSTCEVLGRSTIQLALNQATDGRGRAKRNQSRM

SEQ ID NO: 6324 - protein, 436 aa, Neocallimastix frontalis [sequence omitted]

SEQ ID NO: 6325 - protein, 445 aa, Ricinus communis
MAITIVSVRARQIFDSRGNPTVEADIKLSDGHLARAAVPSGASTGIYEALELRDGGSDYLGKGVSKAVENVNSIIGPALIGKDPTEQTALDNFMVQELDGTVNEWGWCKQKLGANAILAVSLALCKAGAHVKGIPLYKHIANLAGNKNLVLPVPAFNVINGGSHAGNKLAMQEFMILPVGASSFKEAMKMGAEVYHHLKSVIKKKYGQDATNVGDEGGFAPNIQENKEGLELLKTAIAKAGYTGKVVIGMDVAASEFYGSDKTYDLNFKEENNDGSQKISGEALKDLYKSFASEYPIVSIEDPFDQDDWEHYSKLTSEIGEKVQIVGDDLLVTNPKRVEKAIQEKACNALLLKVNQIGSVTESIEAVRMSKRAGWGVMASHRSGETEDTFIADLSVGLATGQIKTGAPCRSERLAKYNQLLRIEEELGAEAVYAGAKFRTPVEPY

SEQ ID NO: 6326 - protein, 199 aa, Escherichia coli CFT073
MMSAPDIRHLPSDTGIEVAFAGRSNAGKSSALNTLTNQKSLARTSKTPGRTQLINLFEVADGKRLVDLPGYGYAEVPEEMKRKWQRALGEYLEKRQSLQGLVVLMDIRHPLKDLDQQMIEWAVDSNIAVLVLLTKADKLASGARKAQLNMVREAVLAFNGDVQVETFSSLKKQGVDKLRQKLDTWFSEMQPVEETQDGE

SEQ ID NO: 6327 - protein, 305 aa, Erwinia carotovora subsp. atroseptica SCRI1043
MSREKIEGSFVALITPFNDDGSVDFGAFEALLKFQEDNGTAAVLIMGSTGEVSMLSPDERKAIIRRTAQYSTSKMKLFYGCTGNNTDTTIDYVRYAHDNGADGAIIAAPAYICASESDIESYFLEIADATDLPLGIYNNPPRVKTDLHWTSLLRIFKHPNYVIHKESTTRVGQVAQVLAGNPDVSVMCCDSPNLGLVVPTMSLGGHGTANMTGNIAPAELAEISRPWKNGEDAERFRQAYQHLLPLLHYTYSAINPVAVKSLMKAVGLPAGSLRRPLRGLQGEALDSGVRIVNELGLSSKYGFKS

SEQ ID NO: 6328 - protein, 468 aa, Lactococcus lactis
MTKTLPKDFIFGGATAAYQAEGATHTDGKGPVAWDKYLEDNYWYTAEPASDFYHKYPVDLELAEEYGVNGIRISIAWSRIFPTGYGEVNEKGVEFYHKLFAECHKRHVEPFVTLHHFDTPEALHSNGDFLNRENIEHFIDYAAFCFEEFPEVNYWTTFNEIGPIGDGQYLVGKFPPGIKYDLAKVFQSHHNMMVSHARAVKLYKDKGYKGEIGVVHALPTKYPYDPENPADVRAAELEDIIHNKFILDATYLGHYSDKTMEGVNHILAENGGELDLRDEDFQALDAAKDLNDFLGINYYMSDWMQAFDGETEIIHNGKGEKGSSKYQIKGVGRRVAPDYVPRTDWDWIIYPEGLYDQIMRVKNDYPNYKKIYITENGLGYKDQFVDKTVYDDGRIDYVKQHLEVLSDAIADGANVKGYFIWSLMDVFSWSNGYEKRYGLFYVDFDTQERYPKKSAHWYKKLAETQVIE

SEQ ID NO: 6329 - protein, 559 aa, Mesorhizobium loti MAFF303099
MAEVKSDIEIARAAKKKQIQEIGQKIGIPTEHLLPYGHDKAKISAEFIKSVKGNKDGKLILVTAINPTPAGEGKTTTTVGLGDGLNRIGKKAIVCIREASLGPNFGVKGGAAGGGYAQVVPMEDMNLHFTGDFHAITTAHNLLSALIDNHIYWGNELGIDTRRVVWRRVMDMNDRALREMICSLGGVANGFPREGGFDITVASEVMAILCLSTDLKDLEKRLGDIIVAYRRDKSPVYARDLKADGAMAVLLKDAMQPNLVQTLENNPAFVHGGPFANIAHGCNSVVATTTALKLADYVVTEAGFGADLGAEKFFDIKCRKAGLKPAAAVIVATVRAMKMNGGVKKEDLGKENIEAVKKGCANLGRHIENIRQFGVPAVVAINHFYSDTDAEIQAMKDYVASMGEEAVLCKHWAKGSAGIEELANKVVALAESGASQFAPLYPDAMPLFEKINTIVQRIYRGSEAIADKSVRDQLHAWEQAGYGNLPVCMAKTQYSFSTDPNLRGAPTGHTVPVREVRLSAGAGFVVIICGEVMTMPGLPKAPSSEKIFLNEAGQIEGLF

SEQ ID NO: 6330 - protein, 415 aa, Pseudomonas putida KT2440
MNAFNYRDGELFAEGVALSAIAERYGTPTYVYSRAHIEAQYRSYADALQGTEHLVCFAVKANSNLGVLNVLARLGAGFDIVSGGELERVLAAGGRADRVVFSGVGKTREDMRRALEVGVHCFNVESTDELERLQVVAAEMGKVAPVSLRVNPDVDAGTHPYISTGLKENKFGIAIADAEAIYVRAAQLPNLEVVGVDCHIGSQLTTVEPFLDALDRLLVLVDRLAECGIHLRHLDLGGGVGVRYRDEQPPRVADYIKAIRERVGERDLALVFEPGRYIVANAGVLLTRVEYLKHTEHKDFAIIDAAMNDLIRPALYQAWMGVSAVKPRAGEGRAYDLVGPICETGDFLGKDRVLNLAEGDLLAVESAGAYGFVMSSNYNTRGRCAEILVDGDQAFEVRRRETVAELYAGESLLPE

SEQ ID NO: 6331 - protein, 267 aa, Brucella suis 1330
MGRAVDNGAHCIDACTQQNTLTGIEPLSEQDKKQAAIKAAQAAADAVREAQAALAEEGRLLFKKSWIFIRGVPSMKFLPPEGPVEIAFAGRSNVGKSSLINALVGKKGLARTSNTPGRTQELNYFVPDGYSGENGDLPPLALVDMPGYGFAEAPKAQVDAWTRLVFDYLRGRTTLKRVYVLIDARHGIKKNDAEVLDLLDKAAVSYQIVLTKIDKIKPAGVPRLLEETHKLTYKRAACFPGIIATSSEKGQGLDDLRAAIALLLKEY

SEQ ID NO: 6332 - protein, 582 aa, Cryptococcus neoformans var. neoformans B-3501A
MVLRHLTRLSPCLRVSKSFAPISMRYSSSVPSNTPTTPSLFTPEGDPANAKPFYVTTPIFYVNASPHVGHLHSLLLTDVLARFSRLRHPQRKVVFATGTDEHGLKIQQAAKANGVGEQEFCDDVSQRFRKLAKLANASNTDFIRTTELRHVKAVEQFWNTLVASGDIYKGTHSGWYSISDESFYAVSQVTKSPEDGKMIAIETGNEVIWEEETNWKFRLGRHKKVLEKWLSQPESVHPNTVRLDLLRQLSSLEDLSVSRPSSRVKWAIPVPGDPEQSIYVWVDALINYITVLGYPDWEGKGESVGWPADVHVVGKDIIKFHALHWPSLLHSASLPAPKRIIAHAHWTMSHTKMSKSRGNVVDPISAMTQWGEDGVRWYLMRVGGGLVDDADYNPAEVEVHYRLLADQVGNLFSRISGAKVLKKAEREFDWGNEKTRDRGEDRDEELDGMMARMREEFEGKMEVFGVSQACAGVMDVVMATNKLFTSLAPWSPSTPSSVPALTYAYHALRLSAILLQPIIPAKAGEALDRLGVPAEERSWVDAEWPPSEEKVLRTEKMVERLKEASKKWKGKGHLFPLPGKDA

SEQ ID NO: 6333 - protein, 500 aa, Podospora anserina
MKSTRSGSNNWQSAVSGTSPKIATAMEAAISAGAEVSRVGRRILQRIWDPEPTNDRSNNEPVWCLGCSYLLDTKEYGTPPTLTTSTPPADATLTAIVPEPGAGVESEPRRATEKAGVPVNTSNAKAVAPIPVAASGQHQLQVPETPPLSVASSFDSALAYEEPGQDGGWPPAFLDDFESRIWMTYRTGFEVIPRSTDPKAAAALSFTMRFKTSFGDQTGFSSDTGWGCMIRSGQSLLANAMLISRAGRAWRRTTNPDIEREIVCLFADDPRAPYSIQNFVNHGAAACGKYPGEWFGPSATARCIHSLRVYLTRDLPEVYEDNFMSTANPDGNHFHPTLILVSTRLGIDKINPIYHEALISTLQLPQAIGIAGGRPSSSHYFIGAQGQWLFYLDPHHPRPALPYRENPNDYTIEELDSCHTRRLRHLHVEDMDPSMLIGFLIKDEDDWDLWKSSVKHVQGKAIINVSPHDPEHGMGFGRAGAIDEVETLSDEDDTDTVLDL

SEQ ID NO: 6334 - protein, 339 aa, Cryptococcus neoformans var. neoformans B-3501A
MTEATSHLLLHFDIFLKPTIKMNRQGAEAFAKLAQQLNRARMQASGGGGGGGRGGGQMPGGFKGFMAGSGAIGTLVVGAIALNYSLFNVDGGHRAIKYSRLQGVKADIYPEGTHLVLPWFEHPVIYDVRAKPRNIASLTGTKDLQMVNITCRVLSRPSVNDLPTIYRELGTDYDERVLPSIVNEVLKSVVAQFNASQLITQREMVSRLVRENLTRRARRFNLILDDVSITHVAFSPEFTHAVEAKQVAQQIAQRAAFLVDQAIQEKQSIIVKAQGEARSAELIGEAVKTNKGFLQLRKLEAAREIAGTLAQSGNRVMLDAKSLLLDVTEDEVLNATLRK

SEQ ID NO: 6335 - protein, 325 aa, Micrococcus luteus
MIALSYKAFLNPYIIEVEKRLYECIQSDSETINKAAHHILSSGGKRVRPMFVLLSGFLNDTQKDDLIRTAVSLELVHMASLVHDDYIDNSDMRRGNTSVHIAFDKDTAIRTGHFLLARALQNIATINNSKFHQIFSKTILEVCFGEFDQMADRFNYPVSFTAYLRRINRKTAILIEASCHLGALSSQLDEQSTYHIKQFGHCIGMSYQIIDDILDYTSDEATLGKPVGSDIRNGHITYPLMAAIANLKEQDDDKLEAVVKHLTSTSDDEVYQYIVSQVKQYGIEPAELLSRKYGDKAKYHLSQLQDSNIKDYLEEIHEKMLKRVY

SEQ ID NO: 6336 - protein, 344 aa, Anisodus tanguticus
MATLVSNWSSNNVSESFIAPLDKRAEKEVPLGNDVPIIDLQQDHHFVVQQITKACKDFGLFQVINHGFPEKLMVETMEVCKEFFALPAEENEKLQPKGKPAKFELPLEQKAKLYIEGEQLSNEEFFYWKDTLAHGCHPLDEELINSWPEKPATYREVAAKYSVEARKLTMRMLDYICEGLGLKLGYFDNELSQIQMMLTNYYPPCPDPSSTLGSGGHYDGNLITLLQQDLPGLQQLIVKDDNWIAVEPIPTAFVINLGLTLKVITNEKFEGSIHRVVTDPTRDRVSIATLIGPDYSCTIEPAKELLSQDNPPLYKPYPYAEFAEIYLSDKSGYDAGVKPYKINA

SEQ ID NO: 6337 - protein, 492 aa, uncultured bacterium 463
MDPSQFEALYTAKQTRALDRCAIEDHNIPGITLMSRAADATFDSMINHWPEPELVQVLCGTGNNGGDGFLVADLAHKRGIKTIVLQVGASDKISGDALLARNQALANGVDIQPFEDGAVLSLGVVVDALLGTGLGGDVRGDYLEAITEVNAAGTSVVAVDIPSGLCADTGRVLGQAIKADMTVTFIGLKRGLFALEAMDYTGDLQFADLSVPSEVYQQVPADCHRLELELLLEELRPRPATAHKGMYGTVLVIGGDYGMAGAAAMAAEAALRCGAGLVKVATRPEHVSALVARAPEVMPLGVESGDELEPLLASADVLVVGPGLGQSPWSEYLLQAAVASGKPMVLDADGLNMLAGGKVKARDGMIITPHPGEAGRLLSCSTAEVQADRFAAARALQQQTGAVVVLKGNGSLIAGDGQLLLSDYGNPGMATGGMGDVLGGVIASLLAQGLEPVAASALGVCLHGAAGDIAAEDGMRGLLATDLIPWLRELLG

SEQ ID NO: 6338 - protein, 571 aa, Clostridium tetani E88
MLKGISASNGIAIGKAFILKIGDVEIIKETIKDGEEENQRFITALEKGKKQLSKIMKDAKEKLGEEKSKIFEAHLFMLDDPEFTGQVSEKILKQKINAEYALKSTSEELVAIFEQIEDDYMRERVADIKDVTNRILRILTGNEGISISEIEEESILIGYDLTPSDTAQIDKNKILGFATEIGGVTSHSAIIARSIGIPSVLGVGKEIEEIKNGELIILDGNKGLIITNPDDEKINLYKKQIEEEKKLQKILGKYKNIEVITLDGRKVEVASNIGSIEDSENALKNGAEGIGLFRTEFLYMASSELPEEEFQYNAYKEVLEKMGEKPVIIRTLDIGGDKKLSYLTIDEEMNPFLGYRAIRLCLHRKDIFKTQLRALLRASYYGNLKIMFPMIANLQELREAKSILEECKEELRKESIAFNENIKVGIMVEIPSAAIMSDVLAKEVDFFSIGTNDLIQYTIAVDRMNEKVSYLYDFFNPAVLRLINNVIVNGHKEGKFVGMCGEMAGKKELIPLLLGMGLDEFSMSASSVLKAKKLITELNYEDCKKIVSKVMEMGTAEEVKAFLERNLNFNE

SEQ ID NO: 6339 - protein, 644 aa, Rhizobium leguminosarum bv. viciae 3841
MVQSNPGSQPEPALDVITIGRSSVDLYGQQIGSRLEDIGSFAKSVGGCPANIAIGTARLGLKSGLITRVGDEQMGRFIREQSAREGVATDGIVTDKERLTALVLLAVEAEGVSPMIFYRSDCADMALDEGDIDEDFIRSSRAVLVSGTHFSRPNTEAAQRKAIRIAKANGRKVIFDIDYRPNLWGLAGHAEGFERYVKSDRVSSKMKETLPDCDLIVGTEEEILIASGADDVLGALKEIRRLSPATIVLKRGAMGCIVYDGPIADDLEAGIIGQGFPIEVFNVLGAGDAFMSGFLRGFLRDEPLKTCATWANACGAFAVSRLLCSPEYPTWAELDFFLTTGSKHRALRKDEALNHIHWASTRRGEIPLLMALAIDHRSQLVSVADELGVGHEKIVAFKRLAVAAAARVSNGRDGYGMLIDERFGRDAFFDAATKNFSWIGRPVELPGSKPLRFEFSQDIGSQLVEWPLGHCIKCLCFYHPDDPADLKTEQQEKLRTLFEAARKVGRELLVEIIAGKNGPLTDDTIATALEELYALGIKPDWWKLEPQASREAWKKIDAVIAKNDPWCRGIVLLGLEAPAGELISCFEATLAAPSVKGFAVGRTIFADPARAWLSGEMNDEEAIADMAGRFQQLTEAWLKTRGHQ

SEQ ID NO: 6340 - protein, 255 aa, Onion yellows phytoplasma OY-M
MYKNGSIKIELASPPLTVGNPLKNAYSMQNVLNKSKASFVLFPELCLSSYTAGDLFFETTFLEQNFQALDWLLKNNSFEGVYILGMPLALHEVLFNVAVIIQKDKILGITPKKTIPNYKEFSEKRWFQSGKTCESQYIQILGQTVPFGDVLFINSQFDLIFGVEICQDLWTVFSPGDLLSLNGAHLIFNPSASTDHIGKLDLRKNAVLDHSRKQIGGYFYTSSGITESTVDNLFSNHKMAALLGEMVAEKIIYQM

SEQ ID NO: 6341 - protein, 405 aa, Rhizobium leguminosarum bv. viciae 3841
MTDRLVIIGAGQAGFALAAKLRALKDTRPITLIGAEDVAPYQRPPLSKKYLLGEMAFDRLLFRAEHWYADNDVDLRLSTWAEQIKPDSKQVLLQDGSVLDYGTLALATGSTPRRLPAAIGGDLEGVYVARDKRDADLLADEMRPGRRVLIIGGGYIGLEAAAVARHRGLEVTVIEMADRILQRVAAKETADIMRVIHEAHDVVIREKTGLKHLIGKDGRVTGAALSDGSVIDIDFAVVGIGVAPNDQLAKEAGLEVANGIVVDEFARTSDPAIFAAGDCAALPWQGGRIRLESVQNAVDQAEAAAAVIAGGSEPYDPKPWFWSDQYDVKLQIAGFNLGYDETLLRPGTREGAHSVWYFREGRLIAVDAINDAKAYVTGKKLLESGTNPDKSILADPSADLKSLLG

SEQ ID NO: 6342 - protein, 333 aa, Acinetobacter sp. ADP1
MNSLNTNNEFSLQELQKESVMGVMGTETQREVRVIDLSDFEQRKYEIADQLWDAAVEIGFFQVSHHGIPQQDIEHAFGLAEQFFALPREVKAQYPLKRNSGWESKAQIRPSTKTPDQKESYQVTRPRMTGLWPTQQELPDFKEQVLNFESQCWSVGMKILSCFAYKMGFSEDFFTLAHDPSKGNLSKHFADVCITMRLILRFKDELGLWRAGAHTDFDCLTLLFQQKGQGGLQVCPGKEMENRAWTSIEPREDVITCNIGDMLMRWSDDVLPSNFHRVKNPADHEYQGARYSLAFFCQANEDVLIQSPKGKYPDITAKDYLAQRVNANFSGKY

SEQ ID NO: 6343 - protein, 501 aa, Lemna paucicostata
MEERGATMERGADAGGAGAGPSSLAISPVKRSTGREAGSGTDGHRGAIPDTVASSLQQRRVIRWERFLPRRSLRVLLVEPDDCTRHIVTALLRKCSYHVAAVADGIKAWDIVEEKNFNFDIILSEVEVPSFSGINLLSKIMGTELSRSIPVIMMSSQDSVSVVFKCMQKGAVDFLVKPVRKNELRNLWQHVWRRHCSIPYANGTENGDNTQSASENMSNNNGAGNDVKDTKMDEGCDDNDDQSSGKNLIAHSESTRKNGTFLIEENKPFMDKSKEKLASIPDKAKIEVIHRLNDSSRSSPMNGFHEKCVLNHSAASAFSRYANTGICLPVPKSKSTQPAENSQTHYHFRRVEISEMESQRPGMVPFPFTVNAPIPFQNFCPGYSSLVQPMFYHEPFPAVDQETGAHEENLPSSPGRRFEAESQELAIEAERSWLECDPNRSHREAALMKFRLKRKDRCFEKKVRYHSRKMLAEQRPRVKGQFVRQAVADPSAFSMEIDESA

SEQ ID NO: 6344 - protein, 294 aa, Rhizobium leguminosarum bv. viciae 3841
MFNGSIPALVTPFTDAGLIDEDSFAAHVDWQIKEGSGGLVPVGTTGESPTLSHAEHKRVVELCIEVAAKRVPVMAGAGSNNTREAIELAQHAEKVGANAVLVVTPYYNKPTQKGLIAHFSAIAEAVDLPIYIYNIPGRSVVDMAPETMGALAKAHRNIVGVKDATGKIERVSEQRITCGADFRQLSGEDATALGFNAHGGVGCISVTANVAPRLCADFQAATLAGDYARALEYQDRLMPLHKAIFLEPGLCGAKYGLSKLGRMSRNVRSPLLSTLEPATESAIDAAMRHAGLLN

SEQ ID NO: 6345 - protein, 448 aa, Lemna paucicostata
MSEEKEKMEVEKKGEEARVVNWEKFLRGMRVRVLLVEADDSTRKIVAALLRKCSYKVSSASDGLEAWKTLKESPNNIDLVLTEVELPNVSGYALLSMMMEHDSCKSIPVIMMSSRDSMKMVFECMLKGAADFLVKPIRKNELRNLWQHVWRRQSANGAENTPPVENETNSEYNSASNHSSYYMDSNHKNKGSEKGNDTQSSCTRPDTDAETSSDLMSDQHGVSDQLERETLGDGDADETKTIEPTDCLDQIQPIHGFKRCRVIQAGQNLNPAVKPQLKAHQTLENFEDDAAEKREREGNKLNHSISSPFSRYSAKSTLSPLPLPTDENPDASTPNPNPASLTTVFYGQPGQQIWSTPPTQSNPETLDCPEQKTQKQIQDDHSSITSENGAPQAKIWLSVEREAALTKFRLKRKDRCFEKKVRYQSRKKLAEQRPRVKGQFVRQVNPGS

SEQ ID NO: 6346 - protein, 345 aa, Thermus thermophilus
MKVAVLPGDGIGPEVTEAALKVLRALDEAEGLGLAYEVFPFGGAAIDAFGEPFPEPTRKGVEEAEAVLLGSVGGPKWDGLPRKISPETGLLSLRKSQDLFANLRPAKVFPGLERLSPLKEEIARGVDVLIVRELTGGIYFGEPRGMSEAEAWNTERYSKPEVERVARVAFEAARKRRKHVVSVDKANVLEVGEFWRKTVEEVGRGYPDVALEHQYVDAMAMHLVRSPARFDVVVTGNIFGDILSDLASVLPGSLGLLPSASLGRGTPVFEPVHGSAPDIAGKGIANPTAAILSAAMMLEHAFGLVELARKVEDAVAKALLETPPPDLGGSAGTEAFTATVLRHLA

SEQ ID NO: 6347 - protein, 791 aa, Aegilops tauschii
MTMMAMAKAPCLCARPSLAARARRPGPGPAPRLRRWRPNATAGKGVGEVCAAVVEAATKAEDEDDDEEEAVAEDRYALGGACRVLAGMPAPLGATALAGGVNFAVYSGGATAAALCLFTPEDLKADRVTEEVSLDPLMNRTGNVWHVFIEGELHDMLYGYRFDGTFAPHCGHYLDISNVVVDPYAKAVISRGEYGVPARGNNCWPQMAGMIPLPYSTFDWEGDLPLRYPQKDLVIYEMHLRGFTKHDSSNVEHPGTFIGAVSKLDYLKELGVNCIELMPCHEFNELEYSTSSSKMNFWGYSTINFFSPMTRYTSGGIKNCGRDAINEFKTFVREAHKRGIEVILDVVFNHTAEGNENGPILSFRGVDNTTYYMLAPKGEFYNYSGCGNTFNCNHPVVRQFIVDCLRYWVMEMHVDGFRFDLASIMTRGSSLWDPVNVYGAPIEGDMITTGTPLVTPPLIDMISNDPILGGVKLIAEAWDAGGLYQVGQFPHWNVWSEWNGKYRDIVRQFIKGTDGFAGGFAECLCGSPHLYQAGGRKPWHSINFVCAHDGFTLGDLVTYNNKYNLPNGENNRDGENHNLSWNCGEEGEFARLSVKRLRKRQMRNFFVCLMVSQGVPMFYMGDEYGHTKGGNNNTYCHDSYVNYFRWDKKEQYSDLQRFCCLMTKFRKECEGLGLEDFPTAERLQWHGHQPGKPDWSENSRFVAFSMKDERQGEIYVAFNTSHLPAVVELPERAGRRWEPVVDTGKPAPYDFLTDDLPDRALTIHQFSHFLNSNLYPMLSYSSVILVLRPDV

SEQ ID NO: 6348 - protein, 417 aa, Candida albicans
MMNIDQHHQLQQQHQQQMLQQQAQAQAQAQAQAQQQQQAAAAAAAANAAATTSSSSPRQVSFNVSDHYQILEIVGEGAYGIVCSAIHKPSQQKVAIKKIEPFERSMLCLRTLRELKLLKHFNHENIISILAIQRPINYESFNEIYLIQELMETDLHRVIRTQNLSDDHIQYFIYQTLRALKAMHSANVLHRDLKPSNLLLNSNCDLKICDFGLARSIASQEDNYGFMTEYVATRWYRAPEIMLTFQEYTTAIDVWSVGCILAEMLSGRPLFPGRDYHNQLWLIMEVLGTPNMEDYYNIKSKRAREYIRSLPFCKKIPFSELFANTNNNTSTSNTGGRTNINPLALDLLEKLLIFNPAKRITVEDALKHPYLQLYHDPNDEPISDKIPEDFFDFDKMKDQLTIEDLKKLLYEEIMKPL

SEQ ID NO: 6349 - protein, 187 aa, Escherichia coli K12
MAGESFILMGVSGSGKTLIGSKVAALLSAKFIDGDDLHPAKNIDKMSQGIPLSDEDRLPWLERLNDASYSLYKKNETGFIVCSSLKKQYRDILRKGSPHVHFLWLDGDYETILARMQRRAGHFMPVALLKSQFEALERPQADEQDIVRIDINHDIANVTEQCRQAVLAIRQNRICAKEGSASDQRCE

SEQ ID NO: 6350 - protein, 791 aa, Triticum aestivum
MTMMAMAKAPCLCARPSLAARARRPGPGPAPRLRRWRPNATAGKGVGEVCAAVVEAATKAEDEDDDEEEAVAEDRYALGGACRVLAGMPAPLGATALAGGVNFAVYSGGATAAALCLFTPEDLKADRVTEEVSLDPLMNRTGNVWHVFIEGELHDMLYGYRFDGTFAPHCGHYLDISNVVVDPYAKAVISRGEYGVPARGNNCWPQMAGMIPLPYSTFDWEGDLPLRYPQKDLVIYEMHLRGFTKHDSSNVEHPGTFIGAVSKLDYLKELGVNCIELMPCHEFNELEYSTSSSKMNFWGYSTINFFSPMTRYTSGGIKNCGRDAINEFKTFVREAHKRGIEVILDVVFNHTAEGNENGPILSFRGVDNTTYYMLAPKGEFYNYSGCGNTFNCNHPVVRQFIVDCLRYWVMEMHVDGFRFDLASIMTRGSSLWDPVNVYGAPIEGDMITTGTPLVTPPLIDMISNDPILGGVKLIAEAWDAGGLYQVGQFPHWNVWSEWNGKYRDIVRQFIKGTDGFAGGFAECLCGSPHLYQAGGRKPWHSINFVCAHDGFTLGDLVTYNNKYNLPNGENNRDGENHNLSWNCGEEGEFARLSVKRLRKRQMRNFFVCLMVSQGVPMFYMGDEYGHTKGGNNNTYCHDSYVNYFRWDKKEQYSDLHRFCCLMTKFRKECDGLGLEDFPTAERLQWHGHQPGKPDWSENSRFVAFSMKDERQGEIYVAFNTSHLPAVVELPERAGRRWEPVVDTGKPAPYDFLTDDLPDRALTIHQFSHFLNSNLYPMLSYSSVILVLRPDV

SEQ ID NO: 6351 - protein, 263 aa, Triticum aestivum
MAAAGVSREQRWSLAGATALVTGGSRGIGHAIVEELVGLGARVHTCSENAVELEGCRRRWEEMKLPVTVSVCDVSVRAEREKLMESAKQTFDGKLDILVNNVGRNVAKATVECTAEEYSHLMSTNLESAFHLSQLAHPFLRDASIAGGGSVVNISSVASSLGYSTLALYCISKGGVNQLTRSLAAEWAQDKIRVNSVAPGGINTELQNSVDPKVIENTLLRTPMHRLGEPVEVASMVSFLCMPAASFVTGQVMYVDGGRTISG

SEQ ID NO: 6352 - protein, 533 aa, Pichia pastoris
MYRFLGLGTHPNDDQNKIHVLGRQYDPIKTQETEGKDLDLNSRFQQVLDSIKDGNKKSTTYSQSFIDDVYSKIWLTYRAGFPPIARDKDSPTFTLGALLRGQFDFNEIGFTSDAGWGCMIRTSQSLLANALLFLHLGRDWVFKAKDPANVEHDRIISWFVDIPDEPFSIHNFVQQGIKCCDKKPGEWFGPSAASRAIKNLCKEYPPCGLRVYFSSDCGDVYDTEVRELAYGDSDTFTPILVLLGIRLGVEKVNLYIGDLLRECLSLKQSVGISGRKTSFLALLSIGFQGDYLFYLIPTFPKKALTFGKHGEPVHRLQTKKTDENAAGQYPVFKYWIQIMKQTMMTAMKASKTTASTLKFFRVLMSNQSTHQKVTKLHLSHMDPSMLIGFLITSEDDFNDWKENIGKKDPSHKIVHITETKVSESTSNFQFNSLRSNSIADYDNCSGEDCDSAAIASDSDDFVDLAADFAVTGLEPRTHTGVDDETSSDYVQHFPIRRFSQPVIVSREDVVPTLSEDNGVIALDDKMSGISVGR

SEQ ID NO: 6353 - protein, 445 aa, Arabidopsis thaliana
MGCVSSKQTVSVTPAIDHSGVFKDNENECSGSGRIVVEDPPRPTLKKLVSWRSRSGKRRSQKSGSELGSESGRASDSLSFRLGNVSRYLEAEQVAAGWPAWLSNVAGEAIHGWVPLRSDAFEKLEKIGQGTYSNVFRAVETETGRIVALKKVRFDNFEPESVKFMAREILILRRLNHPNIIKLEGLITSKLSCNIQLVFEYMEHDLTGLLSSPDIKFTTPQIKCYMKQLLSGLDHCHSRGVMHRDIKGSNLLLSNEGILKVADFGLANFSNSSGHKKKPLTSRVVTLWYRPPELLLGATDYGASVDLWSVGCVFAELLLGKPILRGRTEVEQLHKIFKLCGSPPEDYWKKSKLPHAMLFKPQQTYDSCLRETLKDLSETEINLIETLLSIDPHKRGTASSALVSQYFTTKPFACDPSSLPIYPPSKEIDTKHRDEAARSVISFIT

SEQ ID NO: 6354 - protein, 345 aa, Zea mays
  misc_feature (239)..(239): Xaa can be any naturally occurring amino acid
MLGAPSPRTAPPMRKPYMREHSCLIFPPPRGRRPLAVIKFLGGAFIGAVPEVTYGYLLELLALEGFVVVCVPYNVTFDHEAAAREVFQRFHACYDALLASGLPEAGLSALDIAELPLYSVGHSNGALLQLLVGSYFSERIPEANAIVSFNNRPASEAVPYFEQIGPLFRQLMPMMEASPVYSVARNASGDAWKALFDLAGGLLREYDQEATVSLSKFIDQLPSVMNQVTEEGVPEFKPXSPPENREFCKSSYSVPNTLLVKFTVDAIDDTDIVEDVLRPRVDSIGGQIKKIILSGTHLTPCIQDVKWQVGSEYTPADAIAQGLKSLVLSETRVLSRTIADWFTSL

SEQ ID NO: 6355 - protein, 430 aa, Cryptococcus neoformans var. neoformans B-3501A
MSTTPNAVIPQAKRMFDGATHKLDVWSIFTPANVPADCINLGQGFMNWAPPDWIRAESHESMDHDIMSNHYSHPRGRPRLLKAISKHYSPQFENIVARGKDLTNEEILVTSGANCGMFAALTAHCEPGDEVICIEPYFDQYFASIHFQGAKPVFVPLHPPTGKGIKHGGDWTLNIDEFAAAFTPKTKAVIINTPHNPVGKVFTKEELEQIAKVCIEKNVLVLADEVYDCMVYDGNKHFRIATLPGMWERTLTVGSGGKSFACTGWRVGWLIGPPQLTAATLAAHSRIVFCTNSPMQEAVAIGLEKAAEHKFFEEQVAAYEERRDILCSYFDQIGLSYTKPEGSYFLLVDISPVKVPEGYPIVETCKGRGKDFEFCWWLCQELKVVGIPPSEFYSEEHVNIGERFARFAFCKDPELLHAAGKRLLKLKEYL

SEQ ID NO: 6356 - protein, 392 aa, Zea mays
MADAGEGRRVCGMPEKAQLHVAMLALQFGYAGFHVVSRLALNMGISKLVFPVYRNIIALCLLVPFAYFLEKKDRPQLTLNFVVQFFFLALCGITANQGFYLLGLDNTSPTFASAIQNSVPAITFAMAAALRIEKVRLDRRDGVAKVAGTLACVAGASVITLYKGPTIFGPSASGGLELAATSKAVAGDKNWTLGCVYLIGHCLSWSGWLVLQAPVLKKYPARLSVTSYTCFFGVIQFLIIAAFMERDADAWKFHSGSELFTILYAGFIASGVAFAVQIWCIDRGGPVFVAVYQPVQTLVVAIMASLTMGEKFYLGGIIGAVLIIAGLYLVLWGKSEERARFARDAATLVSGTGDREGLLPAGGGGIRSASKAAASAATQPLLLPSSTSTDNV

SEQ ID NO: 6357 - protein, 388 aa, Oryza sativa (japonica cultivar-group)
MGCFCIFGKRRATRQQSSQHNDDPSGDMNITKFTYKELSRVTENFSPSNKIGEGGFGSVYKGKLRNGKLVAVKVLSLESRQGAKEFLNELMAISNVSHENLVKLYGYCVEGNQRILVYNYLENNSLAQTLLGYGHSNIQFNWATRVNICVGIARGLTYLHEVVNPHIVHRDIKASNILLDKDLTPKISDFGLAKLLPPDASHVSTRVAGTLGYLAPEYAIRGQVTRKSDVYSFGVLLLEIVSGRSNTNTRLPYEDQILLERTWVHYEEGDLEKIIDASLGDDLDVAQACMFLKIGLLCTQDVTKHRPTMSMVVRMLTGEMDVELAKISKPAIISDFMDLKVRSMRKEVDIVSSSTSTLLSSIMAHSSPLLSQETTEASMTFTAISDRE

SEQ ID NO: 6358 - protein, 314 aa, uncultured bacterium 463
MSDFGSGTSTSEVIEGVDLKGKCALVTGASSGLGVETSRSLASAGAAVIMVARDASKLDTAVAQVRAAVPDAQLDTALLDLADLESVRAGAQTILAKCPSIQLLINNAGVMACPLMRTAQGFEMQLGTNHVGHFLLTCMLAPALVAGAPARVVNLSSAGHRFSAMDLDDPNYHRRDYEKWQAYGQSKTANALFSVGLDQRLQGQGVRSFAVHPGMIMTELSRHMDPSDMEIILAGRNIEDIGFKTVEQGSATSVWAATSQDLDGLGGLYLEDCHIAEPATPDNEAGIESYALDPVTADKLWQLSEDMVGENFNF

SEQ ID NO: 6359 - protein, 291 aa, Streptococcus pneumoniae TIGR4
MTENRYELNKNLAQMLKGGVIMDVQNPEQARIAEAAGAAAVMALERIPADIRAAGGVSRMSDPKMIKEIQEAVSIPVMAKVRIGHFVEAQILEAIEIDYIDESEVLSPADDRFHVDKKEFQVPFVCGAKDLGEALRRIAEGASMIRTKGEPGTGDIVQAVRHMRMMNQEIRRIQNLREDELYVAAKDLQVPVELVQYVHEHGKLPVVNFAAGGVATPADAALMMQLGAEGVFVGSGIFKSGDPVKRASAIVKAVTNFRNPQILAQISEDLGEAMVGINENEIQILMAERGK

SEQ ID NO: 6360 - protein, 437 aa, Saccharomyces cerevisiae
MAVSKVYARSVYDSRGNPTVEVELTTEKGVFRSIVPSGASTGVHEALEMRDGDKSKWMGKGVLHAVKNVNDVIAPAFVKANIDVKDQKAVDDFLISLDGTANKSKLGANAILGVSLAASRAAAAEKNVPLYKHLADLSKSKTSPYVLPVPFLNVLNGGSHAGGALALQEFMIAPTGAKTFAEALRIGSEVYHNLKSLTKKRYGASAGNVGDEGGVAPNIQTAEEALDLIVDAIKAAGHDGKVKIGLDCASSEFFKDGKYDLDFKNPNSDKSKWLTGPQLADLYHSLMKRYPIVSIEDPFAEDDWEAWSHFFKTAGIQIVADDLTVTNPKRIATAIEKKAADALLLKVNQIGTLSESIKAAQDSFAAGWGVMVSHRSGETEDTFIADLVVGLRTGQIKTGAPARSERLAKLNQLLRIEEELGDNAVFAGENFHHGDKL

SEQ ID NO: 6361 - protein, 315 aa, Escherichia coli CFT073
MSFKLTKDDKIKQDKTNMTRIACVGITVQDRIYSLPTLPEGGGKYQANHYLEIGGGPAATAAVAIAKLGVEVDFIGRIGDDSCGNTLLAELEGWGVNTAFCRRYPNARSSQSAILVDQHGERIIVNYPSPDLGTDAEWLEAIDFSRYDLILADVRWHSGTEKAFSLARLAGVTTLLDADMTPQDISPLVALADHAVFSTPGLKRMTGLQSPEEGLFQATTQTAGKVYVTLGSEGSLWIEDGHLCQQEAFSVNVVDTTGAGDVFHGALAVALAEKMPTKEAIRFASAVAAMKCTQPGGRAGIPNREQTESFLSLYA

SEQ ID NO: 6362 - protein, 448 aa, Francisella tularensis subsp. tularensis SCHU S4
MALHGKKDTIDNLDFFEQSLPKFKLPLNSQDPLEVYQEIKDELMLDGNSKQNLATFCQTEVDDFIHKLMDDCIDKNMIDKDEYPQTAEIESRCVNILANLWNSSAENAIGCSTTGSSEAAMLGGMAMKWRWRDKMKAQGKDYTKPNLVTGPVQVCWHKFARYWDIELREIPMSNESLIMTPEAVLERCDENTIGVVPTLGVTFTGQYEPVEQVCKALDDFERQTGVDIPVHVDAASGGFLAPFVEPELKWDFRLPRVKSINSSGHKFGLSPLGVGWVIWADKKYLPDDLIFNVNYLGGNMPAFALNFSRLGGQIVAQYYNFVRLGFEGYKKVHQLCYDVAEYIAKELRKMEIFEIIHAGEGGIPAVSWSLKATKEYSLFDISEKVRAKGWQIAAYTMPNNREDLVVMRVLVRRGFSYDLAQLMIRDLVAVIDSLEGKLKILKRSSFAH

SEQ ID NO: 6363 - protein, 389 aa, Rhodopirellula baltica SH 1
MKAVCWHGRNDIRVDNVDDPKILDPRDAIIRITASGICGSDLHLMAGAAPAMEAGDIIGHEPMGEVVEVGNAVSNLSVGDRVVVPFTISCGECFFCQSTLYSLCDQSNRNAEQAEKIMGHSPAGLFGYTHMLGGYAGGQAEYLRVPYADVGPIKVPDGLPDEQVVFLSDIFPTGYMAAENCEITPNDTVAVWGCGPVGQFAIQSAWMLGAKRVIAIDNVPERLEMARSVSKAEVIDYEKSDVYETLQEWTKGRGPDCCIDAVGAENHAAGNLQSVLDDAKTALHLGSDRPHVLNEIFKCCRKGGRVSVPGVYFSSVNLQWGTAMNKALQIRLGQTHMQRYLTPLMEKITDGEIDPSFVITHVEPLDNAPEAYKKFRDKEDGCIKVVLKP

SEQ ID NO: 6364 - protein, 847 aa, Magnaporthe grisea 70-15
MTVVAGPTYPLELLQGTKVTKFAKKRGSTTSRKQLMLVLDAESAKITWDKSKPSKSIYIDDIKDIRTAEDIRQYRLDFGIPESEEPLCFSIIYATHDVKPKTKMMHLVAGDPAIVDMWVSTLHTISMHRQDIMSSLMAFNDKAIRTYWKNELHKQLKNTSNNGEENIDFLGVERVCQNLHIHVSSETLKEKFLEALGTSSVDADASVKNGRLNFSQFQEFVRLMKRRADIRPIFRERASDIERGMTLLDFVSFLTDVQNEDVDADRAYWEAIFARFAKRNKSKDLEGDDVPRISEAALVSFLTSTYNVPIVSAPKNYTLDRPINEYYISSSHNTYLLGRQVMGFSSVEGYISALMRGCRSVEVDCWDGGDGWPLVSHGWTMTTNIAFREVMNVINKYAFVKSEFPLWISLEVHCNPDQQRKMVAIMKEIFGARLVTEPLEGLPADKLPSPSQLKNRILIKAKKPGHEEPNPERTGRRRGNSLTSPYTKPVMLDNSTIPSQSLPHSPLLTPTHSQIRRMGAKTRVNTITEGRVHDSTSGSPSDCDSGSERDIQQPISPNSGTSKIVKELGDLAVYCAGIKFSGFEHPDSKTVNHIFSFHEGTFQRHGRPGDAKRALYRHNMRYMMRVYPHRGRVYSSNFDPLLMWRRGVQMAALNWQTFDLGMQLNHAMYDGGMDQSGYVLKPKEFREIQHFPYLPEHMVGGKRPRKNVKFSIDVISAQQLMRPHNLRDRHTLDPYIEVEAFLADDKRNTNKEYSDAGPSKTKHKTPIAKDNGFNPIFDQRYNFNFNTKYPDLIFIRWTVRLSEGGSQSDRSTILEGTESVNKLRSLGRTVFNRSNNSPKSSVDGGSQ

SEQ ID NO: 6365 - protein, 419 aa, Mesorhizobium loti MAFF303099
MGDFVIIGSGVAGHRAAAELHRLDPSQSVYVVGTEPGAPYDRPPLSKEYLKTTEPVRPDLGPAEIYKSNVTLRDGLTATSIDRPNQTIALSDGSSIQYDRLLLATGSRLRHLDLPNIDPARVFYLRTILDAQRLRTALDNHLRIAIIGGGFVGLEIAAAAKRNGCTVTLLERAPELLSRGATPPLAEFARKMHSRQDVRIFLGINISEAFQDGSDIVLRWPEGEVRSDILVVGVGIIPNIELALQCGLATADGILVDQQCRTSDEWIFAAGEVTSYPVDRLGVHIRTESWSSASAQGTVAATSMLGRNGMFNELPWFWSDQYDCNIQCLGLPKRASRFHQIGDLNSESWLRIGVDDAGSLVGAESVNKGREMSALRRADRRGEPIPTALIKDSILVQSCSTVGDLGAGSASLNVNVRTQ

SEQ ID NO: 6366 - protein, 277 aa, Saccharomyces cerevisiae
DPRLLYLSTVFQSVHIFDPALPGMVTGPFPSLMRRYKYMHVARTAGCIGILVNTLSLRNTRETINELVKLIKTREKKHYLFVVGKPNVAKLANFEDIDIWCILGCSQSGIIVDQFNEFYKPIITPYELNLALSEEVTWTGKWVVDFRDAIDEIEQNLGGQDTISASTTSDEPEFDVVRGRYTSTSRPLRALTHLELEAADDDDSKQLTTRHTASGAVIKGTVSTSASALQNRSWKGLGSDFDSTEVDNTGADIEEGISGVARGYGFDREDAMKKENK

SEQ ID NO: 6367 - protein, 216 aa, Medicago truncatula
VDIFRDAATIMVNYIDEIRAQGFEVDYLNIGGGLGIDYYHAGAVLPKPRDLIDTGHEVRELVLSRGLKLIIEPGRSLIANTCCLVSRVTGVKTNGSKNFIVIDGSMAELIRPSLYDAYQHIELVSPAPANAEITTFDVVGPVCESADFLGKGRELPTPAKGTGLVVHDAGAYCMSMASTYNLKMRPPEYWVEDDGSLSKIRHGETFEDHMRLFDGL

SEQ ID NO: 6368 - protein, 441 aa, Haloferax mediterranei
MQTSEPEGSSPNTAEAASQSSEPKPASESALETARRQLYRAADHLDIDPNVVERLKHPEAVHEVTVPIERDDGSVSVYTGYRAQHDSVRGPYKGGLRYHPGVTRDECVGLRMWMTWKTEVRRDGPIFGGAKGGIAVNPKDLTLDEKERLTRRFTQEIRTIIGPMKDIPAPDMGTDPQTMAWVMDAYSMQEGETVPGVVTGKPPIVGGSEGRDTAPGRSVAIIAREAIDYLSWDIEDTTVAVQGFGSVGAPAARLLDDYGANVVAVSDVNGAIYDPDGLDTHAIPTHEEEPEAVMTHDAPETFSNEELLELDVDVLIPAAVGNVLTAENADDVQANLIVEGANGPTTSAADANFAERGVPVIPDILANAGGVTVSYFEWLQDINRRTWSLERVHDELETEMLNAWSVVRDEYESRDVPWRDAAYIVALSRIAAAHDARGLWP

SEQ ID NO: 6369 - protein, 180 aa, Onion yellows phytoplasma OY-M
MKGLLVLYDRFEDCEALVTRALLNRVALPLTTATLNPQLEVMSSSGLCVKADANLATINPLEYDFLVIPGGPYVAQIIEKETFLLKLIQKFVDANKVIGAICAAPMFLGKLDLLKNHPFTCFPSCNHFIEGTYLPDQKAVISDKFVTSRSPITVFDFVFALVEVLKGKAFAFAFKNSLNV

SEQ ID NO: 6370 - protein, 222 aa, Leptospirillum ferrooxidans
TQALDIGAMSVFFYTFREREELLDLFEIICGARLTSNYYRVGGVDADLPKEFITRLYKFLDTFEKNIGEYNTLLETNRIWLARTKNIAVITGEDAINFGVSGPSLRGSGVDYDLRKYEPYGVYDQVEWSVPVGTNGDVYDRYWIRIEEMRESSKIIRQCLDRLPAGKILTDDHKITFPDKGKVMHNMETLIHHFLLVSRDSRFLQEILTGTETPRELGFYIV

SEQ ID NO: 6371 - protein, 440 aa, Arabidopsis thaliana
MSCSSSSGSEEDDEGFDAYRKGGYHAVRIGDQFAGGRYIAQRKLGWGQFSTVWLAYDTRTSNYVALKIQKSALQFAQAALHEIELLQAAADGDPENTKCVIRLIDDFKHAGPNGQHLCMVLEFLGDSLLRLIKYNRYKGMELSKVREICKCILTGLDYLHRELGMIHSDLKPENILLCSTIDPAKDPIRSGLTPILEKPEGNQNGTSTMNLIEKKLKRRAKKAAAKISGRRVSIVGLSETPKKNKRNLDGIDMRCKVVDFGNGCWADNKFAEEIQTRQYRAPEVILQSGYSYSVDMWSFACTAFELATGDMLFAPKEGNGYGEDEDHLALMMELLGKMPRKIAIGGARSKDYFDRHGDLKRIRRLKYWPLDRLLIDKYKLPEAEAREFADFLCPIMDFAPEKRPTAQQCLQHPWLNLRTQNNEDDIEGQMSNMQIKGSCS

SEQ ID NO: 6372 - protein, 466 aa, Pyrococcus horikoshii OT3
MVSMTKWDEIRKYTSKKIEKNLEIVKLDEKYIPRASGFKYYPMVIERSSGSRIWDKDGNEYIDFLTSAAVFNVGHTHPGVVKAVEEQIKKFFNYTMGYLYVEPPVRLAELLVEITPGNFEKKVTYGFSGSDAVDSSIKAARAYTKRVNIISFLHSYHGMTYGALSATGILDPKLKKLLHPMGNFHHVEFPDPYRNSWGIDGYEDPSELANRALDEIERKIKELNEDVAGIIIEPIQGDAGVVIPPEEFVRDLKKLTEEYGIVFIDEEVQTGMGRTGRWWGIEHFGVTPDLIVSAKALGGGMPISAVVGKAEIMDSVPVPFFVFTHIGHAVNASAAIATINVIKEEKLVERSEKLGEYMLKRLRELQETYPIIGDVRGKGLLIGVDIVKEGTREPDRSLAQKISWRAWEKGLIMITFGKHGNVLRIAPPLNIPQEDLDKGVEIIEESIKDAVEGKIPDEVLKFLRAW

SEQ ID NO: 6373 - protein, 1016 aa, Escherichia coli CFT073
  misc_feature (196)..(196): Xaa can be any naturally occurring amino acid
MQVSRRQFFKICAGGMAGTTAAALGFAPSVALAETRQYKLLRTRETRNTCTYCSVGCGLLMYSLGDGAKNAKASIFHIEGDPDHPVNRGALCPKGAGLVDFIHSESRLKFPEYRAPGSDKWQQISWEEAFDRIAKLMKEDRDANYIAQNAEGATVNRWLSTGMLCASASSNETGYLTQKFSRALGMLAVDNQARVXHGPTVASLAPTFGRGAMTNHWVDIKNANLVVVMGGNAAEAHPVGFRWAMEAKIHNGAKLIVIDPRFTRTAAVADYYAPIRSGTDIAFLSGVLLYLLNNEKFNREYTEAYTNASLIVREDYGFEDGLFTGYDAEKRKYDKSTWTYELDENGFAKRDTTLQHPRCVWNLLKQHVSRYTPDVVENICGTPKDAFLKVCEYIAETSAHDKTASFLYALGWTQHSIGAQNIRTMAMIQLLLGNMGMAGGGVNALRGHSNIQGLTDLGLLSQSLPGYMTLPSEKQTDLQTYLTANTPKPLLEGQVNYWGNYPKFFVSMMKAFFGDKATAENSWGFDWLPKWDKGYDVLQYFEMMKEGKVNGYICQGFNPVASFPNKNKVIGCLSKLKFLVTIDPLNTETSNFWQNHGELNEVDSSKIQTEVFRLPSTCFAEENGSIVNSGRWLQWHWKGADAPGIALTDGEILSGIFLRLRKMYAEQGGANPDQVLNMTWNYAIPHEPSSEEVAMESNGKALADITDPATGAVIVKKGQQLSSFAQLRDDGTTSCGCWIFAGSWTPEGNQMARRDNADPSGLGNTLGWAWAWPLNRRILYNRASADPQGNPWDPKRQLLKWDGTKWTGWDIPDYSAAPPGSGVGPFIMQQEGMGRLFALDKMAEGPFPEHYEPFETPLGTNPLHPNVISNPAARIFKDDAEALGKADKFPYVGTTYRLTEHFHYWTKHALLNAILQPEQFVEIGESLANKLGIAQGDTVKVSSNRGYIKAKAVVTKRIRTLKANGKDIDTIGIPIHWGYEGVAKKGFIANTLTPFVGDANTQTPEFKSFLVNVEKV

SEQ ID NO: 6374 - protein, 241 aa, Triticum aestivum
MTSVWKTKVLPGLNKIFDKDGKKAAAAEFLKSFNKEEIDKEIEDKKTELEPKVVETIEASPPEIKGLIKDKKTSKIRKNSVAVTKFLDDLAKIDFPGAKLVSDAVAKSGTTPLSPAIVFILDKVAPFVPAPKEEPKVEPEVAAAAPAEETTTREVAVEEEKKEEAKPSAAPAEAAAPAEAAAPAEVVEEKKEEKPVEAAGTCPPRSQRRSDRSPPAGLQEQPKPPPGLLAAGNGRNHFKLL

SEQ ID NO: 6375 - protein, 287 aa, Bordetella pertussis Tohama I
MDTPTSSSLPAIERQHLPALFAARPTDAHKGSCGTLGVIGGGPGMVGAALLAARAGLKVGAGKVLVGLVADTPPLPCDPMQPELMLRDFRGLLEAGLGIDAWTAGCGCGMDALAANALSELFQLRGDAALVLDADGLNLLAAGAVQARWGDAPVVLTPHPAEAGRLLGLSTEAVQADRPGAARALAARYGAWIVLKGAGSIVCDPAGACRINRTGNPGLATAGTGDVLAGILGSLLAQRIAPEQAVPGAVWLHGAAADALVTHGVGPIGLTAGELADSARRLRNSRA

SEQ ID NO: 6376 - protein, 460 aa, Kineococcus radiotolerans SRS30216
MTTLSSPDATSAPAVGGPALPQEIRLRTEVPGPLSRELAARRVAAVSAAVGSSMPFYAAVAGGGVVVDVDGNSYADLGSGIAVTTVGNADPAVVAAVGEQVGRFTHTCFMITPYDSYVAVAERLNALTPGDFPKRTALFSTGAEAVENAVKVARAFTGRQAVVVFDHAYHGRTNLTMAMTAKNMPYKNGFGPFAPEVYRAPLSYPFRDGLDGPTAAARAIATIEKQVGAANLAAVVVEPVQGEGGFIVPAPGFLPAIAAWARENGVVFVADEVQTGIARTGAVFASHLEGIEPDLVTIAKGVAGGLPLAAVTGRAEILDAPVVGGLGGTYGGNPAACAAALATLDAVEHEDLPARARQLEGVLLRRLQALAAVDPRVGDVRGRGAMVAVELVRPGTTEPDAALAKRVAADAARRGVIVLTCGTDGNVLRFLPPLSIPDALLEEAFDVLDDVFATDRPTAR

SEQ ID NO: 6377 - protein, 496 aa, Pseudomonas putida KT2440
MVAGLLERLGVAAEAYTQGDYPVHTPIDGSQIASVKLLGKAETIARIDQAQSAFEAWRSVPAPRRGELVRLFGEVLREHKADLGELVSIEAGKITQEGLGEVQEMIDICDFAVGLSRQLYGLTIASERPGHHMRETWHPLGVVGVISAFNFPVAVWAWNTALALVAGNSVVWKPSEKTPLTALACQALFEKALKAFGDAPAGLAQLVIGGREAGEAMVDDPRVPLVSATGSTRMGREVGPRVAARFGRSILELGGNNAMILAPSADLDLAVRGILFSAVGTAGQRCTTLRRLIVHRSIKDEVVARVKAAYGKVRIGDPRKDNLVGPLIDKQSFDAMQGALAKARDEGGQVFGGERQLADQYPNAYYVSPAIAEMPAQSDVVRHETFAPILYVLAYDDFEEALRLNNEVPQGLSSCIFTTDIREAERFQSASGSDCGIANVNIGTSGAEIGGAFGGEKETGGGRESGSDAWKGYMRRQTNTVNYSRELPLAQGIVFD

SEQ ID NO: 6378 - protein, 159 aa, Oryza sativa (japonica cultivar-group)
MAAPLRRSLPSLGRTLLSPSPAPARMLSAAASDALVEIKPGEIGMVSGIPEEHLRRKVVIYSPARTASQQGSGKVGRWKINFVSTQKWENPLMGWTSTGDPYANVGEAGLTFDSADSAKAFAEKHGWDYVVRKRHTPLLKAKSYAENFKWRGPPKAEQA

SEQ ID NO: 6379 - protein, 488 aa, Kineococcus radiotolerans SRS30216
MSTTQHEQDLVRAVPTGLFVGGGWREAEGGRTVDVEDPATGQVLVAVSDASVADGTAALDAAVAAAPAWARTPTRQRAEVLRRAFELITARADDFALLMTLEMGKPLAEARGEVAYGAEFFRWFSEEAPRIAGRYAQNPAGGSRLLTLKQPVGPVLAILPWNFPLAMGTRKIAPALAAGCTIVVKPATQTPLTTLLLAQVLAEAGVPDGVVNVVTTTSTAEVVEPLVRDPRLRKLTFTGSTPVGKKLVAQSAERLLRVSMELGGNAPFLVFDDADLDAAVEGAVAAKMRNTGEACTAANRFYVQRPVAEEFSRRLGERLGAMVVGRGTEDGVQVGPLIDARARDGVARRVSEAVDAGAQVLVGGSPVGERGYFYAPTVLTGVPAGSRLLTEETFGPVAPVVVFDEEAEGVALANDTEYGLVGYAFTRGLDRGFRVAEALETGMVGLNAGVISNAAAPFGGVKASGFGREGGAEGIEEYLETKYVGFPL

SEQ ID NO: 6380 - protein, 343 aa, Brucella suis 1330
MQAIIDAEQSFKFPVLVGDIGGTNARFSILVDSNAEPKEFPVLQTADYATIDEAIQHAILDQTAIQPRSVILAVAGPVDGDEIDLTNCDWVVRPKKMIADLGFEDVTVLNDFEAQALAVVSLEGHHMEQIGGKPEEAVATRVVLGPGTGLGVAGLVRTRHAWVPVPGEGGHIDIGPRTERDYQIFPHIERIEGRVTGEQILSGRGLRNLYLGICAADKITPTLETPVDITSAGLDGSNPQAAETLDLFATYLGRLAGDLALIFMAHGGVYLSGGIPVRILSALKAGSFRAAFEDKAPHKAIMRDIPVRVITYQLAALTGLSAFARTPSRFEVSTEGRRWRMRR

SEQ ID NO: 6381 - protein, 119 aa, Idiomarina loihiensis L2TR
MAKVSQSIIKALEEEQMKQDLPEFAPGDTVVVNVKVKEGNRERLQAFEGVVIRVRNRGLHSAFTVRKVSNGEGVERTFQTHSPLVDSIKVKRRGAVRRAKLYYLRERSGKSARIREKLS

SEQ ID NO: 6382 - protein, 334 aa, Oryza sativa (indica cultivar-group)
MAAARSRAPWLDLAVVGVGWAWGGTEVDAARGGAVGEGRRLSRLGLAGPVTTTLQASSSFLGALSSRPLPLVGLPGENPVLVFPETLMDGGSSVIVALLPRDVVKEVPSPNLLSNSWCRLTLDSSSCDSALAFREMMMMGKRGGRKNPMRRTTSMTEFAPPVDVLVGGRVAEEAEAEAEADEATELEVSGGGEVEEEDAAVEEASYGWFGAGADGAGVRADWLAAYRARAAPALAGLRRNSADFSAVETAAFLRACGLCNRRLGPGRDTFMYKGDTAFCSLECRQQHITHEEWKEKRALAIATAAAAPPQPPPSMPDPTAAGSDNPAGGTLAAA

SEQ ID NO: 6383 - protein, 438 aa, Hypocrea jecorina
MGQTLSEPVVEKTSEKGEDDRLIYGVSAMQGWRISMEDAHTAELNLPPPDNDTKTHPDRLSFFGVFDGHGGDKVALFAGENIHNIVFKQESFKSGDYAQGLKDGFLATDRAILNDPKYEEEVSGCTACVTLIAGNKLYVANAGDSRSVLGIKGRAKPLSNDHKPQLETEKNRITAAGGFVDFGRVNGNLALSRAIGDFEFKKSAELSPENQIVTAFPDVEVHELTEEDEFLVIACDGIWDCQSSQAVVEFVRRGIAAKQDLDKICENMMDNCLASNSETGGVGCDNMTMVIIGFLHGKTKEEWYDEIAKRVANGDGPCAPPEYAEFRGPGVHHNYEDSDSGYDVDADSGGKFSLAGSRGRIIFLGDGTEVLTGSDDTEMFDNADEDKDLASQVPKSSGKTDAKEETEAKPAPEAESSKPADGSEKKQDEKTPEESKKD

SEQ ID NO: 6384 - protein, 450 aa, Rhodococcus sp. RHA1
MRIVIVGASLAGLRAAEALRGQGFDGSLTLIGDEPYEPYDRPPLSKAVLLGIMPPDHAALPFRPDLDAQWRLGVRATSLDLENNRVVLSDGDTVEFDKVLIATGVRARPWSNSSEAALDGVFTIRTCDDSRRLNERLSTGPSHVLVIGAGFTGSEIASVCRERGLSVTVTERGPAPLVGALGGVVAAVAADMQREHGVDLRTGVTVTGLDGDGDGQLCRAHLSDGTTLDVDVAIVAQGSIRNTDWLFGSGLAAGPRGVTCDAGCRAFDINGIVTDNVFVAGDVARQPHPLYDYQLLALEHWGNAIGQAEVAAHNMIHDGLRRRPHLEIPAFWSSQFGVNIKSVGIPTYSDQVVITQGSVADRRFVAAYGFRGRVTAAVAFNQGKWLDFYRGLIESAAAFPPDFDVMDRAEPFEVRASELPDPAVLSHGPTVAVTGHLPTERRVEFVSLPK

SEQ ID NO: 6385 - protein, 460 aa, Erwinia carotovora subsp. atroseptica SCRI1043
MTDKVRIDSLGANSLNGNNETYLARQAEFESNVRSYPRKLPLAIAKAEGVWITDVENNQYLDCLAGAGTLALGHNHPDVLQSIQRVITSGLPLHTLDLTTPLKDQFSEYLLSLLPGQGKEYCLQFTGPSGADAVEAALKLAKKYTGRSGVISFSGGYHGMTHGALSVTGNLSPKEAVDGMMPEVQFMPYPHQYRCPLGIGGDAGVKALTYYFENLLNDVESGVRKPAAVILEAVQGEGGVNPAPAEWLQRIRKVTQEHGILLIIDEVQAGFARTGKFFAFEHAGIEPDIIVMSKAVGGGLPLAVLGIKKQFDAWAPGHHTGTFRGNQLAMATGLTTLMHLKDNQVADKVAEQGEWLKAKLAELQKRYPVIGHIRGLGLMIGIEMVKPGEAQDHMGCYPADGDLSALLQKKCFESGLILERGGRNGCVLRLLPSLLISNAELEIFLDKFENALLSAGVKPV

SEQ ID NO: 6386 - protein, 370 aa, Oryza sativa (indica cultivar-group)
MTKQSVVLPEVAVPVPPNSAPLLPYPPPRAAPGVAVRKKYLQAQLDLGAGLPLINGWVESMRASSPTHAKAAAALAAAGAVDDERAAWMVRHPSALSKFEQIVAASKGKKIVMFLDYDGTLSPIVDDPDSAFMSDTMRRAVRSVAKHFPTAIVSGRCRDKVFEFVKLAELYYAGSHGMDIKGPAKASRHNKAKAKGVLFQPASEFLPMIEQVHDSLIERTKCIPGAKVENNKFCVSVHFRCVDEKSWSTLADIVKAELKDYPKLKLTQGRMVFEIRPTIKWDKGKALEFLLESLGFADCTNVLPVYIGDDRTDEDAFKVLRKRGQGIGILVSKYPKDTNASYSLQEPAEVMEFLLRLVEWERLSRARPKW

SEQ ID NO: 6387 - protein, 446 aa, Borago officinalis
MEGTKKYISVGELEKHNQLGDVWISIQGKVYNVTDWIKKHPGGDVPIMNLAGQDATDAFIAYHPGTAWKNLENLFTGYHLEDYLVSEISKDYRKLASEFSKAGLFEKKGHTVIYCLSFIALLLCGCVYGVLCSNSLWVHMLSGAMLGMCFIQAAYLGHDSGHYTMMSSKGYNKFAQVLNGNCLTGISIAWWKWTHNAHHIACNSLDYDPDLQHLPVFAVPSSFFKSLTSRFYGRELTFDGLSRFLVSYQHFTIYLVMIFGRINLYVQTFLLLFSTRKVPDRALNIIGILVYWTWFPYLVSCLPNWNERVLFVLTCFSVTALQHIQFTLNHFAADVYVGPPTGTNWFEKQAAGTIDISCSSWMDWFFGGLQFQLEHHLFPRMPRCQLRNISPIVQDYCKKHNLPYRSLSFFDANVATIKTLRTAALQARDLTVVPQNLLWEAFNTHG

SEQ ID NO: 6388 - protein, 444 aa, Solanum lycopersicum
MATIKSIKARQIFDSRGNPTVEVDVHISNGVFARAAVPSGASTGIYEALELRDGGSDYLGKGVSKAVNNVNSIIGPALVGKDPTDQTGLDNFMVHQLDGTQNEWGWCKEKLGANAILAVSLAVCKAGAAVRNVPLYKHIADLAGNKKLVLPVPAFNVINGGSHAGNKLAMQEFMILPVGAANFKEAMKMGCEVYHHLKAVIKKKYGQDATNVGDEGGFAPNIQENKEGLELLKTAIEKAGYTGKVVIGMDVAASEFYGKDKSYDLNFKEESNDGSQKISGDQLKDLYKSFVSEYPIVSIEDPFDQDDWETYAKLTAEIGEQVQIVGDDLLVTNPKRVAKAIAEKTCNALLLKVNQIGSVTESIEAVKMSKKAGWGVMTSHRSGETEDTFIADLAVGLSTGQIKTGAPCRSERLAKYNQLLRIEEELGSEAVYAGASFRKPVEPY

SEQ ID NO: 6389 - protein, 517 aa, Candida glabrata CBS 138
MFSRTITRTLRAPAVLRLYSTNVPLEVPVTLPNGIKYMQPTGLFINGEFVKSHEGKTFDVLNPSTEETIATLYEAQAADVDIAVKAAKEAFENHWSREDPEVRARALFNLADLVEANLETLAGIDSLDNGKSLLCSRADVALVAKYLRSCGGWADKIYGDVIDTGKSHFTYSVKEPLGVCGQIIPWNFPLLMWSWKIGPALATGNTVVLKPAELTPLSALFASKLCQEAGIPAGVVNIIPGPGKTVGERICTHPDIKKVAFTGSTATGSRIMKTAADSIKKVTLELGGKSPNIVFADADLEQAVENIAHGIFFNSGEVCCAGSRIYVQDKCYDEVLDRLKKYTESLKVGNPFGDNTYQGSQTSQQQLDKILEYVDIGKQEGARIVTGGERIGEKGYFFKPTVFADVKENMRIVKDEIFGPIVTVSQFSTVDEVIAMANDSQYGLAAGIHTNDVNKAVEVSSRLKAGTIWINTYNAFHQNVPFGGFGQSGIGREMGSAALDNYTQVKSVRMAITKPRV

SEQ ID NO: 6390 - protein, 343 aa, Triticum aestivum
  misc_feature (188)..(188): Xaa can be any naturally occurring amino acid
  misc_feature (209)..(209): Xaa can be any naturally occurring amino acid
  misc_feature (218)..(218): Xaa can be any naturally occurring amino acid
  misc_feature (255)..(255): Xaa can be any naturally occurring amino acid
  misc_feature (264)..(264): Xaa can be any naturally occurring amino acid
MSSSGAGEEGAAAPQGPLPVEHRKGANGLDKVVLREARRISAEVYLYGGHVTSWKDEHGEELLFVSNKAIFKPPKAIRGGIPICFPQFSNFGQLEAHGFARNKIWSVDTDPPPFPVPISSRAYIDLILKPTDEDLKIWPHSFEYRLRVALGPGGDLMLTSRIRNTNADGKPFSFTFAYHTYFSISDIXVRIRVEGPGNPWDYLDNLQRXGARFTEQGXAFVFESELDRIYLGTPSKIAIIDHEKKRTFVVRKGGXPDAEFLLGXVVWNPWDKKAKAMADFGDDEYKRMVCVEAAAIEKAITLKPGEEWTGKLELSAVPSSYYSGQLDPDRVIQDSVVPEDSVS

SEQ ID NO: 6391 - protein, 335 aa, Mycobacterium tuberculosis H37Rv
MRTPATVVAGVDLGDAVFAAAVRAGVARVEQLMDTELRQADEVMSDSLLHLFNAGGKRFRPLFTVLSAQIGPQPDAAAVTVAGAVIEMIHLATLYHDDVMDEAQVRRGAPSANAQWGNNVAILAGDYLLATASRLVARLGPEAVRIIADTFAQLVTGQMRETRGTSENVDSIEQYLKVVQEKTGSLIGAAGRLGGMFSGATDEQVERLSRLGGVVGTAFQIADDIIDIDSESDESGKLPGTDVREGVHTLPMLYALRESGPDCARLRALLNGPVDDDAEVREALTLLRASPGMARAKDVLAQYAAQARHELALLPDVPGRRALAALVDYTVSRHG

SEQ ID NO: 6392 - protein, 323 aa, Triticum aestivum
MAPMLKRIAEDEPKKAAYVTFLAGSGDYWKGVVGLAKGLRAVKSAYPLVVAVLPDVPEDHRQKLLAQGCVVREIVPVYPPESQTQFAMAYYVINYSKLRIWEFVEYERMVYLDADIQLYDNIDHLFDLEMGSFYAVMDCFCEKTWSHTPQYEIGYCQQCPDRVVWPERDLGVPPPPLYFNAGMFVHEPSMATAKALLDKLVVTDPTPFAEQDFLNMFFRDVYKPIPPVYNLVLAMLWRHPENIQLHKVKVVHYCAAGSKPWRYTGEEANMDRDDIKMLVKKWWAIYDDESLNYKPAADEAADPLRAALAEVVAVKSFPAPSAA

SEQ ID NO: 6393 - protein, 472 aa, Mycobacterium tuberculosis H37Rv
MSGTSSMGLPPGPRLSGSVQAVLMLRHGLRFLTACQRRYGSVFTLHVAGFGHMVYLSDPAAIKTVFAGNPSVFHAGEANSMLAGLLGDSSLLLIDDDVHRDRRRLMSPPFHRDAVARQAGPIAEIAAANIAGWPMAKAFAVAPKMSEITLEVILRTVIGASDPVRLAALRKVMPRLLNVGPWATLALANPSLLNNRLWSRLRRRIEEADALLYAEIADRRADPDLAARTDTLAMLVRAADEDGRTMTERELRDQLITLLVAGHDTTATGLSWALERLTRHPVTLAKAVQAADASAAGDPAGDEYLDAVAKETLRIRPVVYDVGRVLTEAVEVAGYRLPAGVMVVPAIGLVHASAQLYPDPERFDPDRMVGATLSPTTWLPFGGGNRRCLGATFAMVEMRVVLREILRRVELSTTTTSGERPKLKHVIMVPHRGARIRVRATRDVSATSQATAQGAGCPAARGGGPSRAVGSQ

SEQ ID NO: 6394 - protein, 288 aa, Xanthomonas campestris pv. campestris str. ATCC 33913
MPVPNYPRPPFKPQQQGFPGKTDKMDPRPDHGEDSYVGHGQLKGKRALITGGDSGIGAAVAIAYAREGADVAIAFLPDEQEDASRIGALIEKAGVRALLVGCDISDPNQAASLIDKVNSEFGGLDILVNNAGYQKYFQSFEEITLDEWRKTFDTNVHAVFNLVRLSVPLMKDGGSIINTASVQSKKPTPNILPYGATKGALANLTIGLAGVLAEKQIRVNAVLPGPIWTPFIPAGMDEESVESFGSQTPMGRPGQPVELASAYVMLASDTASYTSGTLLTISGGAVTL

SEQ ID NO: 6395 - protein, 412 aa, Carboxydothermus hydrogenoformans Z-2901
MADFKAKALELHKKFRGKIEVKSKVPAKTAEDLSLAYTPGVAEPCKLIAENKDLSYEYTSRWNMVAVVSDGTAVLGLGDIGPYAAMPVMEGKALLFKEFAGVDAFPICLDTKDPDKIVEVVKLLEPTFGGINLEDIAAPNCFYIEERLKKETSIPIFHDDQHGTAIVTLAALINALKIVNKDISKIKVVVNGAGASATAVSKLIMASGVKNLIMCDSKGIIYRGRQEGMNKYKEELAQITNPENIKGTLKDALKGADVFIGLSKAKQVTEEMVKSMNKDAIVFAMANPEPEIYPDEAKRAGARIVATGRSDFPNQVNNVLAFPGVFRGALDVRATDISEKMKIAASYAISSLVAENELNEDYILPKAFDARVASTVAREVAKAALEEGIARIKISPDDVFKHTLELLEKSGS

SEQ ID NO: 6396 - protein, 506 aa, Ralstonia eutropha JMP134
MSFSELGLSDKLVRAVAEQGYTTPTPIQAQAIPAILKGGDLLAGAQTGTGKTAGFTLPMLQLLSESAPQRQGKPAVRALVLTPTRELAAQVEESVRNYGKYVRLRSMVMFGGVGINPQIEQLRRGVEIVVATPGRLLDHVSQRTIDLSSVELLVLDEADRMLDMGFIHDIRKILNVLPPKRQNLLFSATFSDDIRALADRLLNNPASIEVARRNTTAETVAQRVYPVDRERKRELLAHLVREHDWHQVLVFTRTKHGANRLAEQLTKDGLSALAIHGNKSQSARTRALSEFKAGTLRLLVATDIAARGIDIDQLPHVVNFDLPNVPEDYVHRIGRTGRAGAEGEAISLVCVDEHGLLRDIERLIKRKLEQTVLTGFEVDPTIAAEPIQKGRQQRGGGQGGGQGGGRGRAQAKPAAPAAAKPSQGQPRQRPAQNAPRGASQAGGEAARGHGGANRNAGQAQPRNPQRNGGGQARPAQDATGAPARNNNRRPASQAALLGGARAKPAR

SEQ ID NO: 6397 - protein, 442 aa, Leptospira interrogans serovar Lai str. 56601
MYFESKPKIFVIMAGFFDSLKIGFGGASRILNSSFVFSTKTILLLKDLALGDDTFPIRLREAFEELGATYIKLGQLIASAPSLFPDKFVTEMQKCLDQVRPIPYSMITTIIQKELGGTLSDHFLSVEPIPIASASIAQVHSAVTKDGLDVVIKVQRPDIESTLSADLNLIYFVSVLFEKFAPGLSKSGIADMVEQFQTSILEEIDFYKEADNIEEFEKELLSMGETRARVPKVYRELSTKKILTLERFYGAPITDESSVRRYSSDPQKTLTGALEIWFSTLSRSGFFHADVHAGNLMILRDGTVGFIDFGIVGRISPRVWEGLMIFLEGLSLNRTEKIAKGLIQMDSTAKGVDEKKLSKDLEIVFSKMTEMVLKVQMGDLESLDDKKLNAILFEFREISIQNGLKIPKEFGLLIKQILYFDRYVKTMAPDIDLIRDRDKFLI

SEQ ID NO: 6398 - protein, 527 aa, Brucella suis 1330
MSNLSAVFRLMRAGWILTREGVISALPVEGLSGLPALGHRIAGFLARPRARQMERSERMSRAMNKLGPSYVKLGQFLATRPDIVGHDVAADLELLQDRLDFFPQAGAVAAIEGSLGRKIDDLYVRFDAPIAAASMAQVHPAEVMKDGAPQKVAVKVIRPGVRQRFARDLESFFMVARMQERHMPFTRRLRPVQVVETLSQTTRIEMDLRLEAAALSEIAENIKGDEGFRVPKVDWERTGRDVLTLEWIDGIKMSDIPALEAAGFDLKKLAETLIQSFLRHTLRDGFFHADMHPGNLFVDHQGLVVAVDFGITGRLDKQQRRFLAEILYGFITRDYMRVAEVHFEAGYVPYTHDVASFAQAIRAIGEPIHGQPAETISMAKLLTLLFEVTELFDMETRPELLMLQKTMVVVEGVSRTLDPHFNMWKAAEPVVGDWIRKNLGPQGMVLDAKESAYALLHFTRKTPELLQRIDRISVALDTMAANGLRFDDATAEAIGRAEAQHSRWGRIAQVVIAVSMAAIAIKLYIWL

SEQ ID NO: 6399 - protein, 398 aa, Glycine max
MSLILQTPPSTTLSSASPIHRTITRYTTFSFSLRPPTTLHFNPHRSLPLIRASNSSINAASTTELDAVSAFSEIVPDTVVFDDFEKFPPTAATVSSSLLLGICGLPDTIFRNAVEMALADSECYGLENPNARLSCFVNKAFANIGSDMAKLVPGRVSTEVDARLAYDTHAIIRKVHDLLKLYNDSNVPPQRLLFKIPSTWQGIEAARLLESEGIQTHLTFVYSFAQAAAAAQAGASVIQIFVGRIRDWARNHSGDTEIESAQLRGEDPGLALVTKAYNYIHKYGHKSKLMAAAVRNKQDLFSLLGVDYIIAPLKVLQSLKESVASPDEKYSFVRRLSPQSAAKYTFSDEELVRWDEDSLSKAMGPAAVQLLAAGLDGHADQAKRVEELFGKIWPPPNV

SEQ ID NO: 6400 - protein, 367 aa, Carboxydothermus hydrogenoformans Z-2901
MKILLLAERFGHGHLKAAYNLQKAFGEVAPNVEVKVLTMLNLIGPKIEKIASDLYLKILTHTPEIWGYVYEQGHDKEKDRLRLVVAFLYKKKLKEVIRKFKPAGIIVTHAFPAVALDYLGYRNYATVITDYDYHAFWLTQNSRFYYVAAEEIKEKLVGKGYSRDKIYAFGPPIDPVFAGEIDANAVRERYQIREGTKIILMMGGGLGLGPLAEAAKTLTDINKEWVVIVLCGHNQKLYRDLKVLGRRNLIPVPFTAEVPEYLAAADIVITKPGGLSTAEALALGKPLIIINPLPGQEQRNAEFLQKKGAALYLSDVLELNKVLPELFFSQNLLSLRQKAAKLGRRDASINISKHFFQNIGDNISGGD

SEQ ID NO: 6401 - protein, 607 aa, Bacillus anthracis str. Sterne
MNKEERAKRQSKIRNFSIIAHIDHGKSTLADRILEKTNALTQREMKAQLLDSMDLERERGITIKLNAVQLNYKAKDGEEYILHLIDTPGHVDFTYEVSRSLAACEGAILVVDAAQGIEAQTLANVYLALDNNLEILPVINKIDLPSADPERVRQEVEDVIGLDASEAVLASAKAGIGIEEILEQIVEKVPAPTGDSEEPLQCMIFDSLYDPYRGVIAYIRVVNGTVKVGDKVRMMATGKEFEVTEVGVFTPKTTQRDELTVGDVGFLAASIKNVGDTRVGDTITHAKRPAAEPLAGYRKLNPMVFCGLYPIDSARYNDLRDALEKLELNDSALEFEPETSQALGFGFRCGFLGLLHMEILQERIEREFKIDLITTAPSVIYKVFLTNGEDMIVDNPSNMPDPQTIDRVEEPFVKAAIMVPNDYVGAVMEICQGKRGTFIDMQYLDETRVTLTYEIPLSEIVYDFFDQLKSNTKGYASFDYELIGYKPSKLVKMDILLNSEQVDALSFIVHRDSAYDRGKVIVEKLKELIPRQQFEVPIQATIGNKVVARSTIKAMRKNVLAKCYGGDISRKRKLLDKQKEGKKRMKSVGSVEVPQEAFMAVLKMDDN

SEQ ID NO: 6402 - protein, 415 aa, Glycine max
TSATTMVAMAAATASSQLIFSKPRSPSRLCPFQLCVFDTKQVLSSSSGRRRHVGGSGVRCMAVGEAATTETKKRSGYELQTLTNWLLKQEQAGVIDAELTIVLSSISMACKQIASLVQRANISNLTGVQGAVNVQGEDQKKLDVVSNEVFSNCLRSSGRTGIIASEEEDVPVAVEESYSGNYIVVFDPLDGSSNIDAAVSTGSIFGIYSPNDECLADIGDDPTLDTTEQRCVVNVCQPGSNLLAAGYCMYSSSIIFVLTLGNGVFVFTLDPMYGEFVLTQENLQIPRAGKIYAFNEGNYQLWDDKLKKYIDDLKDPGPSGKPYSARYIGSLVGDFHRTLLYGGIYGYPRDKKSKNGKLRLLYECAPMSFIVEQAGGKGSDGHQRILDIQPTEIHQRVPLYIGSVEEVEKVEKYLA

SEQ ID NO: 6403 - protein, 276 aa, Candida glabrata
VCFSPDGKFLATGAEDKLIRIWDIEQKKIVMVLKGHEQDIYSLDYFPSGDKLVSGSGDRTVRIWDLKTGQCTLTLSIEDGVTTVAVSPGDGKFIAAGSLDRAVRVWDSDTGFLVERLDSENELGTGHKDSVYSVVFTRDGNGVVSGSLDRSVKLWNLRNVNHNNADGKPTSGTCEVTYTGHKDFVLSVATTEDDEYILSGSKDRGVLFWDKVSGNPLLMLQGHRNSVISVAVNHGHPLGPNYHIFATGSGDCKARIWKYIKTTTEVNSNGKIQPIS

SEQ ID NO: 6404 - protein, 556 aa, Neisseria gonorrhoeae FA 1090
MEKIWLESYEKGVSAEIDITQYNSVSDVFRQSVEKFARLPAFQNMGKTLTYAETGKLATDFASYLQNVLKLPRGERVAIMMPNVLQYPIALFGILQAGLVAVNTNPLYTPRELEHQLKDSGATAIIVLENFANTLELVLPRTQIKHVIVASVGEMFGLLKGSLINFIIRKIKKMVPEYRIRETVSFQTALKEGAKHVFQPVALNREDTALLQYTGGTTGVARGAVLSHGNICANMLQAKEWIKNQLREGKETVIAALPLYHIFALTVNLMIFANAGSKIVLIANPRDMKGFIGELKKQRVNVFIGVNTLFNAMVNRPDFAEVDFSGLRLTLGGGMATQKAVAEKWKKITGTPIVEAYGLTEASPGVCCNPLNIESYSGSIGLPVPSTEVELRDANGKEVPVGQPGELWVKGPQVMQGYWNRPEETAKAIDACGFLETGDIAVMDEKGRLKLVDRKKDLVVVSGFNVYPNEIEEFIAHHEKVMEVACIGVPNEKTGEALKVFVVKKDPSLTKEELTAFCRTGLTAYKVPKDIEFRDELPKSNVGKILRRELRQSAGK

SEQ ID NO: 6405 - protein, 87 aa, Glycine max
CLCEVANSCRYLCPEPYPEGNLEFLRSQNIRLFQFGIEGKTDVSMPVLKDSIMDALKVLIDVRNHPILVHCKRGKHRTGCLVGCLRN

SEQ ID NO: 6406 - protein, 339 aa, Brassica napus
MDHEADAFRDLMTITRFVLNEQSKYPESRGDFTILLSNIVLGCKFVCSAVNKAGLAKLIGLAGDTNIQGEEQKKLDVLSNDVFVKALVSSGRTSVLVSEEDEEATFVESSKCGKYCVVFDPLDGSSNIDCGVSIGTIFGIYTMEHSDEPTTKDVLKPGNEMVAAGYCMYGSSCMLVLSTGTGVHGFTLDPSLGEFILTHPDIKIPKKGNIYSVNEGNAQNWDGPTTKYVERCKYPKDGSPAKSLRYVGSMVADVHRTLLYGGIFLYPADKKSPNGKLRVLYEVFPMAFLMEQAGGQAFTGKKRALDLVPKKIHERSPIFLGSYDDVEEIKALYAEEEKN

SEQ ID NO: 6407 - protein, 294 aa, Coffea arabica
MDQYEKVEKIGEGTYGVVYKARDKSTNETIALKKIRLEQEDEGVPSTAIREISLLKEMQHGNIVRLQDVVHSEKRLYLVFEYLDLDLKKHMDSCPEFSKDPRLVKMFLYQILRGIAYCHSHRVLHRDLKPQNLLIDRRTNALKLADFGLARAFGIPVRTFTHEVVTLWYRAPEILLGSRHYSTPVDVWSVGCIFAEMVNQRPLFPGDSEIDELFKIFRVMGTPNEDTWPGVTSLPDFKSAFPRWLSQDLATVVPNLDAAGLDLLRKMLCLDPSKRITARNALEHEYFKDIGFVP

SEQ ID NO: 6408 - protein, 340 aa, Solanum tuberosum
MDHAADRHRTDLMTITRFVLNEQTKHPESRGDFSILLSHIVLGCKFVCTAVNKAGLAKLLGLAGETNVQGEDQKKLDVLSNEVFIKALVSSNRTCILVSEEDEEATFVRPANRGKYCVVFDPLDGSSNIDCGVSIGTIFGIYMIKDGHEPTLDDVLQPGMNMLAAGYCMYGSSCTLVLSTGSGVNGFTLDPSLGEFILTHPDIKIPKKGKIYSVNEGNAKNWDSPTSKYVQSCKYPADGSSPKSLRYIGSMVADVHRTLLYGGIFLYPGDKKSPNGKLRVLYEVFPMSFLMEQAGGQAFTGKQRALDLVPEKIHERSPIFLGSYDDVEEIKKLYAAEEQN

SEQ ID NO: 6409 - protein, 343 aa, Listeria monocytogenes EGD-e
MKAVVKTNPGYDQMELKDVEEPQVYGDKVKIKVAFTGICGSDIHTFKGEYKNPTTPVTLGHEFSGVVVEVGPDVTSIKVGDRVTSETTFETCGECIYCKEHDYNLCSNRRGIGTQANGSFAEFVLSREESCHVLDERISLEAAALTEPLACCVHSALEKTTIRPDDTVLVFGPGPIGLLLAQVVKAQGATVIMAGITKDSDRLRLAKELGMDRIVDTLKEDLAEVVLGMTGGYGAERVFDCSGAVPAVNQGLPLTKKKGDFVQVGLFAEKKNAIDEESIIQREIAYIGSRSQKPSSWILALDLLANGKIDTDKMITKVYGLDDWREAFEAVMAGNEIKVLVKS

SEQ ID NO: 6410 - protein, 387 aa, Xanthomonas campestris pv. campestris str. ATCC 33913
MLALNYHGSRDVRVETVPDPLLVERDDLILRVTATAICGSDLHLYHGKIPDLRPGDILGHEFMGIVEEVGPDVTAVRPGDRVVIPFVVACGQCFHCLLQEFSACETTNTGKGAALNHKDMRPPAALFGFSHLYGGLSGGQAEYVRVPKANVGPLVVPDALHDEQVLFLSDILPTGYQAVVDAGVKQRSTVAIFGAGPVGLMAAACCRMLGAERVFMVDRHAYRLDFASRTYGVIPINFDEIDDPADIIVSQTDGRGVDASIEAVGFEAEGSALETALTTLKLEGSSGVALRQCIAATRRCGTVSVPGVYAGFIHAFMFGDAFDKGLTFKMGQTHVQKHMPYLLERIGNGELKPSAIISHRLPLAEAARGYEVFDKKQDDCRKVVLTP

SEQ ID NO: 6411 - protein, 350 aa, Listeria monocytogenes EGD-e
MRAAVLYENNVIKAEQIDEATCGKDQVRVEVKAVGICGSDIHKMQTRWKYPLPAVMGHEFAGVITEIGSEVTNVAMGDRVAGIPLEPCMECNYCKAGDFALCDNYRMVGSHFHGGFAENVVMKADNVISIGDLDFEEGAMIEPLAVSMHGVLGIQPRLGDTVIVFGIGTIGILVVQCLLLAGVKDIIAVDISDKKLADAREFGCKYTINPKNEDLKERVFAYTNGLGADIALECAGSKITQEQCLLVTKKKGKVGFLGIAYADVLLHEEAFENIFRRELTLKGFWNSYSAPFPGEEWRTSIEFVKQGRIKLKPLISHRYKLEETKEAFDMILSREHDYNKVMILPQKGDD

SEQ ID NO: 6412 - protein, 497 aa, Pseudomonas putida KT2440
MTTLTRADWEQRAQQLKIEGRAFINGEYTDAVSGETFECLSPVDGRFLAKVASCDLADANRAVENARATFNSGVWSQLAPAKRKAKLIRFADLLRKNVEELALLETLDMGKPIGDSSSIDIPGAAQAIHWTAEAIDKVYDEVAPTPHDQLGLVTREPVGVVGAIVPWNFPLLMACWKLGPALATGNSVVLKPSEKSPLTAIRIAQLAIEAGIPAGVLNVLPGYGHTVGKALALHMDVDTLVFTGSTKIAKQLMVYAGESNMKRIWLEAGGKSPNIVFADAPDLQAAAEAAASAIAFNQGEVCTAGSRLLVERSIKDKFLPMVVEALKGWKPGNPLDPQTTVGALVDTQQMNTVLSYIEAGHKDGAKLLAGGKRTLEETGGTYVEPTIFDGVTNAMRIAQEEIFGPVLSVIAFDTAEEAVAIANDTPYGLAAGIWTSDISKAHKTARAVRAGSVWVNQYDGGDMTAPFGGFKQSGNGRDKSLHALEKYTELKATWIKL

SEQ ID NO: 6413 - protein, 353 aa, Leptospira interrogans serovar Lai str. 56601
MATKKKNWLLYGANGYTGKLIAKKAVERGQTPILAGRSESKIRFLAEELGLPFRVFSLENPKEIQNQISDSFLVLNCAGPFIETAIPIAKACVESGVHYLDVTGEIPVFEMLYSLSPKALAKNIMLLPGVGFDVVPTDCLAVMLKEKLSKAHFLELGFTGFTDLSRGTLKSALVQLPYGSKIRRNGKIETIPQLSLKKVIEINGRYAEFFAVPWGDIFTSFISTGIPNITVYSSFPELQARVLKLLQPSIFFLKNSAILKGIQKIVEVIVSGPDEQKRKKGEVLLWGEVWSEANSKRVSIRMRCSEAYEFTIESALAAVSKVEKKKFHAGFTTPAKVFGSKFVLEIPGTKILS

SEQ ID NO: 6414 - protein, 531 aa, Magnaporthe grisea 70-15
MNATTEQEAIVKVLFTTTEQGLELPESKRLLLVPADIRRYGLSRVLNSESMLNTAAPIPFDFLVNGTFLRTTLEDYLKENGLPFEKTVTLQYVRSLVPPAYEASFEHDDWVSSVDLLSATSSAGKWSGSSFLQGQDRILSASYDGLLRIWNGSGQALATSSVVNRGPLCGLKSAKFMSSTKIAAAGLDRTVRIWDYTEADDHFSGQLKPTLELYGHRSIIESLGVDGSSRRILTACADGSIGLWTTSKKLAPEAPTALLPQTYATKRRKGSTTSANIIAQRGALSLIPVHSRPVSAAIFDPQNQHTAYSASQDHTLKVLDLTTSRVVSTITTSNALMSACYLSNKSAPLIAAGTSSRNVTLIDPRESAAATSVMTLRGHINVVSSVSASPDNEYSLVSGSHDGTCRIWDLRSVRPAAGKEETGLGSVGESVYLIERESLGDKKRPLAGEGVKVFDVQWDKTWGIPSKEVPQLPSRKYHVYYETGNLIVSNFNYHQVQLLNRLLCIVHNRREPKAWIKHFKPRRLPPTVVVK

SEQ ID NO: 6415 - protein, 103 aa, Zea mays
MSGRGKGGKGLGKGGAKRHRKVLRDNIQGITKPAIRRLARRGGVKRISVLIYEETIGVLKIFLENVIRDAVTYTEHAKRKTVTAMDVVYALKRQGRTLYGFGG

SEQ ID NO: 6416 - protein, 140 aa, Glycine max
MSMRGIGGPLLCIGDLLNDVGEDEQQHGQGHSLLRETFPSSSNFNYNDPPPDLTKLFQEHYDHLNSALSGTDHSWTSLTLKLCTALETSNQLVQSTNTNVASLSKKVEDLQKIVKRGDSAIAAAKALYYVTPDNHSSASK

SEQ ID NO: 6417 - protein, 545 aa, Acidovorax sp. JS42
MYDQNLPRTEANHTPLSPLSFIERTAEVYPDRLAIVHGELRQTWGQTYARCRRLASSLRRAGIGKNDTVAVMLPNTPPMVEAHFGVPMAGAVLNALNTRLDPETIAFMLDHGEAKAVIVDPEFAPVMAKALALRQSQAPLLLIDVEDAVYGPAAQRLGTLTYEDFLAQGDAQFAWELPGDEWDAIALNYTSGTTGNPKGVVYHHRGAHTNAVSNVLEWDMPKHAVYLWTLPMFHCNGWCFPWTVAARAGVNVCLRRVEAQAIFDAIRNHGVTHYCGAPIVHGLLVNAPAAMKEGVPAGVKAMVAGAAPPASMIEGMEQMGFDLTHVYGLTEVYGPATVCAKHAAWDALDIGERARLNARQGVRYHLQRAAMVLNPDTMEPVPHDGETMGEIMFRGNIAMKGYLKNPKATEEAFRGGWFHSGDLAVQYPDGYIKIKDRSKDIIISGGENISSIEVEDVLYRHPDVLAAAVVAKPDPKWGETPCAFVELKAGAQATPEDIVAHCKKHLAGFKVPRAVVFGELPKTSTGKIQKFELRKQAGSAAAIDV

SEQ ID NO: 6418 - protein, 480 aa, Brucella suis 1330
MQTRYPDVKLFIDGTWRDGSRGETIEIFNPATDEVIGHIARATTADLDDALAAVDRGFEAWSKVSAFDRYKIMRRAADIFRSRGEEVARLLTMEQGKPLAEARIEAAAACDLIDWFAEEARRSYGRIVPPRQAYVMQAEVKEPVGPVAAFTPWNFPINQAVRKISAALAAGCSILLKAAEDTPAAPAELVRAFAEAGLPDGAINLVYGDPAEISAYLIPHPVIRKVSFTGSTQVGKQLAALAGLHMKRVTMELGGHAPVIIAADADVEQAIKVVSGSKFRNAGQVCISPTRFLIENSVYDQVVEGMAAYATSLKVGDGLEAGTTMGPLVNAKRVNAMERLVQDAREHKARVVTGGERIGNRGNFFEPTILADVPRDATIMNEEPFGPVALLNRFDALDEALSEANRLNYGLAAYAFTGSSAKAARISSTVRSGMITINHYGLALPEVPFGGINDSGYGTEGGADALEAYQNTKFVSFLQA

SEQ ID NO: 6419 - protein, 219 aa, Triticum aestivum
MDSSSSSTASSSQAQAQPDFDYLFKLLLIGDSGVGKSSLLLRFTSDSFEDLSPTIGVDFKVKMVNIAGKKLKLAVWDTAGQERFRTLTSSYYRGAQGIIMVYDVTRRETFTNLSDIWAKEIDLYSTNQDCIKMLVGNKVDKESERAVTKKEGVDFAREYGCLFLECSAKTKVNVEQCFEELVLKILDTPSLLADASSGAKKNIFKQKAPEADAAASGCC

SEQ ID NO: 6420 - protein, 424 aa, Rhodococcus sp. RHA1
MSALSNLSTELSTVVIVGSGIAGASAAQTLRSEGFSGRVVLIGDEPAPPYRRPTVSKDFLSGATAAEKTALKPDSFWKERDIELITGATAVELDTRRKLLTLSSGVTLSYSALLLATGGRARKLEGVSGAHVFTLRSMADADSLRESIRRTGSLLVIGGGLIGCEVAATARSLGAEVTVLERDPSLLSRIVPPEISTMIASLHSENGVDVRTDVALSSLDVSDDGSARATADDGRSWSAGTVLVSVGTVPEVTLAVAAGLRVHNGITVDGQFRTSADGVYAAGDAANIPGARDSERYRSEHWNGAQAQGIAAAHSILGEPMPFTDVPWGWSTQYGHNVQFAGATRFDDDYVIRGSIDDRDFTAVAVRGSTPVGVIAVGRPKDLRTARTMIARGGTVDRAALADESVALTDVLAGEREGRVAAAR

SEQ ID NO: 6421 - protein, 277 aa, Bacillus anthracis str. Sterne
MKQLYGVIGNPIGHSLSPVMHNDAFEHLKMDAHYHAFLVKEEVLGEAVRGLKALGISGFNVTTPHKVAIMDYLDEIDPLAKQIGAVNTVVHKDGKLIGYNTDGIGFVRALQSISSEPLQEKRILLLGAGGASRAIYFSLADAGVKEIDVANRTVDKAKELIAACTATVHSVALSLEKATKEQGNYDIIIQTTTIGMHPRVEHTPLQISSLKKGTIVSDIIYNPFETKILCEAKEQGAIIQNGIDMFVYQGALAFEMWTGCVPNIERMKQLVIRKLGG

SEQ ID NO: 6422 - protein, 274 aa, Onion yellows phytoplasma OY-M
MNYKPRTKVIAGNWKMYKCKDEALEFIQKVSLQVPDQTQVQTLIFPQLTLLDSLAQLQGTNLQVGAQNMFYESEGAFTGEVSPQNLLSLGVKHVLLGHSERRTFFGETDQTVNLKLLSALKHKLVPTVCVGESLLTKENNQTQVFLDQQLTNIFAGVPEEALQNIIIAYEPVWAIGTGKSATPQDANKVIEQIRDKVTALYSSQASCAMRIIYGGSVSVANIKTILEQPAIDGILAGKASLQTEDFLFFAQIASKQALASTKDIFQKNDCPFCC

SEQ ID NO: 6423 - protein, 157 aa, Brassica napus
RILNEKDFDINLDAYNDYSKLYLSVMFALLYGLSFGSLFATISHVALYDGKFIWGMWKKATTATKDKFGDVHSRLMKKNYQAVPQWWFIAVLIISFALALYACESFDKQLQLPWWGLVLACAIAMFFTLPIGVIQATTNQQMGLNVITELIIGYLYP

SEQ ID NO: 6424 - protein, 938 aa, Oryza sativa (japonica cultivar-group)
MARPVSQSHNGPGSFTSPISGAASAHVGPPPLSFQLQLPRRRRSAAAAAAAAAQQFHLPLSVISQGSYVYDSKGNKYLDTLAGLWCTALGGSEPRLVKAATDQLNKLPFYHSFWNSTAKPPLDLAEELISMFTAKEMGKVFFTNSGSEANDSQVKLVWYYNNALGRPNKKKIIAQSQALPAMHLKFDLPAPFVLHTDCPHYWRFGLPGEAEEEFATRLADNLENLILKEGPETVAAFIAEPVIGAGGVIPPPKTYFEKIQAVLQKYDVLFIADEVITGFGRLGTMFGSDLYNIKPDLVSLAKALSSAYVPIGATLVSPEISDVVHSQSNKIGFFAHGFTYSGHPVSCAVALEALKIYRERNIPAHVKQISPRFQEGIKAFAGSSIIGETRGVGLLLATEFANNKSPNDPFPVEWVNEDDDVDEDGDGPNEQGVQNQELTKARRLNVDIEATTSLELEWRLQTSPQLLRFKGHGMLAPFTAGWQSTDVHPLVIERSEGSYVYDIDGKKYLDSLAGLWCTALGGSEPRLVKAATEQLHKLPFYHSFWNRTTKPSLDLAKELLSMFTAREMGKVFFTNSGSEANDSQVKLVWYYNNALGRPDKKKFIARSKSYHGSTLISASLSGLPALHQKFDLPAPFVLHTDCPHYWRFHLPGETEEEFATRLANNLEELILKEGPETVQSSFHRNLYCAKRSKIAAFIAEPVMGAGGVIPPPKTYFEKVQAIVKKYDILFIADEVITAFGRLGTMFGSDMYNIKPDLVSMAKALSSAYVPIGAIMVSPEISDVIHSQSNKLGSFAHGFTYSGHPVACAVAIEALKIYQERNIPDHVKQISPRFQEGVKAFAGSPIVGEIRGVGLILGTEFADNKSPNDPFPAEWGVGAIFGAECQKRGMLVRVAGDNIMMSPPLIMTPDEVEELVSIYGDALKATEERVAELKSKKNN

SEQ ID NO: 6425 - protein, 352 aa, Escherichia coli CFT073
MLYYLHIRWITSMCKKTSGNRFHFAFQSSEVVMIKKIGVLTSGGDAPGMNAAIRGVVRSALTEGLEVMGIYDGYLGLYEDRMVQLDRYSVSDMINRGGTFLGSARFPEFRDENIRAVAIENLKKRGIDALVVIGGDGSYMGAMRLTEMGFPCIGLPGTIDNDIKGTDYTIGFFTALSTVVEAIDRLRDTSSSHQRISVVEVMGRYCGDLTLAAAIAGGCEFVVVPEVEFSREDLVNEIKAGIAKGKKHAIVAITEHMCDVDELAHFIEKETGRETRATVLGHIQRGGSPVPYDRILASRMGAYAIELLLAGYGGRCVGIQNEQLVHHDIIDAIENMKRPFKGDWLDCAKKLY

SEQ ID NO: 6426 - protein, 250 aa, Pyrococcus abyssi GE5
MIVEVARVLASSKNAIAFTGAGISAESGVPTFRGKDGLWNKYRPEELATPEAFARNPKLVWEFYKWRINKILKAKPNPAHYALVELEDMGILRAVITQNVDDLHREAGTRNLIELHGNIFRVKCTKCNFKEYLKESQRLEEVLKEDLPKCPRCGSLLRPDVVWFGEPLPREELDRAFKLAEKADAVLVVGTSGLVYPAAYIPYIVKESGGTVIEVNVEESAITPIADFFLRGRAGEVLPRVVHEVRRLLQ

SEQ ID NO: 6427 - protein, 430 aa, Pyrobaculum aerophilum str. IM2
MDNTIIRRAREGRIDDEMRKIAEAEGVSPEKLRDRIAKGQVVYIRNVKWPSEKVVAIGKGLSTKINVNLGTSTEVVDLDSELKKVEVANKWGDTLMDLSVGGDLDAIRRAVISKSKLPVGTVPVYQAFIEAFNKRSGGAYFTIDDLFNTIERQLKDGVAFMTIHAAVTKEAAIRVLKSDRVIPVVSRGGDMIIGWMLHNDAENPYLTHWDYLLELFAQYDAVISIGDALRPGAVADAHDEFHVGELVEAARLAKRAIKAGVQVMIEGPGHVPLNDVIWTIKLEKRLTGGVPYYVLGPLPTDVAAPYDHIASAVGAALAAAAGADLLCYITPAEHLSLPTVEQVEQGAIAYRIAAHIGDVVKLGRKARRWDDEVSYYRGRLMWDEMIKRLVDPERAYKVYTQYGPPKVKGCTMCGGYCPMNMVIQQARRLK

SEQ ID NO: 6428 - protein, 233 aa, Leptospirillum ferrooxidans
PKVLFKGEGSSKQEPYEYLVIDVAEEYVGTVMEKLGPRKGEMLNMAPQRGGHVRLEFLIPARGLLGYRSEFLSDTRGTGLLTHTFHGYGDFKGDIPGRVNGALISMEQGETVAYAMVNVQERGVLFVNPGVKVYEGMVIGAHSRPTDLAVNPCKKKHLNNIRSSNAEEAIVLTPPRLMSLEQTLEFLEEDEILEVTPENLRIRKKLLSENDRKKGRKKMNGLNLIKWKIPIRE

SEQ ID NO: 6429 - protein, 209 aa, Zea mays
MAASSALRLILGSSSASRRQILSEMGYKFTLLSADIDEKAIRKENPEELVVALAHAKADAILEKMQNNGMMKEILDSQDTTLMITADQVVLHDGVIREKPSTPEEARKFIKGYSESHAATIGSVLVTNVKTGARREGWDKAEVYFHKIPDEVVESLIEEGDVFYVAGGLLVEHPLTSPLVEAIVGTIDSVMGLPKALTEKLIKESLSET

SEQ ID NO: 6430 - protein, 518 aa, Zea mays
LTSAQDCHRIFHEELVVRAFLEAEKAHRGQMRASGDPYLQHCVETAVLLAKIGANATVVSAGLLHDSIDDSFIDYDHIFHIFGAGVADLVEGVSKLSHLSKLARDNDTASRTVEADRLHTMLLAMADARAVLIKLADRLHNMKTLEALPWVKQQRFAKETREIFVPLANRLGIASWKEQLENLCFKYLNPEEHRELSSKLTESFDEELITSAVDKLDKGLRDAGVSYHNLSGRHKSVYSIHSKMLKKNLAMEEIHDIHGLRLVVDNEEDCYEALCVVHRLWPRVTGRFKDYISRPKLNGYRSLHTVVMGEGVHPLEVQIRTKEMHLQAEYGFAAHWRYKEGRTCRHSFVLQMVEWARWVLTWQCEAMDKERTASSLGSGDAASARPPCPFPLHSEDCPYSYTRQCNHDGPLFVILLEHDKMSVQEFPADSTVMDLMDRVGANSSRWSPYSIPVKEDLRPRVNREPICDPNRKLSMGDVVELTPALPRRSLSGYREEIQRMYDRGGFALSAQGGGSRRC

SEQ ID NO: 6431 - protein, 119 aa, Acidovorax sp. JS42
MAFTTTASGLQYEDTVVGTGAQATRGQSVRVHYTGWLYNDGQQGAKFDSSRDRNDPFEFPLGAGMVIKGWDEGVQGMQIGGQRTLIIPAALGYGARGAGGVIPPNATLKFDVELLAVGV

SEQ ID NO: 6432 - protein, 892 aa, Oryza sativa (indica cultivar-group)
MAEHKPPPGRPKREGEGASKKKAKSGGFESMGLCEEVYRGVRHKGYRVPTPIQRKAMPLILAGHDIAAMARTGSGKTAAFLVPMIQRLRRHDAGAGIRALILSPTRDLATQTLKFAQQLGKFTDLKISLIVGGDSMESQFEELAENPDIIIATPGRLVHHLAEVEDLNLRTVEYVVFDEADSLFSLGLIQQLHDILHKLSDTRQTLLFSATLPQALADFAKAGLRDPQIVRLDLDKKISPDLKLAFFTLRQEEKLAALLYLVRERISSEEQTIIFVSTKHHVEFLNILFREEGLEPSLSYGAMDQEARNIHISKFRARKTMILIVTDVAARGLDIPLLDNVVNWDFPAKPKLFVHRVGRVARQGRSGTAYTFVTSEDMAYLLDLHLFLSKPLRPAPTEEELLKDMEGMNLKIDRALANGETVYGRFPQTIIDLVSDGIREVINGCTDLIALEKPCTNAFHLYLKTRPMPSTESIRRVKDLPREGLHPIFRDVLGSDELSALAFSERLKSFRPKQTILEAEGEAARARNSKGSNQWLDVMKKKREVHEGIINLVHQKNNVDHEPKLEPKAQHALSHIILKILIAGSSVGGLEEGLSLCETEEELVENISNWERKDVCGNKRKLQSFRDEEYYISSVPQNQHLEAGLSVRANEGFVENRLDAAVLDLVDDETSGMQAQKTRYHWKKNKFVKLNSGDRVTATGKIKTESGAKLKPTKTGIYKKWQQKTHRSIDTGRKYGGFAEEGASTTGSHQRGNRKHTAAGRGRRYIPNADVPSEIRNPEQIQKSRQQKAMDIARMKNRSTKESKFQKFQKNNRRHDGPSKDGKFQKNRRPDGNGKGRGKGKGNANGFGKGKGKMKGKGTRLVMSIGKQFVAITCENASLALLLLFFPQKRIL

SEQ ID NO: 6433 - protein, 398 aa, Onion yellows phytoplasma OY-M
MTKSLTNMNITNKKVLLRADLNVPLENSVITDDNRIKAILPTLKYLVQQKAKVIIFSHLGRVKTEADKAHFSLQVVAEKIAFYLQQKLKFVPETQGNTLNQAVGQMLPGDVLVVQNTRFEDVPFKKESKNDPELGKYWASLGDVFVNDAFGTCHRTHASNVGIATYIKEKCFGFLVEKEISFLKKIVQTPQRPLVAVLGGSKVSDKIGVIRSLLQKVDVLLIGGGMSYTCLKAKCFNIGTSLLEADKIPLVKELLASPEGKKIVLPKDFVCGKEFSPTTQAAVYSYDNISDDVMGLDIGPQTIELFKTYLQTAQTVVWNGPVGVFEFEQFSKGTKALAETISNLSPNTTTIIGGGDSAAAVFKFGLDQNFSHISTGGGAFLEFLEGKPMPGLACMEKL

SEQ ID NO: 6434 - protein, 127 aa, Triticum aestivum
  misc_feature (76)..(76): Xaa can be any naturally occurring amino acid
MDMAPPASAVSFSPRPSTGTTFRPRAASASGSVGAGRVRAAVAPEGGKWWAPLLGWSGRADYIEAAAPAPAMAMVXGAEEEEKAGRSFVGGLTEEKARQLRARMVETESFHDAMYHSAIASRLARST

SEQ ID NO: 6435 - protein, 215 aa, Brassica napus
MTSFSTFSELLGSGHESPVTLGEEYCPKLAASCPKKPAGRKKFRETRHPVYRGVRLRNSGKWVCEVREPNKKSRIWLGTLLTAEIAARAHDVAAIALRGKTACLNFADSAWRLRIPETTCPKEIQKAAAEAAVAFKAEINNTTADHGIDVEETIVEAIFTEENNDGFYMDEEESMFGMPALLASMAEGMLLPPPSVQFGHTYDFDGDADVSLWSY

SEQ ID NO: 6436 - protein, 371 aa, Burkholderia vietnamiensis G4
MRAPFVGSCVYGGARRTDASRADTSGTRACIRLRPDYVYAGVRPAWSQLEICMNLKVALAVLSVLVAAALLAAHSPLRLLNALTPTNTFRLFADIPYGPGERQVLDVYLPARVARDWPTEPNAGAPVVVFFYGGSWQSGKRNDYLFVGEALASRGFVAVVPDYRTYPATTFPGFIDDAARAVAWARGHAAAFGGDPRRVFLMGHSAGAQIAALLATDGRYLAASEMRSSEIAGVIGLAGPYDFLPLRDATLERIFPDDQRAASQPIRFVRGSEPPMWLAVAENDTVVEPGNTDRFARALQNAGDSVVVTRYRHLSHAALVGVLGAPLRRAASVLDDLSAFVERAGGVSNAGVASGDAKPRAATVASAVSAQ

SEQ ID NO: 6437 - protein, 513 aa, Triticum aestivum
  misc_feature (70)..(70): Xaa can be any naturally occurring amino acid
MAPFLNPSPELKHALLWSVPILIIAPTVIFLYMQAVGKKKNTIRLPPSPLRLLIIGHLHLMVHEPHRSLXEAGSQPGPVIHLQLGGIAAIVVSSPEAAKEVLKTHDVHCCSRPSSPGAKLITYGQQDIAFSPYNASWRERRKLFVSELVSSKRVQSFAYALEAQVGELIQSLSLRSPPTEAVNLNETLFTLIDGFIGRVAFGSMNGAKLMKYAKFQQVFSEAMIALSAFSAQDFFPASPMSRWVDKLVGLEARYQRIFLELDSYFEMGLSQHMDPGRVKPDKDDLVDVLISLWLGQGKVTKDHLKALLMDTFIGGTTTSSVTLLWAMSELIKNPTVMQKAQREVRSLVGGKQRLVQVDDLSKLNYLKMVVKETLRLHPPAPLLVPRETMDHVKVLGYDIPAKTRIFVNVWAMGRDPACWEKPEEFYPERFDGMDTDFYGLHYELLPFGAGRRICPAIPMGATIVEFTLASLLHSFDWELPDGMRKEDVSMEGTGRQVFCRKTPLCLVPSVNTG

SEQ ID NO: 6438 - protein, 382 aa, Glycine max
MSSTVGQTIKCKAAIAWEAGKPLVIEEVEVAPPQAGEVRLKILYTSLCHTDVYFWDAKGQTPLFPRIFGHEASVGGIVESVGEGVTHLKPGDHALPVFTGECGDCAHCKSEESNMCELLRINTDRGVMIHDGQSRFSKNGQPIHHFLGTSTFSEYTVVHAGCVAKINPAAPLDKVCVLSCGICTGFGATVNVAKPKPGSSVAIFGLGAVGLAAAEGARVSGASRIIGVDLVSARFEEAKKFGVNEFVNPKDHDKPVQQVIAEMTNGGVDRAVECTGSIQAMVSAFECVHDGWGLAVLVGVPSKDDAFKTAPINFLNERTLKGTFYGNYKPRTDLPSVVEKYMSGELEVDKFITHTVPFSEINKAFDLMLKGQSIRCIIRMQE

SEQ ID NO: 6439 - protein, 384 aa, Pyrococcus abyssi GE5
MSKFPEKGLPREEVLNLLEDKTKVDLTFSSGKILGSMCTMPHELAIEVFARYIDRNLGDPGLHPGTRKIEEEVIEMLSDLLHLEKGYGHIVSGGTEANILAVRAFRNISDAERPELILPKSAHFSFIKAGEMLGVKLVWAELKQDYAVDVKDVEAKISDNTIGIVGIAGTTGLGVVDDIPALSDLAREYGIPLHVDAAFGGFVIPFAKSLGYDLPDFDFKLKGVESITIDPHKMGMAPIPAGGIIFRRKKYLKAISVLAPYLAGGKVWQATITGTRPGASVLAVWALIKHLGFEGYREIVRKAMELSRWFAEEIKKLNNAWLVREPMLNIVSFQTKNLRKVERELKRRGWGISAHRGYIRIVFMPHVTKEMVEEFLRDLREVLK

SEQ ID NO: 6440 - protein, 334 aa, Burkholderia vietnamiensis G4
MSSDEVSESRRKWMQGTTASLVASVAIPAVAQNAGATDVGDTAPHDPRTLYPHAPFPQQHQPWPGLAGRMTPRPDHGERSYRGSGRLDGRKALITGGDSGIGRAAAIAFAREGADVAIAYLPDEEPDAREVVQYIRSAGRKAVPLPVDIRTEAACGKLVEQAVAGLGGLDILVNNAARQQSHDSILDISTEQFDWTLRTNLYALFWITRAAIPHMPPGSAIVNTTSVNAYDPSANLLDYAMTKAAIANFTKGLAKQMIQRGIRVNGVAPGPFWTPLQVSGGQTEKNVETFGQQVPMGRPGQPAELASIYVELASSRASYVTGQIYGASGGAGQP

SEQ ID NO: 6441 - protein, 664 aa, Bacillus cereus E33L
MIQNINQLAVNTIRTLSIDAINAANSGHPGLPMGAAPMAYALWANHLNHNPNHPKWFNRDRFVLSAGHGSSLLYSLLHLAGYDVSIDDLKNFRKLNSKTPGHPEFGHTSGVEATTGPLGQGIANAVGMAMAEAHLAAKFNKDGHSIIDHNTYALVGDGDLMEGVAYEAMSMAGHMKLGKLIVLYDSNEISLDGELNIAFSEDMQKRVESAHWQYIRVEDGNDVDAITKAIQLAKDNADQPTLIEIRTIIGYGSPKVAGTNKAHGNPLGLEEATATKQVYGWHYEEDFFVPEEVTAHFNELKQKGIEKENGWNEQFNLYRESNPALADELEKAITGEVLIEAKDILSFDTEKTISTRVASGEAINHYVKSIPSIFGGSADLSHSTMTDIKGEAVYAVESYAGRNIYFGVREHAMGAAANGLALHGGVKPFVSTFFVFNDYLRPSIRLAALQKLPVTYVFTHDSIAVGEDGPTHEPIEHLAALRAIPGLTVIRPSDANETASAWAYALQQTDGPVVLVLSRQNLPVFNETKANIENLSKGAYVLTQTNENPDVILIATGSEVSLAASAKAKLEEDNVSVRIVAMPSWELFDHQSKEYKESVLPSSVTKRVSLEMGVSLGWERYVGQEGNILSIETFGASGTGAEVMNLFGFTTENVVQITKNVLNS

SEQ ID NO: 6442 - protein, 457 aa, marine gamma proteobacterium HTCC2080
MSYSNHFVPPHPKPLPALPALARVLWHGDGNLLELMPGEAYRFDFGNLGYSRRSTVLFNQPELVREILRDDGSRFPKSDLMVNALEPLIGQSIFVTDGARWKRQRGMIDPAFSQLRVSHAFDAMQSAVLDHLDVLDGHADSGDSFSLDMAMSHLTADVICRTIFSTPLAAGVSSDVFEDFTEFEQSVAQVDIFRLIFQKAWAKMPQPPGVLAACQRIRGHLGDLVDPHLENPGAFNDIASDVIAAKDSDTGEAFTREELIDQLGVFFLAGHETSASALTWVFYLLAEQPTLVLRLRNELEHVVGSGPINFNHVKQLPLVRAVFRETLRLYPPITFIPRVALEDCQIGPRKLRRGALVMVSPWTIHRHQRYWSDPDAFIPDRFLVEGESSIQEGAYIPFGVGPHTCIGAGFAQAEAVLIIAELVRRFDFSRADRQSVRPAARLTTRPAQQIKLHCRRL

SEQ ID NO: 6443 - protein, 164 aa, Oryza sativa
ARGLVPNSAAVVLFSLAVAAAAPLIDAQAVLPRRLFPAPLVGLHRWYATEFGDYLAAEPPGFFRGLVWLELLLHWPLSVATLYGVLARRPWAGATALAAGVSVVTAMSAVLGEFLVSGRATHKLLQMYVPFAVLAVIAALRGLVVWSSQGTGLAPAPSSQKKRP

SEQ ID NO: 6444 - protein, 687 aa, Magnaporthe grisea 70-15
MGYSEVDKKAINTIRVLAADATFNANSGHPGAPMGMAPVAHVLWDKIMKFNPKNPSWLNRDRFVLSNGHGCMLQYALLHLFGYAVSMDDLKKFRQVDSITPGHPEAHDTPGIEVTTGPLGQGICNAVGLAMAQAHTAATFNKDGFNLIDNYTYCFLGDGCLMEGVSSEACSLAGHLQLGNLIAIWDDNHISIDGDTNQAFTEDVAKRYESYGWHVEVVKDGDNDLEGIEAAIKKCQQVKDKPSLIQLRTIIGFGSTQQGTHGVHGSPLKADDLKQLKEKFGFNPDESFAVPQEVYDLYNKKAAEGAALEQEWDQLFAKYGEQYKAEHDDLVRRQTGELPQGWEKNLPTYTPSDPAIASRKLSETVLTKIEAAIPELVGGSADLTGSNLTRWKGAVDFQPPALKLGDSNYAGRYIRYGVREHGMGAIMNGLAAYGTILPFAGTFLNFVSYAAGAVRLSALSQVRMIWVATHDSIGLGEDGPTHQPIETLAHFRALPNCMVWRPADGNETSAAYYVALTSKHTPSIIALSRQNLPQLAGSTIEKAIKGGYVAHEVEGAQVTLVSTGSEVGICIDAVKYLADNHNIKARVVSMPCFEVFDTQSKEYRLSVLPDGIPSMSVEVMSTMGWERYTHEQFGLNRFGASGPYKDVYKKFEFTPEGIAKRAAATVDFWKDVPNVRSPINRAFQQII

SEQ ID NO: 6445 - protein, 516 aa, Arabidopsis thaliana
MTNLFLGFLVISFCLLGNLIHAADGSIHDYNNSGGFTKIANARYFVGGSEGIYGSEFLDVHHASSDTPLLKGNSFIRFDDITFVRTKESASKQNSTLAAAGLVEAILFEVKQRDRVGGSFFKSEDMCCTPKLADAGSCNLGEVMISADPNDPEWPKRIPTFFKRGEEEVKMSPEAVIIKKTGLYTVYFMTCDPELDGATIRGRTVWKNRGGYLQGEKAPLKKFYASMLLAYVVLGLVWFPQVAQYWKDGIQLHSHINFVIAFTMGELAFLYLDFVYLDSAGTSPMEVTVWAITLSSMRKALSRLLLLVISSGFGIVRPTLGGITLKMLLIGVLCFVISESLGLAMQFGNISENGMNYLMLSWAILETCFIQWIFRSLSKTLKKLKLNKRNITKLQLYKMFATVLVIMVVLSFAWIYVEVYLYSSLSQFWKVKWIVPTLWYILSYAMLVLICLFWPPSEKPMRYLYVADMEEETEEEDDLSTAETGMNATKAEYERSERKTLLEAFILLLGNIPGEK

SEQ ID NO: 6446 - protein, 126 aa, Pseudomonas putida KT2440
MSKTVINSDKAPAAIGTYSQAIKAGNTVYMSGQIPLDPKTMELVEGFEAQTVQVFENLKAVAEAAGGSFKDIVKLNIFLTDLSHFAKVNEVMGRYFEQPYPARAAIGVAALPKGAQVEMDAILVIE

SEQ ID NO: 6447 - protein, 260 aa, Mycobacterium sp. JLS
MTAGDRRVAIVTAAAAGIGKAIALRWCREGGCCVMADTDGEGLDAAVHELAESGAAVCGVAGDVCLSDVANSVVERALTEFGRLDTLFNVVGGSLARNVEEISEEQWRSQIDLNLGSVFQMSKPVIPLLRQGGGGSIVNVASTAGILAENRCSAYSASKGGVVLLTKNMALDFARDNIRVNAIAPGGTRTPRIERFLAEHPEHASMMVDLCAMQRFAGPEEIAAPAVFLASPEASYITGAVLPVDGGMTAGVTFRAFEAV

SEQ ID NO: 6448 - protein, 486 aa, Mycobacterium sp. JLS
MINANLIIDGREETSDRTIDVVSPADIRVLLGSVPDAAPGQVDEAVAAAAMAFPEWSSRPLEERQGALLAAAGTIHDMIEEYAPILSRENGKILEESHVDLEFASGICGYTAGISAEILADQQIRDTGGTTLIRRRPIGPVAAITPWNFPVVLAFMKLAPALVAGNTVVLKPAANSPLVLAEVVRALQQHFPPGVLNMVTGGDAVGEALVAHPRIRKIGFTGGIDTGRKVMAAAARDIKRVTLELGGNDPAILLDDVDLSPETMRQIVKGAFGTTGQVCFGLKRIYVPTRIHDRFVEAFSAAVDEIVVGPGDDPRVTMGPLNNAQQKNLVEKIVDDARSSGATVTTLGQRLDSAAWDHGHFMMPSVVTAADPRLAIVEEEQFGPVVPVLKYDELDDVIRLVNQSQYGLAASIWTSDEERAFLLGRRFDTGSVFINSHTFTSLDPRAPFGGAKASGLGREFSPASLDSYTELQTISRRIGPPGPPLS

SEQ ID NO: 6449 - protein, 398 aa, Nephroselmis olivacea
MAIEHASSIKKVKNFTLNFGPQHPAAHGVLRLVLELNGEVVARADPHIGLLHRGTEKLIEYKTYTQALPYFDRLDYVSMMCQEHAYSLAVEKLLHCEVPERAQYIRVLFSEITRILNHLLALTTHAMDVGALTPFLWAFEEREKLIEFYERVSGSRMHAAYIRPGGVACDLPANLCEDIYLFCQQFASRIDEMEEMLTNNRIWKQRLVDIGIVTAENAFAWGFSGVLLRGSGVAWDLRKTQPYDVYNRMIFDVPVGTQGDCYDRYLCRVEEMRQSIHIIMQCLNQLPKGMIKADDKKITPPSRSQMKQSMESLIHHFKLFTEGYTVPNSETYTSVEAPKGEFGVYLVSNGTNRPYRCKIRAPGFLHLQGLDMMSKNHMLADVVTIIGTQDIVFGEVDR

SEQ ID NO: 6450 - protein, 549 aa, Azoarcus sp. EbN1
MNFEPVLLADRMDAMKAAGLWRDETIDVHFQRALENCPDKPAVVAYRDGHPEPVRLSYRELDCRVDRIARGLAALGVGRGDVVSFQLPNRWEFVALALACARIGAAANPVMPIFRQHELTYMLNFAESKVFIVPSVFRKFDHAAMARELQSKAPHLRQVVVIDGDGDDSFDRVLMRDDTPPLAGPALGPDDVALLMYTSGTTGEPKGVMHTSNTLFSNLHAYIERMELGGGDVILGASPMAHLTGYGYLAMLPLILNSTTVLQETWNAARALEIVRETGVTFSMASAAFISDLCTAVEAGAPVSSQFTKFNCAGAPIPPIVIQRAWELMGLLVCSAWGMTECGAVTVTEPARALEKSGVSDGRPVPGIEVKIIDANGAKLSQGETGSLLIRGASLFAGYLKRPHLNSVDAEGWFDTGDLAFQDAEGYIRINGRNKDIVIRGGENIPVIEIENLLYQHPSITTVAVVGYPDRRLGERICAFVSLKPGCTLTFADLTAYLDRQQVAKQYYPERLEIVDDLPRTPAGKLQKFKLRETAKTFGDTANPAPEKS

SEQ ID NO: 6451 - protein, 495 aa, Arabidopsis thaliana
MVRKRETNPGVRVVGKRIYDSQNGKSCHQCRQKTLDFAAPCKAMRRKKLCPIKFCYKCLSIRYGENAEEVAKLDDWICPLCRGICICSVCRKAQGLEPTGILAHEAKARGYSSVYALLEAEGHDKFAYQKKPELVSACNEGSSSNSESVPGTEVGILDVPKEKKKVVDKRKRAKPSDKLKEEIQLEAQLPEGISLTCVSRIDIPTEEAGNVCQLFEFCSAFGKALALKEGHAETIVRELFICGRNTRRQQYCSITQMMIQLLDLISKDREMSLSLSATDSSWFTAIGEILSKSEVLSDELPLETFVGGVAAYEKMNASRKLKLLNFLCDESLSTWAMRNYINSQTEECGERKKEAKQKAAAAKQKEKQLKQKMQGEVAKSIMEKNGAPLSIEEHNSIVSQIRDEAKEAHEEMMEAKGMKSKMTLICDARRTEPIMLDDNGFVLWKLKCFEEEQFFLLQDLGTFDDLCPHERWLAFKPEQKPEIENISLVRGKSFL

SEQ ID NO: 6452 - protein, 680 aa, Oryza sativa (indica cultivar-group)
MATRVLLSSKVILALVLASLFSLPRHGRALELMNWSCNNGSAYAANTTYDTNVHSILATLTARTPNTTTGFATATTGRGTDTEAWGLALCRGDTDRVGCASCLAAVPAVAFNECRGDMDVTVFYDRSLARFSYVDFTARPDNTEVLIGSPSADRITADAGHFDALVADLAGALADWAAYNSTLRYAAGVMTSGDGFMSTTEDMVHNIYGVVQCTPDQAAAACRACLEALRVDMPKVFAGKMGGMFNAVWCNLRYETFVFFDGDPSVKLVAPPVVPEDGKRRSSPENAAAVVGAVLGALVILLSLFIIYLWKKLQAKQYAADKDVDSGSLLFDLAIIRKATANFAEHNKLGHGGFGAVYKGFLPDVGEIAVKRLDRTSGQGLEQLRNELLLVAKLRHNNLAKLLGVCIKGDEKLLVYEFLPNRSLDTILFADPQKREQLSWETRYQIIHGTARGLLYLHEDSQIKIIHRDLKASNVLLDSNMNPKISDFGLARLFSGTKTTSITSQVVGTLGYMAPEYAVLGHLSVKVDVYSFGILVLEIVTGRRNTDVFDADEESSNLLSYVRPIDQLFYDFLKVWDHWQKGIPLEITDTLLLLSGSRGLQDMELLKCVHIGLLCVQENPADRPTMLSVLVMLQDIDTTNFAAPSKPAFTFANVRNTTSSSPSAAALSANEVSISEFHPR

SEQ ID NO: 6453 - protein, 670 aa, Oryza sativa (indica cultivar-group)
  misc_feature (537)..(537): Xaa can be any naturally occurring amino acid
MAALMVLWPTLLPLVLLANLLPLPRHGRALELMNWSCNNGSSYAANTTYHSNVRVVLTALSAITPNSTARFATASAGRGGADAVWGLALCRGDTDRAGCASCLAAVPAVAFGECRGDRDVAVFYDRCLARFSYADFTARPDNMEVQIGSPSENRVTVDAGRFDALVARLAGALADWAAYNSTRRYAAGLMASGDGFTSTTEDMVHNIYGVVQCTPDQAAAACRACLEALRVDMPKVFAGRIGGRFDAVWCNLRYETFLFYDGDPTVRLAASSSPGSSSSPLPSPSPSPSLPPLEGKRRNRPKNAAIVVVSVLASLVVLLSLLSFYLWRKLQAKQYTDENDIYSGSLLFDLATLRKATASFAEHNKLGHGGFGAVYKGFLPDGREIAVKRLDKTSGQGLEQLRNELLFVAKLRHNNLAKLLGVCIKGEEKLLIYEYLPNRSLDTFLFDPEKRGLLNWETRYQIIHGIARGLLYLHEDSQTKIIHRDLKASNVLLDANMNPKISDFGLARLFDGTKTASITNHVVGTLIYGARVCSVLXHVSVKLDVYSFGILVLEIVTGRRNLMCRVWDHWVKGTPLEIADASLLGGGRGLSDMELLKCVHFGLLCVQENPVDRPTMLDILVMLHDVDTNSFVAPSKPAFTFAHGGNTTSSSQGVATLSTNEVSISEFVPR

SEQ ID NO: 6454 - protein, 154 aa, Triticum aestivum
ATVCEYAGEILTHTELHERAIQNMQNARYTHPILLDAGWCSGGEPKDEEALCLDGTFYGNVGRFINHRCCDANLAMIPVEVETPDHQYYHVAFFTSKKVEAFEELTWDYGIDFDDERQPMKAFECLCGSRYCRGGRRHLLRKERRRSRVTGTAG

SEQ ID NO: 6455 - protein, 300 aa, Oryza sativa (japonica cultivar-group)
MTTARFVSPSLSRVSPSPAGRVSGSSWLSRAGVALPARPHGLSLHLRPPAMASAAAAGNGSPSAPEDSTALSRIGEVKRVTKETNVHVKINLDGTGVADCSTGIPFLDHMLDQLASHGLFDVCVKAKGDTHIDDHHSNEDIALAIGTALLEALGDRKGINRFGHFTAPLDEAAVEVILDLSGRPHLSCGLSIPTERVGTYDTQLVEHFFQSLVNTSGMTLHIRQLAGKNSHHIIEATFKAFARALRQATEYDLRRRGTVPSSKDCNIQRKQMEWPLQLLESYLPWESPLVAITEHEAIAN

SEQ ID NO: 6456 - protein, 216 aa, Idiomarina loihiensis L2TR
MADIKHLIANNKEWAEQQVKNDPDFFKRLVGQQSPQYLWIGCSDSRVPANEIVGMAPGELFVHRNVANQVIQTDFNCLSVIQFAIEALKVRHILVVGHYGCGGVKAALESKPHGLVDHWLYPIRDVYREHAEELEQLGETEQIDRLCELNVIEQVKNLAKTNMVQEAWDKGESLTIHGWVYRLDNGLVNDMNVSVSSREGMEQVYHVYHQKLPKGG

SEQ ID NO: 6457 - protein, 457 aa, Mortierella alpina
MAAAPSVRTFTRAEILNAEALNEGKKDAEAPFLMIIDNKVYDVREFVPDHPGGSVILTHVGKDGTDVFDTFHPEAAWETLANFYVGDIDESDRAIKNDDFAAEVRKLRTLFQSLGYYDSSKAYYAFKVSFNLCIWGLSTFIVAKWGQTSTLANVLSAALLGLFWQQCGWLAHDFLHHQVFQDRFWGDLFGAFLGGVCQGFSSSWWKDKHNTHHAAPNVHGEDPDIDTHPLLTWSEHALEMFSDVPDEELTRMWSRFMVLNQTWFYFPILSFARLSWCLQSIMFVLPNGQAHKPSGARVPISLVEQLSLAMHWTWYLATMFLFIKDPVNMIVYFLVSQAVCGNLLAIVFSLNHNGMPVISKEEAVDMDFFTKQIITGRDVHPGLFANWFTGGLNYQIEHHLFPSMPRHNFSKIQPAVETLCKKYGVRYHTTGMIEGTAEVFSRLNEVSKAASKMGKAQ

SEQ ID NO: 6458 - protein, 372 aa, Idiomarina loihiensis L2TR
METIKSRAMVAWGPGEPLKEEIIDVAPPKKGEVRVRIIATGVCHTDAYTLSGKDPEGIFPSVLGHEGGGIVESVGEGVTSVEVGDHVIPLYTAECGECKFCTSGKTNLCQAVRATQGKGLMPDGTSRFSKDGETIYHYMGTSTFSEYTVLPEISLAKIPKDAPLEKVCLLGCGVTTGMGAVKNTAKVQEGDTVAVFGLGGIGLAVIIGAVQAKASRIIAIDVNDDKQTIAKELGATDFVNPTKYDKPIQEVIVDMTDGGVDFSFECIGNVDVMRAALECCHKGWGESVIIGVAGAGEEISTRPFQLVTGRVWRGSAFGGVKGRTELPDYVKQYMDGKFDLDTFITHTMPLEEINEAFDLMHEGKSIRSVIHY

SEQ ID NO: 6459 - protein, 462 aa, Gloeobacter violaceus PCC 7421
MTRITPNSSFSLTLRLHLPNQPGMLAKATAAIGEAGGNIGDIELIEQERAYTVRDLIVDATSEEHAHAIAERVSAIPELKLLQVDDRTFQIHQGGKIQIVSKIPLRTRSDLAMAYTPGVGRICMAIARNPERVYELTIKRNTVAVLTDGSAVLGLGDIGPAGALPVMEGKALLFKEFANIDAFPVCLSTQNVDEIVETAVRISTVFGGINLEDISAPRCFEVERLLQERLDIPVFHDDQHGTAIVVLAALENALKLVDKSLASVRIVINGAGAAGIAIHQLLTAAGARAIVMCDSHGIVSAGRADLNAEKRAVAVEQTGALADAMAGADVFLGVSKGGVLSRAMVQSMATDPVVFAMANPVPEILPEEAEGVVAVMATGRSDYPNQINNVLAFPGIFRGALDCRARRVNLEMKMAAARAIAALVSPDEIAPESIIPSVFDRRVVVAVSAAVQQAARATGVAR

SEQ ID NO: 6460 - protein, 398 aa, Ralstonia eutropha JMP134
MTSVLRLSDLISQGKISGKRVFIRADMNVPQDDAGNITEDTRIRASVPAIEACLAAGAAVMVTSHLGRPTEGEFKPADSLAPIATRLSELLGKPVKLVQNWVDGVEVAPGQVVLLENCRVNKGEKKNSDELAQKMAKLCDVYVNDAFGTAHRAEATTHGIAKYAPIACAGPLLAAEIDALGKALGQPARPLVAIVAGSKVSTKLTILKSLADKVDNLIVGGGIANTFMLAAGLKIGKSLAEADLVADAKTIIDIMAKRGASVPIPVDVVCAKAFSATAAATVKDVKDVADDDMILDIGPKTAAQLADQLKAAGTIVWNGPVGVFEFDQFGNGTKVLAEAIADSKAFSIAGGGDTLAAIAKYGIADRVGYISTGGGAFLEFLEGKKLPAFEVLEQRAAG

SEQ ID NO: 6461 - protein, 350 aa, Medicago truncatula
MSSQHSIPTVDRVSVLPDSVICHILSFLPTKESAATSILSKRWNPLWLSVLTLDFDDQNFTEFSTFRHFVYSVIALRNITLQTIQSFRLKCGNSSGFNPHDVKRFIHAIFQRGIQNLNLEMSPFKLGFKLPHCVFSCSNLTALKLKGLAIDYSCDFNFPLLKTLHLYTISFGRDRDCFLRLLKGCPILEDLETKDLLLHSSNSTGMYYFIQKYELSTFLNLTHMKIVFELTHNWPGKWKWLTKVLQHCPKLQNLTIHEGSSDRNKIEDVDWMDTPIVPECFSSQLKTCSLIGYKGMNCDFQFAKYILKNAKVLQTMTINASPVDINIKHQILIKLTLCPRGSTTCKISFD

SEQ ID NO: 6462 - protein, 340 aa, Triticum aestivum
  misc_feature (80)..(80): Xaa can be any naturally occurring amino acid
  misc_feature (89)..(89): Xaa can be any naturally occurring amino acid
  misc_feature (106)..(106): Xaa can be any naturally occurring amino acid
  misc_feature (114)..(114): Xaa can be any naturally occurring amino acid
  misc_feature (136)..(136): Xaa can be any naturally occurring amino acid
  misc_feature (146)..(146): Xaa can be any naturally occurring amino acid
  misc_feature (155)..(155): Xaa can be any naturally occurring amino acid
  misc_feature (176)..(176): Xaa can be any naturally occurring amino acid
  misc_feature (187)..(187): Xaa can be any naturally occurring amino acid
  misc_feature (210)..(210): Xaa can be any naturally occurring amino acid
  misc_feature (238)..(238): Xaa can be any naturally occurring amino acid
  misc_feature (244)..(244): Xaa can be any naturally occurring amino acid
MAASLQAAATLMPAKIGGRASSARPSSHVARAFGVDAGARITCSLQSDIREVASKCADAAKMAGFALATSALLVSGASAXRGAPKRLTXDEIQSKTYMEVKGTGTXANQCPTIXDGGVRLLPLQGPAKYEMKKFCXLEPTSFTVKXAEGIQKNEXPPAFQKTKLMTRLTYTLDEMXEGPLEVGARRXTLKFEEKDGIDYAAVTVQLPGGXERVPFLFTVKQLVATGKPEKLSRGPFLXPSYRGXSSFLDPKGRGGSTGYDNAVALPAGGRGDEEELAKENVKNASSSTGNITLSVTKSKPETGEVIGVFESVQPSDTDLGAKAPKDVKIQGVWYAQLESN

SEQ ID NO: 6463 - protein, 530 aa, Zea mays
  misc_feature (27)..(27): Xaa can be any naturally occurring amino acid
  misc_feature (274)..(274): Xaa can be any naturally occurring amino acid
PRVAAGLLPGLSYISAAGKLSSDPFTXMGSSSSHQRSKTRSRNRKPLGIQLLERVRGSPISFRSCQALVLVLTFLSYASYHATRKTTSVVKSVLDPKTKTNLGTSSAHYWPPSHLFYLHNLKGADNNSSSGGGWAPFNAAEDGTALLGEIDLAFLGAYAAGMFFAGHLGDRVDLRVLLTVGMVGTGLFTAAFGAGYWLDVHSFYYFLAVQMVAGLFQSSGWPSVVAVVGNWFGKSKRGLIMGVWNAHTSVGNISGSLIAAAMLRRRISVWRTMXKKPSDMDAPLLERERRRADVEEKAVGFIEAWRIPGVAPFALCLFFCKLVAYTFLYWLPFYISHTAIGGEYLSDSAAGVLSTLFDVGGVVGGILAGHISDHLDARALTAASFTFSAIPALFFYRVYGNVSLAWNIALMFVTGMLVNGPYALITTAVSADLGTHSSLNGNSRALATVTAIIDGTGSIGAAVGPLLTGYISARSWSAVFTMLMASALVAGLLLSRLVAAEVVAKMESRRTPAPAASDLLPVSSSSMDEP

SEQ ID NO: 6464 - protein, 1015 aa, Rhodococcus sp. RHA1
MSCTASSSPRTADTAPIPRPQRWSIPLLEQTTTSVDPGRAGSVRVIREGVASYLPDIDPDETTEWLESFDGLLDRSGPTRARYLMLRMLERAGEKHVALPALTSTDYVNTIPTENEPWFPGDEETERRYRAFIRWNAAVMVTRAQRPGVGVGGHISTYASSAALYEVGFNHFFRGKDHPGGGDQIFIQGHASPGIYARAFLEGRIPAERMDGFRQEHSHADQGGGLPSYPHPRLLPDFWEFPTVSMGLGPMNAIYQARFNHYLHDRGIKDTADQHVWAFLGDGEMDEPESRGLAHVAATEGLDNLTFVVNCNLQRLDGPVRGNGKIIQELESFFRGAGWNVIKVVWGREWDALLHADRDGALVNLMNVTPDGDYQTYKANDGGYVREHFFGRDPRTKELVANLSDQDIWNLKRGGHDYRKIYAAYAAAMAHKGQPTVILAHTIKGYTLGKHFEGRNATHQMKKLTLDDLKNFRDLQRIPISDAELEKDPKMPPYYHPGPDAPEIQYMLDRRRALGGFLPQRRTSPAPLPMPPDSTYDVVRKGSGKQQVATTMALVRIMKELLRDKEIGKRIVPIIPDEARTFGMDSWFPSLKIYNRNGQLYTAVDADLMLAYKESEIGQILHEGINEAGSTASFTAVGTSYATHGEPMIPLYIFYSMFGFQRTGDGLWAAADQMARGFVLGATAGRTTLTGEGLQHADGHSLLLASTNPAAVAYDPAFSYEIAHIVKDGLRRMYGGTPAADGTLKPGFGGEDIFYYITLYNEPYSQPAEPADLNVEGLLKGMYLFKKSQASGDSASNNGHSAGSAPQHGHSAGSAPQHGHSAGSAPQHAHSAGSAPQHAHSAGSAPRAQILVSGVTMPEGLRAQELLADEWGVAADVWSVTSWGELRRDGIESERQALRDPGTDAPLPYVTQALSDAAGPFVAASDWMRAVADRIRQWVPGSYTTLGTDGFGFSDTRPAARRYFNVDAESIVVAVLSALAGEGTLDRSKAVEAANRYRIDDVRAAAVSYADTGSA

SEQ ID NO: 6465 - protein, 197 aa, Oryza sativa (japonica cultivar-group)
MCLPLWLVLPSASLRGLVPRVDFDMSSVASSGWIRVLQSGKVQKIMGKLWTILTHVHSLAGPTVMLLYPLYASVQAMESPSKLDDEQWLAYWILYSFITLVEMLLESLIYWIPIWYELKLLFIAWLALPNFRGAAFIYNRFVREQLRKHGLAGAGAGAAASVGKKDKSSPSSSPKDKEKTKSKFLSFVTPKKDHEAY

SEQ ID NO: 6466 - protein, 395 aa, Streptococcus pneumoniae TIGR4
MKLSNRVLEMEESVTLAAGARAKALKAEGRDILSLTLGEPDFTTPKNIQDAAIASIRDGRASFYTVTSGLPELKAAVNSYFERFYGYSVASNQVTVAAGAKYSLYTFFMAVVNPGDEVIIPTPYWVSYGDQVKMAEGVPVFVSAKEDNHFKVTVEQLEAARTDKTKVLVLNSPSNPTGMIYTREELLAIGNWAVENDILILADDIYGRLVYNGHEFTPISSLSEAIRKQTVVINGVSKTYAMTGWRIGYAVGEADIIAAMSKIAGQTTSNPSAVAQYAAVEALSGEQDTVESMRQAFEERLNTIYPLLAEVPGFEVVKPQGAFYLFPNVKKAMEMKGYTDVTDFTTVILEEAEVALVTGAGFGAPENVRLSYATDLDTLKEAVERLKAFMGSEND

SEQ ID NO: 6467 - protein, 456 aa, Pyrococcus abyssi GE5
MGKLFGTFGVRGIANEKITPEFTLKIGMAFGTLLKREGREKPLVVVGRDTRVSGEMLKEALISGLLSVGCDVIDVGIAPTPAIQWATKYFNADGGAVITASHNPPEYNGIKLLEPNGMGLKKEREAIVEELFFKEEFDRAKWYEIGEVRKEDIIKPYIEAIKSKVDVEAIKKRKPFVVVDTANGAGSLTLPYLLRELGCKVVTVNAQPDGHFPGRNPEPNEENLKEFIEIVKSLGADFGVAQDGDADRAVFIDEKGRFIQGDKTFALVADAVLRERGGGLLVTTVATSNLLDDIAKRNNAKVMRTKVGDLIVARTLFEHNGTIGGEENGGVIFPDHVLGRDGAMTVAKIVEIFAKSGKKFSELIDELPKYYQIKTKRHVEGDRHGIVNKVAEIARGRGYNVDTTDGAKIIFEDGWVLVRASGTEPIIRIFSEAKSEEKAKEYLNLGLGLLDEVLSS

SEQ ID NO: 6468 - protein, 561 aa, Burkholderia xenovorans LB400
MELAMNISPLAGKRLPDAMLVNVPRLVTAYYTDKPDAAIPAHRVAFGTSGHRGSAFARSFNEWHVLAITQAICYYRKQQAIDGPLFIGIDTHALSEPAYASALEVLAANGVEVMIAQNGEYTPTPAVSHAILAYNRGRSAGLADGIVMTPSHNPPESGGFKYNPPNGGPADETVTGWIERAANGLLESRLDGVLRICLSKALRATTTHRHDFLNAYVGDLVNVLDMDVVRGAPIRLGVDPLGGAGVHYWGPIAERYNLNLSVVNDEVDPTFRFVSVDWDGRIRMDPSSPYAMQTLIDQKDRFDVAFACDTDHDRHGIVTRHAGLLPPNHYLAVLVHYLYANRPQWRAHVAVGKTIVSSQMIDRVTEKLGRTLYEVPVGFKWFVDGLLDGSLGFAGEESAGASCLRLDGTAWSTDKDGIVPALLAAEMTTRTGRDPAEIYRDLTQRLGEPVERRVQAAATAPQRALLARLSPAQFPHTELAGEKIEQVLDRAPGNGAAIGGIKVVTKSGWFAARPSGTEDVYKIYAESFRGEAHLTRIVGEAQAMVDSVFEAQVATDDGARP

SEQ ID NO: 6469 - protein, 653 aa, Pyrococcus abyssi GE5
MNITSFINRLKELVEIEREAEIEAMRLEMRRLSGIERERLGRAILNLNGKIIGEELGYFLVKYGRNREIKTEISVGDLVVISKRDPLKSDLLGTVVEKGKRFIVVALETVPEWALRDVRIDLYANDITFRRWLENLNTIKKAGKRALRFYLGLDEPSQGEEVNFVPFDKSLNRSQRKAISKALGSEDFFLVHGPFGTGKTRTLVELIRQEVKRGNKVLATAESNVAVDNLVERLSRSGIKIVRIGHPSRVSKHLHETTLAYLITQHELYGELRELRVIGQSLAEKRDTYTKPTPKFRRGLSDEEIIKLAERKRGARGLSARLIMEMAEWIKLNRQVQKAFDDARKLEERIARDIIREADVVLTTNSSAALEVVDYDTYDVAIIDEATQSTIPSILIPLNKVERFVLAGDHKQLPPTILSLEAQELSRTLFEGLIERYPWKSEMLVVQYRMNERIMEFPSKEFYGGKIIADESVRGITLRDLVEYQSPNDSWGKILNPENVIVFIDTSKAENKWERQRRGSESRENPLEAEIVAKIVDKLLSIGVKPEWIGVITPYDDQRDLISMKVPEDVEVKTVDGYQGREKEVIILSLVRSNKLGEIGFLKDLRRLNVSLTRAKRKLIVVGDSSTLSSHETYKKMIEFFKEKGCFIEFPFS

SEQ ID NO: 6470 - protein, 467 aa, Candida glabrata CBS 138
MASLFRPPESTRQNARSPRLKLPPLSNVSLAVPGESPTGKLSATSSRGSSATSANMKRPMPPPLPKLDVPLSAASSTEGLVRKMKQLSVEDESPQSGSSRGVERDDTTAVNQSVDSFFSNLISVYDQSSSAITSPKIDEPEDSAVKDALATRVPRSLTQGKDIDELSEEVWHSKNLLAEIETQGVLGEGAGGSVAKCKLRTGKKVFALKTINILNGDPEFQKQLLRELQFNKSFKSEYIVRYFGMFTDEQNSSIYIAMEYMGGKSLEAIYKELLSRGGRISEKVLGKISEAVLRGLSYLHEKKVIHRDIKPQNILLNEDGQVKLCDFGVSGEAVNSLATTFTGTSYYMAPERIQGQPYSVTCDVWSLGLTILEVAQGHFPFGPDKMATTIAPIELLTLILTFTPHLDDEPDKNIKWSRAFKSFIEYCLRKEARARPSPRQMIQHPWIQGQMKKQVDMRKFITKCWQK

SEQ ID NO: 6471 - protein, 379 aa, Brassica napus
MATQGQVITCKAAVAYEPNKPLVIEDVQVAPPQAGEVRIKILFTALCHTDAYTWSGKDPEGLFPCILGHEAAGIVESVGEGVTEVQPGDHVIPCYQAECRECKFCKSGKTNLCGKVRSATGVGVMMNDRKSRFSVNGKPIYHFMGTSTFSQYTVVHDVSVAKIDPQAPLEKVCLLGCGVPTGLGAVWNTAKVEPGSNVAIFGLGTVGLAVAEGAKTAGATRIIGIDIDSKKYETAKKFGVNEFVNPKDHQKPIQEVIVDLTDGGVDYSFECIGNVSVMRAALECCHKGWGTSVIVGVAASGQEISTRPFQLVTGRVWKGTAFGGFKSRTQVPWLVEKYMNKEIKVDEYITHNMTLGEINKAFDLLHEGTCLRCVLSTSD

SEQ ID NO: 6472 - protein, 465 aa, Rhodococcus sp. RHA1
MPNPSPGYSITVRVTAPVGAGTTSTLAGAVASVKGAMTALDVVESHPDHMVIDVTCDASDVEHAEQIASAIADVPGVVVGKVSDRTFLLHLGGKLEVVPKVPLKHRDDLSRAYTPGVARVCTAIAENPEDVRRLTIKRNTVAVVTDGSAVLGLGNIGAAASIPVMEGKAALFKQFADVDAWPVCLDTQDTDAIVEIVRALAPVYGGINLEDISAPRCFEIEARLRDMLDIPVFHDDQHGTAIVVLAALTNALRVVEKSLDTVKIVVSGVGAAGHAIIRLLVAQGATNIVACGRNGILSPDDTSDSFRSWIANNTNPEARSGSLRDAVVGADVFIGVSAPDILTGDDIETMGPDSIVFALANPVPEVDPVAAGRHAAVVATGRSDFPNQINNVLAFPGVVRGLLDAHAVEITDDMLIAAARAISDSVSPSELNPTYIVPSVFDAAVAPAVAAAVRSVADAGGEHDV

SEQ ID NO: 6473 - protein, 218 aa, Pseudomonas putida GB-1
MLTALLFDLDGTLTDTDTLHLQAFRQLLREHDGRELSQAQFDAQVSGRANGELFAELFNGASVEQCQALADRKEALFRDLSPSLEPMPGLLRLLEHAQAHAIGMCVVTNAPRLNAEHMLNAMGLGQRFEHVLVAEELARPKPDPLPYLTGLQQLGAEARQALAFEDSLPGVTAASGAGIFTVGVATTQTAERLLAAGAQLVIDDFNDPALWALIESMQ

SEQ ID NO: 6474 - protein, 399 aa, Mesostigma viride
MAIEYSVKPKKVKNFQLNFGPQHPAAHGVLRLVLEMNGEVVERADPHIGLLHRGTEKLIEYKTYLQALPYFDRLDYVSMMAQEHAYSLAVEKLLGIRSVPLRAQYIRVLFSEITRLLNHLLALTTHAMDVGALTPFLWAFEEREKLLEFYERVSGARMHAAYIRPGGVAQDIPQGLCDDIYQFTQQFASRIDEMEEMLTNNRIWKERLIDIGVVTAEKAMQWGFTGVMLRGSGIPWDLRKAEPYEVYDQLEFDIPVGTKGDCYDRYLVRVEEMRQSLRIIVQCLNKMPLGIVQIDDRKIMPPSRFSMKHSMESLIHHFKNFTEGFSVPAGETYTAIEAPKGEFGVYLVSDGTNRPYRCKIRAPGFVHLQGLDMMSKKHMLADVVTIIGTQDIVFGEVDR

SEQ ID NO: 6475 - protein, 624 aa, Oryza sativa (japonica cultivar-group)
MASISGAAALRPRRRRAGCGCGGTPPPPLPPPPPRPPLHRGPLPLLLVLVGAAALLYPGGAARLQAGAERQHPRRVEKDPIKLWERYVEWLYQHKELGLFVDVSRMGFTEEFLRRMEPRMQRAFAAMRELEKGAIANPDEGRMVGHYWLRDPGLAPNSFLRTKIETTLDRILAFSQDVVSGKIKPPSSPAGRFTQILSIGIGGSALGPQFVSEALAPDNPPLKIRFIDNTDPAGIDHQIAQLGPELASTLVIVISKSGGTPETRNGLLEVQKAFRDAGLDFSKQGVAVTQENSLLDNTARIEGWLARFPMFDWVGGRTSEMSAVGLLPAALQGIDIKEMLVGAALMDEETRNTVVKENPAALLALCWYWASEGIGNKDMVVLPYKDSLLLLSRYLQQLVMESLGKEFDLDGNRVNQGLTVYGNKGSTDQHAYIQQLREGVHNFFVTFIEVLRDRPPGHDWELEPGVTCGDYLFGMLQGTRSALYSNDRESISVTVQEVTPRAVGALVALYERAVGIYASLVNINAYHQPGVEAGKKAAGEVLALQKRVLTVLNEASCKDPAEPLTLDQIAERCHCPEDIEMIYKIIQHMAANDRALIAEGSCGSPRSIKVYLGECNVDEDMLAA

SEQ ID NO: 6476 - protein, 166 aa, Triticum aestivum
AYLGDVLSSVYKKAVSYRAGIPGISSTHASAFCGRLPSPAAANNPLAYKFSWSPAGAIRAGRNPAVYKFLGEIIDVDGSKLYESAKRLRLPELPAFALEHLSYRNSLMYGDLYGISKHPSTGYGSTLRYEGFSEIMAILAKIGFFDAENHPLLQETDPPTYKNFSS

SEQ ID NO: 6477 - protein, 104 aa, Brassica napus
  misc_feature (30)..(30): Xaa can be any naturally occurring amino acid
MSGRGKGGKGLGKGGAKRHRKVLRDNIQGXITKPAIRRLARRGGVKRISGLIYEETRGVLKIFLENVIRDAVTYTEHARRKTVTAMDVVYALKRQGRTLYGFGG

SEQ ID NO: 6478 - protein, 262 aa, Ralstonia solanacearum GMI1000
MSRIASPASSARAAPLPPIDPARTAFLLDFDGTLVDIAPQPEAVHVAPDLRATLAALQRASGGALAVISGRTVADLETRLDLPGLVIAGVHGAERRHADGSFHRLQTDSEALAALERELRAQLPSVPGVVLESKGIAFALHYRHLPQAADAVCALARRLADRYADHVRLQAGKMVVELKPRGASKGAVVGHLMRAAPFAGRIALFAGDDLTDESAFEAVNTLGGWSIKVGMGPSQAHWRVPDPAALRDWLAALARRAGGRAA

SEQ ID NO: 6479 - protein, 300 aa, Myxococcus xanthus DK 1622
MNTATLGHAEVSLNGKGTGEPRASTASLVPPEVGRLRFDAARTLWLWGMLIPGVTVGLAAATPTTVVVSLLLTFATLCLGHSVGLHRGVIHRTYEAGPLTRGVLAYLFVLSGLGGPLSWARLHAVRDYWQNRPDCPPYFAYEHSMARDFGWNLHLRFEPADDRALARLPPDVLTDPWLCFLERTWPLHVLGLTGVVLAVLGPEAVALCVCARTAAGILGHWAVGYAAHVWGERRYALPGAAESGTNIWVLGVLSFGEGFHNNHHAFPGSARMGQKAHELDLGWWVIRGLCRLGLVRDVRT

SEQ ID NO: 6480 - protein, 339 aa, Ralstonia solanacearum GMI1000
MNRIAKFVAGSLLAVATGAALAAGSPGVERNTQAFLDALAAGGGKPLETLSPAEARAVLVGAQAAPKVPLPPADVSEKTINVDGKPIRLTIVRPAGAKGELPAFMFFHGGGWILGDFPTHERFVRDLVADSGAVAVFVNYTPSPEARYPVAINEAYAATRWVAENGAQINVDGTRLAVAGNSVGGNMAAVVALMAKTRGAPALRAQVLFWPVTNASFENASYDAFAEGHFLTRPMMKWFWDAYTANPAQRQEITASPLLATPGQLKGLPPTLVQTAEKDVLRDEGEAYARKLDAAGVTVVATRYNGMIHDFGLLNALSGLPATRAALHQASETLKLRLK

SEQ ID NO: 6481 - protein, 461 aa, Burkholderia xenovorans LB400
MTFLKSPPPTPDAVADEYAAMISGSSLPKYRIPEASSDRRAVFDLVRDELFMDGNSRQNVATFCTTYADDEVRRLMDLSIDKNMIDKDEYPQTAEIEMRCVHMLADLWHATKSWKTTGCSTTGSSEACMLGGLALKWQWKKRREAQGKPTGKPNFVCGPVQVCWAKFARYFDVEMRQVPLSGDATGLRPEDLAQYCDENTIGVVATLGITFTCVYEPVKALAGALDALQANVGLDIPIHVDAASGGFVAPFIQPDLEWDFSVPRVKSINASGHKYGLAPLGVGWIVWRSTQDLPDELIFRVDYLGGDMPTFALNFSRPAGQIIAQYYMLLRLGREGYRHIQQECADTAQALADGLAKIDALDMIYDGRGALPAVCYKLKHPDTAGFTLFDLSDRVRMRGWQIASYELPAGREDTIVQRVLIRRGVTRDMAAMLLEDIKHAIAHLTKNPVPNSTAGPTFHHD

SEQ ID NO: 6482 - protein, 119 aa, Brassica napus
  misc_feature (31)..(31): Xaa can be any naturally occurring amino acid
MGRKRKHSETEAAARAKKDDSAPERPKRTLXGWKDKNEDAEESKAKAASGFRNKEKVLVTCSRRISFRYRHLMLNMVSLLPHCKKDSKVEAKSSKGATLNELVELKGSSSCLFFECRKH

SEQ ID NO: 6483 - protein, 384 aa, Triticum aestivum
  misc_feature (207)..(207): Xaa can be any naturally occurring amino acid
  misc_feature (255)..(255): Xaa can be any naturally occurring amino acid
MVAEAEVMHQQPAPVLEVQYRRCVAKGAGMSAVAVPEVEVEVAVELPRMGLANTDGATSVSAETLQFVPNIRSGSFADIGPRRYMEDEHIRIDDLSAHLGSLLVCPLPSAFYGVFDGHGGPDAAAYMKRHAMRFLFEDREFPQALQVDDVFLQSVEECIRSAFLQADLALADNLDISRSSGTTALAALVFGRQLLVANTGDCRAVLXCRRGIAMEMSRDHRANYPEECERVAASGGYIEDGYLNGVLSLTRDLGXTWDMKGPDCSTSPLIAEPEFQQATLSEDDEFLIMGFDGIWDVMTSQHAVSVVRPGLRQHDDPERCARELVMEANRLETADNLTVIVVCFGSELASPPPPPVAAAARPRSCKGLSAEALCNLRSWLETDR

SEQ ID NO: 6484 - protein, 395 aa, Idiomarina loihiensis L2TR
MDYQLSDRINAIQPSPTLAVTQKANELRQQGKDVIGLGVGEPDFDTPDFIKEAAIQAIRDGKTKYTAVDGIDELKDAVIKKLQRDNNLSYERKEIIVSAGGKHSIFNLLSAWLNPGDEVIIPAPYWVSYPDMTKLVGAEPVIVKAGIDQRFKITPEQLREALTDKTRLMFINSPSNPAGTAYTADELKALAEVLRDYPKVLIATDDMYEHILWSDSAFANFPMVAPDLKDRTVILTGVSKAYAMTGWRIGYAAGPKPIIAAMKKMQSQSTSNPTSISQYAAAAALNGDQSCIDTMVSAFKERHDYLVDALNSIDGVNCVPGDGTFYAFAQVDELMAKAKVSSDVELCEKLLTEANVALVPGSAFGTDGYCRLSFATSMDVLKEAVKRIKDFSESL

SEQ ID NO: 6485 - protein, 609 aa, Oryza sativa
MPAIADCAADPPLADSYYTLLRLGGDDDDDACTKVTTTPQPVSECELPMIDVGCLTAPTGAAAAAAVGQQHQAEERAACAAAIAAAAAEWGFFQVVNHGVAQELLEAMRREQARLFRLPFEAKSSAGLLNDSYRWGTPTATSLRQLSWSEAFHLPLAGISGKSCNYGDLTSLRDVTREVADAMSRLARALARVLAESLLGHAAGERFPEGCDDATCFLRLNRYPPCPFPPDDAFGLVPHTDSDFLTVLCQDHVGGLQLMKGSRWVAVKPIPGALIVNIGDLFQAWSNNRYKSVEHRVMTNATTERYSVAYFLCPSYDSPIGTCREPSPYKAFTFGEYRRRVQEDVKKTGKKTGLSNFLLSLTVYKYWPPSRGGGGGPTVGGAVADDDDNGGQRAQLLPRRPLARARGTHQGAAQRRAAKGDDRRLAGGGGGGQRRNIQADSSSSARTWRKPEAGWIKLNFDGSSKHATKIASIGGVYRDHEGAFVLGYAERIGRATSSVAELAALRRGLELVVRNGWRRVWAEGDSKTVVDVVCDRANVRSEEDLRQCREIAALLPLIDDMAVSHVYRSGNKVAHGFARLGHKAVRPRVWRAAPPEEVLRFLQQDADQR

SEQ ID NO: 6486 - protein, 497 aa, Alternaria alternata
MTSVKLSTPQTGEFEQPTGLFINNEFVKAVDGKTFDVINPSTEEVICSVQEATEKDVDIAVAAARKAFNGPWRKETPENRGKLLNKLADLFEKNADLIAAVEALDNGKAFSMAKNVDVPAAAGCLRYYGGWADKIEGKVVDTAPDSFNYIRKEPIGVCGQIIPWNFPILMWSWKIGPAIATGNTVVLKTAEQTPLSAYIACKLIQEAGFPPGVINVITGFGKIAGAAMSAHMDIDKIAFTGSTVVGRQIMKSAAGSNLKKVTLELGGKSPNIVFADADLDEAIHWVNFGIYFNHGQACCAGSRIYVQEEIYDKFIQRFKERAAQNAVGDPFAADTFQGPQVSQLQFDRIMGYIEEGKKSGATIETGGNRKGDKGYFIEPTIFSNVTEDMKIQQEEIFGPVCTISKFKTKADVIKIGNNTTYGLAAAVHTSNLTTAIEVANALRAGTVWVNSYNTLHWQLPFGGYKESGIGRELGEAALDNYIQTKTVSIRLGDVLFG

SEQ ID NO: 6487 - protein, 496 aa, Davidiella tassiana
MTSVQLETPHSGKYEQPTGLFINNEFVKGQEGKTFDVINPSDESVITQVHEATEKDVDIAVAAARKAFEGSWRQETPENRGKLLNNLANLFEKNIDLLAAVESLDNGKAISMAKGDISMCVGCLRYYGGWADKITGKVIDTTPDTFNYVKKEPIGVCGQIIPWNFPLLMWAWKIGPAIACGNTVVLKTAEQTPLGGLVAASLVKEAGFPPGVINVISGFGKVAGAALSSHMDVDKVAFTGSTVVGRTILKAAASSNLKKVTLELGGKSPNIVFEDADIDNAISWVNFGIFFNHGQCCCAGSRVYVQESIYDKFVQKFKERAQKNVVGDPFAADTFQGPQVSKVQFDRIMEYIQAGKDAGATVETGGKRKGDKGYFIEPTIFSNVTEDMKIVKEEIFGPVCSIAKFKTKEDAIKLGNASTYGLAAAVHTKNLNTAIEVSNALKAGTVWVNTYNTLHHQMPFGGYKESGIGRELGEDALANYTQTKTVSIRLGDALFG

SEQ ID NO: 6488 - protein, 258 aa, Xanthomonas campestris pv. campestris str. ATCC 33913
MTAHRWRLDGQTALITGASAGIGLAIARELLGFGADLLMVARDADALAQARDELAEEFPERELHGLAADVSDDEERRAILDWVEDHADGLHLLINNAGGNITRAAIDYTEDEWRGIFETNVFSAFELSRYAHPLLTRHAASAIVNVGSVSGITHVRSGAPYGMTKAALQQMTRNLAVEWAEDGIRVNAVAPWYIRTRRTSGPLSDPDYYEQVIERTPMRRIGEPEEVAAAVGFLCLPAGSYITGECIAVDGGFLRHGF

SEQ ID NO: 6489 - protein, 377 aa, Phycomyces blakesleeanus
MTQPSRRNDMSRLQQFDAGEQYSIVDIVGEGAYGVVCSAVHKPTGQTVAIKRILPFDHAMFCLRTLREIKLLKYFNHENIISILDIVKPKSYDEFTEVYLIQELMETDLHRVIRTQDLSDDHCQYFTYQTLRALKAMHSANVLHRDLKPSNLLLNANCDLKICDLGLARSANSADENSGFMTEYVATRWYRAPEIMLTFKEYTKAIDVWSVGCILAEMLSGKPLFPGRDYHHQLTLILDVLGTPTMDDFYGIKSRGARDYIRSLPFKKRIPFARLFPEATVDLLEKLLSFNPDRRITVEEALKHPYLEAYHDPDDEPNATPIHESFFDFDKYKDQLTKEQLKRKFFFHIIKRKKERLTQNIYINMYITEMLYEEITQ

SEQ ID NO: 6490 - protein, 130 aa, Zea mays
  misc_feature (48)..(48): Xaa can be any naturally occurring amino acid
  misc_feature (55)..(55): Xaa can be any naturally occurring amino acid
  misc_feature (80)..(80): Xaa can be any naturally occurring amino acid
  misc_feature (92)..(92): Xaa can be any naturally occurring amino acid
  misc_feature (98)..(98): Xaa can be any naturally occurring amino acid
  misc_feature (105)..(105): Xaa can be any naturally occurring amino acid
QVVQDIAKDCNDAPERSIITLCLTDMVRGLMLTLKYFFQRNVTINYPXEKAALEXRFRGECALRRYESGEEGCIACELCXAICPAQEITIDXEEREDXSRRTTRXYDIDVTKCILLWGSANRLDQSMLLL

SEQ ID NO: 6491 - protein, 357 aa, Ralstonia solanacearum GMI1000
MGSSPPRLVVSEHAPAAAADTGTRAAPRHPLAGVPDAVPAGALRVAAADQPGPGTDAPATAEANTPPRAVSAADYWTQGYASRIRLRVFRPERRADDGAVPLRQPGVLYLHGGGFVGGCIDDADVSARHLAATLPAVVVTVGYSLAPAAPFPAAPEDVYAALCCMAEHAATWGIDRRRLAVAGHDAGGNLSAALAMIARDRGGPGLRAQVLIAPMLDPTMARVRPDRLADADNSAEACAACYRQYLPRPTERVHPYAAPVESRRLHGLPPALLLTAPQDLLRTEAERYASALIEAGVATQVLRVADACHDSIATDRAALDEITCFLRWHLGLTRPAGPRKRRRRRAATAGTADELPG

SEQ ID NO: 6492 - protein, 361 aa, Rhodococcus sp. RHA1
MPQQVRGVIARSKGAPVEIATVNIPDPGPGEVVVDIAACGVCHTDLTYRDGGINDEFPFLLGHEASGIVESVGEGVTSVAVGDFVVLNWRAVCGQCRACKRGRPQYCFDTHNAAQKMTLEDGTELTPALGIGAFADKTLVHAGQCTKVDPSADPAVVGLLGCGVMAGLGAAVNTGNVSRGDTVAVIGCGGVGDAAIMGARLAGAVKIIAIDRDDKKLEWAKDLGATHTINGGQVDAVSAVQELTGGFGADVVIDAVGRPETWKQAFYARDLAGTVVLVGVPTPDMTLEMPLIDFFSRGGSLKSSWYGDCLPERDFPVLVDLYQQGRLPLDKFVTERIKIDEVEAAFHSMHAGEVLRSVVVL

SEQ ID NO: 6493 - protein, 127 aa, Pyrococcus abyssi GE5
MAKEVIFTEKAPKPIGPYSQAIKVGNFIFVAGQIPIDPETGEIVKGDIKEQTKRVIENIKAILEEAGASLNDVVKVTVYLKDLNDFAKMNEVYSEYFGESKPARVAVEVSRLPKDVLIEMEAIAYKE

SEQ ID NO: 6494 - protein, 140 aa, Brassica napus
  misc_feature (132)..(132): Xaa can be any naturally occurring amino acid
MDQNEPISKKLWNIVRFLLYMIRKGVSKHKLIADFNATLKRGKNLMFHHRRRVPAAATSSSAAANAPQRQEYEFSCSNTPNYSFPFPNIGFMKKKSHINLFACGQTPQTLDDDAAAARAVLELLNGVGDKGXVTPAVFVG

SEQ ID NO: 6495 - protein, 113 aa, Glycine max
ACSRAVRAAIFQAPVSDREYQATLPHTASMIDLAAKMISEGRGLELMPREADPSAPITAYRENSIEQCSGFKRKMQLRAENKEIRGDKLHDPVAGGTQNCQIDFLPLISSLVP

SEQ ID NO: 6496 - protein, 135 aa, Oryza sativa (japonica cultivar-group)
MTTMDKGRALPKFGEWDVKNPASAEGFTVIFQKARDDKKTTGPGNARDKGRALPKFGEWDVKNPASAEGFTVIFQKARDDKKTTGPGNARVGIPPAFRSTDDDGGYRPQFKPAESYPEKKAPKRVKKKWAFCAGC

SEQ ID NO: 6497 - protein, 401 aa, Oryza sativa
  misc_feature (241)..(241): Xaa can be any naturally occurring amino acid
MPLSSLSLLPLHRAPLPPTSNYPPPPPPSRALLLPLLRHSPLARRSPVSRARAVAADGMAAATAAAETPPTLLEYMGQAGAADDLVVLVAHVQSACKRIAALVASPGNAELSRGKAGGGVAVAAGRDAPKPLDELSNEIILSSLRRSGKVAVMASEENHLPIWVSNDSPYVVVTDPLDGSRNIEVSIPTGTIFGIYNRLAELDHLPEEERAQLNSLQSGTHLVASGYVLYSSRTRAHIIGXSSTHGFTLDHLTGEFVLTHPSIQIPPRGQIYSVNDARYFDWPEGLRKYIDTIRQGKGQHPKKYSARYVCSLVADFHRTLIYGGVAMNPRDHLRLVYEANPLSFLAEQAGGRGSDGKSRILSIQPVKLHQRLPLFLGGMEDMLELESYGDVQQKVNPGYEV

SEQ ID NO: 6498 - protein, 294 aa, Pyrococcus abyssi GE5
MEGVIVPLVTPFREDYSIDFEALEWHIRFLEEKGVHGIFVNSTTGEFTSLNTDERKMLAEKGREITSGMYLVGTGSTSTLEVIELSRHAEDIGADGIVIVAPYYCKLKDEEILKHFSMVAERVDIPIIVYAIPSCANPVPVDIIRKVSLEYSNIIGVKASVDSLTYLQELIEVKEERKDFRVFTGLDQYFLSTLLLGGDGGIMACANFAPEIHLQIWNSFKRRNFEEAIKLSRVLGEISRIYNVASSFASAVKLAMIAKGFPIKPVLRPPHVIDGEEVFNEIKGILRSLENVKP

SEQ ID NO: 6499 - protein, 323 aa, Yersinia pestis CO92
MNLEKIIELTAPDMAAVNTTILDQLNSDVVLINQLGHYIISGGGKRIRPMISVLVARALNYQGSKHITVAALIEFIHTATLLHDDVVDESDMRRGKATANAAFGNAASVLVGDYIYTRSFQMMTGLQSMRVLTLMSEATNVIAEGEVLQLMNCNNPDITEESYMQVIYSKTARLFEAAAQSAAILSDASEEQELALQNYGRYLGTAFQLIDDLLDYSAEGSTLGKNTGDDLNEGKPTLPLLHAMHNGTPEQAAMIRQAIEQGNGRHLLEPVLAAMEHCGSLVYTRQRAEEEADKAIAALHALPESDYRLALEGLAHISVHRRF

SEQ ID NO: 6500 - protein, 713 aa, Kineococcus radiotolerans SRS30216
MQIWPGRPYPLGATYDGAGTNFALFSEVAERVELCLIDDSGKEQRLDLPEVDGFVWHAYLPSVMPGQRYGYRVHGRFHPESGARCQPEKLLLDPYAKAIEGQVDGDESLFSYYFDRPDEVNVEDSLGHTMLSVVVNPFFDWGNDRRPGHEYHESVIYEAHVKGLTMQHPDVPEEIRGTYAAMAHPAVIEHLTSLGVTAVELMPVHQFVQDTHLVDKGLSNYWGYNTIGFFAPHNAYSSNGQRGQQVQEFKSMVLALHEANIEVILDVVYNHTAEGNHMGPTLCFRGIDNEAYYRLVDEDKKHYFDTTGTGNSLLMRHPHVLQLIMDSLRYWVTEMHVDGFRFDLAATLARQFHEVDRLSAFFDLVQQDPIVSQVKLIAEPWDIGEGGYQVGGFPPLWTEWNGKYRDTVRDFWRGEPKTLGEFASRISGSSDLYAHSGRKPIASINFVTAHDGFTMRDLVSYNDKHNDANGEGGNDGESHNRSWNCGVEGETDDAGIIALRARQHRNLLTTLLLSQGVPMLLHGDELGRTQRGNNNVYCQDNELSWVDWDLSDAQRELLAFTQRVVNLRRTEPVFQRRRFFAGDAGHGGESEVGDIEWFSADGQEMTDADWADQSNPTVMVFLNGEAIPEPDRRGERIVGDSFLVLWNPWHEAVEFTLPEKAYGDGWAPRLDTADDQVGIVSIFTEESAFSPGAKLPVAARSVLVLARGPLGEK

SEQ ID NO: 6501 - protein, 424 aa, Bradyrhizobium sp. BTAi1
MTGQAQNPHHVVIVGAGFGGLETTYRLAGAPVRITLIDRRNHHLFQPLLYQVATASLATSEIAWPIRSLVRNRPEVTTLFASVKGIDAAGRRVLLEDDTDVAYDTLVLATGARHAYFGHDEWEPFAPGLKTLEDATTLRRRILVAFERAERERDPARRAAWMTFVIIGAGPTGVELAGTIAELARSTLPPDFRSIDTHEARVVLIEAGPRVLGGFPEDLSAYTLTSLERIGVEVVLGQAVTECTADSVVYGGKRLDTRTLIWAAGVRASRAAEWLGAPADRAGRLQVAPDLTVPGHPEIFAIGDTVTIAAWNGQPVPGIAPAAKQQGRYVAEAIKARLAGRTLRPFRYHHAGSLAQIGKRLAVIDFGWIKLRGALAWWIWGLAHIYFLIGLRNRLSVALSWLWIHARDQRAARLITQGSSKVMD

SEQ ID NO: 6502 - protein, 404 aa, Magnaporthe grisea 70-15
MAPSMLRSILRSSPSAARRWSRHYSVKAEVASTAQPKDIEPAQLKITKTSKPGVLDKPENLLFGRKFSDHMITCEWEQTNGWQQPQIVPYQNLSMDPATCVLHYAFTCFEGMKAYKDKSGQVRLFRPDKNMERFNKSAARIALPNFSSPALIDIISQYAKLESRFIPDQRGFSLYLRPTMIGTQKTLGVSPPGSAMLFVIASPVGPYYPTGFKAVSLEATDYAVRAWPGGAGDKKLGANYAPCIVPQREAMARGFQQNLWLFGEEEYVTEVGTMNMFVAIKNKQTGQKELLTAPLDGTILEGVTRDSILALARERLVPEGWAVSERKFTMKELHEASTEGRLIEAFGSGTAAIVSPVRSIAWKGKLVHCGLQDHEESGEIAMRMKGWIESIQYGDEDHEWSHVC

SEQ ID NO: 6503 - protein, 735 aa, Gloeobacter violaceus PCC 7421
MRRRDILRLAGLGLGAAGGAGVPALAQNPAKVGARAAAGRLLVPQYRAAGAASFSAITWNKAWATVAERLLEVRASSWSEANRRAERLGVYCGTGLTNEEAYAWAKLARLSGARLERSGEGASLALARALEATFGVPAAPNHWLELSKSQAILVVGRAGGAGHPAFAAAQAAAQAGVPVWSLGEGQDASIGNALAVAPRGEVAVLGGLIRFIVENKRADAAFLDVHTNAAFRLLPEFGFQNGVFSGFDPKTRRYDPESWGYEFLENGRPARSEQIAEEGTVYAQIARFFAPYTLERAARTAGVGEAALGRFYREFTAPERRSAAIVCAIDAAAEPAAIEQRVRLAAIASLLLGQVGRPGGGIVVASPGFNPQGTADVGATGAMLPGYAGAPPLAGEDFIGWVQRHGVRNQRRLVAMLRSWYDTAAPDFGFAALPCSRPGEPTLRGGNLEMLVCVGADPLAEGNWPLEKLKTLVVLDHAGTNRTARFWQGRGAARTEVLFLPLAHPDEREGTTTDSGRRIVLLSPASGPRGQSQTGLTTAASLWEQIGFKLASRTQPREESLREARWWRETTPAAVWAEMVGADLGNPAEVDGAANPRELRCGVAIYAGASGEKLAGRRERGEDGSGLGLYPAYGYPWPGDVRVIANRASADLQGNPRLAPPFMRWDGKAWSGPDTPDIANPANPDDPAATRSFRGTPEGVARLFAAYYAAGLNLDTGIAFLPAALPAGGPLPFAK

SEQ ID NO: 6504 - protein, 336 aa, Oryza sativa (indica cultivar-group)
MTLANIPEIMESLPVETRFTEFPLRQYGGFWLLEVMLNGVAAAETSFQPRPSDILLSSFPKCGTTWLKALAFATLNRSTYPPSDEHHPLLEHNPHDLVGFLEIYPKLELYESLPSPRLLSTHLPYSMLPHRIREQETGCRLVYIYRDPKDAMVSMWHQNKKEKKNRLTFEEMFDMFCEGRCVVGPQWCHAGEYWDESQARPEKVLFLMYEDLLQDTVGNLRTLAEFMGCGLSRQEEDDGIVQQIVELCSLNNLKNLYVNKSGTTLLGISKDGFFRKGGTGDWSNHMSPEMAARLDKIVKERLEGSGHPIISRINAKATTSIGSSNHGASEAKYIKE

SEQ ID NO: 6505 - protein, 428 aa, Xanthomonas campestris pv. campestris str. ATCC 33913
MTSSPSRAPLHLVVVGGGFAGLWATRALADPDIRITLIDRQNHHLFQPLLYQVATAGLSAPDIAAPLRHILREQRNVEVLLGDVAEIATDRRAVVLADGNTVNYDMLLLATGATHAYFGNDHWAEHAPGLKTLYDALVLRRKLLLAFERAEAESDPAARAAWLSFAVVGGGPTGVELAGTLAEIARHTLKNEFRHIDPQQARVRLVEAGPRVLPSFPDDLTDKARKQLERLGVEVHTGTPVTNIDAFGYQLGDTFVPARTVVWAAGVAASPLARTLGVPLDRAGRVLVEPDLSVPGHPEIFVGGDLASVQQDGRPVPGVAPAAKQMGKHIAKAIRARQRGQAAPAFHYQDFGNLATIGRMAAIVHVGKLKLSGIVAWWFWLAAHVYFLIGFRNRFVVLVNWAMAYWSYQRAARIIFGGTDQPPPSKDG

SEQ ID NO: 6506 - protein, 386 aa, Ipomoea nil
MAIECMIPTPTPNHERQEIENKPAAAVVFDSPVLRHESNIPTEFLWPDHEKPGPYAAREFQVPVIDMAAFRSGDPVAVAETCKLVDEACKKHGFFLVVNHGVDTELLSDGVREMDRYFELPLSFKEKALRKLGEHCGYASSFTGRFNAKLPWKETLSFRFSAEKECSHVVGEYFEKTLGQEFADLGELYQKYCNAMNTLALEITELLGMGLGVDRKHFSEFYQENDSVLRLNYYPPCQKPELTLGTGPHCDPTSLTILHQDSVSGLQVFVDNEWRAVNPTPNAFVVNIGDTFMALSNGLYKSCMHRAVVNNEIPRKSIAFFLCPHKDKVVTPPPELVDATHPKLYPDFKWPALLEYTQLHYRSDTDTLLNFATWLQQNQTLHATQA

SEQ ID NO: 6507 - protein, 203 aa, Listeria monocytogenes EGD-e
MYKAIIFDVDGTILDTERAVLHSLQAVLAEEGLSYELDELRFVLGITGAAAVEQLNILDQEKVLGKWIEREATFIEEVEVFEGIHKVLHAIPESGVVTSKNALEMEKGFYPFNIQDHFQAIVCASDTENHKPHPDPLLKGLEILGREPHEVLYVGDSSYDMKCAHAAGAHFGLALWGAKTTDGFEKAELVFEKPEDILAYVSK

SEQ ID NO: 6508 - protein, 341 aa, Zea mays
MDHAAEAQRTDLMTITRHVLNEQSRHPESRGDFTILLSHIVLGCKFVAAAVNKAGLAKLIGLAGETNVQGEEQKKLDVLSNEVFVKALVSSGRTCVLVSEENEEAIFVDPALRGKYCVCFDPLDGSSNIDCGVSIGTIFGIYMVKDKDNVTLEDVLQPGTNMLAAGYCMYGSSCTLVLSTGNGVNGFTLDPSLGEFILTHPNIKIPKKGKIYSVNEGNAKNWDGPTAKFVEKCKYPEDGSPPRSLRYIGSMVADVHRTLLYGGIFLYPADQKSPNGKLRVLYEVFPMSFLMEQAGGQAFTGKQRALELAPAKLHDRSPVFLGSYDDVEEIKALYASMSNSG

SEQ ID NO: 6509 - protein, 253 aa, Oryza sativa (japonica cultivar-group)
MGRKFFVGGNWKCNGTTDQVDKIVKILNEGQIASTDVVEVVVSPPYVFLPVVKSQLRPEIQVAAQNCWVKKGGAFTGEVSAEMLVNLSIPWVILGHSERRSLLGESNEFVGDKVAYALSQGLKVIACVGETLEQRESGSTMDVVAAQTKAISERIKDWTNVVVAYEPVWAIGTGKVATPDQAQEVHDGLRKWLAANVSAEVAESTRIIYGGSVTGANCKELAAKPDVDGFLVGGASLKPEFIDIINSATVKSA

SEQ ID NO: 6510 - protein, 308 aa, Sorghum bicolor
MEINIVDKYEKLEKVGEGTYGKVYKAQDKATGQLVALKKTRLEMDEEGIPPTALREISLLNLLSHSIYVVRLLAVEQAAKNGKPVLYLVFEFLDTDLKKYLDVYRRGPAARPLPATLIKNFLYQLCKGVAHCHGHGVLHRDLKPQNLLVDKDKGILKIADLGLGRAFTVPMKSYTHEIVTLWYRAPEVLLGATHYSTGVDMWSVGCIFAEMARRQALFPGDSELQQLLHIFRLLGTPSEEQWPGVSELRDWHEFPQWKPQSLARVVPTLEPEGVDLLSKMLQLDPSNRISAIAAMEHPYFDSLDKSQF

SEQ ID NO: 6511 - protein, 310 aa, Triticum aestivum
  misc_feature (77)..(77): Xaa can be any naturally occurring amino acid
  misc_feature (99)..(99): Xaa can be any naturally occurring amino acid
  misc_feature (128)..(130): Xaa can be any naturally occurring amino acid
  misc_feature (152)..(153): Xaa can be any naturally occurring amino acid
  misc_feature (155)..(155): Xaa can be any naturally occurring amino acid
  misc_feature (196)..(196): Xaa can be any naturally occurring amino acid
  misc_feature (198)..(198): Xaa can be any naturally occurring amino acid
  misc_feature (205)..(205): Xaa can be any naturally occurring amino acid
  misc_feature (217)..(217): Xaa can be any naturally occurring amino acid
QMPGEAAGWFRGTADAVRKFIWVLEDYYKNKSIEHILILSGDQLYRMDYMELVQKHVDDNADITLSCAPVGESRASXYGLVKFDSSGRVVQFSEKPKGXDLEAMKVDTSFLNFAIDDPAKYPYIASMXXXYVFKGDVLLNLLKSRYAELHDXXGXEILPRALHDHNVQAYVFTDYWEDIGTIRSFFDANMALCEQXPXFGFYDPXTPFFTSPRYLPXSELKNAMMMGADSYETEDEISRWMSEGKVPIGVGENTKISNCIIDMNARIGRDVVISNKEGVQEADRPEEGYYIRSGIVVIQKNATIKDGTVV

SEQ ID NO: 6512 - protein, 195 aa, Triticum aestivum
  misc_feature (121)..(121): Xaa can be any naturally occurring amino acid
  misc_feature (177)..(177): Xaa can be any naturally occurring amino acid
MARHHLLLFLPLLALAFSFVIAAPERQGDAAAFIDGASHRYLRDQPEDQATSMSLGEVSAAVSVLLGFAPPAILPAPSSAKLNKLLLPNPFDRPRSVFLMQLDGSHDYVNGFISDAGSIYXTKIDGAKSAAIELSDKDELIVIRSDESSGFRCLDNELANLAPWLAGSYQKADSKLXIPLKRENSLTLFLIREQT

SEQ ID NO: 6513 - protein, 750 aa, Anaplasma marginale str. St. Maries
MGDFSERDREALEFHCKRRPGKVSLLPTKPLMTQGDLSLAYSPGVAVPCLRIASDPDTVYDYTARGNYVAVISNGTAVLGLGNIGPLASKPVMEGKAVLFKRFADIDAVDIEVDTEDVEEFINAVKHLGLSWGGINLEDIRAPECFIIERRLGELMDIPVFHDDQHGTAIITLAGIINALDITGRNLKSVKIVVNGAGAAGIACVEMLKFVGIPNDNIVLCDQNGVIYKGRQLGMNEWKLKHAIETKERDLKDAMKGADIFIGLSVRDVLSKEMLLSMNKDPVIFALANPYPEVNPEFAREVRPDAIIATGRSDYSNQINNVMGFPYIFRGALDVRAKSVNNEMKLAAAEALAMLAREVVSDEVLEAYGGRGMGYGKEYIIPTPFDPRLLSVVSPAVAKAAINSGVARKKIDDWDRYALELNSRISPTSNILNLMYGSVKSSPKRVIFPEGEEVRVIKAALQWYGQGYGTPILVGRVDKIKESLDLIGVDSLEGITIANAAISSRNDVYIDYLYSKLQRMGRLHRSCVRDVKTDRNVFAACMLACGDGDTLVTGITRGYSESLSDIRKVIDARGEVFGLSVVVMEERTLFIADTAINELPTAQQLADIAIKSAAAARSMGHEPRVAFVSFANFGSHSQKESDRVRQCMDIVASRNVDFEYDGEMSVDVALKPESLSMYPFCRLSKPANVLIMPSLYSASISSKLLREVGGTTVVGPILMGMEKPVQIVQMTASVSEILNLAVLATLSHPI

SEQ ID NO: 6514 - protein, 228 aa, Glycine max
  misc_feature (83)..(88): Xaa can be any naturally occurring amino acid
MAFSATSKAGRFPYSLGQEPTLPGNAEFLLQCMEEAGVDGALIVQPINHKFDHSYVTSVLNKYPTKFVGCCLANPADDGSGLXXXXXXVLKDGYRAVRFKPYLWPPGEKMTSKVGKAIFQRAGELNVPVGFLCMKGIGLYMSEIEQLCTEFPSTVVLIDHLGFIKPPLNEEEGLVFSQLLNLSRFPKVYVKFSSLFQVSREKFPYLDLAPLLSQVVASFGANRVMWGR

SEQ ID NO: 6515 - protein, 507 aa, Arabidopsis thaliana
MRLVSRIMCSRMGEMIDLFLLALMAGFIAVAYVFRSKQKKNLPPNPVGFPVIGHLHLLKEPVHRSLRDLSRNLGIDVFILRLGSRRAVVVTSASAAEEFLSQQNDVVFANRPLATLTEYMGYNNTLVSTAPYGEHWRRLRRFCAVDILSTARLRDFSDIRRDEVRAMIRKINVELVTSGGSVRLKLQPFLYGLTYNILMSMVAGKREEDEETKEVRKLIREVFDFAGVNYVGDFLPTLKLFDLDGYRKRAKKLASKLDKFMQKLVDEHRKNRGKAELEKTMITRLLSLQESEPECYTDDIIKGLVQVMLLAGTDTTAVTLEWAMANLLNHPEVLRKLKTELNEVSKEGRVFEESDTGKCPYLNNVISETLRLFPAAPLLVPHASSTDCEVAGFDIPRRTWLFINAWAIQRDPNVWDDPETFKPERFESETHRGKFLPFGIGRRACPGMGLAQLVLSLALGSLIQCFDWERDNDVAVDMSEGKGLTMPKSVPLVAKCKSLPILDKLVL

SEQ ID NO: 6516 - protein, 857 aa, Ustilago maydis 521
MGRPQRSAAPGPSRRSTRAASTIKNERITRSSRAKHSYALDDPEQVERDLNAQLKRMGLYAANTTGDGNCLFRALSDQLYGHSARHAQLRQETCDHLAARPEKFAGFVDDKPFDQYIKLMRENGTYGGHLELHAFAQMKQKQIKIVQPGLVYVVEGVDDSPEARRLRDEKEQERLRIQSSIQAGTESAPLTERQQRKQKRDEAKRDKKPTKLAQHDEASESSSTCTQPAADATRSASRTSPFSSSPGSYQGTSAASAPQLAEAYGPLYIAYHNWEHYSSIRNLEGPHSGLPRIKEQSIASAGAAAAASADNGKAIKDAANEAEPTREEKMVLQSISGDHDLDEVRRLLEENQNDWAHVVELILEKDAIIDEEEVGAELQAVSSSGQQFHASDRLTVPPPPPLPDHLRHWRATSPSSVDTSATHSSGEGDSPSTTATTDDGGDATACASPGSSNLSRGSTPSVEKISSKRAASSDAMTMSTIRSPKRRSQSRSPELGLAAQSQSVEAVEHDASPASDDKKSQDGQAVYEIIKRGRGRPRKDGLPNKSTIAIKRRVPTAREKRDAAQARKRERQLEKIVRTRATSRAEGGDSAAASERPSPAEIGSDTMATACKESAVELNTLTVEHVLSDLEALTPGAALFSLVQGSASSSGSGCDRGLLESFEAGVDPSGRKQHVELSHMLLASHRTAERLNSERVSAAEVALVLPSERSRASKSTSGSTSPSRDIDLARKATRTDLLHAKVADLQSQVDAWSSALEQASQVVHEPGSNTSLAAAATASTADAQSTRTSGSQAAPLESQSTVQGQIDRSSNNRSTFVESISSELRQEGSTRIAIDAPEAVTSATEDFEDDDPWNDPT

SEQ ID NO: 6517 - protein, 337 aa, Yersinia pestis CO92
MKTLGEFIVEKQLDFSHATGELTALLSAIKLGAKIIHRDINKAGLVDILGASGVSNIQGEDQMKLDLFANEKLKAALKARGEVAGIASEEEDDIVIFDGGRAENAKYVVLMDPLDGSSNIDVNVSVGTIFSIYRRITPFGTPITEEDFLQPGTKQVTAGYVVYGSSTMLVYTTGYGVHAFTYDPSLGVFCLSHEKVRYPATGCMYSINEGNYIKFPLGVKKYIKYCQEQDEATKRPYTSRYIGSLVADFHRNLLKGGIYIYPSTASHPQGKLRLLYECNPMAFLAEQAGGKATDGVNRILDIVPEKLHQRAPFFVGTKSMVEDAEGFIAKFPDEEAK

SEQ ID NO: 6518 - protein, 326 aa, Rickettsia typhi str. Wilmington
MQITVREALRDAMQEEMLRDDKVFVIGEEVAEYQGAYKVTQGLLEQFGSKRVIDTPITEYGFAGLAVGAAFAGLRPIVEFMTFNFAMQAFDHIVNSAAKTHYMSGGQVKCPIVFRGPNGAASRVAAQHSQNYTACYSHIPGLKVVAPYSAEDHKGLMLTAIRDDNPVIFLENEILYGHSFDVPDIIEPIPFSKAKILKEGSNVTIVTFSIQVKLALDVVNILQNDNIDCELIDLRTIKPLDTNMIIESVKKTNRLVIVEEGWFFAGVGASIASIVMKEAFDYLDAPIEIVSGKDVPLPYAVNLEKLAMPSANDLIEAVKKVCYYTI

SEQ ID NO: 6519 - protein, 488 aa, Mycobacterium tuberculosis H37Rv
MRAEIGPDFRPHYTFGDAYPASERAHVNWELSAPVWHTAQMGSTTHREVAKLDRVPLPVEAARVAATGWQVTRTAVRFIGRLPRKGPWQQKVIKELPQTFADLGPTYVKFGQIIASSPGAFGESLSREFRGLLDRVPPAKTDEVHKLFVEELGDEPARLFASFEEEPFASASIAQVHYATLRSGEEVVVKIQRPGIRRRVAADLQILKRFAQTVELAKLGRRLSAQDVVADFADNLAEELDFRLEAQSMEAWVSHLHASPLGKNIRVPQVHWDFTTERVLTMERVHGIRIDNAAAIRKAGFDGVELVKALLFSVFEGGLRHGLFHGDLHAGNLYVDEAGRIVFFDFGIMGRIDPRTRWLLRELVYALLVKKDHAAAGKIVVLMGAVGTMKPETQAAKDLERFATPLTMQSLGDMSYADIGRQLSALADAYDVKLPRELVLIGKQFLYVERYMKLLAPRWQMMSDPQLTGYFANFMVEVSREHQSDIEV

SEQ ID NO: 6520 - protein, 359 aa, Solanum lycopersicum
MVFPLDSQLQNPISALLDGLYCEEDRFLDDDLGEWSSLDVGNENVKKTLPLLECDMFWEHDELATLLSKENEFHLGFQSLISDGSLMGARKEALDWMLRVIAYYGFTATTAVLAVNYFDRFVSGWCFQKDKPWMSQLAAVACLSIAAKVEETQVPLLLDLQVADSRFVFEAKTIQRMELLVLSTLKWKMNLVTPLSFIDHIMRRFGFMSNLHMDFLKKCERLILDIITDSRLLHYPPSVIATASMFYVINDIEPSNAMEYQNQLMSVLKVRKDIFEECHDLILELMDTACYKLCQSLKRKHHSVPGSPSGVIDAYFSSESSNESWSVASSISSSPEPQYKRNKTQDQRMTLAPLGSNLH

SEQ ID NO: 6521 - protein, 229 aa, Listeria monocytogenes EGD-e
MNKLNEALKKAERIVFLTGAGVSVPSGIPDYRSKNGLYAGMSSPEYMLSHTCLVREPEKFYQFVTENMYYPNAVPNVIHKKMAEIETEKDVTIITQNIDGLHEKAGSKKVVNFHGSLYHCYCQNCGMTVTAKDYLKSDIHTDCGGVIRPDVVLYEEAISESAIDQSLTAIRKADLIVIVGTSFRVSPFCNLTDYRNKKARIFAVNKERISLPYPFEMMESDAVKVFEEI

SEQ ID NO: 6522 - protein, 1147 aa, Hordeum vulgare subsp. vulgare
MSSSRSNSRSACSRGSSARSRHSERVVAQTPVDAQLHAEFESSHRHFDYSSSVSALNRSGASTSSAVSAFLQNMQRGRYIQPFGCLLAIHPESFALLAYSENAAEMLDLTPHAVPTIDQRDALAVGADVRTLFRSQSAVALHKAAVFGEVNLLNPILVHARTSGKPFYAILHRIDVGLVIDLEPVNPADVPVTAAGALKSYKLAAKAISRLQSLPSGNLSLLCDVLVREVSELTGYDRVMAYKFHEDEHGEVIAECRRSDLEPYLGLHYPATDIPQASRFLFMKNKVRMICDCAASPVKLIQDGNLSQPISLCGSTMRAPHGCHAQYMANMGSIASLVMSVTVNEDDDEDGDTGSDQQPKGRKLWGLVVCHHTSPRFVPFPLRYACEFLLQVFGIQLNKEVELASQAKERHILRTQTLLCDMLLRDAPVGIFTQSPNVMDLVKCDGAALCYQNQIMVLGSAPSEGEIKKIAAWLLECHDGSTGLSTDSLLEAGYPGASALGEVVCGMAAIKISSKGFIFWFRSHTAKEIKWSGAKHEPGDADDNGRRMHPRSSFRAFLEVVKWRSVPWEDVEMDAIHSLQLILRGSLQDEDANDNNVRSIVEAPSDDVRKIQGLLELRIVTNEMVRLIETATAPILAVDIVGSINGWNGKVAEITGLPTTEAIGMLLVDLVEGDSVEVIKQMLNSAMQGTEEQNFEIKLKTFHQQESNGPVVLMVNACCSRDLSDKVVGVCFVAQDLTGHKMVMDKYTQIQGDYVAIVKNPNELIPPIFMINDLGSCLEWNEAMQKITGIKREDAIDKLLIGEVFTLHDYGCRVKDQATITKLSILMNTVISGQEPEKLAFGFFSTDGKYMESLLTANKRTDAEGKITGALCFLHVPSPELQHALQVQKMSEQAAARSFKELTYIRQELKNPLNGMQFTRKLLEPSDLTEEQRQLFASNVLCQEQLKKILHDNDLEGIEQCYMEMNTVEFNLEEALNTVLMQGMSLSKEKQISLDRDWPVEVSSMYLYGDNLRLQQVLADYLACTLQFTRPAEGPIVLQVIPKKEHIGSGMQIAHLEFRVVHPAPGVPEALIQEMFRHGPGVSREGLGLHISQKLVKTMSGTVQYLREAESSSFIVLVEFPVAQLNSKRSKPSTSKWSKPSTSKSNF

SEQ ID NO: 6523 - protein, 167 aa, Zea mays
MEYGQQGQHGHGATGHVDQYGNPVGGVEHGTGGMRHGTGTGGMGQLGEHGGAGMGGGQFQPAREEHKTGGILHRSGSSSSSSSEDDGMGGRRKKGIKEKIKEKLPGGHKDDQHATATTGGAYGQQGHTGSAYGQQGHTGGAYATGTEGTGEKKGIMDKIKEKLPGQH

SEQ ID NO: 6524 - protein, 626 aa, Oryza sativa (japonica cultivar-group)
MDGGGGGDPGGRVGEAKADATRAANKRRAPSPAGGGGVEAKRRRKDAMGSSVSGSRSGGGGGRRLRHGRGRRARAFRRKLEEENKNSNNRPRASNVVIAYTPNLIRRYGTLLRNISFLLPYDGQGKAYACPSDKINVFLKWSRCNFCLFFEWAEGDQMMICHMFNTLKEIHISFLINPAFLDESMEVKVTNPLLSFSSNFVEDETWALVKEMLMMMFSPVQEDERAASDLYVFTKSRDSVYFRIFKITSIPAGESENSLVLDEVGLNFCLKLLDVHGAFVGSDCDQALDGLQSQTRNELKLSPDIYYCVPNDKLGCCTLHSVALNNQNYLFFLENGLDLSHFEGFCLTLEEFLERNSFLKIKHIVGSRNDEECNFVRNIAKAIIRSMLSHLVNLFSLGKCLRMGTDLLRRRKILLKGSDVKFFQLEVIAYEEDEAINNVLQVVELVKSCFVGEMIPADLQGDLHDLKENPLKRLESVIDSSSLMSAKEKKGLLVNLHTEYKTNISPAISEDDRDSLFKHIPYLDCWMNRTEDNEYLKLVANLDSKKVALKVNKVGTDKRKPSKNGILQFDFMRNSDVHIPEKALKDGITPFRLSWTDYILTSRYPTYLRAIQKSLEPYMKSRKKLK

SEQ ID NO: 6525 - protein, 405 aa, Photobacterium profundum SS9
MTMEHKVERKLFDEVMVPCYSPMQIIPVKGQGSRIWDQADREYIDFAGGIAVSCLGHCHPVMVNALKSQAEKLWHLSNVMTNEPALRLAKKLTEHSFAEKVFFANSGAEANEAALKLARRYAVDKFGPEKSEIIAFNQGFHGRTFFTVTVGGQAAYSDGFGPKPQAISHIPYNDLSALAEIMSDRTCAIMMEPLQGEGGIISPTSEFVQGVRELCDKHNALLIFDEVQTGNGRTGNFYAYQGLGVTPDILSTAKSLGGGFPIGAMLTTTALAEHMKVGTHGSTYGGNPLACAVAEAVVDEVSKPEVLAGVKEREQWFRDALEQINAKYPIFAEVRGKGLLLGAALNEEWQGRARDVLLAAVEEGLMVLVAGTNVVRFTPSLVIDKADVDEGMARLERAIAKLYNK

SEQ ID NO: 6526 - protein, 325 aa, Sphingomonas sp. KA1
MVKTTICGTDLGIWKGKNPEIEQTQIERSGAFNGRILGHEGIGVIEDVGSAVKNFSKGDKVILSCVSRCGTCENCQKQLYAHCRNGGGWIFGYMIDGTQAEYVRVPFADNSLYLLPPELDEDVAVMLSDALPTAHEIGVQNGDIKPGDTVAIIGSGPVGMGCLLTAQLYSPSRIILVDLDDNRLALARDLGATDTINSGAEDAASKILELTEGRGVDCAIEAVGAEATWNICQQVVKEGGHLANVGVHGHPVTFALDKLWIRNLTITTGLVNANTTAMLLKTCCAGKFPMEKLVTHHFAFSELPKAYDVFKNSAAEKAMKVVIDF

SEQ ID NO: 6527 - protein, 786 aa, Arabidopsis thaliana
MQPSRTRVSFFETGETMKQRKKSYLSIFVIFFSLFFFGIFMYNDNLKSSIADFTSSNPFSSSFVELPPDECDLFTGQWVFDNKTYPLYKEEECEFLTEQVTCLRNGRKDSLFQNWRWQPRDCSLPKFNARVLLEKLRNKRLMFVGDSLNRNQWESMVCLVQSVIPPGRKSLNQTGSLTVFKIQDYNATVEFYWAPFLVESNSDDPEKHSIIDRIIMPESIEKHGVNWIGVDFLVFNSYIWWMNTVSIKVLRGSFDDGDTEYDEIKRPIAYERVLRTLGDWVDHNIDPLSTTVFFMSMSPLHIKSSDWANPEGIRCALETTPILNMSFNVAYGQFSAVGTDYRLFPVAENVTQSLKVPIHFLNITALSEYRKDAHTSVYTIKQGKLLTREQQNDPANFADCIHWCLPGLPDTWNEDSRDLKLAKKAYLSLLYFAVILLPVFLLGCYLYNEKQLRVGQFQEFNTHNLQEHITPLQQSKEDKDKKTDLVPLEFCDVFTGKWVLDNVTHPLYKEDECEFLSEWVACTRNGRPDSKYQKWRWQPQDCSLPRFDSKLLLEKLRGKKLMFIGDSIHYNQWQSMVCMVQSVIPSGKKTLKHTAQMSIFNIEEYNATISFYWAPFLVESNADPPDKRDGKTDPVIIPNSISKHGENWKDADYLIFNTYIWWTRHSTIKVLSSDWGFNEGSKCEKETEPILNMSKPINVGTNRRLYEIALNATKSTKVPIHFLNITTMSEYRKDGHTSFYGSINGKLMTPEQKLDPRTFADCYHWCLPGLPDSWNELLSLYIIYKI

SEQ ID NO: 6528 - protein, 605 aa, Rickettsia typhi str. Wilmington
MTSIRNIAIIAHVDHGKTTLVDNMLKQSGTFRANQTVAERAMDSNELERERGITILAKCTALMWNEIRINIVDTPGHADFGGEVERILSMVDGVVLLVDASEGPMPQTKFVLSKALNLGLKPIVVINKIDRDDQRIKEVIDEVFELFVALEANNDQLDFPIVYASGRAGTASLNFDNKINPLDNLSPLFNLIVTHVPTPSADNKAPFSMLVTTREYNPFFGRVLTGRIQSGTVKINQNVKVLNHENKVLETGRITKILAFRGLERIAIDHATAGDIIALAGVENANVADTICAPEVTEAIPSLPIDPPTLSMTFSINDSPLAGSEGTKITSSLIGARLMRELESNVALKVTETANKNAFQVAGRGELQLGILIETMRREGFELSISRPEVLYHTDKTGNKQEPIEEIQVDVDDDYIGVVVKSLALRKAEMTNMRPSGGGKSRITFIGPSRGLIGYYNQFLTETRGTGIINRIFYGYTDYKGPIEGRRKGVLISNCDGAAVAYALWNLEERGKMFINPGDKVYRGMIIGEHNRDNDLDVNPLKAKQLSNVRAVGKDEAIRLTPPMLLTLEQAISYIQDDELVEVTPKSIRLRKVLLNPNDRKRAAQ

SEQ ID NO: 6529 - protein, 201 aa, Schizosaccharomyces pombe 972h-
MKVYINVYDLMPDSPVNKLAWTLGLGIYHTGLVLEGKEYAFGAHEIPGSTGVFATMPRPPLEGCRWRCSIALPNCTLPKPDVDRILIRLSQEFTGLSYSLLERNCNHFTNAAAIELTGSPIPSFLNRISRIGLAFPTITNALLQHGQKNTSDVDDSSDSSSDVDEETLIVSKSKKAHKDIPKFSAPPPSADLNNLITDSLP

SEQ ID NO: 6530 - protein, 304 aa, Kineococcus radiotolerans SRS30216
MSTDSTEQTSGPVVGTARVKRGMAEMLKGGVIMDVVTAEQARIAADAGAVAVMALERVPADIRAQGGVSRMSDPDMIDSIIAAVSIPVMAKARIGHFVEARVLQSLGVDYVDESEVLTPADYTHHIDKHAFTVPFVCGATNLGEALRRITEGAAMIRSKGEAGTGDVSNAVMHMRTIRAELNRLRSMEEDELYVAAKEMSAPYDLVREVAETGKLPTVLFTAGGIATPADAAMMMQMGADGVFVGSGIFKSGNPAQRAEAIVKATTFHDDPDVIAKVSRGLGEAMVGLNVEEIPEPHRLAQRGW

SEQ ID NO: 6531 - protein, 255 aa, Burkholderia vietnamiensis G4
MATWRRHVGGPIMCATLRERFARMSPGQEIHMRIETSFLFDLDGTLVDSVYQHVLAWKEALDAEGIELSVWRIHRKIGMSGGLFLNQLLRETSGDIDADRVERLARLHAAAYQRLRAQVRPLPGARELLAALSNAGIRWAIATSGRMETAAINLEALGVDPAKNVVVTRDQVKYAKPDPDLFLTAAAKLNVQIEHSVVVGDSIWDMLAASRCRALGVGLLSGGYGSDELERAGALRVYDDPADLLRHLDEVAARP

SEQ ID NO: 6532 - protein, 886 aa, Arabidopsis thaliana
METRSKLMLLACATFSIISLVKSQNQQGFISLYCGLPSNESPYIEPLTNLTYISDVNFVRGGKTGNIKNNSDIDFTSRPYKVLRYFPEGIRNCYSLSVKQGTKYLIRTLFFYGNYDGLNTSPRFDLFLGPNIWTSVDVQKVDGGDGVIEEIIHVTRCNILDICLVKTGTTTPMISAIELRPLRYDTYTARTGSLKKILHFYFTNSGKEVRYPEDVYDRVWIPHSQPEWTQINTTRNVSGFSDGYNPPQDVIKTASIPTNVSEPLTFTWMSESSDDETYAYLYFAEIQQLKANETRQFKILVNGVYYIDYIPRKFEAETLITPAALKCGGGVCRVQLSKTPKSTLPPQMNAIEIFSVIQFPQSDTNTDEVIAIKNIQSTYKVSRISWQGDPCVPIQFSWMGVSCNVIDISTPPRIISLDLSSSGLTGVITPSIQNLTMLRELDLSNNNLTGVIPPSLQNLTMLRELDLSNNNLTGEVPEFLATIKPLLVIHLRGNNLRGSVPQALQDRENNDGLKLLRGKHQPKSWLVAIVASISCVAVTIIVLVLIFIFRRRKSSTRKVIRPSLEMKNRRFKYSEVKEMTNNFEVVLGKGGFGVVYHGFLNNEQVAVKVLSQSSTQGYKEFKTEVELLLRVHHVNLVSLVGYCDKGNDLALIYEFMENGNLKEHLSGKRGGPVLNWPGRLKIAIESALGIEYLHIGCKPPMVHRDVKSTNILLGLRFEAKLADFGLSRSFLVGSQTHVSTNVAGTLGYLDPEYYQKNWLTEKSDVYSFGIVLLEIITGQPVIEQSRDKSYIVEWAKSMLANGDIESIMDRNLHQDYDTSSSWKALELAMLCINPSSTLRPNMTRVAHELNECLEIYNLTKRRSQDQNSSKSSGHTVTFISDIPSAR

SEQ ID NO: 6533 - protein, 130 aa, Kluyveromyces marxianus
MTRTSVLADALNAINNAEKTGKRQVLIRPSSKVIIKFLQVMQKHGYIGEFEYIDDHRSGKIVVQLNGRLNKCGVISPRFNVKISDVEKWTANLLPARQFGYVILTTSAGIMDHEEAHRKHVSGKILGFVY

SEQ ID NO: 6534 - protein, 379 aa, Triticum aestivum
MLHLRKLFLSASHVRTPSLSPLSPLHRLLAATAPASPEPFAVEDYLVTTCGLSRPKARKASKKLAHLKSPSKIDAVLAFLAALGISPSGTAAIVAADPQFLCADVELNLAKRVAELTVLGLKRSQIARLIPLARATFRSSSLGPNLAFWLPVFGSFEKLLGAIKVNGGILGADLEKVAKPNLAILQQCGISVQEFSDTYLTRVLTRLPEYVQSAVLYIDKLGVPRDSPMFRYAIMAFAFQSQEKIDRKMGILEMLGWSQDDVLTAVRKMPCILTMSEERMQTAVNFLTRDVGLEIPYIAQRPVLVMYSYERRLLPRHSLLNILNSKDLLYPELDFYSIVALTEKKFLDKYVHPYEKSIPGLAATYASYCAEKVPNEVST

SEQ ID NO: 6535 - protein, 129 aa, Nitrosomonas europaea ATCC 19718
MSKFIIQTNDAPQAIGTYSQAVRVTGGETVYLSGQIGLDPVSMEMVAGVDAQIEQVIANLKAVIAASGGSLGDVVKLNVYLTDLGNFSRVNEIMGKHFSQPYPARAAIGVAALPRDALVEMDAVVVLDK

SEQ ID NO: 6536 - protein, 185 aa, Kineococcus radiotolerans SRS30216
MSDLLVVPDAERVAATVVAGFRDVVDFPQPGVVFKDITPLLADARAFATVVEALAALARASGASAVAGIEARGFMLAAPAAERAGLGFWPVRKAGKLPAPVLRREYALEYGTAALELSAGTVGAGERVLVVDDVLATGGTARAACELLEEAGAQVVALAVLLELAPLGGRPRLGDRPVVALHTQT

SEQ ID NO: 6537 - protein, 228 aa, Zea mays
  misc_feature (184)..(184): Xaa can be any naturally occurring amino acid
  misc_feature (194)..(194): Xaa can be any naturally occurring amino acid
KGSGEVGKKIKFELMPETLYLTMYIIDQYLSLQPVLRRELQLVGVSAMLIACKYEEIWAPEVNDFILISDSAYSREQILSMEKGILNSLEWNLTVPTVYMFLVRFLKAAALGNKVEKEMENMVFFFAELALMQYGLVTRLPSLVAASVVYAARLTLKRAPLWTDTLKHHTGFRGSEAELIECTXRCWSAHTRPXADSKLRSVYKKYSSEQFGGVALRPPAPAVGVCLV

SEQ ID NO: 6538 - protein, 561 aa, Leptospira interrogans serovar Copenhageni str. Fiocruz L1-130
MSEAKELSPVEDIKLNSNNLRGKIAEGLDQNIDTYEEDEKQLLKFHGLYQQKDRDRKKDENGNDIEAPTSFMIRGRIPGGRLTSEQYLVWDELGDKFGGGAIRLTTRQSVQLHTLRIFHLRDVMKAIHEVNLSSMGACGDVVRNVTQAVNPLGKKELQLLDGVSQILSDHFKYKTNAYAEVWLGDKQLNKDEEDPIYGKTYLPRKFKIAVTLAGNNTVDIYANDMGFAATLSSDGNRIDGYFVFAGGGFGMTHNKPETFARAASLLGWVPENALIPVAEAIVTAHRDFGDRTNRKHARLKYVLAEKGVEWFQSEVESRSNVKLDKDKPLPNWETPSYLGWNERQDGTLSLGFHTLAGRIKDFPGKPLKSALKEIIGAYKLSVQITADQDLILIGIQKSDQEKVEKRLEELNVSWKSPSRLYDRALACPALPTCALALTESERSFPEVLNGIQKVLDKLGLSDRAPVVRMTGCPNGCARPYSAEVGIVGQQAGGKYSLFFGADSEGTKVGEYVAKKIALADIPAQLEKAFVLWKNEGDSDEKFGDFVNRFPLERFREALGSM

SEQ ID NO: 6539 - protein, 452 aa, Pseudomonas putida GB-1
MNAPFDQLSTWLKEHRITEVECVISDLTGIARGKIAPTAKFLHERGMRLPESVLLQTVTGDYVDDDIYYNLLDAADIDMVCRPDPTAVYQIPWAIEPTAIVIHDTFDKQGNPIELSPRNVLKKVLKLYADKGWQPIVAPEMEFYLTKRCEDPDLPLQVPLGRSGRAESGRQSFSIDAANEFDPLFEDVYDWCEIQGLDLDTLIHEDGPAQMEINFRHGDALDLADQITVFKRTMREAALKHNVAATFMAKPITDEPGSAMHLHQSVVDIATGKPVFANEDGSMSQLFLHHIGGLQKYIPKLLPMFAPNVNSFRRFLPDTSAPVNVEWGEENRTAGLRVPTSSPEAMRVENRLPGADANPYLAIAASLLCGYLGMVERIDPSAPVQGRAYERRNLRLPITIEDALQHMEDCETVQQYLGKQFVQGYVAVKRAEHENYKRVISSWEREFLMLSV

SEQ ID NO: 6540 - protein, 323 aa, Gloeobacter violaceus PCC 7421
MKAFILAAGKGTRLRPLTNLVPKPLVPVLNRPVMGRMLDLCREHGFCEAMANLHYQGEKIERAFGSGYEYGVDLAYSHETQLLGTAGGVRRQAAYLQGGTFVVTSADVVTDLDFSELLAFHRTRGALATIATTVVSDPSRFGVLVCDPDGRVRSFQEKPAPGTARSNLVNMGIYMLEPEIFDFIPAAEEFDFGSQLFPMLVAKGAPIYALETKAYWSDIGTLSQYLHTHWDLLSQPGLQSRIGRHTVIEPGARISPTALVGDHCYIHSTAIIEGNSCIGDGTILNHGARVLDSVVWSAAAFRLSVADTVVRSVRADDCCIAIS

SEQ ID NO: 6541 - protein, 773 aa, Arabidopsis thaliana
MDEDVEQASLMSFNDRPRAFPNMRSKTYSPLIFRIIRKLNVRVLSIILLFCFGAIFYMGASTSPIIVFVFTVCIISFLLSIYLTKWVLAKDEGPPEMVEISDAIRDGAEGFFRTQYSTISKMAILLAFVILCIYLFRSLTPQQEAAGLGRAMSAYITVAAFLLGALCSGIAGYVGMWVSVRANVRVSSAARRSAREALQIAVRAGGFSALVVVGMAVIGIAILYSTFYVWLGVGSPGSMNVTDLPLLLVGYGFGASFVALFAQLGGGIYTKGADVGADLVGKVEQGIPEDDPRNPAVIADLVGDNVGDCAARGADLFESIAAEIISAMILGGTMAKKCKIEDPSGFILFPLVVHSFDLIISSIGILSIKGTRDASVKSPVEDPMAVLQKGYSLTIILAVITFGASTRWLLYTEQAPSAWFNFALCGLVGIITAYIFVWISKYYTDYKHEPVRTLALASSTGHGTNIIAGVSLGLESTALPVLTISVAIISAYWLGNTSAVATMGMLSTAAYVLTMDMFGPIADNAGGIVEMSQQPESVREITDLLDAVGNTTKATTKGFAIGSAALASFLLFSAYMDEVDIAIPEVFVGGLLGAMLIFLFSAWACAAVGRTAQEVVNEVRRQFIERPGIMEYKEKPDYSRCVAIVASAALREMIKPGALAIASPIVVGLVFRILGYYTGQPLLGAKVVASMLMFATVCGILMALFLNTAGGAWDNAKKYIETGALGGKGSEAHKAAVTGDTVGDPFKDTAGPSIHVLIKMLATITLVMAPVFL

SEQ ID NO: 6542 - protein, 897 aa, Oryza sativa (indica cultivar-group)
MAVGEECAAAVASQGFVSDARAYWVTRSLIAWNVNDQDTSLFLYASRDATMHVSDGAIHGYDSKIELEPEHASLPDNVAEKFPFIRSYRTFRVPSSVDVASLVKCQLAVASYDAHGRRQDVTGLQLPGVLDDMFAYTGPLGAVFSDKDVDLYIWAPTAQDVRVCFYDGPAGPLLQTVQLKELNGVWSVTVPRYRENQYYLYEVKVYHPSTSQVEKCLADDPYARGLSANGTRTWLVDINSETLKPASWDELSDEKPNLESFSDISIYELHIRDFSAHDSTVDCNSRGGFRAFTFQDSAGIRHLRKLSAAGLTHVHLLPSFHFASVDDNKSNWKLVDEAQLAKLPPGSDEQQAAIVSIQQEDPYNWGYDPVLWGVPKGSYASNPDGPSRIIEYRQMVQALNRIGLRVVMDVVYNHLDSSGPFGVSSVLDKIVPGYYLRRNVNGQIENSAAMNNTASEHFMVDRLIVDDLLNWAINYKVDGFRFDLMGHIMKNTMIRAKSAIRSLTRDVHGVDGSKIYLYGEGWDFGEVAQNKRGINASQINMSGTGIGSFNDRIRDSVNGGNPFGNPLQQGFSTGLFLEPNGYYQGNEADTRRELATYADHIQIGLAGNLKDYVLRTHTGEAKKGSDIYTFDGSPVGYTSSPVETINYVSAHDNETLFDIVSIKTPIGLSIDEKCRINHLASSMIALSQGIPFFHAGDEILRSKSLDRDSYNSGDWFNKLDFTYETNNWGVGLPPRDKNEENWHLIKPRLENPSFRPSKNHILSVFDNFVDILKIRYSSPLFRLSTASEIEVQQRVRFHNTGPSMVPGVIVMSIKDAQNEKCEMAQLDKNFSYVVTIFNVCPHEVSIEIHDLASLVLELHPIQVNSSDALVRQSTYEASKGRFTVPRRTTAVFVQPRC

SEQ ID NO: 6543 - protein, 277 aa, Zea mays
MLPVHSTLRSTPPLVISASTSCTGLLWSFGFSINGKPIYHFVGTSTFSEYTVMHVGCVAKINPQAPLDKVCVLSCGISTGLGASINVAKPPKGSTVAVFGLGAVGLAAAEGARIAGASRIIGVDLNPSRFEEARKFGCTEFVNPKDHNKPVQEVLAEMTNGGVDRSVECTGNINAMIQAFECVHDGWGVAVLVGVPHKDAEFKTHPMNFLNERTLKGTFFGNYKPRTDLPNVVELYMKKELEVEKFITHSVPFAEINKAFDLMAKGEGIRCIIRMEN

SEQ ID NO: 6544 - protein, 156 aa, Haemophilus influenzae
NRTNTPVLVDGKDVMPEVNAVLAKMKDFCQRIISGEWKGYTGKAITDVVNIGIGGSDLGPYMVTEALRPYKNHLNMHFVSNVDGTHIAETLKKVNPETTLFLVASKTFTTQETMTNAQSARDWLLKAAKDESAVAKHFAALSTNAKDVEKFGIDTN

SEQ ID NO: 6545 - protein, 304 aa, Ralstonia solanacearum GMI1000
MDYQAILETIHRDIQPWLGKGRVADYIPELAKASATDFGMAIVTPRGEVFRVGQAETLFSIQSISKLFACTLAFQLEGESLWQRVGREPSGNAFNSLVQLEHENGIPRNPFINAGALVVTDVLCRRFVQAETAMVQFMRRLVDNPRVDYNPRVALSELEHADRNRAMAHFMRSFGNLHMPVETVIDAYCRQCAIEMHCVDLARAVLFLANGGVVPWSGERVIETSPAKRLSALMLTCGTYDAAGDFVYRVGLPAKSGVGGGIVAVLPGEFGVCVWSPGLDVSGNSLAGLQALEWLTTLSGRSIF

SEQ ID NO: 6546 - protein, 156 aa, Haemophilus influenzae
NRTNTPVLVDGKDVMPEVNAVLAKMKDFCQRIISGEWKGYTGKAITDVVNIGIGGSDLGPYMVTEALRPYKNHLNIHFVSNVDGTHIAETLKKVNPETTLFLVASKTFTTQETMTNAQSARDWLLKTAKDESAVAKHFAALSTNAKDVEKFGIDTN

SEQ ID NO: 6547 - protein, 630 aa, Listeria monocytogenes str. 4b H7858
MARYKRLKGYDVFYLTGTDEHGQKIQAKAKERGISEQEYVDEIAEGFQELWKKLEISNTDFIRTTQDRHKTSVEKIFEQLLEQGDIYLGEYEGWYSVSDEEYFTETQLEEVYKDENGKVIGGKAPSGNEVELVKEESYFFRMSKYADRLVEYYNSHPEFILPESRKNEMINNFIKPGLEDLAVSRTTFDWGIKVPGNPKHVVYVWIDALSNYITALGYNTDNDTKFQKYWPADVQIVGKEIVRFHTIYWPIMLMALDLPLPKMVFGHGWILMKDGKMSKSKGNVVDPYMLIDRYGLDALRYYLLREVPFGSDGLFTPEDFVDRVNFDLANDLGNLLNRTVAMINKYFDGEIPAYQGNVTEFDQTLVDFKNNVVKEYEGSMDHMQFSVALNQLWSLISRTNKYIDETAPWTLAKDEDKRTELASVMTHLAENLRIIAVLLQPFLTRTPGEIFLQLGLQEENLKKWDSIYGYGEIPAGTTVVKKGTPIFPRLEAEVEVTYIQDEMKGSAPAPAKEAAEVEALETPQIGIEDFDKIDLRVAEVKQVDKVKKADKLLCFQLDLGEGKLRQVLSGIAEFYQPEELIGKKVIVVSNLKPVKLRGLMSEGMILSGEKDGKLSVIEASSALPNGAKVK

SEQ ID NO: 6548 - protein, 1151 aa, Oryza sativa (japonica cultivar-group)
MGVPEAVALEIPAAAEAEEEVEEEEGSPSPPVVARVPPRIRRRLLLRHRGGAPATAEEIEAKLRDADLRRQQFHEALSCKARCTVRYPSCPSQEEDPKKRLEAKLVAAEQKRLSLLAKEQSRLAKLDELRQAAKNDAELRFKKEREELGMKVESRVRQAEEKRTQLMHARSQRRAALEERTTKYLVQRVAWENKYRERVHSAILQKRTAAEKRRTGLLEGEKRRAQGRFSQVQLAARTLSCQREADRSKLKEQLEDKLQRAKRQRAEYLKQRGSTHSFTYTASVKHGDFLSRNLARCWRRFITSRKTTVVLARAFDMLRINEESVKPMPFEKLALCIESPTVLQTTRAFLDRLESRFTLSQSSSPSSPENIDHLLKHLGSPKRTLSKSGGRTRVTPTKAARNSDVSKLPRYSPRIVLCAYMILGHPSVVFNERGEREKLLVESAENFVKEFELLIKTILDGSSGACILKQPILDDLSPGSSNYQESSAVVADRKKFRSQLASFDKAWCAYLYHFVVWKAKDAKSLEEDLVRAACKLELSMMQTCKFTAEGQPENLNDNLKAIQKEVMVDQTLLREKVRHLGGEAGIERMEVALSEARTKFFEAKGNRSPLATTIKNVAATCSSGESPISDMKENSNINDKRPSQAVQSMFRVPSSPSESNTAGITMSNPMTVSSTLSEKRPTENEQMVNEILHGFLADSSSNIGTVEGGFKEKVRETMEKAFWDVVVDSLRGDMPDYSYLVQLVKEVRDTLYEMVPKGWKEEIINNIDLEILLQVLESGTQDMQYLGQILQYSLGMLRKLSSPAKEDEMKRSHDKLLGELTEHSECNNSGSNSFVIAVIKGLRFTMEELKALKTEVSRARIQLLEPIIKGSGGVEYLQKAFADRYGFPSNASVALRSTAQWISTSKDTVEVEWNEHAQPFVATLRSGHGVPDQRQSTIPVSDDTGLPECTGQRLDQLIRIGLLQLISGIEGVQMQSVTETFKLNWLRLSMLVQRQVLATDDPNITPTELESATSQLFNTLAELLDNFPDVSTAKIMEVMLRSSSSSSSGSTTGSPSDERTESRKQILARVFLKSLQTDDPVFKKVSRSVYCAFRAITLGGSGARGRKLADAALRRIGATKLTDRVVRSAEILIRAASISQQVHGPWYNHLV

SEQ ID NO: 6549 - protein, 272 aa, Photobacterium profundum SS9
MKPVLKMSLLAATILLAVGCQDEKTTETTPAEPAKVEQVAAEATSEKAAEAFASEDQKSAYAIGASLAQYLSANLDQQKELGLELNSDDVLAGVSDVFANKSRMTPEETQQALQDLDKRVSDIVAEKAKVESEQSIKAGEEFRAEFEKQEGVAKTESGLLYQVEKPAEGEKPAATDTVQVHYKGTLTDGTEFDSSYKRNQPATFPLNQVIPGWTEGVQLMPVGSKFKFVIPPELAYGSQANPSIPANSTLVFEVELLQIVKADKPVTELETQ

SEQ ID NO: 6550 - protein, 457 aa, Pyrococcus abyssi GE5
MDYPRIVVNPPGPKAKELIEREKRVLSTGIGVKLFPLVPKRGFGPFIEDVDGNVFIDFLAGAAAASTGYSHPKLVKAVKEQVELIQHSMIGYTHSERAIRVAEKLVKISPIKNSKVLFGLSGSDAVDMAIKVSKFSTRRPWILAFIGAYHGQTLGATSVASFQVSQKRGYSPLMPNVFWVPYPNPYRNPWGINGYEEPQELVNRVVEYLEDYVFSHVVPPDEVAAFFAEPIQGDAGIVVPPENFFKELKKLLDEHGILLVMDEVQTGIGRTGKWFASEWFEVKPDMIIFGKGVASGMGLSGVIGREDIMDITSGSALLTPAANPVISAAADATLEIIEEENLLKNAIEVGSFIMKRLNELKEQFDIIGDVRGKGLMIGVEIVKENGRPDPEMTGKICWRAFELGLILPSYGMFGNVIRITPPLVLTKEVAEKGLEIIEKAIKDAIAGKVERKVVTWH

SEQ ID NO: 6551 - protein, 708 aa, Burkholderia vietnamiensis G4
MPSALPARLEPGRCYPLGATWDGLGTNFAVFSAHAHRIQLCVFDPTGRKELARLDLPECTDEVWHGYLPNAHPGTVYGFRADGPYQPQQGHRFNPTKLLLDPYARKLVGHFRWSDALFGYRVHSNRSDLSMDRRDSAPAMPKAVVVDEAFDWSTDRRPDVPWRNTVIYETHVRGASMRRAGLRAPERGTFASLAHPAFIDHLLSIGVTTVELLPVHAFLQQRALVNRGLRNYWGYDTAAFFAPEPSYLSTRRLDEMRIAIRQLHAAGIEVVLDVVYNHTCEGNELGPTLSWRGLDNASYYRLRQDDPRYHVDETGCGNTLNMSHPRVVQMVMDSLRYWATAFNVDGFRFDLGVTLGREDHGFEPGSGFFDALRQDPILAQRKLITEPWDLGPGGYQLGRHPPGFAEWNDRFRDTVRRFWRGDAGQRPELAARLAGSADLFNHQRRRTWASVNFVTAHDGFTLADLVSYEHKHNDANGEDNRDGRDDNCSANWGAEGPTDDPAIRDLRARVARSMLATLFTALGTPMLVAGDEFGRTQHGNNNAYCQDNELSWLDWELARGDEGTQMIRFVSRLAAMRRMYPVMSAPHYPSGDRDGAPGMREIEWFDERGEVLSVPAWEDGERRALTMRRVGTGRTGRTEALLVMLNASADAITFQQPAPALEYRVLLDTATPDAGPRSWPDSGVEVAAHAAVIAVAAVPPDLSTKEPS

SEQ ID NO: 6552 - protein, 225 aa, Magnetospirillum magnetotacticum MS-1
MVYHHRGAALLSLGNVITAGLPQHAVYLWTLPMFHCNGWCFPWTLSVVAGTHVCLRQVRAPAMYAALAEHGVTHLSGAPIVMSTLLNASEEQKRPLPRRVHFLTAAAPPPEAVLAAMGEAGFDVTHLYGLTETYGPAVVNAWHEEWDALPPEARAKKKARQGVRYPVLEGLDVRDPETMASLPADGTSLGEVMFRGNVVMRGYLKNPASTQAAFKAAGSAPAISG

SEQ ID NO: 6553 - protein, 232 aa, Zea mays
MEYAAVGYGYGYGYDERQEPAESADGGGGGDDEYATVLSAPPKRPAGRTKFRETRHPVYRGVRRRGPAGRWVCEVREPNKKSRIWLGTFATPEAAARAHDVAALALRGRAACLNFADSARLLQVDPATLATPDDIRRAAIQLADAASQQDETAAVAADVVAPSQADDVAAAAAAAAAMYGGGMEFDHSYCYDDGMVSGSSDCWQSGAGAGGWHSIVDGDDDDGASDMTLWSY

SEQ ID NO: 6554 - protein, 237 aa, Aeropyrum pernix K1
MGGCDPMDEAARGALDLLGRIGGELGVLGVGTGRTVMRFLREASARGVEPGVAVPSSFETAVELAGLGWSVGDPRVYRGVNVYVDGADEAEPGRGYMVKGGGGALLGEKILSSRSKLNIFIVGEDRLVGRLGEKTPVPVEVEPGFVSMVLASLEELGLNPRVRTSPGKRGPVVSDWGGVIVDLLTGPLEDPRGLESMLRNVPGVRETGLFLGLADYIVVGLSSCGYRVLGPYRGRAV

SEQ ID NO: 6555 - protein, 302 aa, Glycine max
MVTKTEETQLNRLENQVDNGGGGAWEYLCLVRKLKVRRSEKVLKHGLSILNDLKQRSSLGSDEWTLYEQVAVAAMDCQCLDVAKDCTKVLRKRFLESKRVGRLEAMLLEAKGSWELAEKAYTSLLEDNPLDQAIHKRRVAMAKAQGNISVAIDWLNKYLETFMADHEAWRELAEIYISLQMYKQAAFCYEELILSQPTVPLYHLAYADVLYTLGGLENLQTAKKYYSSTIDLTGGKNTRALFGICLCTSAVTQLTKGKSKEDKEGSQLQSLAAKVLEKDYKQRAPDKLPQLTTALKSLTLSS

SEQ ID NO: 6556 - protein, 221 aa, Triticum aestivum
  misc_feature (139)..(139): Xaa can be any naturally occurring amino acid
  misc_feature (197)..(197): Xaa can be any naturally occurring amino acid
MEEDLQALVVDNGSGMCKAGFAGDDAPRAVFPSIVGRPRHQAMMVGAGDKDSFVGDEAQAKRGILTLKYPIEHGIVTNWDDMEKIWHHTFYNELRVAPEEHPVLLTEAPLNPKANREKMTQIMFETFNTPAMYVAIQAXLSLYASGRTTGIVMDSGDGVTHTVPIYEGYALPHAILRLDLAGRDLTEYLQKILTERXYAFTTTAEREIVRDIKEKLCYIAL

SEQ ID NO: 6557 - protein, 484 aa, Listeria monocytogenes EGD-e
MEHNKLKPFPKDFLWGSASAAYQVEGAWDEDGKGPSVWDEFVRIPGTTFKETNGDVAVDNYHRYKEDVALMAEQGLKAYRFSVAWSRVIPHGNGEVNEAGLKFYDNLIDELLSYGIEPVVTLYHWDIPQGLQDEYGGWESRKVVEDFTNYAALLFERFNGRVKYWVTLNEQNVFISHGYKLAYHPPGVSDDKRMFAANHNANLANASAIAKFRELGTSGKIGPSFAYGPSYSIDANPANVLASENSEEFNAHFWMDVYTWGEYPTATWNWLEEHGLAPEILPGDTELLKKGKPDFMGVNYYRSMTHAFNGKDGVGSGKMNTTGEKGTSEETGVPGLYKNTNNPYLEKTNWDWDIDPTGLRIGLRRITNRYKLPIMITENGLGEYDSLTEDHKIHDEYRIEYIRAHALAIQEAITDGVEMLGYCTWSFTDLLSWLNGYQKRYGFVYVDRDENDEKELKRYKKDSFYWYKKTIEANGANLVEEQGK

SEQ ID NO: 6558 - protein, 194 aa, Solanum lycopersicum
NLLLTEDKTTIKLADFGLAREDAEAEMTTEAGTYRWMAPEMFSMDPIRVGVKKYYNHKVDVYSFSMILWELLTNSTPFKGRSNIMVAYATATKMRPSLENIPSEIEPLVSSCWAEDPAERPEFEQISDFLANILGNVCGSPSCSPNLFDTEHPTGNELVNSPVTNCLMEKDAENSKKKHRSSCCCFMSAYDNSL

SEQ ID NO: 6559 - protein, 156 aa, Haemophilus influenzae
NRANTPVLVDGKDVMPEVNAVLAKMKDFCQRIISGEWKGYTGKAISDVVNIGIGGSDLGPYMVTEALRPYKNHLNMHFVSNVDGTHIAETLKKINPETTLFLVASKTFTTQETMTNAQSARDWLLKAAKDESAVAKHFAALSTNAKDVEKFGIDTN

SEQ ID NO: 6560 - protein, 374 aa, Schizosaccharomyces pombe 972h-
METDPILKVEREPEFTPSPAPEAIVKDIEQGVAPVSQNEPDRPQHWITRVVIIVLIVLAWYFFSLLLSMMNKWIFSESKMDFQFPLFLSSCQMLVQMGFAKLTILAFPRYQPNKKDNFSWLEYFYRAGICALVTGLDIGLSNASLETITLSFYTMCRSSILIFVFFFSVIFRIEMFDWILLCITLVISAGVVLMVATETQFVLSGFLLVMASSVLSGLRWALTQKLLLDHPWTSNPFTSLFALTPLMFLFLLVAGLIFEGPVRFIESPAWKEFGPFMSVVILVPGTLAFFMVASEFGLIQKTSIVTLSVCGILKEIITIIASTLFYHDILLPINIVGLVITLCGIGVYNYYRITKGNKKEAEKEVEYIVLNENA

SEQ ID NO: 6561 - protein, 407 aa, Sphingomonas sp. KA1
MITYDVVIVGAGHGGAQAAIALRQRHFEGSIAVIGEEPDLPYERPPLSKDYLSGKKAFERILIRPATFWEERGVRMLTGRRVAAVNPAAHTVSTDDGESFGYGRLIWAAGGRPRRLTCTGHDLAGVHQVRTRADVDQMIVELPETARVAVIGGGYIGLEAAAVLAEMGKHVTVLEAQDRVLARVAGEALSRFFEAEHRAHGVDVRLGAAVDCIEGRDGRAVGVRLADGTLVAADMVIVGIGIVPAVEPLLAAGALGMNGVQVDEHGRTSLPDIFAIGDCALHINAFADNLPIRLESVQNANDLATTVARTLTGDPEPYVSVPWFWSNQYDLRLQTVGLSAGHDAAITRGNPVDRSFSIVYLNQGRVIALDCVNAVKDYVQGKALVATRVAASPEALSDPALPLKAFV

SEQ ID NO: 6562 - protein, 1436 aa, Schizosaccharomyces pombe 972h-
MENILDPSVVNSHILENGSRRSSINPILDSELRDKTFEKAHRRSLTLLSSFTSSMLELPNNGKEENHRRPSVARSSSDRSKASAKEDLFSEAFRMAEQPPAEALTISTPVDPINIDELDRAYAVSPSDTSNLLHPPTSSSSIPIPIKNAGHSNLDHPIRPSLQSSISSNRIIKSPGIKEDDYMHRGRSISSPMIDVEHINSTAVPSKTKNLPEKPKRSHKLRNSITFAKIEDHPERKSQLRRLSSSLKCFDPEYDYNDPSLSIRRDSSTYYFSNVNETYDEEDSDLDSETSTVNWVQSVLNLPSLLSDDLMANPKNKERFEWQYMLTSVLTGDIVRSEKLRLRKIASSREGRNSDYSDNLWMEIWCWLTHRSVDSYRENLKHLRTGMVDVLLAIMNFHWDESNELTPIVAVDNMLQKLDKYERLYPSRRSILQEHSLYASESFQHKLDVLTAYSNVTHALEIQVNIIRSWVGNEEMDITKNTTNSINNVSQISNGPFVERFYRETGLIRAFEQRIMTNMNSVLSKVCNTIVTYADDLKSYGLPLIADDYMRLLSFPFRLIKEFLNLRLSCAENITSISLFTIDSLLDDLRNTMKVAVHIIQQHTVLIKPFRDDSKFVDENQSLNNILVASLKFYFNLLHRKVRNGCALLHFKETEILEGEWDFLLAVCPHIEHGFQIMSKSLSSLVGEILTNINRYLKDQLQGPDTDDSALITSFYIKVLDCVRIRFRKLMSFTRILKAHLENSCEYVIKENSLSLLIQRLEESNHVLTYTASIEHEGAYVIVPGHLVDSPNILREVLSMTFNKGDNNFESVPPYAVVLAPDSSICWNGHVTDLDIPEVSISIAPNCVRLVTLATANQLSVIEDYFISIVGDTVSLVDSAKANSSKINKQMTKIKRNSLKLALSLLDVIQTIRTRYHGMNCQNLIHYSFSYAIEFAQRLMRLSILDASSIGLIRRKMIQLAISWVGFIYEDCSPTDRNTFRWTVTALEFAMIMTYGSNILMIDKKSFEELKEKVGKCVALLLLHFDVMGTKHAGRSMDQQAGDIPARLVRNNSDRSRLSDNELASFVKEEVMHRIIELESNRRDRLYKSQLIGRVLDDTTKENRLLKELASSKSNITIRWQQGGLIGSGSFGTVYRAVNLDTGDLMAVKEVALHKPRISRPMIKRIKGEMLVLELFDHPNVVSYYGIEVHREKVNIFMELCQGSSLFEFLRYGRIEDELVIQVYVLQLLEGLAYIHSCGVSHQDVKPENILFDHNGIMKFTDFGSAKMSGSASTKIFEQLTQQEEEEFEKDSEFLQHLDQNRGYSLTGTPTYMAPELILGNPSERVGAMDIWSLGCVIVEMATGSPPWPRLDNHFSLMYHIAAHNPPIIPADDQLSPLGQNFLKRCFVSDPNQRATAAELLMDPWVYPLRAGTEFDLMNSSVVESAPSTNGAPLEL

SEQ ID NO: 6563 - protein, 432 aa, Pseudomonas fluorescens Pf-5
MTHRIVIVGGGAGGLELATRLGKTLGKRGTASVMLVDANLTHIWKPLLHEVAAGSLNSSEDELNYVAQAKWNHFEFQLGRMSGLDRQRKKIQLAATYDEEGVELLPARELGYDTLVIAVGSTTNDFGTQGAAQHCLFLDTRKQAERFHQQLLNHYLRAHAGQTDAVEQISVAIVGAGATGVELAAELHNAAHELAAYGLDRILPENMHITLIEAGPRVLPALPERISGPVHKTLEKLGVKVLTNASVSEVTADSLITADGQTIPASLKVWAAGIRAPGFLKDIDGLETNRINQLQVLPTLQTTRDENIFAFGDCAACPQPGSDRNVPPRAQAAHQQASLLAKSLKLRIEGKDLPTYKYTDYGSLISLSRFSAVGNLMGNLTGSVMLEGWLARMFYISLYRMHQMALYGVFRTAMLMLGSRIGRGTDPRLKLH

SEQ ID NO: 6564 - protein, 248 aa, Daucus carota
MVKLAIGSVGDSFSAVSLKSYLAEFIATLLFVFAGVGSAIAYGHLTADAALDPAGLVAIAIAHAFALFVGVSMAANISGGHLNPAVTLGLAIGGNITIITGLFYWIAQCLGSTVACFLLKFVTAGKAIPTHGVGAGLGAAEGVVFEIVITFALVYTVYATAADPKKGSLGTIAPIAIGFIVGANILAAGPFSGGSMNPARSFGPAVASFDFSGHWIYWVGPLIGGGLAGLVYGDVFIGSYAPIAEDYA

SEQ ID NO: 6565 - protein, 680 aa, Oryza sativa (japonica cultivar-group)
MAPPPPSPPCRPRVKPERALLCFSLLLLLTATTANASITDCPTTSSTNSSHVDDGAFGANLRALLSSLSAAAAASSSGFAENATGAAPDTAYGLAQCRGGIVGGGNGTSCRSCLDDSVRDAAKACPGEKSAVIISDYCLVRYSNASFAGAADERTVKLWWNTDNATQPERFKSLLGTLMGNLTDAAARASSPLMFAAGETDLPPFTKIYGMAQCTRDLAAGDCYRCLVGAVNNIPKCCDGKQGGQVITRSCSIRFEVYPFFDAQAAKAAMSPAPAPAPVTTPTGVNGSNHTVSKSVIVPVTVGVAVLLVVILLLIALCLCKRNRKPHKHMMIGSVDLGDEDEMRGSESLLYDLSTLRAATANFSEENKLGEGGFGPVYKGTLQNGQEIAVKRLSATSHQGQLEMKNEVVLVAKLQHKNLVRLLGCCIEEREKILVYEFLCNKSLDTILFDTSRQQDLNWEQRFKIIEGIGRGLLYLHEDSRLKIIHRDLKASNILLDVDMNPKISDFGLAKLFNMEASVANTSRIAGTYGYMAPEYALHGIFSAKSDVFSYGVLLLEIVTGRRNTCLHDSEDLLAFVWRHWSRGGAGELLDGCPAAGRRPQELLRCIHVGLLCVQEDPQLRPGMAAVVVMLNSRSVTLPAPSAPAFVSASRGIGGSPPPAAAAGDAPARSTDHEVPTAAR

SEQ ID NO: 6566 - protein, 364 aa, Pseudomonas putida
MPAHSFRIAAIPGDGIGLEVLPEGIRVLEAAALKHGLALEFDTFEWASCDYYLQHGKMMPDDWAEQLKQYDAIYFGAVGWPDKVPDHISLWGSLLKFRREFDQYVNIRPVRLFPGVPCALANRKVGDIDFVVVRENTEGEYSSLGGIMFENTENEIVIQESIFTRRGVDRILKYAFDLAEKRERKHVTSATKSNGMAISMPYWDKRTEAMAAHYPHVSWDKQHIDILCARFVLQPERFDVVVASNLFGDILSDLGPACAGTIGIAPSANLNPERNFPSLFEPVHGSAPDIFGKNIANPIAMIWSGALMLEFLGQGDERYQRAHDDMLNAIERVIADGSVTPDMGGTLSTQQVGAAISDTLARLD

SEQ ID NO: 6567 - protein, 623 aa, Oryza sativa
LVLPYYHRPTESQHLRVQVIFFSPDIRIGKKYSSILLHAKKGETREVVEGKVDWRGRPAIRGSHGGVANSFFILVNFGLENLASLSLAVNLIIYFMTVMHIGLTDGSNLLTNYMGTSYMVAVLISVFADTFIGRYKTVIISSVIELVGLLILTLQAHSNKLKPPYCVFPFDPKCETVSGDGRTHLYVGLYLVAIGSAGIKAALPAHCADQFDEKHPTEKLQMSSFFNWLLLSLCTGGAISVTVFVWIQSYKGWDKGFGAATGVMGLALLVFIAGLPGYRISVVQGSTALLEILQVYVAAIRNRNMKLPENPDELYEISKSKAPPDTDFMAHRDKPFRFLDKAAIVQAPTDEAPSPWRQCRVTQVEHAKTVLAMVPIFCSAIIMSTCLAQLQTFSIQQGVTMDRTIGTFKMPPASLPIIPLIVLVFAVPIYERGFVPFARRITGHPNGIPHLQRVGVGLVLSIVSMAIAAVVEVRRKRVAARHGMLDANPILGKQLPISCFWLAPQFTVFGVADMFTFIGLLEFFYSQAPPALKSMSSSFLWCPMSLGYFLSTIIVKAVNAATRGATASGGWLAGNNINRNHLDLFFWLLAVLSFLNFLNYLFWASWYKYKPQQSAHVPAEHKV

SEQ ID NO: 6568 - protein, 504 aa, Nitrosomonas europaea ATCC 19718
MRFFRLLKIILIAFRFGLDEILFTQVRLRILKVFSALLPFRSRLQLPRAVRLRLALETLGPIFIKFGQMLSTRRDLLAQDFAEELALLQDRVPPFPSEQAVQILETVYGRPVHEVFLEFDIKPVASASVAQVHYAVLHDGTRAAVKILRPTIAPVIAHDVALMETGAWLLESIWPDGKRLKLREVVAEFARHLGDELDLIREAANCSQLRRNFLDSPLLLVPEVYWDYCHTEVMVMERVVGTPISHVASLRTQGIDIPQLARMGVEIFFTQVFRDGYFHADMHPGNIFVGSDGRYIAVDFGIMGSLSDQDKNYLAQNFLAFFRRDYRRVAQTHIEAGWAPRNTRVDDFESAIRAVCEPIFDRPLKEIYFGRVLLRLFQASRQFNVEIQPQLVLLQKTLLNIEGLGRDLDPDLDLWKTAKPFLENWMAEQVGLRGLVTHLQKEATNWAVILPQFPRLLHYNLSQERAQNLEDRLAQLVAQEKRQSRLLMLLALLLAGLLLAQIYL

SEQ ID NO: 6569 - protein, 449 aa, Oryza sativa (japonica cultivar-group)
MATRHQRAAAAPQPANRGAAVAAGKQKAAATAAAGRPGARNRQALGDIGNVLNAHVVDGKIQLPEGINRPITRSFGAQLLKKAQENAVAANKIVVQNPARKEPAPKPAKKVVPRPENAAKASTGAGVNENKKPSESEGAGSSSGGSALKYSRKKVVNTLTSVLTARSKHACGITEKPKEVVEDIDKLDGDNQLAVVEYIEDIYNFYRTAQLERRPTDYMSSQVEVNPKMRAILADWIIDVHYKFELMPETLYLTMYVIDRYLSLQPVLRRELQLVGVAAMLIASKYEEMWAPEVQDLIHVCDNAYSRQHILAMEKNILNRLQWNITVPTPYVFLLRFIKAAGGDKELENMVFFFSEMALKEYGMASLCPSLVAASAVYAAQCTLKRSPLWTSTLKHHTGFTESQLRECAKVLVNAHAAAPESKLKTAYRKYASEQLGRVSLRPPAVCLA

SEQ ID NO: 6570 - protein, 315 aa, Zea mays
  misc_feature (299)..(299): Xaa can be any naturally occurring amino acid
MYSLVFKLFLFLSLLQISVSARNLASQEPNQFQLLKYHKGALLSGKISVNLIWYGKFKPSQRAIISDFITSLTHTSPTSKTLHQPSVATWWKTTEKYYKLATPSKNSSPLSLTLGKQIIDESCSLGKSLTDKKIQTLASKGDQRNAINVVLTSADVTVTGFGMSRCGTHGHARGLGKRGSKFAYIWVGNSETQCPGQCAWPFHAPVYGPQSPPLVAPNNDVGLDGMVINLASLLAGTATNPFGNGYYQGPQNAPLEAASACPGVYGKGAYPGYAGDLLVDTTTGGSFNAYGANGRKFLXLPALYDPTTSACSTMV

SEQ ID NO: 6571 - protein, 203 aa, Debaryomyces hansenii CBS767
MDKSNILRKYKIVFLGDQIGKTSLITRFMYDTFDDQYAATIGIDFLLKTMYLEDNKTIRLQLWDTAGQERFRSLIPSYIRDSHVAVICYDITNKKSFENLNKWIQDVKLERGDDVIIVVVGNKSDLNNKRQVTMEECEAYLKSINGKFCIETSTKANHNVKQLFKKIASSLPDVEKSTKDETTQPETVDINIEQPKVENNSCC

SEQ ID NO: 6572 - protein, 169 aa, Oryza sativa (indica cultivar-group)
MRSSRCFLGTAKVIVTGNNRTKSVLVGLQGVVKKAVGLGGWHWLVLKNGVEVKLQRNALSVLEPPTGNEDDDDIDGNNSFCSSSDMGDKDMDYCKHEPQSIKGTALPWGPAAFSVSVKILYIFDMEINFWVGSWWTGSMEGEACGGVASGSVQLSIDGWMEWTTGVRKR

SEQ ID NO: 6573 - protein, 304 aa, Trifolium pratense
MEFWGTEVKSGESLKVEPEDDKIIHLSAACLGEVSKDKGGEPVSLYVKIDNQKLQLGTLSSEKIPQISFDLVFEKEFELSHNWKYGSIFFTGFKMESLLVSDDDEDSDDSIEEDNPVNAANGKPEVEVKNGAKPGVNEAQQNKTSDPKKKQKDIENDVSADDEEDSSETDSDEDSSEDEPVANGQIESSDDEDDSEEDDEDSDDEETPKKTEGGTKRVAESSKKTPVAVKRAKFATPEKTGSKNGVHVDTPYPKQTVKSGANNKPPMKQQTPQSTGDYSCKPCKRSFKTEDALGSHNRAKHSAK

SEQ ID NO: 6574 - protein, 364 aa, Shewanella sp. MR-4
MSYQIAVLAGDGIGPEVMAEARKVLKAVEARFGLNIEYTEYDVGGIAIDNHGCPLPEATLKGCEAADAILFGSVGGPKWEKLPPNEQPERGALLPLRGHFELFCNLRPAKLHDGLEHMSPLRSDISARGFDVLCVRELTGGIYFGKPKGRQGEGESEEAFDTMRYSRREIARIARIAFEAARGRRKKVTSVDKANVLACSVLWRQVVEEVAVDFPDVKLEHIYIDNATMQLLRRPDEFDVMLCSNLFGDILSDEIAMLTGSMGLLSSASMNSTGFGLFEPAGGSAPDIAGKGIANPIAQILSAALMLRHSLKQEEAASAIERAVSKALNSGYLTGELLSSDQRHKAKSTVEMGDFIADAVKAGV

SEQ ID NO: 6575 - protein, 214 aa, Clostridium perfringens ATCC 13124
MIKAVLFDLDGTLINTNDLILKSFKHTFKTMLDLEPSEEEITMNYGRPLQEIFKSYDENRIEEMINCYRKINLELHDDECKEFAGVDLMLKTLKSKGIKIGVVTSKKSDMAERGAKLMGIFKYFDTFITPEITTKHKPDGEPVLKACENLGVSPSEALMVGDSPYDILAGKNAGAKTCGVKYTALPLEKLGESEPEFYVDKPLEILDLVEKLNS

SEQ ID NO: 6576 - protein, 892 aa, Symbiobacterium thermophilum IAM 14863
MRVSYNWLKDYVKVGLSPQELAERLTARGVVVENVVRANPGVEGVVVGRVVAMERHPNADTLWVCQVDVGGGRVLQILTGAQNVTVGALVPAAVPGAKLPGGVTMGVKKLRGLDSHGMLCSEAELQVGDDADGILILPPEPGLEPGMDVAEVLGLNDWIFELDLTANYAAHCQSMLGVAQEVAALVGGEVNRPSTYTPDAPGTDVRNLIAVQIDAPDLCSRYVARVVRGVKIGPSPLWLQARLRAAGMRPINNIVDIANFVMLETGQPLHTFDYAQIRGQRIIVRRARTGERFTTLDGQERVMDESVLVIADAERPVALAGVMGGEDSEVTDQTADILIESAHFDNINNRRTSLRYNLPSEASKRFTKGVDPSGCVAAADRAAQLMAELAGGTVVAGHVDVCPRPAVPPVILLRTERANALTGLKLTPERMAEHLRSLGMAVLTPADLAADLALGAPESDEEPGEDLGGHPVWTALHQVSPVPSDPVVYRTWAEAAWAEVEDAGSRLEALLGGGESDGKAAASGEGVSPGGASDGILVVVVPTRRSDVAVEVDLIEEIARCEGYDAIPLELPVLSSHRGGRSRQGEVKLAARRALAAAGLTEVLTHSLTHPRVYDMLALPEDDPNRRCLALANPMYEDRSTLRTMLLPCLLDVVRYNANRQVRDLAIFEISHVYRPVEGEQLPDEPLMIGLAMTGNLAPLGWNSPERPADFFALKGVVEHLLAELGVPDARFERSAHPSLHPGRQAALVVGGKPVGLLGELHPQVQERWELPGRVYVAELAFAPLMEAMLPQAVYRPVPRFPAVTRDVAVVVDLDLTAHRLETAIREAGGDLLEEVRLFDVYQGERVAEGRRSLAYRLVYRAADRTLTDEELEPVHNRVREALKALGAELRS

SEQ ID NO: 6577 - protein, 496 aa, Pisum sativum
MAATGVLAEIIDGDVYKYYADGEWKKSTSGKSVAIINPTTRKPQYKVQACSQEEVNKVMDSAKSAQKSWAKTPLWKRAELLHKAAAILKEHKAAIAECLVKEIAKPAKDAVTEVVRSGDLVSYCAEEGVRILGEGKFLVSDSFPGNERTKYCLTSKIPLGVILAIPPFNYPVNLAVSKIAPALIAGNSIVLKPPTQGAVAALHMVHCFHLAGFPKGLISCVTGKGSEIGDFLTMHPGVNCISFTGGDTGIAISKKSGMIPLQMELGGKDACIVLEDADLDLVAANIIKGGFSYSGQRCTAVKVVLVMESVADALVEKVKVKVAKLSVGPPEDDSDITPVVSESSANFIEGLVNDAKEKGATFCQEYKREGNLIWPLLLDNVRPDMRIAWEEPFGPVLPVIRINSVEEGIHHCNASNFGLQGCVFTKDINKAIMISDAMESGTVQINSAPARGPDHFPFQGIKDSGIGSQGITNSINMMTKVKTTVINLPSPSYTMG

SEQ ID NO: 6578 - protein, 319 aa, Gibberella moniliformis
MSANYWHSTQCRFWSFTKEQLVTMRQKLEEDNAELVRMFPLPQQRRLYIYFNQQLIRLAKRLTIRQQSMATAQVYMKRFYSKVEIRRTNPYLVIATAIYLACKIEESPQHIRLIVTEARQMWGDLVAIDTSKLGECEFFMISEMRSQLIVFQPYRTITALRNELSLVDDEVQLARSVINDHFMTDLPLLYPPHIIAMVAILLALVLRPNNSGPGQSTSGAAAAAGLAAAQQALMRAQGQQAQGGMPEPAAAEPKEKRQQDRVSRVQKFAKWLVDSNVEIASMVDATQEIISFYECYEHYNDKLTREQINRFVKARGLDK

SEQ ID NO: 6579 - protein, 144 aa, Myxococcus xanthus
AIERTLSIIKPDGLEKGVIGKIISRFEEKGLKPVAIRLQHLSQAQAEGFYAVHKARPFFKDLVQFMISGPVVLMVLEGENAVLANRDIMGATNPAQAAEGTIRKDFATSIDKNTVHGSDSLENAKIEIAYFFRETEIHSYPYQK

SEQ ID NO: 6580 - protein, 156 aa, Haemophilus influenzae
NRTNTPVLVDGKDVMPEVNAVLAKMKDFCQRIISGEWKGYTGKAITDVVNIGIGGSDLGPYMVTEALRSYKNHLNMHFVSNVDGTHIAETLKKVNPETTLFLVASKTFTTQETMTNAQSARDWLLKAAKDESAVAKHFAALSTNAKDVEKFGIDTN

SEQ ID NO: 6581 - protein, 268 aa, uncultured alpha proteobacterium EBAC2C11
MKMLSSLWILASIILILILASAFFSSAETALTAASDARMRQLASKGDERALIVEALRADREGLIGSILIGNNAVNVFGSALATSVAISLFGEGGLVWATIAMTVLLVVFAEVMPKTYAFAYADRYALRIAPVLKWVVRLLSPLSLGLRLLANQMIRPNPIAESDREEELRGLIELQGDDGNADDRERKAMLSSILDLNELSVDQIMTHRGAVSMVNADDHMDDILRNVLGSPHTRHPVFSGKPDNIIGVLHVKDLLRALGEVEKKGKM

SEQ ID NO: 6582 - protein, 156 aa, Haemophilus influenzae
NRSNTPVLVDGKDVMPEVNAVLAKMKDFCLRIISGEWKGYTGKAITDVVNIGIGGSDLGPYMVTEALRPYKNHLNMHFVSNVDGTHIAETLKKVNPETTLFLVASKTFTTQETMTNAQSARDWLLKAAKDENEVAKHFAALSTNAKDVEKFGIDTN

SEQ ID NO: 6583 - protein, 156 aa, Haemophilus influenzae
NRANTPVLVDGKDVMPEVNAVLAKMKDFCQRIISGEWKGYTGKAITDVVNIGIGGSDLGPYMVTEALRPYKNHLNMHFVSNVDGTHIAETLKKVNPETTLFLVASKTFTTQETMTNAQSARDWLLKASKDESAVAKHFAALSTNAKDVEKFGIDTN

SEQ ID NO: 6584 - protein, 476 aa, Saccharomyces cerevisiae
MIASKSSLLVTKSRIPSLCFPLIKRSYVSKTPTHSNTAANLMVETPAANPNGNSVMAPPNSINFLQTLPKKELFQLGFIGIATLNSFFLNTIIKLFPYIPIPVIKFFVSSLYCGGENFKEVIECGKRLQKRGISNMMLSLTIENSEGTKSLSSTPVDQIVKETISSVHNILLPNIIGQLESKPITDIAPGYIALKPSALVDNPHEVLYNFSNPAYKAQRDQLIENCSKITKEIFELNQSLLKKYPERKAPFMVSTIDAEKYDLQENGVYELQRILFQKFNPTSSKLISCVGTWQLYLRDSGDHILHELKLAQENGYKLGLKLVRGAYIHSEKNRNQIIFGDKTGTDENYDRIITQVVNDLIINGEDSYFGHLVVASHNYQSQMLVTNLLKSTQDNSYAKSNIVLGQLLGMADNVTYDLITNHGAKNIIKYVPWGPPLETKDYLLRRLQENGDAVRSDNGWPLIKAIAKSIPKRVGL

SEQ ID NO: 6585 - protein, 432 aa, Magnetospirillum magnetotacticum MS-1
MTHELEIAARERGIKYFLVSYTDLFGTQRAKLVPAAAIGSTCRNGAGFAGFATWLDMSPADADLLAVPDPSGLIQLPWKPEVGWLPADLVMGGKAVEQGPRNILKRLIKEAAREGLQMKSGVECEFFLITPCGSEPADTADKQTKPCYDQSALMRRYDVISEICDAMLSLGWKPYQNDHEDANGQFEMNWDYDDALITADRHAFFKYMARSIAEKHGFRATFMPKPFMDLTGSGCHAHVSLWSGGQNVFADESDEIGMSRKGYHFIGGLIHSADALAALTNPCVNSYKRINAPRTTSGATWAPNTVTYTGNNRTHMIRIPDGGRFEFRLADGAANPYLLQAGILAAGLDGIRQQRDPGQRLDINMYTDGHKVEGVKQLPLNLLDALRALEASSVLNEALGSFVPSYLKLKRQEWDDYCRHLTQWERDTTLDC

SEQ ID NO: 6586 - protein, 385 aa, Vitis labrusca
MDDAKISELKQFVNSVKSDPSILHNPSLSFFKSYLQSLGARIPAKPDKCGCGTSDHGEHVDAKKTNLCSEDDKFEDDIVESDIELDDTDVVEPDNDPPQKMGDLSIDVTEENQDAAQMLKSKAMEAISEGKLDEARDNLTEAIMLNPSSAILYATRASVYVKLKKPNAAIRDADAALKINPDSAKGYKIRGMARAMLGLWEEAATDLHVASRLDYDEEIALVLKKVEPNARKIEEHRRKYARLCKERELRKYGHQKQQQQAQPHDPEAAAALKDGQVMAIHSSSELETKLKAASKTSRLAILYFTATWCGPCRYISPVFTSLSGKYPKVVFLKVDIDGAQDVAVSWNVSSVPTFFFIKNGKEIDKVVGVDKSALETKIAQYAGQS

SEQ ID NO: 6587 - protein, 580 aa, Schizosaccharomyces pombe 972h-
MEPEYVSFSDKDTKSILNESKSSLKDVKPSLEEKSYITPGLVDDVEPKGKNFVVRFFDDFKPAKATGEDGTALKRSLKSRHMQMISIGGAIGTGLYVGSGSSLADGGPASVIINYSLIGIMMFFIVYALGEMAVAYPVAGGFNTYATRFIDPAWGFAVSWNYFINYFVTFPLELTTCAITFRYWTDINSAAWISIFLVVIIIVNLFGVRAYGEVEFILSTVKVVATFGFIILAIIINCGGVPTDHRGYIGGSIIKHKPFRHGFKGFCSVFTTAAFSFSGTEVIGLAAAEVDNPQKALPHAVKQVFWRIAIFYVVSLILIGLLISPDDPNLMGNGSTSVSPFVLAIKEANIKGLPSVFNAVIIISVVSVTNSSTYTAGRTLHGMANLKQAPSFFKYTDRLGRPLLAMIVVLLFGFFAYINEADKNGNDVSDTVFNWLLALSGLSNFFTWGSICLCHIIFRLAFKKQGHSLKELGFVSPMGIWGSCIGLFFNILCLMAQFYVSLFPIGGKPNANDFFQGYLAAPVTLAFFIGYKIYDRSHIPSLDKLDITTGLKTYENLDEEEDEPTTASKRIFKKISSVFC

SEQ ID NO: 6588 - protein, 391 aa, Zea mays
MALRLPSHQLAPLAVLVCAAVAAYDEELSASPPSDNNNTPAGLGIKVPFRPRVAIVVGIFTMIFSLTFLLLMYAKFCHPSSSSSPPQPASNNGAAAAAVCVGLPKQVIESLPFFRFATLRGARHGMECSVCLARFDDADLLRLLPRCRHAFHLACVDRWLQSSATCPLCRSNVDADDAKLDADHALSSGRFDDGAAAEAAGSGRDLLDIFVERVPGPDRHKHRIIVSDVVFKSRWSELNSADLIALDTEMLRSMSSGRFVFPPDSPYCAAPEHKLAAEDQEETTMANKNKERKRLLEPVVVVDAPLGGECSSGSAVSASAARMISSGVRSMSEIVSLPRLRAAARERLSEEENRRWLPIARRTARWFAGRASGGQEEHRAVHVVAAEHDGV

SEQ ID NO: 6589 - protein, 426 aa, Thiomicrospira crunogena XCL-2
MSLIKDIKARQVIDSRGNPTVEADVILDDGSKGRGISPSGASTGSREAIELRDGDKSKFGGKGVLKAVNNINTEIRDLLIGKEATDQAAIDNAMIALDGTDNKARLGANAILAVSIAVAQAAAQSKGLPLYAYLKTDDYKMPVPMMNIINGGEHADNSVDFQEFMIMPVGAPSMSEAIRYGAEIFHALKKVLHDKGYNTAVGDEGGFAPDLKSNEEAITVILEAIEAAGYKAGEDIMIAMDAASSELYKDGKYFLGSENKTLTSKEMVDLLSDWVTKYPIISIEDGLDESDWDGFKYQTEKDGKRLQIVGDDLFVTNPKILKEGIEKGIANSILIKINQIGTLTETFEAIQMAKDAGYTAVVSHRSGETEDTVIADIAVATGAGQIKTGSLSRTDRIAKYNQLIRIEEELGSKAVYPGKDAFYNLK

SEQ ID NO: 6590 - protein, 108 aa, Oryza sativa (japonica cultivar-group)
MAEEAQQPRGVKVGGIHDAPAGRENDLTTVELARFAVAEHNSKANAMLELERVVKVRQQVVGGFMHYLTVEVKEPGGANKLYEAKVWERAWENFKQLQDFKPLDDATA

SEQ ID NO: 6591 - protein, 449 aa, Arabidopsis thaliana
MDDETSVKEKQRNSDRISNLPDSLLCQILSDLSTKESVCTSVLSKRWRNLWLHVPVLDLDSNNFPDDDVFVSFVNRFLGSENEQHLERFKLIYEVNEHDASRFKSWINAVIKRRVCHFNVHNEVDDDDELVKMPLSLYSCERLVNLQLYRVALDHPESVSLPCVKIMHLDMVKYDADSTLEILISGCPVLEELTIVRDPNDSLEVVCVRSQSLKSFKIDSERYESQNHVVTIDAPRLEYMNLCDHRSDSFIIHNIGPFAKVDIDVIFNVEYNDPLEPDDSSKIAMLGKFLTGLSTVSEMVISSDTLQVIHDYCKMEQLPQFSNLSRLHAYFEDTWWEMLPTFLESFPNLHSLVMEFDCFPDTEQIDLSYVPQCFLSSLEFVHLKTPYVVNMQKEGRPLTGTSSKRKLAKYFLENGAALKKLTVSASFCNIIDEIKAIPRSSTSCQVVMD

SEQ ID NO: 6592 - protein, 209 aa, Arabidopsis thaliana
  misc_feature (65)..(65): Xaa can be any naturally occurring amino acid
  misc_feature (124)..(124): Xaa can be any naturally occurring amino acid
  misc_feature (140)..(140): Xaa can be any naturally occurring amino acid
  misc_feature (151)..(151): Xaa can be any naturally occurring amino acid
  misc_feature (180)..(180): Xaa can be any naturally occurring amino acid
  misc_feature (187)..(187): Xaa can be any naturally occurring amino acid
TRKKKKKKSPYYPPPPTRGLTKSEEDLWLSSMVSSARMVASPAQVTMVAPFNALKTSGAFPVTRXKANNDITSITSNGGRVNCMQGWPPIGKKNRDTLSYLPDLTDSELDKEVDYLIRTKWIPXDEFELKNGFVYPEHGXNSPGYYDGRDXTMRMLPLFSCTYSAQVLKEVGECKKEYPXAFIKIIXFNNTREVQSIRFIAYKTPSFTG

SEQ ID NO: 6593 - protein, 156 aa, Haemophilus influenzae
NRANIPVLVDGKDVMPEINAVLAKMKDFCQRIISGKWKGYTGKAITDVVNIGIGGSDLGPYMVTEALRPYKNHLNMHFISNVDGTHIAETLKKINPETTLFLVASKTFTTQETMRNAQSARDWLLKAAKDESAVAKHFAALSTNAKDVEKFGIDTN

SEQ ID NO: 6594 - protein, 309 aa, Glycine max
MYSLAQHKYIPRFHLQACKNHPPHHPSSPVFCSTTTTTSRDKPNPKPLVIEPWLVPVPPTVVTADNPRPMNNDPSLQSTWSHRAWVAAGCTTLLISLGESIKGAMDLNMWAEPILAGWVGYILADLGSGVYHWAIDNYGDASIPIVGTQIEAFQGHHKWPWTITKRQFANNLHALARAVTFTVLPIVLLCHDPIVEGFVGMCSGCIMFSQQFHAWSHGTKSRLPPLVVALQEAGVLVSRSQHAAHHRPPYNNNYCIVSGVWNEFLDKHKVFEALEMVLYFKTGVRPRSWSETASEWIEEIETPSQIQAQ

SEQ ID NO: 6595 - protein, 156 aa, Haemophilus influenzae
NRANTPVLVDGKDVMPEVNAVLAKMKDFCQRIISGEWKGYTGKAITDVVNIGIGGSDLGPYMVTEALRPYKNHLNMHFVSNVDGTHIAETLKKVNPETTLFLVASKTFTTQETMTNAQSARDWLLKAAKDESAVAKHFAALSTNAKDVEKFGIDTN

SEQ ID NO: 6596 - protein, 715 aa, Ralstonia solanacearum GMI1000
MSRAFHLLPLTALVAASMSACGGSDSNSSASASTSGVVTGSYFEHAKACIDTNSNGKCDAGETSTYTDANGAYTLTGQGAITVEVGTDAFRNDPATGSHTAITRPLVFRAPASANGVVSAITTELVALMESNGGDLGAAKTTLAARLGVTADKLLADHNKETDPTAKATLQAEIDQAIDLIADAVGNGGDFLKGIRDGVGKRVALVNNVKTIVVIYAENRGFDNLYGLFPGANGVPGVNPTSTGTAAAQKDFDGSTLPSLPPTWGGLTAAGQSVTVTQAQTTGWANKPFQIDDPSGVNGTGVVVPQSVITRDLVHRFYNNQMQINGGANDKFTAYSDAGGLSMGYYDGSKMSMWSLAKQYVLADNFYMGAFGGSFLNHQYLICACAPTYPNADTSVASGSIAKIDTDASGNFVRLTPGTNTPTSVLSGKATYANDGALTPKDAAGMFYAVNTMQPPYQPSGNNAPSGGNASYADPAKASTLPTQSQTNIGDLLTAKGINWAWYAGAWNAATSDAPNATRSVIYAGTTQFQPHHQPFNYYSRFDPATTSGAAERAAHLKDYDAAFLQDAAAGTLPAVTFYKPQGNLNQHPGYANVADGDAHIASVIAQLQQSPQWKNMVIVVTYDENGGFYDHAAVPKADRWGPGTRIPAIIVSPFAKKGFVDHTQYDTASVLRLITHRFDLPTLPGLKQRDAALVINGGKPMGDLTNALDFSQSQ

SEQ ID NO: 6597 - protein, 370 aa, Arabidopsis thaliana
MVSQNVVVSDAKTGIITVSTVSNSSVFTPTAQKPPTAPGYISVSKKKLLKNLEINGADQSQRLNSWVDSMRASSPTHLKSLSSFSSEEEHNSWIKRHPSALNMFERIIEEARGKQIVMFLDYDGTLSPIVDDPDRAFMTSKMRRTVKKMAKCFPTSIVTGRCIDKVYSFVKLAELYYAGSHGMDIKGPTKGFSRYNKDKPSVLYQPAGDFLPMIDEVYKQLVEKTKSTPGAKVENNKFCLSVHFRCVDEKKWSELASKVRSVVKNYPTLKLSQGRKVFEIRPIIKWNKGKALEFLLESLGFENCNDVFPIYIGDDKTDEDAFKLLRGRGQGFGILVSKFPKDTSASYSLQDPPEVMNFLGRLVEWKQMQQ

SEQ ID NO: 6598 - protein, 182 aa, Cucumis sativus
YRGDWHGSEVAVKILTEQDFHPERVNEFLREVAIMKSLRHPNIVLFMGAVTKPPNLSIVTEYLSRGSLYRLLHKSGVKDIDETRRINMAFDVAKGMNYLHRRDPPIVHRDLKSPNLLVDKKYTVKVCDFGLSRLKAHTFLSSKSAAGTPEWMAPEVLRDEPSNEKSDVYSFGVILWESNSRG

SEQ ID NO: 6599 - protein, 418 aa, Sphingomonas sp. KA1
MPIEIKMPALSPTMEEGTLAKWLIKVGDTVSSGDIMAEIETDKATMEFEAVDEGVIADIAVPAGTEGVKVGTVIATLTCEDEEDSAVTMPKAEVKATAEPAKSAEPSTVSVSTPQPTAAPVSKSGRVVASPLAKRIAAQRGVDLGEIRGSGPSGRIVKSDVEGAQDSTPSETQRAPAPQAAVDAVPDFSIPYEAEKLNNVRKTIARRLTEAKQTIPHIYLTVDARLDGLLRLRGELNKALEPDGVKLSVNDLLIKALAKALIRVPKCNVSFAADELRKFTRADISVAVAAPSGLITPIVVDAATKGVAQISTEMKALADKAREGKLQPHEYQGGTASLSNLGMFGIKQFEAVINPPQGMIMAIGAGEQRPYVVDGALAIATVMSATGSFDHRAIDGADGAQLMQAFKDLVENPLGLVA

SEQ ID NO: 6600 - protein, 366 aa, Candida albicans SC5314
MNYDQMWDACTSFWRVIKDFRKSTYDGFDDPHSTMMRAYPEVPEWAYLIIVVISLVLAILCVKLYPAQTPVWGIFFALGINFVFLIPLTTIYARTGFAFGLNVLVELIVGYAIPGNGLALAFIKALGYNIDAQAQNFVNDLKQGHYAKLPPRAVYRVQLLSIFVSSFIQLGILNFQINGIKDYCKPGNTQKFTCPGGRTFFSASVLWGVIGPKKVFNGLYPVLAWCFLIGFLLAFPCIAIKKYAPRKYVKYFEPSIVIGGFLKYAPYNLSYYIPGVYVSYAFMSYIKRKYEAWWQKYTYVLSTGLNAGIAFSSIIIFFAVMYHEKDINWWGNTVMYSGVDYAMTGWLNATVDAPDGYFGPRRGNFP

SEQ ID NO: 6601 - protein, 173 aa, Betula pendula
MASNPKVFFDMEVGGQPVGRIVMELYADTTPRTAENFRALCTGEKGNGRSGKPLHYKKSSFHRVIPGFMCQGGDFTAGNGTGGESIYGAKFADENFIKKHTGPGILSMANAGPGTNGSQFFICTAKTEWLDGKHVVFGQVVEGLDIVKAIEKVGSSSGRTSKPVVVADCGQLS

SEQ ID NO: 6602 - protein, 307 aa, Glycine max
MAVPVIDFSKLNGEERTKTMAQIANGCEEWGFFQLINHGIPEELLERVKKVASEFYKLEREENFKNSTSVKLLSDSVEKKSSEMEHVDWEDVITLLDDNEWPEKTPGFRETMAEYRAELKKLAEKLMEVMDENLGLTKGYIKKALNGGDGENAFFGTKVSHYPPCPHPELVKGLRAHTDAGGVILLFQDDKVGGLQMLKEGQWIDVQPLPNAIVINTGDQIEVLSNGRYKSCWHRVLATPDGNRRSIASFYNPSFKATICPAPQLVEKEDQQVDETYPKFVFGDYMSVYAEQKFLPKEPRFQAVRAM

SEQ ID NO: 6603 - protein, 357 aa, Fulvimarina pelagi HTCC2506
MAQTNALKIATIPGDGIGREVVPEGMRVLEAVGRKFDIAFQFDEVDWSCETYKQTGRMMPEDGLERFKKHDAVFLGAVGWPDVPDHVSLWGLLIPIRRTFHQYVNLRPCRLLRGTTSPLAGRTADDIDFYVVRENVEGEYSEAGGRLYRGMDDEIAIQEAIFTRRGVDRVLRYAFELAKTRKRGHVTSATKSNGIVHTMPFWDERFKAVKADYPDIETSQYHIDILCAHFVQHPDWFDVVVGSNLFGDILSDLGPAVAGSIGIAPSANINPEGDYPSMFEPVHGSAPDIAGQGIANPIGQIWSAAMMLDHLGHPEASAAVIEAMETVIADPASRTKDMGGKANTAECGEAIAQVLAG

SEQ ID NO: 6604 - protein, 358 aa, Triticum aestivum
  misc_feature (160)..(160): Xaa can be any naturally occurring amino acid
  misc_feature (199)..(199): Xaa can be any naturally occurring amino acid
  misc_feature (212)..(212): Xaa can be any naturally occurring amino acid
MAGSDEVNRNECKTVVPLHTWVLISNFKVSYHMLRRPDGTFERDLAEYMDRRVPANPRPVEGVSFFDHFIDLSVGLEARIYRAVAGNAAGAAEGAAALTLPILEFLGGAPSPDPLPVIIFFHGGSFAHSASSTTIYDNLCRQLVKLSKGVVVSVNYRRAXPEHRYPCAYDDGWNRAQVAPRPSPFLRSGEDAQLRVFLXGDSSGGNIAHHVXAVRAAEEGIKIHGNILLNAMFGGNERTESERRLDGKYFVTLQDRDWYWKAYLPEDADRDHPACNPFGPNGRRLKGLPFAKSLIIVSGLDLTCDRQLGYAEGLREDGHDVKLVHREKATIGFYLLSNTDHYHEVMEEIAEFVRANLL

SEQ ID NO: 6605 - protein, 365 aa, Clostridium perfringens ATCC 13124
MQPIKKIAILTGGGDCPGLNAVIRAVTRTAILKYGYEVIGYKFGYRGLYNNDFVKLDLDSVSGILHRGGTILHSSNKDNLFDYQVEDENGKIVKKDVSDVGVENLKKEEVDALVVIGGDGTLTSARDFARKGVNVIGVPKTIDNDLLATDVTFGFNTATEIATEALDRLHTTAESHHRIMLLEVMGRNAGWIALESGIAGSADVILLPEIPYDINKIVEKVKEREEAGKQFTIIVVAEGAKPKDGEVVVSKIVDDSPDPIRLGGIANKLAIDLEGLIKNHEIRSTVLGHIQRGGNTSTYDRILSTKYGVKAVELINSNLFGNMVALKGNKVSYESLENVIGHTKNVDPEGELVNTAKSIGISFAD

SEQ ID NO: 6606 - protein, 186 aa, Glycine max
MPSPSWKIPPHIPLFIFIIIYTIMFPSSPSPRVRTAARRRQKGITISFVNTSISISLILSLLSLLFLFSTMAAQENNFQDYLPVMANKLGGDGLIDELCNGFDLLKDSDKGVITFESLKRNSYLLGLQGLSDEDLRSMVLEGDFDGDGALNQMEFCVLMFRLSPELMEGSKMWLEQVLQQELKDYF

SEQ ID NO: 6607 - protein, 344 aa, Desulfotalea psychrophila LSv54
MYSRKINMIILGIESSCDDTSAAVVIDGTAIQSNVISGQEEIHNCFGGVVPELASRSHLSAIQPVVEKALSDAKISLDDIDLIATTQGPGLSGSLLVGYSYAKSLSLVKKIPFVGVDHMAGHALAILLEEETPDFPFIALTASGGTSSIFLVKSSTDFELLGRTRDDAAGEAFDKVAKVLGLPYPGGPHIAAHAETGDEKSIKFPRAWLDKDGFDFSFSGLKTAVLNYHNKIVQKNGSITKEERADICASFQQAVIDVLVTKTINAARTHGISTVVLGGGVSSNRALRLAFSHECDKCKLQFFVPAAKLCTDNAAMIAVAGYHKYLRFGPGNLSDDVYSRSQLG

SEQ ID NO: 6608 - protein, 189 aa, Arabidopsis thaliana
SRKMAFAATLFVPPPVAVRSPARFLGRLSIPCLLQVLPTNGAASPRQVKRAIVANASPGNGGVKAEEEDGVSLGTMKLPVDTDLARFETLLFQWANSLCQGANLPLPVPLKVDRISGGARLGFIVMEDEGKTDVPVYIDCLVFQTTENGVVFQATRNGRKKDKAPPGEERIMRSLLGALKKAVEIARVT

SEQ ID NO: 6609 - protein, 470 aa, Sphingomonas sp. KA1
MAEQYDLIVLGSGPGGYVAAIRAAQLGLKTAIVERENLGGICLNWGCIPTKALLRSAEVLHNMRHAAAYGLAADNIRADLDAVVKRSRGVAKQLNQGVTHLMKKNKIAVHMGEGVLKGGGKLEVRGDKGTETLSAKHIIIATGARARDLPFAPADGKRIWTYRHAMTPSEMPGKLLVIGSGAIGIEFASFYNDMGSEVTVVEMMDRIVPVEDADVSAFLEKALKKQGMTILTGAGVESLASGPNGVKARIKDKDGKVSESEFSHVIVAVGIMPNTENIGIEALGIKSERGFIQIDGLGRTNVPGIWAIGDVTPGPWLAHKASHEGVIAAEAIAHALGNKVVHPHAMDKRNIPGCTYCRPQVASVGLTEAKAKEAGYTVKAGTFPFIGNGKAIALGEPEGFIKTVFDAKTGELLGAHMVGTEVTELIQGYVVGKTLETTEAELMATVFPHPTLSEMMHESVLAAFERALHI

SEQ ID NO: 6610 - protein, 155 aa, Arabidopsis thaliana
MVQCTDCKKWRLIPSMQHYNIIKETQLQTPFVCGTTSGWTPNMSCNVPQDGTTCDTWPSIPPIPTGWSRSVHIRSESTKFADVYYFPPSGERLRSSAEVQSFLDNHPEYVREGVNRSQFSFQIPKPLDDNYVKKRTRPVKRRKSSKDNNCEKGKK

SEQ ID NO: 6611 - protein, 862 aa, Lotus japonicus
MWSHHGFHLPQNCAAKEQIWGLVATVRHHRNHLFLLRSAVFHSIIFSFSYVVCNGNGSLTLEDSSWKSGNYRCSSKKYEQCTLSQGMTVHDGTFEAGFFHFENPQHHYFGVWYKSISPRTIVWVANRDAPLRNSTAPTLKVTHKGSILIRDGAKGVIWSTNTSRAKEQPFMQLLDSGNLVAKDGDKGENVIWESFNYPGDTFLAGMKIKSNLAIGPTSYLTSWRNSEDPASGEFSYHIDIRGFPQLVVTKGAAITLRAGPWTGNKFSGAFGQVLQKILTFFMQFTDQEISLEYETVNRSIITREVITPLGTIQRLLWSVRNQSWEIIATRPVDLCADYVFCGANSLCDTSKNPICDCLEGFMPQFQAKWNSLDWAGGCVSMEKLSCQNGDGFMKHTGVKLPDTSSSWFGKNMSLDECRTLCLQNCSCTAYAGLDNDVDRSVCLIWFGDILDMSKHPDPDQGQEIYIRVVASKLDRTRNKKSINTKKLAGSLVVIIAFVIFITILGLAISTCIQRKKNKRGDEGIINHWKDKRGDEDIDLATIFDFSTISSATNHFSLSNKLGEGGFGPVYKGLLANGQEIAVKRLSNTSGQGMEEFKNEIKLIARLQHRNLVKLFGCSVHQDENSHANKKMKILLDSTRSKLVDWNKRLQIIDGIARGLLYLHQDSRLRIIHRDLKTSNILLDDEMNPKISDFGLARIFIGDQVEARTKRVMGTYGYMPPEYAVHGSFSIKSDVFSFGVIVLEIISGKKVGRFYDPHHHLNLLSHAWRLWIEERPLELVDELLDDPVIPTEILRYIHVALLCVQRRPENRPDMLSIVLMLNGEKELPKPRLPAFYTGKHDPIWLGSPSRCSTSITISLLEAR

SEQ ID NO: 6612 - protein, 455 aa, Sphingomonas sp. KA1
MGIELRMPALSPTMEEGTLAKWLVKEGDEVKSGDILAEIETDKATMEFEAVDEGIVGKILVAEGTEGVKVGTVIAVIGEDGEVTPSSAPVLTEVQAAPPAIAIERPVAAPRAADPAVPASTNMKMSTVREALRDAMAEEMRRDGRVFVMGEEVADYQGAYKVTQGLLEEFGPKRVIDTPITEYGFAGIGAGAAMGGLRPVVEFMTFNFAMQAIDHIINSAAKTNYMSGGQMRCPVVFRGPNGAASRVGAQHSQNYGPWYANVPGLVVIAPYDASDSKGLLKAAIRSDDPVVFLENELVYGRSFELPELDDHVLPIGKARIMREGSDVTIVSYSIGVGLALAAADALAAEGIEAEVIDLRTLRPLDKETILASLAKTNRLVVAEEGWPQCSIASEITAICMEDGFDHLDAPVLRVCNEDVPLPYAANLEKAAVIDAARIVVAVKRVCHRLAQNEIF

SEQ ID NO: 6613 - protein, 420 aa, Sphingomonas sp. KA1
MADIVIVGAGHGGAQCAIALRQAGFEGTVTIVGRECEPPYERPPLSKEYFAREKTFDRLYIRPPQFWEEKGVRLMLGIEVTAIDPASKQLTLSDGSSFGYGKLVWATGGDPRKLPVPGGSLSGVHGVRTREDCDTLMGEIDGGVKNICVIGGGYIGLEAAAVLTKMGCKVTLLEALPRVLARVAGPELSAFYEKEHRDHGVDLRTGATVEALEGEGRVTGVRLGDGSVLPADAVIVGIGIVPAVAPLIAAGAAGGNGVDVDEYCRTSLPDIYAIGDCAAFACDFADGKVMRIESVQNANDQATCVAKAICGDEKPYHAFPWFWSNQYDLRLQTAGLSVGYDQTVVRGSPDARAFSVVYLKGGKVIALDCVNMVKDYVQGRKLVEAGVSPNQQRLGDVSVALKELLPIQGDTHLRNGGAAV

SEQ ID NO: 6614 - protein, 322 aa, Pseudomonas fluorescens Pf-5
MQPQAFYRAVADDFSAVDGIIKKQLTSRVPLVSKIGDYITSAGGKRLRPLLVLLCGKALGREGDDLRLLAATIEFLHTATLLHDDVVDMSGMRRGRSTANAMWGNAPSVLVGDFLYSRSFEMMVELGSMPVMRILSQATRIIAEGEVLQLSKVRDASTTEETYMEVIRGKTAMLFEASTHSAAALAGATEEQAEALRTFGDHLGVAFQLVDDLLDYRGDAETLGKNVGDDLAEGKPTLPLIYTMREGTPEQAALVRQAIQKGGIEDLESIRAAVEASGSLDYTAQLARDYVARAITCLEALPPSEYRDALVELSEFAVARTH

SEQ ID NO: 6615 - protein, 434 aa, Synechococcus sp. CC9605
MTTLEDKSGENAVTKGTSADSKSAGHWSWGFKSPGSHPSAVMNTYGRFPLALAKGKGCWVKDTQGRLYLDAVAGIATCTLGHSDRAMQRALRNQLGRLQHVSNLYQIPEQEELASWLVHNSCADSVFFCNSGAEANEAAIKLARKHGHLRRGIEQPVILTAAASFHGRTLAAVTATGQPKYHKGFEPMVTGFDYFPYNDLKALEALINRYEQAGPSIAAVLVEPLQGEGGVNPGDRAFFSRLREICTERNILLILDEVQVGMGRSGRLWGYEQLGITPDAFTLAKGLGGGHAIGALLVNASADVFEPGDHASTFGGNPFACRAGLTVATEIERRGLLTNVTARGEQLRDGLQELVNCFPEHLQGVRGWGLLQGIVIREGSSWTAPALAKAAIDHGLLLVAAGPSVLRMVPPLTINKREVRELLRRLATTLSSLS

SEQ ID NO: 6616 - protein, 423 aa, Glycine max
  misc_feature (394)..(394): Xaa can be any naturally occurring amino acid
MPGILSRLNATIYCRIREAITRQQGVPTSLYRSSALPLCSLTSSHTLHTKSMITASHSNAMLGDVYAYGLISGRGSVRDFTKPAVGCLRGSVNLRRLQPLYGPLSFGCSTFDANRRIRDSSLLHGSWLKNFSASSSACYSAGAAHAVSFDGSPPDEQLANSSFSPDPTIVGGKPLKMLSGSCYLPHPDKEETGGEDAHFICTDEQAIGVADGVGGWADVGVNAGLFAQELISNLVRAIQKEPKGSFNLTRVLREAHANTKVKGSSTACIVALTDKGLHSINLGDSGFIVVRDGCTIFESPSQQHDFNFPYQLESGNGADLPSSGEVFTIPVASGDVVISGTDGLFDNLYNSEITGVVEHAIRAGLEPQVTAQKIAALARQRALSKSSRTPFSTXAEKAGFCYYGGKLDDITVVVSYISGSVSE

SEQ ID NO: 6617 - protein, 517 aa, Triticum aestivum
MGNSCVTGSSSTSNHGQSLKSNGEKASDNSCVTGSCLSNQGQSQESNGSETTFKWRIDGFSSLLDKGWTSSSVFNIRGFDWYMVLNLRDRKSGDKNEYVSLELVLFLAPEILHTVVEASFKFLIYDQSYGKHLEQHQVSQNFQAPSRVSGTSFMIPLATLKEQSSGFLVEDSCVFGIQFIKVVPVKGSSKHRQNLKANVARAIGNSCVTGSSQSSQGHCQESNGSETTFKWRIDGFSSLLDKGEGWTNSSVFNIRGFNWYLMLNPRDRKSGDKNEYVSLKLVLTQTVSERSHLIAKATFKFLIYDQSYGKHHEEHQVSHNFQAASRVSGISCMIPLAKLKEQSSGFLVKDSCVFGIQFIKVVAVKGNDVSETLFVQKISNICSDPQVYTWNIDDFFVLKNPSTSPEFELCGHKWLITIYPSGSDKNPNYLSLYLNMKDSLHKDSAILADVSITIKDQETGKHKKLSARLQLKNCAPTWGWGKFISLEDFKDSSQGYLVKTKCCIEAQIAVIGSSKTE

SEQ ID NO: 6618 - protein, 239 aa, Glycine max
VYAKAKECSDILSAEDFAILLAKHFVSFYKKVTGAIVNIVEKPWERVIVDGQPHEHGFKLGSEKHTTEAIVQKSGSLQLTSGIEGLSVLKTTQSGFVNFIRDKYTALPDTRERILATEVTALWRYSYESQYSLPQKPFYFTEKYQEVKKVLADTFFGPPNGGVYSPSVQNTLYLMAKATLNRFPDIAYVSLKMPNLHFLPVNISNKDGPIVKFEDDVYLPTDEPHGSIQASLSRLWSKL

SEQ ID NO: 6619 - protein, 497 aa, Pseudomonas aeruginosa PAO1
MTTLTRADWEARAKDLKIEGRAFVNGEYSNAASGETFDCLSPVDGRFLAKVASCDLADAEQAVKVARNAFDSGAWSRLAPAKRKQTMIRFADLLLENAEELALLETLDMGKPISDSLHIDVASAANSLRWSAEAIDKIYDEVAATPHAELGLVTREPVGVVAAIVPWNFPLLMSCWKLGPALATGNSVILKPSEKSPLTAIRIAQLAVEAGIPKGVFNVLPGYGHTVGKALALHMDVDTLVFTGSTKIAKQLMVYAGESNMKRVWLEAGGKSPNIVFADAPDLKAAAEAAAGAIAFNQGEVCTAGSRLLVERSIKDKFLPLVIEALKGWKPGNPLDPETNVGALVDTQQMNTVLSYIEAGHNDGAKLVAGGKRTLEETGGTYVEPTIFDGVTNAMKIAREEIFGPVLSVIEFEDAEEAVRIANDTPYGLAAAVWTSNLSKAHLTAKALRAGSVWVNQYDGGDMTAPFGGFKQSGNGRDKSLHAFDKYTELKATWIKL

SEQ ID NO: 6620 - protein, 444 aa, Pseudomonas aeruginosa PAO1
MTMNDEPQSSSLDNFWMPFTANRQFKARPRLLESAEGIHYIAQGGRRILDGTAGLWCCNAGHGRREISEAVARQIATLDYAPPFQMGHPLPFELAARLTEIAPPSLNKVFFTNSGSESADTALKIALAYQRAIGQGTRTRLIGRELGYHGVGFGGLSVGGMVNNRKAFSANLLPGVDHLPHTLDVARNAFTVGLPEHGVEKAEELERLVTLHGAENIAAVIVEPMSGSAGVVLPPKGYLQRLREITRKHGILLIFDEVITGFGRVGEAFAAQRWGVVPDLLTCAKGLTNGSIPMGAVFVDEKIHAAFMQGPQGAIEFFHGYTYSGHPVACAAALATLDIYRRDDLFQRAVELEGYWQDALFSLRDLPNVVDIRAVGLVGGVQLAPHADGPGKRGYDVFERCFWEHDLMVRVTGDIIAMSPPLIIDKPHIDQIVERLAQAIRASV

SEQ ID NO: 6621 - protein, 308 aa, Zea mays
METVLCCAVTTTAGVEDVIADSKAHKVLVKGKKAAADPMKVVERVQKKTGRKVELLSPMPPPPEVEEKKEDEAEKKKDDEKKAEPEPPKPEEKKEPPVIAVVLKVHMHCEACAEGIKKRILKMKGVQSVEPDLKASEVTVKGVFEESKLAEYVYKRTGKHAAVVKSEPAPAPEGGGGDKAAKEEEKKDAGGAGSEEKKDGKEEEEKKDGGEKNEEKKDGGDGDGDKKDEAGDKDKDPAASLYMHYPRFPFAGGYYQPPAYPPPPGYPYAYQPAYPPPFYAPPHHHLHQQQPMAPQIFSDENPNACSVM

SEQ ID NO: 6622 - protein, 460 aa, Tropheryma whipplei str. Twist
MRPSLPTTHACTDTCRIYPHSSGGGHSLAEEGRPRTKRWTWSGVGSTLWGGIKGAAGYLAHPFGGGTTDTVTQSAQPTVPVAPAPAAPSAPAPAKPAPSEATQAAQPPAKPAAATHSSSTQAPSSAPKPAAAKPAPAKPAAAKPAPAKPAPSEATQAAQPPAKPAAAKPAPAKPAATQATQAPKPAAAKPAPAKPAAAKPAPAKPAPSEATQAAQPPAKPAAAKPAPAKPAATQATQATKPAAPAKPAAAKPAPAKPAPSEATQAAQPPAKPAAAKPAAAKPAPAKPAATQATQATKPAAPAKPAAAKPAAATHSSSTQAPSQVTKPAAEKPSSTVANTQVTKPAAAKPAPAKPAAAKPTQTTQAAQPSSGNSAERSDSVQPNNSAQPNSEEKSADSSSSTSATETRPVSAKELGKAVEKAVVSLIVGVVSAVVSGIFTAIYRWYSKFYKWYSKFSAKQA

SEQ ID NO: 6623 - protein, 127 aa, Shewanella sp. MR-4
MAEKIIIATENAPAAIGTYSQAVKVGNTVYLSGQIPLVPSTMQIVSDDFEAQVVQVFENLTAVCTAAGGTINDIVKLNIFLTDLSHFAKVNEIMSRYFSQPYPARAAIGVKQLPKDAQVEMDGVMEL

SEQ ID NO: 6624 - protein, 373 aa, Solanum lycopersicum
MPSRISDSCRPHHSQKHFDLNSIKELPESHAWTSSNDHYTQENSCNFESIPVIDLDNNNNNNNNNILDHIGHACKKWGAFQIINHSISEKLLQDIEVAGKTLFSLPMQQKLKAARSPDGVTGYGAARISSFFSKLMWSEGFTIVGSPIEHARQLWPKDYNKFCEVIEEYEKEMEKLAGRLMWLILGSLGITKDDVKWAVGPKGETKEGCAALQLNSYPACPDPGRAMGLAAHTDSTILTILHQNNTSGLQVYQEGNGWITVPPIPGALVVNIGDLLHILSNGSYPSVLHRAVVNRTRYRLSVAYLYGPPSGVRVSPLSKLVDHRHPPLYRAVTWSEYLGTKAKYFDKALSSVRLCVPLNGFTDAKDHKGVQVG

SEQ ID NO: 6625 - protein, 561 aa, Uromyces viciae-fabae
MILIQKKDQKNDSFRIEDELEKHANQAYYESTEVNASSSPTGDGAVGENTVHRALEQRHISMIAIGGTIGTGLFLGMGEALNKGGPLGLILGYMVMGLVVYAMTIALGEMVTMFPVSGSFTHYPCRFVDPALGFAVGWNYWYSLTIAVPSEVIAATIVVEYWKAPVNKVVWIITFIVLSCGINFFGVRWYGETEFAFAAVKVVAIIVLILVGIVIDIGGGPTHERIGFRHFIDPGPFNQLHGIPGALGRFLAFWSVFTQASFSYMGTEMVAITAGEAANPRKTVPKAIERVFYRILVFYLGSTLVVGLLVPYSSPQLLGSTGDASSSPFVIAINRAGITVLPDMINVVILLSAISTASSKLYGGSRVLYGLSKDGMAPRFFSKCNASGLPMWSLLATSSTAALSFMCLNSKAGVAFQWFQNLSAMTGILTWWTVLVSYVLFYQGLKVQGLSRDKLHYKAPFQPYASWIALAMLTLIMFMSGFETFLKGGWSISDFLANYLTLPIFLGFYLYWKISTRSKFVSSKHVDFVTGTRELNEMDAQEREKEIIPTTKWGKFIDKLL

SEQ ID NO: 6626 - protein, 355 aa, Solanum lycopersicum
MPSIISSQLDLYSIKELPESHAWKSSLDDDGSRNINAESIPVIDLNHDHKFVMDTIGHACKTWGAFQIVNHNISHRLLNHMETHGTRLFSLPMQQKLKAARSSDGIAGYGVARISSFFDKLMWSEGFTIFGSPLEHARQLWPYDYNKFCDVIEEYENEMEKLAGRLMGLMLGSLGIAKEDVKWAVGPRSGSSALQLNSYPACPDPDRAMGLAAHTDSTLLTILHQNNTSGLQVFKEGNGWVTVPLLRGALVINVGDLLHILSNGLYPSVLHRAIVNRTRHRLSVAYLYGPPSGVKISPLSKLVDQRNPQMYRPVTWSEYLGTKAKHFDKALSSVRLCAPRIGFANSKDQSGVQVG

SEQ ID NO: 6627 - protein, 301 aa, Burkholderia sp. 383
MANGTQDGIQIRGSIPAIVTPMLEDGSLDLPAFRKLIDWHIAEGTDALVVVGTSGESATLNVEEHILMIRTAVEHAAKRIPIIAGAGGNSTAEAIELTKHAKAVGADATLQVVPYYNKPTQEGMYRHFKTIAEAVDLPVILYNVPGRTVADMANETTLRLAEVPGIIGVKEATGNIDRAAHLIKAAPKHFAIYSGDDPTAIALMLLGGHGNISVTANVAPRAMSDLCRAALAGDVQTARALHMKLLSLHKNLFIEANPIPVKWALQAMGKMQGGIRLPLTALDERCHEAVRSALVEAGVLA

SEQ ID NO: 6628 - protein, 156 aa, Haemophilus influenzae
NRANTPVLVDGKDVMPEINAVLAKMKDFCQRIISGEWKGYTGKSISDVVNIGIGGSDLGPYMVTEALRPYKNHLNMHFVSNVDGTHIAETLKKVNPETTLFLVASKTFTTQETMTNAQSARDWLLKAAKDESAVAKHFAALSTNAKDVEKFGIDTN

SEQ ID NO: 6629 - protein, 156 aa, Haemophilus influenzae
NRANTPVLVDGKDVMPEVNAVLAKMKDFCQRIISGEWKGYTGKAITDVVNIGIGGSDLGPYMVTEALRPYKNHLNMHFVSNVDGTHIAETLKKVNPETTLFLVASKTFTTQETMTNAQSARDWLLKAATDESAVAKHFAALSTNAKDVEEFGIDTN

SEQ ID NO: 6630 - protein, 383 aa, Mycoplasma pulmonis UAB CTIP
MLKCLTMNKKEDYYKILGIDKSANEKEIKKAYRKLAMEHHPDRSSSKESEAKMREINEAYEVLSNPEKKAIYDKYGHEAANNPGFNGFNAGSAGFGNFGGFSNFGGFDSIFEEFFGGSRSHSKQNSNYPYPGESYSTQVKISFLDSVHGRVISQKLDKYKDCESCNGTGARSKSDIKTCSTCNGRGSVEKLVNSLFGKIKQSVTCSTCNGLGQEITHKCPSCKGAKKIKESISQKISIPAGVISGQEVLLRGFGGPGFNGGPNGDLYIRVYVTEHPYYQRINDDIYVDFPISIVNLILEKPVVVPTPYGDEKIKIKSTFKNDQIITFKGKGFKRKNRVGDLKIRLKFEIPNFSSKVKKNLESLLSETNDSINEDFVKKVNSIK

SEQ ID NO: 6631 - protein, 552 aa, Oryza sativa (japonica cultivar-group)
MGDHRATAKVRVNGAPAEATLFCTDPPGAANGGGGDGGELRWRCAGGAAAERVLSLDADVLGVEARGKEVVVKAFVLPADAAARSVSCAAGAGKGGGGRRRRRRDYVFEMAAGEDAAAAWCDRMRGSLDSLGRPKRLFILVNPFGGKKCGKKIYEAEIKPLFEAAGVNVTMQETRYQGHARQVASSLDLARYDGIVCVSGDGVLVEVDFFTDILVYPFRGMRKRLAYDCVKRKGYTSISIGESPDLQERLAKSNKKKDLQVVNGILQRMDWEEAMKIPIGVVPAGTGNGMAKSLLHSASLVADIDIESEKYRWMGSARFDFYFPASQARGSLGVWKSLLENDAFSLKDTLALFQALVRIMNLRKYYGSIQYVPAPGYEAYGDVVKQVENCTVECQEQIGKSLCSYQGPSVEFQGSEWRSLDGPFVSIWINNVQWAAESIMAAPGAKFSDGYMDAVIVRDCPKADLLALLMKMGDGSHVKSPYVTYLKVRCLRLSPGQLVENPKRGGIIDVDGEAIARGEGTYGKNQKQDVMGYGPSIQMTVHRALATMYCPK

SEQ ID NO: 6632 - protein, 468 aa, Pseudomonas fluorescens Pf-5
MRIELIKSRANLFLTTINLPRLPMIESVEDFLARLKKRDPDQPEFHQAVEEVLRSLWPFLEANPHYLSSGILERICEPERAVVFRVSWVDDQGKVRVNRGFRIQMNSAIGPYKGGLRFHPSVNMGVLKFLAFEQTFKNSLTSLPMGGGKGGSDFNPKGKSDAEVMRFCQAFMSELYRHIGADVDVPAGDIGVGAREIGFLFGQYKRLSNQFTSVLTGKGISYGGSLIRPEATGFGCVYFAEEMLKRRGDRVEGKRVAISGSGNVAQYAARKVMDLGGKVISLSDSEGTLYCESGLSEEQWLAVLELKNVQRGRISELASQFGLEFRAGQTPWDLPCDIALPCATQNELDAEAARTLLRNGCTCVAEGANMPTTLEAVDIFIDAGILFAPGKASNAGGVAVSGLEMSQNAMRLLWTAGEVDSKLHNIMQSIHHACVHYGEENGRINYVKGANIAGFVKVADAMLAQGVV

SEQ ID NO: 6633 - protein, 222 aa, Synechococcus sp. CC9605
MLISLLTGVAAGAVHVVGGADHLVAMAPFSLSKPWAAFRHALAWGAGHSTGVVVLALIAIGLKDLAHVEAMSSWAEFLVGVALLVVGALAVRTAFGLELHTHQHRHDGAAEHRHLHLHVRGASNHRRHVHASSGLGLLHGLAGASHLLAVIPALALPPHAAVGYLVAYLLGSIGAMVAVVSVVSFLTLRSGARLMPFLVGGTGALSIITGAIWLQKTSPALF

SEQ ID NO: 6634 - protein, 448 aa, Kineococcus radiotolerans SRS30216
MTAPTPAPTTSSAPTSAALFERAAAVIPGGVNSPVRAFRAVGGTPRFTASARGPYLTDADGREYVDLLCSWGPMILGHAHPDVLAAVTAAAQDGFSYGTPTEREVLLAEEIVARVEPVEQLRMVSSGTEATMSAIRLARGFTGRPVIVKFAGHYHGHVDALLASAGSGLATFALPDTPGVTGTAAGDTIVIPYNDPEALAEVFRLHGDRIACVITEAAAGNMGVVAPQPGFTAELRRVTREHGALLVSDEVMTGFRVSAAGWYGHEGLGLEHAPDLLTFGKVMGGGFPAAAFGGRADVMAHLAPAGPVYQAGTLSGNPIATAAGLATLRACTPEVYAAVETAATAVREAASAALSAAGVPHLVNTAGSMFSVFFTGLDAVTDYEQARQQDLGAFRAFFHSMLDQGVHLPPSAFEAWFLSASHDEAAIGRVVEALPAAARAAAEGSGSL

SEQ ID NO: 6635 - protein, 413 aa, Thauera sp. DNT-1
MIKSIVIVGAGLAGTTAARALRARGYAGRIHLIGNESQLPYDRPSLSKGVLGGAQEIPPLLMEAAWFESEGIELHLGDPVFAINAKERLVTLHSGLSLDFDRLLFATGMRPRKLSIPGGNLEGVFSLRNFADCAALRQAFTAAKSLVIIGGGLIGCEVATSARKAGLEVTILECADELLTRVLGRQIGAWCREQLEAMGVRIELNAHISHLSGERSVRSLVFADGREVEAELVLVSIGGDPEDTLLNAAGVACNQGVVVDACGQTSSPDIYAAGDVAVWPLRHGGRRALETYINSQQQAEAAVAAMLGEYNPVPQVATSWTEIAGHRIQMIGDMQGPGEYVQRGEFEPNQQTVLFRVLDGKALAAVAINSTKDFGGVSRLVMSEIEIVPDHLADTDISIRELLKGNAARTVTA

SEQ ID NO: 6636 - protein, 388 aa, Bradyrhizobium japonicum USDA 110
MDSLCRTSGMNTLSNTITVAVVGGEGIGPEVTDQSHRILKWFSDRRGAPVILREAQYGLIPYLATGKVLPDDTVEAMEEADAILWGATGGPETTEVPPAARKAGSLLSLRSKYDLYANLRPIVANPALADSAPLKAAVLKDVDFIIIRELTSGIYFGEPRGIETLPDGQRRGFNTQQYTTSQIRRVARTAFELARTRKGRVCSVDKANVLETSVLWREEVTALHEAEFSDVELTHLYVDNAAMQIVRAPSQFDVMVTCNIFGDILSDCAAMASGSLGMLPSVSLGPPDRLGRRKALYEPVHGSAPDIAGKGIANPLGSILSVAMMLRITLHRPEDAALLEKAVDTALAAGARTADIAEPGAKRLSTQEMGDAVLNALDKVVGKEREHA

SEQ ID NO: 6637 - protein, 355 aa, Oryza sativa
RPRNAAFLAPLRTSSAVCTKAVSNSDGTPGTSSSPHVVCFGELLIDFVPTVNGVSLAEASAFKKAPGGAPANVAVGIARLGGSSAFIGKVGDDEFGYMLADILKENNVNNQGLLFDAHARTALAFVTLRNDGEREFMFYRNPSADMLLEEKELDLDLIRKAKIFHHGSISLITEPCKTAHIAAAKAAKDAGVLISYDPNLRLPLWSSADDARDGILSIWETADVIKISEEEVSFLTKGEDPYDDSVIKKLMHPNLKLLLVTEGPEGCRYYSKEFNGRVGGLKVNAVDTTGAGDAFVAGILSQLSVDFSLLQDEGRLKEALKFANVCGALTVTERGAIPALPTRQQVVDALTKVVA

SEQ ID NO: 6638 - protein, 102 aa, Nitrosomonas europaea ATCC 19718
MDVVDSIEKQVSSHPVVLYMKGTPQQPQCGFSANAIRILNACGVEDFFAVNVLADPEIRQGIKDYSSWPTIPQLYVNGEFIGGSDIMSEMYQNGELQKLFEK

SEQ ID NO: 6639 - protein, 506 aa, Phalaenopsis hybrid cultivar
MSIFLIATLFLSLSLHLLLRRFRRRRRILPLPPGPLNFPIVGALPFIGSMPHSGLALLSRRYGPIMFLKMGIRQVVVASSSSAARSFLKTHDSRFSDRPLDIISKQVSYNGQNMVFADYGPKWKLLRKVSNLHLFGPKAMSRWADVRRDEAFSMSHFLKKQSDSKNPVLLSNLLVCSMANVIGRISMSKRVFDEEGKEAKEFKEIIKELLVGQGASNIGDLVPAMRWLDPQGARKKLLGLNQRFVRMISKFLAEHGESRGEREGNPDLLDLIVADKIAGDDGEGLSEENIKGFISDLFVAGTDTSAMVIEWAMAEMLKNPAILRRVQEETDRIVGRDRLLEESDIPNLPYLQAICKEALRKHPPTPLSIPHYASEPCEVEGYHIPGKTWLLVNIWAIGRDPEVWEKPLEFDPERFMEGKMARIDPMGNDFELIPFGAGRRICAGKLMGMVMVQYFLGVLVQGFDWSLPEGVVELDMEEGPGLVLPKAVPLLVTARPRLPAAAYGVV

SEQ ID NO: 6640 - protein, 897 aa, Gibberella zeae PH-1
MPRRGASPTPSEGEIDIFGSLYPGETDNANGGNGGDDFDFDGLLNNPEPGNDDTDEAFIALQQAASFRKATNLKGRTVKKGGGFQAMGLNNNLLKAITRKGFSVPTPIQRKAIPLILDRKDLVGMARTGSGKTAAFVIPMIEKLRAHSARFGTRALIMSPSRELAIQTLKVVKEFSRGTDLKCVLLVGGDSLEEQFGYMAANPDIVIATPGRFLHLKVEMSLDLSSIKYVVFDEADRLFEMGFAAQLTEILHALPPSRQSLLFSATLPASLVEFARAGLQDPSLVRLDAEQKVSPDLESAFFAVKGAEKEGSLLHILHDVIKMPVGSPEGVNNDSEKGSKKRKRGADGGSGKPTEHSTIIFTATKHHVEYLANLLIYAGFAVSYVYGSLDQTARRIQVEDFRMGKTNILVVTDVAARGIDIPVLANVINFDFPPQPKVFVHRVGRTARAGQRGWSYSLVRDTDAPYLIDLQLFLGKKLVVGQETKNPSFSEDVVVGALKRDPVEGHVEWFNKSLHESEDINALRGVAVKAEKLYLRTRNSAASQSAKRSKELVGSQGWTQLHPLFGEDVDGAEQARVDMLARISGFRPQETIFEIGGRRDKGTTEAAEVMKQLRKRITPRRQTEAKADDDFEGIGDDIPAAAEAGADSDEEEVVMDEMDVDEESDDGLEVTVTNTNSKKGRTDWRDSEVFMSYTPRTFNAAEERGYGVSSGGQDPSNFVEAARGVTMDLTNDENAKSFGEPTRSKMRWDKKSRKYVSRENDEDGSKGAKMIRGESGVKIAASFQSGRFDKWKRANRLGKLPHVGEQVRPGSASHAANLPSGVRYKHKQERAPKEADKYRDDFEVRKKRVDEAREKRVGRFRDGMGSKKELKGREDIRKARIEKEKKRLKNARPTRRK

SEQ ID NO: 6641 - protein, 322 aa, Nitrosomonas europaea ATCC 19718
MSIESIRNVIAKDMGEVDNVIQQKLHSQVALVRQVSEYIIHSGGKRLRPALVILAAGLFDYKGLHHHNLAAVVEFIHTATLLHDDVVDESELRRNQATANALFGNAASVLVGDFLYSRAFQMMVEVGNMRVMEVLADATNTIAEGEVLQLLNCRDPDVEEENYLQVIRFKTAKLFEAAARLGAILGGATPAEEEALAAYGMHLGTAFQLVDDLLDYSGNDQDTGKNLGDDLAEGKPTLPLIFAMRSGIPEQVDTVRHAIETGGKDGFEPILKIIQESGALDYAKQCAQNEANMAISAITAIRDSIYKQCLLELAEFAITRNY

SEQ ID NO: 6642 - protein, 368 aa, Rumex palustris
MPAPRIMDPYKDKSSHYHHRRHLDFQSVEELPDAYEWGPLESHGGPVGADQGVPIVDLKGPNARELIGSACKSWGAFQVINHGVPQRFLEEVESAGRRLFSLPLHQKLKAARAPDGVTGYGPARISSFFPKLLWSEGFTIFGSPEDHARQLWPQDYQNFCEIIEEYDRDMKRLAGRLMWLVLGSLGIAKDDVEWAGPTGDFNDTCSAALQLNSYPKCPNPGRAMGLAAHTDSTLLTILYQNNTTGLQVHRDGLGWVMVPPVPGALVVNIGDLLHILSNGLYPSVLHRAVVNRTHHRLSVAYLFGPPQSVRISPLERLVDPDHPALYRPISWTEYLSTKAKHFNKALSSVRLCGPPVDRTVSSIVEVGS

SEQ ID NO: 6643 - protein, 513 aa, Vibrio parahaemolyticus RIMD 2210633
MDFNLALKLYTAEQVKNGEVVAAHMAGVSMYSLMQRAGMAVYERFLHLYPRAKNVLVVCGKGNNGGDGYVFASLAKQAQLNVQVFQIGDVTQLQGDALRAYQDWQTVDGKNSSWDDWNTALLEAEVIIDAMLGTGLKGEVRTEYRRYIEQINQIQCPVIAVDIPSGLCANTGSVLGDAIQADHTVTFIGVKQGLCTAQARDRIGELHFCGLGVNVEFDAIEEESALGIDHKVIPRLLPKPKATAHKGDNGKLLCVGGNQGMSGAIRLCASAAVRSGAGLTASITHPDSFIPLQVSCPEVMSQSITTDLLRDTENALTKRIRWADVLVFGPGFGDDEWAYQAYQYLSQEQKPKVVDADGLNILAMLSQRCDGTLVCDNQRVITPHPGEAARLLNVTTKQIESDRYSAARQLQERYGGVVVLKGAGTLVFDGVRMYVCLAGNPGMATGGMGDVLSGVIGALLAKGLPISIAARLGVMIHSHAADLNAEKHGEVGLLATDVVETLRAATHIQRAKN

SEQ ID NO: 6644 - protein, 399 aa, Rumex palustris
MAIECMHKTDHEVKQGREPLSLVFDSKILRNQASIPKEFIWPDDEKPDHEAAELEVPVIDMEGFCREETKSTNNASKLVQEAFMKHGFFLVKNHGVEAELIKHTHKYMREFFELPLVEKQRVQRKLGEHCGYASSFTTRFSCKLPWKETLSFPYSPEEANNTKVVEEYFNSKMTKDFAHMGKLYQEYCEAMNKLSLRIMELLGLSLGVGRQYFRDYFQGNDSVMRLNYYPPCQEPELALGTGPHCDPTSLTILHQDHVNGLQVFVDGEWRFIYPRFDTFVVNIGDTFMALSNGKYKSCLHRAVVNDTSPRKSLAFFLCPKEDLIVCPPNELVNESSPRVYPDFTWPIFLEFTQKHYRADMNTLLNFSRWVRERNQVQQSDGSSSVCPSIHLSCCNVQIK

SEQ ID NO: 6645 - protein, 159 aa, Glycine max
MDPPTSYISSDELRKHNTRHDAWISIHGKVYDVSSWLHRHPGGPLPLLSLAGTDATDAFLALHPPNSASLLLPAFATPHLLSDHSVSPASSDYRKLFSDLSSLNLFNRKGHTTSILLSLILVLFPLSLCGVLLSDSTCVHVLSGALVGFLWIQSGWIGH

SEQ ID NO: 6646 - protein, 526 aa, Gibberella zeae PH-1
MNPSLISKAARPTRVLAQNAPKIQCLRKGAQLHTAAWHVGSQRQPSFRKGSQSPSAKRLFHATNAVQQKDPYQALGVGKTASAGDIKKAYYGLAKKYHPDTNKDPQAKDKFADIQSAYEILSDPKKREQFDQFGAAGFDPSGGGAPGGGGGFGGGHPFSGFGGFGGQGGFGGFGGQGGFGAGVNFEDIFSAFTGQQGFGRRSRQQAYQQEILVGENIEVQSTISFMEAAKGTTKTISITPLSTCDTCKGNGMKSGSSRSACSACDGSGTRINYMQGGFQMASTCGTCGGTGTVIPRGSECKPCSGNGVVRERKTITVDIPAGIEDGMRLRVDGAGDAALTGRSAEPNARSQNGDLYVFVRVAKDPKFRRDGSNILYTANIPLTTALLGGHAEIPTLDGTVNVKVATGTNTGDKITLPGMGMKRLGSRRGGNGDLRVEYRVSMPKYLSANQRTIVEVLADEMGDKTAKRVMGVGSSRDPNDPDTHRDEGFLKSLWHTLTNHPAHQKPNEDGSQNDGSTKKPGDDDKK

SEQ ID NO: 6647 - protein, 215 aa, Arabidopsis thaliana
MAVVSKNQTQQQTPNPGGGVSRIEDSTNGKTCHQCRQKRTDLVGSCVTKKKDKTCPIKLCTKCILNRYGENAQEVALKKDWICPKCRGNCNCSYCMKKRGQKPTGILVHTAKKTGFSSVSELLKTSGSDKYFYTKKVKPEGVVVVSPLKLDQENSIEQKHVSIKKSRKTKREELKDINNGCSNENVVVKKSNPKKIKLSDSVHATTEVIKKVLAE

SEQ ID NO: 6648 - protein, 278 aa, Silene vulgaris
EAHSLKVEKILFQGKSKLQDVMVFQSSTYGKVLILDGVIQLTERDECAYQEMISHLPLCSIPNPKKVLVIGGGDGGVLREVARHSSVEHIDICEIDEMVVTVSKEFFPEVAVGYDDPRVNLHIGDGVAFLKAATEGSYDAVIVDSSDPIGPAKELFEKPFFESVAKALRPGGVVCTQAESIWLHMHIIEDIVSNCREIFKGSVNYAWTTVPTYPSGVIGFMVCSTEGPAVDFRNPVNPIDKMEDEKRPLKFYNAEIHSAAFCLPSFAKRIIEAKANST

SEQ ID NO: 6649 - protein, 278 aa, Silene latifolia
EAHSLKVEKILFQGKSKYQDVMVFQSSTYGKVLILDGVIQLTERDECAYQEMISHLPLCSIPNPKKVLVIGGGDGGVLREVARHSSVEHIDICEIDEMVVTVSKEFFPEVAVGYDDPRVNLHIGDGVAFLKAATEGSYDAVIVDSSDPIGPAKELFEKPFFESVAKALRPGGVVCTQAESIWLHMHIIEDIVSNCREIFKGSVNYAWTTVPTYPSGVIGFMVCSTEGPAVDFKNPVNPIDKTEDEKRPLKFYNAEIHSAAFCLPSFAKRIIEAKANST

SEQ ID NO: 6650 - protein, 427 aa, Burkholderia sp. 383
MSAIVDIIGREILDSRGNPTVECDVLLESGTMGRAAVPSGASTGSREAIELRDGEAGRYNGKGVLKAVEHINTEISEAIMGLDASEQAFLDKTLLELDGTDNKSRLGANAMLAVSMAVAKAAAEEAGLPLYRYFGGSGAMQLPVPMMNIVNGGAHANNSLDIQEFMIVPVSQPTFREALRCGAEVFHALKKILSDRGMSTAVGDEGGFAPNFGSNDECLSTILQAIEKAGYRAGEDVLLALDCAASEFYHDGKYQLAGEGLQLSSAEFTDYLATLADKFPIVSIEDGMHESDWEGWKLLTDRLGKKVQLVGDDLFVTNTRILKEGIEKGIANSILIKINQIGTLTETFAAIEMAKRAGYTAVISHRSGETEDSTIADIAVGLNAGQIKTGSLSRSDRISKYNQLLRIEEDLGDIASYPGKSAFYNLR

SEQ ID NO: 6651 - protein, 156 aa, Haemophilus influenzae
NRANTPVLVDGKDVMPEVNAVLAKMKDFCQRIISGEWKGYTGKAITDVVNIGIGGSDLGPYMVTEALRPYKNHLNMHFVSNVDGTHIAETLKKVNPETTLFLVASKTFTTQETMTNAQSARDWLLKATKDESAVAKHFAALSTNAKDVEKFGIDTN

SEQ ID NO: 6652 - protein, 597 aa, Desulfotalea psychrophila LSv54
MKNIRNFSIIAHIDHGKSTLADRMIQECGVITARDFQDQLLDNMDIERERGITIKSQTVCLPYTAKDGKEYILNLVDTPGHVDFSYEVSRALTSCEGALLIVDAAQGVEAQTLANLYLAMENDLEIIPVINKIDLPSAEPEKVALQIEEDLGLDADLIQLCSAKTGVGVHEILDSIVEHLPAPEGDAKAPLQALIFDANYDPFRGTIISVRLINGTVKAGDIIRFMSTGIEYKVEEVGLFKVQREARKTLSAGEVGYILAGIKTVQDTRPGETITLKANPCEAALAGFQEVQQVVFSSIYPIDTDDYEDLVVALEKLKLNDAALTFEKDSSVALGFGFRCGFLGLLHLEVVQERLEREFNISLILTVPSVKYIFTLSDGTTKEVDNPAHFPDPTHIDEVKEPFIKASILIPEKYMGAVMNLCMERRGENTTFHYPTPGRIEFICELPLAEVIYDFYDRLKSVTQGYGSFDYELIDYRKSDLVKLDILVNSEPVDALSQLVHRVNARKRGLHSCEMLKEEIPRQMFKIAIQAAIGGNVVARTNISAMRKDVTAKCYGGDISRKRKLLEKQKAGKKRMKTVGNVDIPQTAFLAVLKSEQ

SEQ ID NO: 6653 - protein, 128 aa, Triticum aestivum
MGRTTMLLMALALALTAVAHATPPALRRSRFLADKTPPPLSYYDCVRKPPSVCLEPGSPGNTCCKGTCTNTLSSVEHCGNCNRKCKYGDTCCDGKCVDLLKDKKNCGECSNQCANSVKCEFGMCDYAG

SEQ ID NO: 6654 - protein, 288 aa, Triticum aestivum
  misc_feature (208)..(208): Xaa can be any naturally occurring amino acid
NPESAWSRDLRELAPLEAILFDIDGTLCDSDPFHFLAFRELLQEVRAFAFASLAFPLSPAAGLQLPCDRPQVPLLNSAGSLNRISLQVGFNNGVPITEEFYSANISGWHNDALAGALFPELDHAKGMEFMDRKEALFRKLAAGELKGLAGLQELCTWIEGRNLKRAAVTNAPRANAELVLSLLGLTSFFPVLVIGSECERAKPSPDPXYLKALDLIGASPDHTFIFEDSASGIRAGVAAGVAVVGLTTGNPEKVLRDAGASLLIGDFRDPKLMAMLQELDPAAADKQG

SEQ ID NO: 6655 - protein, 507 aa, Synechococcus sp. CC9605
MWPPADSDHVLVDAASMAAAEQRLFESGMPVAALMEKVGLAMAAWLLARRDLLRHGVVVLVGPGHNGGDGLVVARELHLAGIEVSLWCPLPIRKTLTAEHLRHGEWLGLRQRIEEPNPGGAELWLDAVFGLGQSRPLPELLADLFRRRQHLRPGALISLDVPSGLCSDQGTVLGEQAACASVTLSVGWLKRGLCLDPARSWVGALVRIDLGLPPAVMGNAAAVLPRRLPVTEACSAPLPPLPPTAMKYERGRCLVVAGSDRYPGAAHLALRGAMASGCGCVQAVVPPRLQSTLWQVLPEVMQLEDGVIPERLDAVLVGPGLGKLTHWWSQWSEQMLSVSGLLVLDADGLNGLAASPQGWRWLLKRRGATWLTPHAAEFSRLFPDCDAGDALEKAIAAARCSRCCILLKGAHSVLADPTGAAVVLTSTSPHVARTGLGDLLAGFATGWGAQTVASQQQPGLESFAAAASLHGLAAARARSSDASTIADCLKINTARCQKKQTTMFNEV

SEQ ID NO: 6656 - protein, 574 aa, Aspergillus oryzae
MSSSGGTGSSLAKAVVIVSGVSSLVASLLSLLVPIYAAASWTSIVSLKASLWLDPIRDVYEAFTIYTFFQLLINFLGGERALIIMTHGRPPVQHAWPLNHFLPKLDISDPHTFLAVKRGILQYTWLKPILAIVSIIMKATDSYQEGYLGLTSGYLWTGIVYNVSVTISLYSLAMFWVCLHNDLAPFRPVPKFLCVKLIIFASYWQGFFLSILQWLGALSNGVAGYTPDNLAAAIQDTLICFEMPIFAITHWYAFSWHDYADPTISSARLPVIYALRDAFGIRDLIEDTKMTLRGDNYAYRLFDSGDHIMAHAESESRVRRMMHGMRYERGGKGKYWIPTPGEINSRTPLLGGVESSRRGSIVDRFRSPSEVEESTLDEGDEQLFTKARALEFGDWNYPVITANQAPQDQRLSSYQNPQQPNVVKKSRKHRKVRAPGSGETQPKSDSTPSKSRRQRTENRAPLQRGPSSSTSQNSHRSQLVDLVVEDREAEKKERAEHQRMTGSALLEPEHRYFQTPSGHPLSEQSQITPSEGPGSPSERVRQPTERDEGEGTDNDDPKTPGWSYEGLEENVWGQ

SEQ ID NO: 6657 - protein, 369 aa, Synechococcus sp. CC9605
MIAIPQVDMGQDLAVDSAPIGTATAGPHAERLSKLVTTQRATVERDTGLELYRDMTLGRRFEDKCAEMYYRGKMFGFVHLYNGQEAVSTGVIGAMKRQHDWFCSTYRDHVHALSAGVPAREVMSELFGKETGCSKGRGGSMHLFSKEHHLLGGFAFIAEGIPVALGSAFTSRYKRDALGDASSNAVTAAFFGDGTCNNGQFFECMNMAQLWKLPIIFVVENNKWAIGMAHDRATSDPEIWRKASSFGMAGEEVDGMDVLAVRAAAQRAVERARAGEGPTLLECLTYRFRGHSLADPDELRAEEEKLFWAKRDPLKALERDLTEAGLVNSDELRAIEKDIDDIVQDCVDFALSAPEPDPAELTRYIWAED

SEQ ID NO: 6658 - protein, 689 aa, Oryza sativa (indica cultivar-group)
MWHLGSGSCSFSSPLSPFVLTRRDRRGVKMSGAALVAIAASIGNLLQGWDNATIAGAVLYIKKEFKLESEPTVEGLIVAMSLIGATIITTFSGPVSDWIGRRPMLILSSILYFLSSLIMLWSPNVYVLLLARLIDGFGIGLAVTLVPLYISETAPSEIRGLLNTLPQFSGSGGMFLSYCMVFGMSLLPSPDWRIMLGVLAIPSLFFFGLTIFYLPESPRWLVSKGRMAEAKKVLQKLRGREDVSGEMALLVEGLEVGADTSIEEYIIGPAIEPADEHVVDGDKDQITLYGPEEGQSWIARPSKGPSILGSVLSLTSRHGSMTTSAEGKDIAHHAHRGSALSMRRSSLLEEGGEAVSSTGIGGGWQLAWKWSEREGEDGKKEGGFKRIYLHQEEVPGSRRGSVISLPGGGDAPEGSEFIHAAALVSQPALYSKDIIEQRMSGPAMIHPSEAAAKGSSWKDLFEPGVRRALLVGVGIQILQQFAGINGVLYYTPQILEQAGVAVLLSNLGLSSASASILISSLTTLLMLPSIGLAMRLMDISGRRFLLLGTIPVLIASLVVLVVSNVIDLGTVAHAALSTISVIIYFCCFVMGFGPIPNILCAEIFPTRVRGICIAICALTFWIGDIIVTYSLPVMLNAIGLAGVFGIYAVVCSIAFVFVFLKVPETKGMPLEVITEFFAVGAKQMQATKA

SEQ ID NO: 6659 - protein, 440 aa, Streptomyces coelicolor A3(2)
MTSPSAPSSAERPRLPGALDGPRLAAAAAEHGTPLWLYDAATIRAQIDRLRRFDVIRYAQKACSNLHILRLMREEGVHVDAVSEGEIERALAAGYRVGGDDEPIVFTADLLNRSTLRRVVELGIPVNAGSPQMLDQVGRAAPGHPVWIRINPGFGHGHSRKTNTGGEHSKHGIWHEHLEESLALVDRHGLDLVGLHMHIGSGVDYGHLESVCETMVKQVRMAGRDIRAISAGGGLSVPYTPGDPEIDTDRYFELWDAARRELVSELGHPVRLEIEPGRFLVAGAGVLAAEVRAQKPVGSNYFVLVDAGFNDLMRPAMYGSNHRVSVLDADGAPRASDARDTVLAGPLCESGDVFTQVEGGDVEPVPVPRTDVGDLVVFHDTGAYGASMSSTYNSRPLIPEVLVDGAETRLIRRRQTVAELLAPELEPGPALSPRPSRDPR

SEQ ID NO: 6660 - protein, 163 aa, Triticum aestivum
RDTIEPEIDPEAIKFKEMLEAQKKAALENEMPVGPMPLPRADGHISYGGALRPGEGDAIAQYVQQGKRIPRRGEVGLSADEIQKFEDLGYVMSGSRHQRMNAIRIRKENQVYSAEDKRALAMFNYEEKSKREHKVMADLQRLVSRTIGQETGPSHDPFATTDD

SEQ ID NO: 6661 - protein, 503 aa, Nierembergia sp. NB17
MMQLSTELAIAAIIFLLAHILISKTSGRRLPPGPRGWPVIGALPLLGDMPHVSLAKMAKKYGPIMYLKVGTCGMAVASTPHAAKAFLKTLDINFSNRPPNAGATHFAYNAQDMVFAPYGPRWKLLRKLSNLHMLGGKALEDWSNVRANELGHMLKSMLDLSREGQRVVIADMLTFAMANMIGQVILSKRVFVDKGVEVNEFKNMVVELMTVAGYFNIGDYIPCLAWLDLQGIEKGMKILHKKFDVLLTKMFDEHKTTSHEREGKSDFLDMVMANRDNSEGERLSTTNIKALLLNLFTAGTDTSSSVIEWALTEMLKNPSILKKAQVEMDQVIGKNRRLLESDISNLPYLRAICKETFRKHPSTPLNLPRISSESCEVDGYYIPKNTRLSVNIWAIGRDPDVWENPLKFNPERFLSGKYAKIDPRGNDFELIPFGAGRRICAGTRMGIVMVEYILGTLVHSFDWKLPSDVIELNMEEVFGLALQKAVPLEAMVTPRLPLNVYAP

SEQ ID NO: 6662 - protein, 2052 aa, Yarrowia lipolytica CLIB122
MDPLDIGNSQPREGWNRLNAFSNDGVSPTSNSYDHDELPPSPTSRTAFTGIDPDYEFAPKWEPGHGNNNSSIDDPLYSTLDPHARANASLTRSAPGPPPPGQRPPPERPTVITPVGTHTPSAGGSRAVTPISTNVDRRPSYASQGTTGSTGSKKSIPQKVMDLFVSDDTSADSDGQSSSSKKHHKVKLPRPSKSMFFFKKHDDDDSRSEHSRERTERTSHPGDGHQLRAARSFNKPDHGIFHKAATSNHFDDSNSIHRATSHSTLPSGDEDDTLIALAHKAKKSSKNIIGKVFHHKDKKKKSHTFDGPINPLESHAQPFRNASVASVPEPHAPKQQPTMRSASTVSHLDPHRNSSTSSRDHMASSSRDHTASSSREQVLNMISKRPSLANANFYNLDTDLDSMAGIVEDGGASSSANSSALPRHASTGSAAADSIPGMPVLPGGSISGPMGGPMVGDRSSVSTNNNTNNANNANNSNHNSVSGVASPTPVVNTANASGTTAAPVIGVGTDLSFIGNDDTAPQTNAGQWSAPESWAVADTGPGGGSKLEPEEIVETYADPTREQYGLETNVSTHIPGKPPINYFVRIFRQDDSFGTIVCPLETTVSELIQILGKKFFLPSVKGYQLCVRIGGLTRVLDLLEKPLLYQKILLEFMGYTEKDRLVEVGREDLSYLCRFLFLPSSIQTFTPEEEAIMSRDYVHADLQNLELQTIPIIFYQFSNEIEYLDVSNNPSISIPLDFIQSCINLKNLRFSGNRSRFFPVNISHAVFLEYLDMSRNMIKDVAQIRFERMSALTTLDLSCNQLTRINNNVALLKQLRRLSLSNNNVTDFPMAVCNLSNLIELDLSFNRLSSVPASISKLVNLERLVLNNNYISKLPNDIKNLVQLKELDVRYNRLNNVDALSSLPLLEVLYASKNQITSYEHNFESLQCLYFDRNPFTEVNVSNVLHTLTVLHLSKAKLSTLPENFFDRLPNLEKLVLDKNHFVSLPSSLGSLRKLIYLSAVGNNLSVLPSSIGQLTTLQFLDLHSNNLRKLPDEIWNLNVLSTLNVSSNLLDSFPKHKFHVSSVSSGDAFHRNLESEFDSNYEMRIRRPSAFSITSTLSPGETSRRGSLAYNSPKMSTSPMTFARDAPVSSRTTLANSLLILSLADNRLNDECFEELSLLTSLQVLNLSYNELMDIPYGALRRLNRLTELYLSGNNLTSLPADDFENIKTLRTLHVNGNKLHSLPAELGKILHLTVLDVSSNQLKYNISNWPYDWNWNWNLDLKYLSFSGNKRLEIKSAANNLMRHGDGTEQKNLSDFTVLSQLRVLGLMDVTLTTPSVPDQTENCRVRTYGSELNNMPYGMADSLGQHENLSIIDMVVERFRGNENEVVVGMFDGRNEINPRAGNKVAKLLQEMFGALLQDELKKMRDDDTIEDALKRSFLAANRDIGAAALTTVESHTAHRSSTTTHLNKQDGLTGSCATVCYISDNKLYVANVGDSMCILSKGTGEHRLLTTRHDPTEPEELGRVRAGGGFISAHGKLDGVCDVSRAFGFYNLIPHIQARPDIVSMELNDSDELLIIGSKQLWEVMSYETAVDIARTESQDPMLAAAKLRDFAISYGASDKLMVMVLGIGVKRRTANQSNLISGLPPVGEDELFQPYRKRRDKSLLPEDSNLARLGSEVDPPEGEMAMVFTDIKNSTLLWETYPIAMRSAIKIHNAIMRRQLRILRGYEVKTEGDAFMVSFTTPTSALLWCFSVQQQLLAADWPAEILESEEGYEVRDDEGNVVFRGLSVRMGIHWGSPVCEPDPITRRMDYFGPMVNRAARVSAVADGGQITVSADFISKVKKLQSLREKMNAENISLGEAFNDEITGQAITQNLDMLDSLGWIVKEIGELKLKGLENPEFLSLVYSAPLASRHGMQEDLLHPKKKAGGFTSDLLSQVLEIALRLEHMCARFNGQSRPVSLKDIQRHAIQHIAPTPESELGVYFENIVTRIENAIMMLCMRHTVARAGGFDPINIDNVNTSASTHGVEIGQLLDAVAQLTGIRYVPEGQQYHERQPEMESSVQVEEIN

SEQ ID NO: 6663 - protein, 533 aa, Oryza sativa (japonica cultivar-group)
MVHVLLQVGADDTATLDKIIDSLTSLANAHGDPNARREIELSLKIGKVNECGTDDSMAKEGSKVLILGAGRVCRPAAEFLASYSNIFSSSAYDHDIDQIHVIVASLYQKDAEETIDGIRNATAAQLDVADIKNLSNLVSQPASFHAAIARVCIEMKKHLVTASYVDESMSKLEQSAEGAGVTILCEMGLDPGIDHMMSMKMIDEAHSRKGKIKSFTSFCGGLPSPASANNPLAYKFSWSPAGAIRAGRNPAVYKFHGEIIHVDGDKLYESAKRLRLPELPAFALEHLPNRNSLMYGDLYGISKEASTVYRATLRYEGNEIMATFAKIGFFDAASHPLLQQTTRPTYRDFLVELFNACNISTTARKEYSEVSGGQDGELISRLLSFGHCKDKEIAAKTVKTIKFLGLYEETQIPENCSSAFDVICQRMEQRMAYIHNEQDMVLLHHEVEVEYPDGRPTEKHQATLLEFGKVENGRPTTAMALTVGIPAAIGALLLLQNKIQKKGVIRPLEPEIYIPALEILESSGIKLAERVET

SEQ ID NO: 6664 - protein, 227 aa, Oryza sativa (japonica cultivar-group)
MYPSLAAAKAAVIAIGEEIATFGLPSGICPIVFVFTGTGNVSQGAQEIFKLLPHSFVDAGKLPELSAARSLSQHPQSSKRVFQLYGCVVSSRDMVTPKDPTRCFNKADYYAHPEHYKPVFHERIAPYASAIVNCMYWERRFPRLLSIDQLQQLMKNGCPLVGISDITCDIGGSIEFVNKSTSIERPFFRYDPCTNSCHDDMEGNGVICLAVDILPTEFSKEVGSFIE

SEQ ID NO: 6665 - protein, 278 aa, Silene latifolia
EAHSLKVEKILFQGKSKYQDVIVFQSSTYGKVLILDGVIQLTERDECAYQEMISHLPLCSIPNPKKVLVIGGGDGGVLREVARHSSVEHIDICEIDEMVVTVSKEFFPEVAVGYDDPRVNLHIGDGVAFLKVAPEGSYDTVIVDSSGPIGPAKELFEKPFFESVAKALRPGGVVCTQAESIWLHMHIIENIVSSCREIFKGSVNYAWTTVPTYPSGVIGFMVCSTEGPAVDFKNPVNPIDKTEDEKRPLKFYNAEIHSAAFCLPSFAKRVIEAKAKST

SEQ ID NO: 6666 - protein, 363 aa, Shewanella sp. MR-4
MEIKYDLKPASERRTEQFKPEGNVGFGSLRTDHMFLMDYRDGEWRDPRIVPYGPFEMAPGAMALHYGQSIFEGAKAFMHEDGEIYTFRINKNAERMNRSADIVCIPNIDEQMQIDAINALIDVDRLWFPMQEGACLYIRPFIFATEDRLSVSPSTRYTFCVVLSPSGAYYAAGVNKGIRLLISKTYHRAVSGGTGASKAAGNYAASLRAGKAAAQFGASQVLYLDANNQQIEEAGAMNHFHILKDGTVIIPTFTDTILKSITSQSIMELGELLGCEVRQETVMLDKFIADIESGEIIEAGGFGTAAVVSAVGSYIFEDGRVVTVGNGEVGEHIQRIYKLYTDIQKGHIQGPDGWVKRVERVAP

SEQ ID NO: 6667 - protein, 569 aa, Schizosaccharomyces pombe 972h-
MAMSSITSAKQLNAEELLDECDSFNGEFVPGTIPFRANGAAIGYVTPLVLEILIKADNFKFNWVYVPGEYIEINASTFEKRTDILAKVLEHWRHNNTFGIADQWRNELYTVYGKSKKPVLAVERGGFWLFGFLSTGVHCTMYIPATKEHPLRIWVPRRSPTKQTWPNYLDNSVAGGIAHGDSVIGTMIKEFSEEANLDVSSMNLIPCGTVSYIKMEKRHWIQPELQYVFDLPVDDLVIPRINDGEVAGFSLLPLNQVLHELELKSFKPNCALVLLDFLIRHGIITPQHPQYLQTLERIHRPLPVPVGKYERGDSFEDTSKKAETCVPAKPQKATHQLAPCKAWLRDYDTDQKFAVLLLNQPIDIPDDRFRTLWKRASIRVCADGGANQLRNYDSSLKPDYVVGDFDSLTDETKAYYKEMGVNIVFDPCQNTTDFMKCHKIIKEHGIDTIFVLCGMGGRVDHAIGNLNHLFWAASISEKNEVFLLTELNVSTLLQPGINHVDCHDNIGLHCGLLPVGQSVYVKKTSGLEWNIEDRICQFGGLVSSCNVVTKATVTIEVNNFIVWTMETRL

SEQ ID NO: 6668 - protein, 814 aa, Fulvimarina pelagi HTCC2506
MQKLVVIGAGMASGRVLETLFETDPSAYEVTLFNAEPRGNYNRIMLSPVLSGEKSFEEIVTHDDAWYAGNHVTCRFGEKVVSIDRERKIVTGKNGELAYDKLIIATGSSPFIVPVEGRDLPGVIAYRDLDDTNTMIEVSGDREARAIVIGGGLLGLEAAAGLRLRGMEVTVLHLSGHLMERQLDEAAGFLLRKDLEKRGIEVMTKASTQKILGTDKVEGVELADGTVLKADLVVMAVGIRPSVEIAKQAGLAVNRAIAVNAQMQTSDPDIYAVGECVEYNGTLFGLVAPLYEQAKVLAKSLLGENDAFVVKELSTKLKVTGCDLFSAGDFAEGEIREDVVLRDPALGIYKRLVIENDRLIGAVMYGDTSDSNWFFDLIRDKTPIAEMRDTLIFGPAYQGGSPLDPMAAVAALPDDAEICGCNGVCKVKITGAITAKGLTSLDEVRAHTKASSSCGTCTGLVEQLMSLTLGDAFDPNAVKPMCGCTALSHDDVRRLIKAKELKSIPEVQQELQWSTPNGCAKCRPALNYYLVADWPDEYADDYQSRFINERVHANIQKDGTYSVVPRMWGGVTSSKELRAIADVVDKFEIPTVKVTGGQRIDMLGIRKEDLPAVWADLGQAGFVSGQAYAKGLRTVKTCVGTDWCRFGTQDSTGLGIRIEKFMWGSWTPAKLKMAVSGCPRNCAEATCKDIGIICVDSGFDIHFAGAAGLDIKGTEILGHVDTDDEVLEHVVALAQMYREQGHYLERIYKWAKRIGLDEIRRQIMKDHAARRAYYERFVFSQKFAQIDPWSERVSGKDKHEFQPMAELEFAQAAE

SEQ ID NO: 6669 - protein, 150 aa, Silene latifolia
FLKVAPEGSYDTVIVDSSGPIGPAKELFEKPFFESVAKALRPGGVVCTQAESIWLHMHIIENIVSSCREIFKGSVNYAWTTVPTYPSGVIGFMVCSTEGPAVDFKNPVNPIDKTEDEKRPLKFYNAEIHSAAFCLPSFAKRVIEAKAKST

SEQ ID NO: 6670 - protein, 205 aa, Schizosaccharomyces pombe 972h-
MSVNNEVSADQHNPELEDDTFEHGPPVSLGEKKSLNEYMKMDAEDESLQKWKASLGITGTGYSPSNDRRTVVILKLSLLVDGRDPVDVNMEDAASVEQIRKKGFTIKEGSEFKIGVKFRVQHEVISGLRYVQTVRRRGFVVDKTSTMIGSYGPSETPYDFTSEPDEAPTGMLARGHYEANGKFVDDDKVVHHEFVWAFDVAKSWK

SEQ ID NO: 6671 - protein, 362 aa, Bradyrhizobium sp. BTAi1
MQQDARSPLAHLGGALGFGKYMTNAMVLCRYSDGTGWEKPSLVPYGTLAFDPCALVLHYGQAIYEGMKAYRSPDASIALFRPDRNAARFRASARRMEMAEMPEGLFIEAVSTLVDAQRDWVPAGAESSLYLRPVMVADEAAFGVRRSTTYLFFIVATPVDALYRDGMAPFRLMVSEDFARAAPGGGGDAKTSGNYGRTLIALEAARRSGFNNVLWLDPVEREFIEEAGITNVFVRRGRDLLTPPLNGRILPGVMRETILQVARDWGLSAIEREISVTELLSGIDAGDVDEVFLSGTAVHVAPVGVIARRGREHRLAAAGEAQSLAKRLSQAISEIQRGLVADTRGWMRRVAAPSDCLVLSEP

SEQ ID NO: 6672 - protein, 891 aa, Fulvimarina pelagi HTCC2506
MKHANEIGRTVRTTCAYCGVGCGVLATPEGNGLVKISGDPNHPANYGRLCSKGSALGETLGLEERVLHPMIGGARADWENALDLVASRFTAAIEEHGPDSVAFYLSGQLLTEDYYVANKLMKGFIGSANIDTNSRLCMASSVAGHKRAFGSDTVPGTYEDLEKADLVVLTGSNLAWCHPVIFQRIAAAKAERPEMSIVVIDPRRTATCEIADMHLAIRADGDVALFSGLLNALAENGAIDCDYIGQHTEGFVDAMRESRSMRLRHVSERTGLGPEEIRAFYELFKRNKKVVTVYSQGVNQSASGTDKVNAIINCHLATGRIGRPGMGPFSVTGQPNAMGGREVGGLSNMLAAHMELGNAEDRARVKSFWNAPRIAEKSGFKAVELFEAAADGKIKALWIAGTNPVVSMPDADAVKRALEACPFVVVSDVIAETDTTPFADVLLPAAAWGEKNGTVTNSERRISRQRPFLPLPGEARPDWTIFADVARRMGFAGFDYRSASEVFDEHARLSGVENDGARDFDIGGLAGLSEAEYDLMAPVQWPLPAGRVARETRFFAKGGFYHGDRRARFVAVKPPKPEETADFTLNTGRVRDHWHTMTRTGLSARLSAHIAEPFAEIHPADAERLGIAAADLVEVASPQGSAVVRALITDRQRPGNVFVAMHWTSRYAPSARIGAVAHSATDRASGQPALKSTAATVKRFEAAWHGFAILTSRPDLDAIGRHAAYTATARTEGGWRLELAGANPLGDAKAFALALFGEPEADIVGYRDARAGTERFAVFFAEKLLGALYLSPQPVAVSRNWAVAQLGLTDGAVGSRAELLAGRGPADRPDPGPIVCSCFAVGVNQISALVVSGEAVSVEAVGKALNAGSNCGSCRSEIKGIIENVRVKVPG

SEQ ID NO: 6673 - protein, 356 aa, Neisseria meningitidis Z2491
MTKHIAILRGDGIGPEIVAETVRVLDKLIAQGLDVGYEYAPLGGEAYDEYGHPYPEFTQNLCRKADAVLLGAVGSPQYDNLDRPLRPERGLLAIRKDLNLFANLRPAILYPELANASTLKSEIVAGLDILIVRELTGDIYFGEPRGIRVLENGEREGYNTMKYSESEIRRIAHVAFQSAQKRSKKVCSVGKANVLETTELWREIFEEIGKEYPDVELSHMYVDNAAMQLVRAPKQFDVIATGNIFGDILSDEASMLTGSIGMLPSASLDENGKGLYEPSHGSAPDIAGQNKANPLATVLSLAMLLRYSLNDEARAQQVENAVQKVLQQGLRTGDIYEEGTKLVSCSEMGDAVLATL

SEQ ID NO: 6674 - protein, 185 aa, Zea mays
  misc_feature (167)..(167): Xaa can be any naturally occurring amino acid
PADDPEANRPFYGPNQWPSKEVLPKWREVMEQYHREALRVAKSVARIIALALDLDVDFFDRPEMLGESIATLRLLHYEGKVSDPAKGVYGAGAHSDYGLITLLATDDVVGLQICKDKNAQPQLWEYVAPLKGGFIVNLGDMLERWSNGVFRSTLHRVVLDGRERYSXTCKSESNPPKFPPITCSA

SEQ ID NO: 6675 - protein, 406 aa, Xylella fastidiosa Temecula1
MNGFAVIPSVTTTTTSGEPIASDVARKQNLLELDREGLERFFEDVLGEKRYRAHQVMKWIHHRYVADFEQMTDVGKALRTRLQACAEVRVPRVVFDKHSADGTHKWLLAMGTDRKNAIETVYIPDKGRGTLCVSSQIGCGLNCTFCSTATQGFNRNLTTAEIIGQVWVAARHLGNVPHQQRRLTNVVMMGMGEPLMNFDNVVRAMSVMRDDLGYGLSNKRVTLSTSGLVPMIDRLSTESDVSLAVSLHAPNDKLREQLVPLNKKYPIVELMASCERYLSVNRKRDSVTFEYTLMKGVNDKQEHAHELAKLMRQFDCAMQVKGAAKVNLIPFNPFPGTCYERSTEVDIRAFQKILLDAQILAMVRRTRGDDIDAACGQLKGQVVDRTRRQAEFRRTIEDRVGRDVAA

SEQ ID NO: 6676 - protein, 141 aa, Xylella fastidiosa Temecula1
MVLERTLSIIKPDAVAKNVIGDIYSRFEKAGLKIVAAKYKQLSRREAEGFYAVHRDRPFFNALVEFMISGPVMIQVLESENAVARHRELLGATNPKDAAPGTIRADFAESIEANAAHGSDSVENAAIEVAYFFAATEIILR

SEQ ID NO: 6677 - protein, 336 aa, Xylella fastidiosa Temecula1
MNMAIKVGINGFGRIGRNILRSAVQNFGSNIDIVAINDLLEADYLAYMLQYDSVHGRFKGEIAIEGTALILNGKKIRLTAERDPGNLQWADAGAEIVIESTGLFLTQESAGKHLAAGAKKVIISAPSKDETPMFVYGVNHNSYNGEPIVSNASCTTNCLAPLAKVINDKWGITRGLMTTVHAATATQKTVDGPSNKDWRGGRGILENIIPSSTGAAKAVGKVIPSLNGKLTGMSFRVPTSDVSVVDLTVQLNTPATYKEICTEVKQQSEGPLRGILGYTEDKVVATDFRGETCTCVFDADAGIALDPTFIKLIAWYDNEWGYSNKCLEIAKVIAAK

SEQ ID NO: 6678 - protein, 348 aa, Arabidopsis thaliana
DNSVDLLTNDIGVVVVSDENGEPQGFNIYVGGGMGRTHRMESTFARLAEPIGYVPKEDILYAVKAIVVTQREHGRRDDRKYSRMKYLISSWGIEKFRDVVEQYYGKKFEPSRELPEWEFKSYLGWHEQGDGAWFCGLHVDSGRVGGIMKKTLREVIEKYKIDVRITPNQNIVLCDIKTEWKRPITTVLAQAGLLQPEFVDPLNQTAMACPAFPLCPLAITEAERGIPSILKRVRAMFEKVGLDYDESVVIRVTGCPNGCARPYMAELGLVGDGPNSYQVWLGGTPNLTQIARSFMDKVKVHDLEKVCEPLFYHWKLERQTKESFGEYTTRMGFEKLKELIDTYKGVSQ

SEQ ID NO: 6679 - protein, 156 aa, Haemophilus influenzae
NRANTPVLVDGKDVMPEINAVLAKMKDFCQRIISGEWKGYTGKAITDVVNIGIGGSDLGPYMVTEALRPYKNHLNMHFVSNVDGTHIAETLKKVNPETTLFLVASKTFTTQETMTNAQSARDWLLKAAKDESAVAKHFAALSTNAKDVEKFGIDTN

SEQ ID NO: 6680 - protein, 296 aa, Oryza sativa (japonica cultivar-group)
MADDGFKYHEEYVTNKRGMKLFACQWSPLDHEPKALIFLCHGYAMECSISMRGTGVRLAKAGFTVHGLDYQGHGKSEGLQGYINSFDDVVVDCSNYFASVCERGECKGKKKFLLGESMGGAIVLMLHRKEPTNWDGAILVAPMCKIVEDMKPRPIVITILSKLSNVIPTWKIIPTEDVIDKAIKSEEWRQEVRNNPYCYKGRPRLKTGYELFMASLDIESTLDKVTLPFIIVHGGDDAVTDPSVSEELYTSAQSKDKTLKLYPGMCHALTSGEPASNIDIVFLDIIKWLDERVSVS

SEQ ID NO: 6681 - protein, 578 aa, Desulfotalea psychrophila LSv54
MSSDLYRFKYDEFGNTRDIAVYGTGPSIMSCSYTNKSTAFSSKERDDFGLQGSLPPGFRDLEAQVENCHIKLGEKESEEEKYIFIRSLFDRNVTLAHALIQSDLEKFMGIIYTPTVGLAVQKYSAMFRQANGLHFSPDTIDQAEDILRRFAHRDIRVAVVTDNQGILGIGDQGAGGIAICLGKLMLYTQGAGIAPWHCLPISLDIGTDNEALLADKHYLGWRQKRLVGDEYTAFIDRFARAFRNVFPNALCQWEDFSKQNAFDIRDKYRHSMVSFNDDVQGTGAITFSAILSAMKVKRAKLTDQVFLIHGAGAGGVGIGEQIQVALMAEGLSEEEARDKVFTIDSRGVVTVDRKIEAYKKKFAKDGAKLSWLADPENHKLENVIKQAGVTVLIGTSGQGGCFTETVVKNMLGNTERPVIFPLSNPTHMAEAQPKDIYAWTNGQALVATGSPFAPVEHDGKTSRIGQCNNVFVFPGVGLGVLASGAREVLPEFFTAAAYAVSNSLSQEALDRGCLVPEVSEISKVSEKVALAVATCAIEHGVSRPCVYSDFSHNNDPARMKVLISKMRWSPEYLPMTAM

SEQ ID NO: 6682 - protein, 476 aa, Azotobacter vinelandii
SQKFDVIVIGAGPGGYVAAIKSAQLGLKTALIEKYKGKEGKTALGGTCLNVGCIPSKALLDSSYKFHEAHESFKLHGISTGEVAIDVPTMIARKDQIVRNLTGGVASLIKANGVTLFEGHGKLLAGKKVEVTAADGSSQVLDTENVILASGSKPVEIPPAPVDQDVIVDSTGALDFQNVPGKLGVIGAGVIGLELGSVWARLGAEVTVLEAMDKFLPAVDEQVAKEAQKILTKQGLKILLGARVTGTEVKNKQVTVKFVDAEGEKSQAFDKLIVAVGRRPVTTDLLAADSGVTLDERGFIYVDDYCATSVPGVYAIGDVVRGAMLAHKASEEGVVVAERIAGHKAQMNYDLIPAVIYTHPEIAGVGKTEQALKAEGVAINVGVFPFAASGRAMAANDTAGFVKVIADAKTDRVLGVHVIGPSAAELVQQGAIAMEFGTSAEDLGMMVFAHPALSEALHEAALAVSGHAIHVANRKK

SEQ ID NO: 6683 - protein, 796 aa, marine gamma proteobacterium HTCC2143
MKISENWLQEWVNPGVSIEDLVEKITMAGLEVDGVEAVAGEFTGVVVGEIIAIEQHPDADKLRVCQVAGGDEIVQVVCGAPNARTGIKIPFATVGAVLPGDSPKGFKIKKAKLRGVESFGMLCAEQELGLSDANEGLMELAGDAPVGINLRDYLDLDDTVIEVDLTPNRADCLSVAGIARDVGVIYECDVVAPLIAPVKPQIDDRLAIDIEAGADCPRYVGRIIRGVDVGQPSPLWMQEKLRRSGIRSIDAVVDVTNYVLLELGQPMHAFDLRSLEGGIRVRHAQESEKMTLLDGQELELQAGTLVIADHQRPVALAGIMGGEATAVKPTSQDIFLEAAFFAPVKLAGRARAYGLHTDSSHRFERGVDYQLQVPAIERATQLLLDIVGGQPGPIIELVSSDIPIAAEIELRAARIKKLLGLDIERNEVTGILTRLGLTVTTTDQGWIVVAPSWRFDIAIEADLLEEIARIYGYNRLPVTRIHSDLALQAKTETKTGLRAIRRQLVARGYQEAITYCFIEPKAQQLVCPQDDTVALTNPISSDMAVMRTSLWPGLLGVMEHNLNRQQSRIRLFESGLRFIPNGDDLPKQDAMLAGAITGRREPESWSENGELVDFYDLKGDLESVLALSGLGNNTDLVFLAGEHPALHPGQTAAICYQGKTVGYVGTIHPLLQKKMGFAQPIYLFEVELSAITSAELPKFTELSKFPEVRRDLAILLERGIEANSVLNAVREVAGDELRNLRLFDIYEGKGIDLKEKSLALGLTYQHSSRTLNEDEVNASVERVVSQLQQRFGATLR

SEQ ID NO: 6684 - protein, 175 aa, Oryza sativa (japonica cultivar-group)
MAPSVMASSATTVAPFQGLKSTAGMPVARRSGNSSFGNVSNGGRIRCMQVWPIEGIKKFETLSYLPPLTVEDLLKQIEYLLRSKWVPCLEFSKVGFVYRENHRSPGYYDGRYWTMWKLPMFGCTDATQVLKELEEAKKAYPDAFVRIIGFDNVRQVQLISFIAYKPPGCEESGGN

SEQ ID NO: 6685 - protein, 261 aa, Aspergillus nidulans FGSC A4
MGHEDAVYLAKLAEQAERYEEMVENMKVVAASDVELTVEERNLLSVAYKNVIGARRASWRIVTSIEQKEESKGNESQVALIKEYRQKIEGELAKICQDILDVLDQHLIKSAQSGESKVFYHKMKGDYHRYLAEFAVGDNRKAAADASLEAYKSATEVAQTDLAPTHPIRLGLALNFSVFYYEILNSPDQACHLAKLAFDDAIAELDTLSEESYKDSTLIMQLLRDNLTLWTSSEAEPAAENAPAEKKEEAPAAEGEEKPAE

SEQ ID NO: 6686 - protein, 337 aa, Zea mays
MDAFLSCLDDGPTASPPRAAPPPSPALSARDLYSFICSGPLVDRIGYTKEKVADSIGRWLRCGVDVARLLRLDELQLSEAEKARVYQFYIPVFLWCEDQVIEHRAKYSEGDDIPPLVIGVSAPQGSGKTTLVFALDYLFQVAGRKSATLSIDDFYLTAKEQNELRDRYPGNALLELRGNAGSHNLQFSVETLESLMKLTKEGIKMKVPRYDKSAFGGRGDRADPSVWPEVEGPLELEVVNNNLEAYYDAWDRFIDSWIVIKIREPSSVYQWRLQAEIAMRADGKPGMSDEEVMDFVSRYLPAYHAYLPKLYKEGPNGSKPDHLLVIDIDEGRNPIWG

SEQ ID NO: 6687 - protein, 771 aa, Aspergillus oryzae
MTVSYDHSSLRNAAPTSMATLEDRFEVMKEVGDGSFGSVAVARVRTAGSNIARRGTMVAIKTMKKTFDSLAPCLELREVIFLRTLPAHPHLVPALDIFLDPLSRKLHICMEYMDGNLYQLMKSRDHKPFDGKHVKSILYQILSGLDHIHAHHFFHRDIKPENILVSTSAPSDSAFSRYSNLVTPPSTPPTYTVKIADFGLARETHSKLPYTTYVSTRWYRAPEVLLRAGEYSAPVDMWAVGAMAVEIATLKPLFPGGNEVDQVWRVCEIMGSPGNWYSKSGSKLGGGEWRDGSRLAQKLGFTFPKMAPHSMESILQAPQWPTSLSHFVTWCLMWDPKNRPTSTQALNHEYFADAVDPLRPKSSTARLLGRKTSDRSFKSPTRENSDSPSLTSKSSWFRRSLIGRSDSDNEQSKQPVVSYSTAPETTKTKPAPSKRATWANGAPMPILPSIRPVSPLSNAVTAQANSCIAGDNGKASKKIGRQLSLNSHGNHYADVHRQEAERALNGGNPLVGANQKESFFSHLRKRARRLSGRNQGNVGSDNVEANAGCMPWSNRSSLALDTANANDAKQGSDLSELDKALQGVKCSLDSTALGNVPVHITSPVEGVKRQSMPQGSIRSMGDSPVSTSGTGAPISSRTRRALQLSSHPVHRYETPEEEDELLDEALHSASKAARRLAQTETSSDGSSNFSHQTMGNDNSRALPSPYPTPSPSAKCDGVSFGHSDTTPIRRLGLPDGKTDATSNRQWPTPPYEDGDWNHSGTTNFMTGSTYR

SEQ ID NO: 6688 - protein, 344 aa, Photobacterium profundum SS9
MMQGLYMPNMKTLGEFIVEKQNDFPHASGDLSSLLGSIKLAAKIVNREINKAGLVDITGAIGSENVQGEEQQKLDLYANDKFKAAMEARDQVCGVASEEEDEAVTFNKDLNRNAKYVILMDPLDGSSNIDVNVSVGTIFSIYRRVSPIGTTPTQDDFLQPGNQQVAAGYVIYGSSTMLVYTTGNGIHGFTYDPSLGVFCLSHENMQIPEDGQIYSINEGNYIRFPQGVKKYIKFCQEDVPADNRPYTSRYIGSLVSDFHRNLLKGGIYMYPSTAMYPNGKLRLLYECNPMAFLMEQAGGVASDGKNRILDITPTELHQRVPFFVGSTNMVKQVESFIEEYPEQH

SEQ ID NO: 6689 - protein, 529 aa, Arabidopsis thaliana
MKSNKFSCKTRAETLEWITAIIDFLKPFSFLINAHVVNFFKDKQWEAVNEEWMSCLKDEKPENILLIPSGGVQDHWPASLKKFVHTLRSLSFPREQADLQAILADVDMVPLSTVLSQGMNLKKKHEVTYYGIMQVEVLSSVVSSVVKSVGAPTVVDVGAGQGYLAQVLSFQYKHSVVAIDSSSHHGKVTDARAARIKKHFAAQMRKSGSGNKCPDVPMTITCRVLSTEMLKALTDVHLEKDETDSSGSALNEEGQSRSQSSSDANRSCSLVLAGLHACGDLSVTMLRTFMECEEVKALVSIGCCYNLLSEKSSEDSCSKCGYPMSAGLRSLGFSLGKNARDLACQSAERWSSLGEDAGLQNFELHSFRAAFQMVLSKHYPEVLATSPSIGRQGKAFRRQQQRKSLETPAAVDTTRKDTVDKKPMRQTSLNSDMCSSFEKFCLSAFSRLNLEHPRDLDLNATWNEADAFTELIGPYWSIRAALGPVLETLILLDRLMFLQEQGDSIKVVMLPIFDPTISPRNVAIIARRL

SEQ ID NO: 6690 - protein, 318 aa, Oryza sativa (japonica cultivar-group)
MSSSVGGGGGQQFRYTQTPSKVLHLRNLPWECAEEELVELCNPFGRIVNTKCGVGANRNQAFVEFTDINQAISMVSYFASSSEPAQIRGKTVYIQYSNRQEIVNNKSPGETAGNVLLVTIEGVQANDVTIDVIHLVFSAFGFVHKIATFEKAAGFQALIQYTDAATASAAREALDGRSIPRYLLPEHVTSCCLRISFSAHKDLNIKFQSHRSRDYTNPYLPVNSSAIDTLQPAVGADGRKVEAEGNVLLASIENMQYAVTVDVLHTVFSAFGTVQKIAIFEKNGGTQALIQYPDVTTASVAKEALEGHCIYDGGYCTQ

SEQ ID NO: 6691 - protein, 132 aa, Oryza sativa (japonica cultivar-group)
MASKSLFLLGAVLASLLLVAQDVSAARELAEANEAKGKNMKQEVAYGPQDEKLAHHADGYGHGGGYGGGYGSGYGGGNGGGYGGGYGGYGGYNKGYGGGGGGGYSKGFGGGYGGGGYPGGGYYGGGGGGGWH

SEQ ID NO: 6692 - protein, 322 aa, Streptococcus pyogenes MGAS8232
MVTVSKEQHLDMFLKMERIREFDSRINKLVRRGFVQGMTHFSVGEEAANVGAVAHLSYDDIIFSNHRGHGQSIAKDMDLNKMMAELAGKATGVSKGRGGSMHLADFEKGNYGTNGIVGGGYALAVGAALTQQYKGTNNIAVAFSGDGATNEGSFHESVNMAATWKLPVIFFIINNRYGISMSINNATNTPHLYTRAEAYGIPGFYCEDGNDVMAVYETMGKAVEHVRGGNGPAIVEVESYRWFGHSTADAGKYRTKEEVDEWKEKDPMIKYRTYLTSEGIATDDELDAIQAQVKKEVDDAYEFAQNSPDPELSVAFEDVWVD

SEQ ID NO: 6693 - protein, 469 aa, Streptococcus pyogenes MGAS8232
MAFEIIMPKLGVDMQEGEIIEWKKQEGDTVNEGDILLEIMSDKTNMELEAEDSGVLLKIVRPAGDTVPVTEVIGYIGAEGESVDTIASSEKTTEIPVPASADAGPTVAPKENVASPAPQVAATAIPQGNGGKVRATPAARKAAAEMGIDLGQVPGTGPKGRVHKEDVENFKGAQPKASPLARKIAADKGIDLATVSGTGFNGKVMKEDIMAILEAAKPAEAKAPAAKEEKVVDLPEGVEHKPMSAMRKAISKGMTNSYLTAPTFTLNYDIDMTEMIALRKKLIDPIMAKTGLKVSFTDLIGMAVVKTLMKPEHEYMNASLINDANDIELHRFVNLGIAVGLDDGLIVPVIHGADKMSLSDFVLASKDVIKKAQTGKLKAAEMSGSTFSITNLGMFGTKTFNPIINQPNSAILGVGATIPTPTVVDGEIVARPIMAMCLTIDHRLVDGMNGAKFMVDLKKLMENPFELLI

SEQ ID NO: 6694 - protein, 318 aa, Arabidopsis thaliana
MTTNDDDHAAERNTMSMNYELAATLSDEEQRARKGKAKIVCKEEDHVFIKKKEKYEEESEKREFFSHVPRKIRPALRYPQPNFENPNGASSSLNLPFEEDYYMAEYYKKTETINPPNPYHQWSPSSFLTEYTHPRMLEVLHRCGFNRPVVTCYSRTAREMRWWLRQVMKDMRAEDLTLILEKTLSTTDVITTTHGRFSMHFNRLISNDFLKPEERSILEEDTYNDETMGVGAILVDQRSQKWSVILKRWGQNYFLSCGWNDVVKANKLKAGDDICLWAFRCDGVLCFAMRQWRAFLRLARRPPLTLRQSSSSNARRLC

SEQ ID NO: 6695 - protein, 587 aa, Streptococcus pyogenes MGAS8232
MAVEIIMPKLGVDMQEGEIIEWKKQEGDTVNEGDILLEIMSDKTNMELEAEDSGVLFKITRQAGETVPVTEVIGYIGAEGESVEVSSPAASDVNVARTTEDLEAAGLEVPKAPAQAASAAPKAALADDEYDIIVVGGGPAGYYAAIRGAQLGGKIAIVEKSEFGGTCLNVGCIPTKTYLKNAEILDGIKIAAGRGINLASTNYTIDMDKTVDFKNTVVKTLTGGVQGLLKANKVTIFNGLGQVNPDKTVTIGSQTIKGRNVILATGSKVSRINIPGIDSKLVLTSDDILDLREMPKSLAVMGGGVVGIELGLVWASYGVDVTVIEMADRIIPAMDKEVSLELQKILSKKGMKIKTSVGVSEIVEANNQLTLKLNNGEEVVAEKALLSIGRVPQMNGLENLNLEMDRNRIKVNDYQETSIPGIYAPGDVNGTKMLAHAAYRMGEVAAENAIHGNTTRKANLKYTPAAVYTHPEVAMVGLTEEQAREQYGDVLIGKNSFTGNGRAIASNEAHGFVKVIADAKYHEILGVHIIGPAAAEMINEAATIMESELTVDELLLSIHGHPTFSEVMYEAFADVLGEAIHNPPKRK

SEQ ID NO: 6696 - protein, 74 aa, Populus tremula x Populus alba
CMPGMTGYELLKKIKESSSFREIPVVIMSSENVMARIDRCLEEGAEEFIAKPVKLSDVKRLRDYYMASREVRSV

SEQ ID NO: 6697 - protein, 126 aa, Pseudomonas aeruginosa PAO1
MTKTVIHTDNAPAAIGTYSQAIKAGNTVYVSGQIPLDPKTMELVEGFEEQTVQVFENLKAVIEASGGYLHDVAKLNIFLTDLSHFAKVNEIMGRYFTQPYPARAAIGVAALPKGAQVEMDAIVVLE

SEQ ID NO: 6698 - protein, 627 aa, Schizosaccharomyces pombe 972h-
MKGLRSKFVKALSLKDEQGSHKNGHSKSHYISKNGSYVETDDVKHTDTHHSSKHELKKLKSHFLKDTLKHKRNHHANSNNEKHENSDKKIHTTVLASGHEDSDYSTFLPVIETSKVKDANHFPPNYPEPKNDSVSSNIDEFPNDSISSASFLSVPQSTPPYLVSQPTPLNKFLAGAENVDIPHSLRPVPRREHSSQFQVSEKRTLVRLPSFDDVHTSEREELFIKKLEQCNIIFDFNDPSSDLASKEIKREALLQMIDYVSENRGISSASLFPYVVNTFSLNVFRPISPALNDYSSDMFALDDEPFLEPAWPHLEEVYLLFIKFLESPDFRASKAKSLVDRRFFNRLLALFDTEDPRERELLKTTLHRIYGKFLNLRSYIRKSMNNVFLQFIYEREKFHGIAELLEILGSIINGFAVPLKEEHKIFLSKVLIPLHQTKSVFLYHPQLTYCIVQFIDKDPSLTKAVLTGILKYWPRINSFKELLFLNEIEDIFEVLEPSEFVNIMSPLFQQLARSISSMHFQVAERALCLWSNEYFTSLVSQNVVTLLPIIYPSLYKTANEHWNSTIQAIACNVLQIFVDMDADFFNGLVEDYKQAIIKQEEVMIIRKQQWCQIEALAAENKPTDYLR

SEQ ID NO: 6699 - protein, 685 aa, Nitrosomonas europaea ATCC 19718
MANGLTIAICSAILALIFSGLWIRRIYAQSAGDSRMQEIAAAVQEGASAYLKRQYLTIGMVGTVLFVIIGLALSWNTAIGFALGAILSGLAGFMGMNVSVQSNVRTAEAARSGLNEALAIAFRGGAVTGMLVVGLGLLGVAGYTALLVSGADETSSISDLIHPLIGFAFGGSLISIFARLGGGIFTKGADVGADLVGKVEAGIPEDDPRNPAVIADNVGDNVGDCAGMAADLFETYAVTIIATMLLGALLFKTGTGDAAVYPLALGAASIVASIIGCYFVKMREGGKIMNALYRGLAVAGGIAFFAYLPITVWFMGGATLTLDGTEVGGGELIMRLFASTTIGLVLTGLMVVITEYYTSTEYPPVQHIANASTTGHATNIIAGLGVGMRATAAPVLAVCASIIVAYSLAGLYGIAIAATAMLSMTGIIVALDAYGPITDNAGGIAEMAGMPESVRAVTDPLDAVGNTTKAVTKGYAIGSAGLAALVLFADYTHGLEHANKLMTFDLSNHLVIIGLFIGGMVPFLFGAMSMEAVGRAAGSVVLEVRRQFKEIPGIMDGSRKPDYSRAVDMLTKAAIREMIVPSLLPVLIPVLVGVFLGPQALGGVLMGSIVTGLFIAISMTAGGGAWDNAKKYIEDGNYGGKGSDAHKAAVTGDTVGDPYKDTAGPAINPLIKIINIVALLIIPLL

SEQ ID NO: 6700 - protein, 316 aa, Vibrio parahaemolyticus RIMD 2210633
MSNKLEQLRKLTTVVADTGEIDAIKKYQPEDATTNPSLILKAAQIAEYAPLIDASIEYAKAQSNDKAQQVQDTCDMLAVNIGKEILKTIPGRISTEVDARLSYDMEGSVAKARQLVKMYNDAGITNDRILIKLASTWEGIRAAEILEKEGINCNLTLLFSFAQARACAEAGVFLISPFVGRIMDWYKAKEGRDFEASEDPGVLSVTKIYNYYKEYGYKTVVMGASFRNIGEILELAGCDRLTIAPALLAELEAAEGEVVEKLVDSKGAAERPAPMTHAEFLWEHNQDPMAVEKLAEGIRNFAVDQGKLEAMIEAKL

SEQ ID NO: 6701 - protein, 663 aa, Vibrio parahaemolyticus RIMD 2210633
MDRKYLANAIRALSMDGVQQANSGHPGAPMGMADIAEVLWRSHLNHNPSNPEWADRDRFVLSNGHGSMLIYSLLHLSGYELSIDDLKNFRQLHSKTPGHPEYGYAPGIETTTGPLGQGITNAVGMAMAEKALAAQFNKEGHDIVDHFTYVFMGDGCLMEGISHEACSLAGTLGLGKLIAFWDDNGISIDGHVEGWFSDDTPKRFEAYGWHVIPAVDGHDADAINAAIEAAKADPRPTLICTKTIIGFGSPNKSGSHDCHGAPLGAEEIAATRKELGWEHGPFEIPQEVYAEWSAKETGAAKEAAWNEKFAAYEAAYPELAAEFKRRVNGELPAEWEEKASQIIADLQANPANIASRKASQNALEAFGALLPEFMGGSADLAPSNLTMWSGSKSLEANDFSGNYIHYGVREFGMTAIMNGIALHGGFVPYGATFLMFMEYARNAMRMAALMKIQNIQVYTHDSIGLGEDGPTHQPVEQIASLRLTPNMNTWRPCDQVESAVAWKLAIERKDAPTALIFSRQNLAQQPRSAEQVADIAKGGYILKDSEGKPELILIATGSEVELAVKAAEQLTAEGKKVRVVSMPSTDAFDKQDADYREAVLPSDVTARIAIEAGIADFWYKYVGFDGRIIGMTTFGESAPADQLFEMFGFTVENVVNTAKELLA

SEQ ID NO: 6702 - protein, 167 aa, Coffea arabica
MFPMLTEFINYGQQTIRAARYIGQGFMITLSHANRLPITIQYPYEKLITPERFRGRIHFEFDKCIACEVCVRVCPIDLPVVDWKLETDIRKKQLLNYSIDFGVCIFCGNCVEYCPTNCLSMTEEYELSTYDRHELNYNQISLGRLPTSVIDDYTIRTISNSPQIKNG

SEQ ID NO: 6703 - protein, 1117 aa, Schizosaccharomyces pombe 972h-
MFGGELDDAFGVFEGKVPKSLKEESKNSQNSQNSQKIKRTLTDKNASNQEQGTKKLESSVGEQESATKRAKIENLKDNQDLIPNNDVNGIHINNSAVADTKHKPKIGDIAADDISNEVSIKNEGDTIPEATVADSFEQEASLQVAGKVGMTEAKSSTEEVVELRHQVRHQVSIPPNYDYVPISKHKSPIPPARTYPFTLDPFQAVSIACIERQESVLVSAHTSAGKTVVAEYAVAQSLRDKQRVIYTSPIKALSNQKYRELLAEFGDVGLMTGDVTINPDATCLVMTTEILRSMLYRGSEVMREVAWVIFDEIHYMRDKERGVVWEETIILLPDKSHFVFLSATIPNAMQFAEWITKIHRQPCHVVYTDFRPTPLQHYLFPSGSDGIHLVVDEKSNFREENFQRAMSALMEKQGDDPAAMATKGNAKKGKTGKGGVKGPSDIYKIVKMIMVKNYNPVIVFSFSKRECEALALQMSKLDMNDQTERDLVTTIFNNAVNQLSEKDRELPQIEHILPLLRRGIGIHHSGLLPILKEVIEILFQEGLLKVLFATETFSIGLNMPAKTVVFTNVRKFDGKTFRWISGGEYIQMSGRAGRRGLDDRGIVILMIDEKMDPPVAKSMLKGEADRLDSAFHLSYNMILNLLRVEGISPEFMLERCFFQFQNSLEVPKLEAKLEESQQHYDSFTILDERPLEEYHTLKTQLERYRTDVRTVVNHPNFCLSFLQGGRLVRVKVGNEDFDWGVVVNVSKRPLPKGQSNEYLPQESYIVHTLVMVASDTGPLRIRSGHLPEVHPPAAEDKGKFEVVPFLLSSLDGIAHIRVFLPNDLKSQGQKLTVGKALSEVKRRFPEGITLLDPVENMNIKEPTFIKLMKKVNILESRLLSNPLHNFSELEEKYAEYLRKLALLEEVKDLKKKLSKARSIMQLDELNSRKRVLRRLGFTTSDDVIEVKGRVACEISSGDGLLLTELIFNGMFNDLTPEQCAALLSCLVFQEKSEVENQRMKEELAGPLKILQEMARRIAKVSKESKQELNEEEYVNSFKPSLMEVVYAWAHGASFAQICKMTDVYEGSLIRMFRRLEELIRQMVDAAKVIGNTSLQQKMEDTIACIHRDIVFSASLYL

SEQ ID NO: 6704 - protein, 395 aa, Coffea arabica
MTVPATRKDLMIVNMGPHHPSMHGVLRLIVTLDGEDVIDCEPILGYLHRGMEKIAENRTIVQYLPYVTRWDYLATMFTEAITVNGPEQLGNIQVPKRASYIRAILLELSRIASHLLWLGPFMADIGAQTPFFYIFRERELIYDLFEAATGMRMMHNFFRIGGVAADLPHGWIDKCLDFCDYFLTGVAEYQKFITRNPIFLERVEGVGIIGGEEALNWGLSGPMLRASGIQWDLRKVDHYECYDEFDWEVQWQNEGDSLARYLVRIREMTESIKIIQQALEGIPGGPYENLEIRRFDIDRVKDPEWNDFEYRFISKKPSPTFELSKQELYVRVEAPKGELGIFLVGDRSVFPWRWKIRPPGFINLQILPQLVKRMKLADIMTILGSIDIIMGEVDR

SEQ ID NO: 6705 - protein, 306 aa, Haemophilus influenzae 86-028NP
MKKTLTVLGSINADHVISVPYFAKPGETLTGQNYQIAYGGKGANQAVAAARLGAKVAFISCIGSDSIGKTMKNAFEQEGIDTTHINTVSQEMTGMAFIQVAKSSENSIVLASGANAHLGEMVVRQSEAQIAQSDCLLMQLETPLSGVELAAQIAKKNGVKVVLNPAPAQILSDELLSLIDIITPNETEAEILTGVAVADEQSAVKAASVFHDKGIETVMITLGAKGVFVSRKGKSRIIKGFCVQAIDTTAAGDTFNGGFVTALLEEKSFDEAIRFGQAAAAISVTKKGAQSSIPTRQETLEFLEHA

SEQ ID NO: 6706 - protein, 627 aa, Mycoplasma pulmonis UAB CTIP
MYKFKFADIGEGLHEGKVAEIYVKLGDTVKEGDSLFSVETDKITSDIPSPTGGVINKILFELGGTVHVGEEIFWIDDGSGPASDSPEPAAAEAKPAAEEHKSSAGDLFGSRRRKPGGSAAAAAPSPAPAPVAAPAPAAVAAPSVAGKVAGKAYTGAVEAEYDVIVIGAGPGGYLAAEEAGKYGLKTLIIEKQYWGGVCLNVGCIPTKALLHATEELYNLEHSHEHNGIVADFKALKIDRQKTWINIQKNKKSVVDKIVGGVKFLMKAAKATSIEGEAKFVGSHELEVNGKVYRGKNIIIATGSLDRKLNLPGFEQAYKDEVVLSSDKLINLDSHLPETLGIIGAGVIGVEFAEVFAMAGTKVTIIQNTDAILANAPLAKEIKTELTNHLKKYGVEFKFNASTTKIEKNQLFFEVGGKEESMKFDKILAAVGRIPTPLNAGEVGIEIGQRNEIIVDDKLMTNVENVYAIGDVTGKNMLAHVAYRHAIRVVESIVGEEEVYPKQEIPGCIYTKPEIAFVGLTEQQAKEAGYDVVTSKYSFSTLGKALASSEGNGFVQLVVDKKYGRILGCHIIGKNSTDYIAEIVLAMDNEISVFEIAATIHPHPTYGEIVWEAARALSLKLNIEKHKK

SEQ ID NO: 6707 - protein, 444 aa, marine gamma proteobacterium HTCC2143
MKDVHLQKTMGPFTATMLGVGAMVGAGIFVLSGIAAGYAGPAVILAFFLNALIALAIGSCYAELGSAMPRAGGSYFWVKTALGRSAGFAVGWIGVYANTIVSALYALGFGAFFVALLQRLGVGISDDYVLVFAALITVAITYLQYRGIRDLGVVENSVTVIKVLLLCALVVGGLIIISSSNGGVGKLTPFAPHGMTGVLMAMAVIFVAFEGFEVITRTGEEMHQPEKNIPLAIYASIGISVSLYLLIAVILIVAVTGPDDQPSWQYLGDLGELGMATTARQLLPYGDVIFYIAGIASTASAMIAATYSAVRVTFALGRAGDLPALLGYIHPLHNSPSNAAIASGAIVLAIVMILPISEVAGAASQMFALLFAVVCFAAWRLRFTQPRMIRPFRARLLPLCASVGMLAGSVVMITLLNISPLAWWISFVWLAIGGVIFVIRSPAR

SEQ ID NO: 6708 - protein, 332 aa, Mycoplasma pulmonis UAB CTIP
MSDKLTLNNIEALTNAIDVKMEEDKTIVLYGQDAGFEGGVFRATAGLQKKYGEERVWDSPIAEASQTGVGVGAAIYGLKPIVEIQFQGFSYPAFQQLMVHAARYRNRSRGRFSVPMVLRMPMGGQVRALEHHSEAIEALYSHIPGLKVVMPSNPYDTKGLMIAAIEDPDPVVFLEHKRIYRSFKQEIPAGRYTVEIGKANVIYEGDDLTLVTYGAQVHDTIKAMDLLDEEGKEYSIELIDLRTISPLDSETIIESFKKTGRLLVVHEAVRSFSVSAEIMARVSEEAGDYIKTPLARLTGWDITVPLAKGEQYHALSPERIADAIKKVMEREE

SEQ ID NO: 6709 - protein, 368 aa, Mycoplasma pulmonis UAB CTIP
MSKKFKYVDPKKVMDSSDQLIRVLDIDGKLIDSKYKTSLSNEKIIEAYTWMVRSRQQDTYMTQLQRQGRMLTFAPNFGEEALQVATSLAMEKDDWFLPAFRSNATMLHLGVPMINQMVYWNGNERGSKIPEGVNVLPVNVPIATQYSHAAGVAYGMKLLGKKNVAVTIIGNGGTAEGEFYEAMNVSSIHNWPVVFTVNNNQWSISTPEHLETKATIAAKAHAVGIPGVRVDGNDLLASYEVMKEAVEWAKEGNGPVLVEFYTWRQGVHTSSDNPRIYRTEEMEKEKEKWEPMHRIKNYMIEKGFWTEEQDQKLWEDSLTLVKETYEESMKMHDIPVDEVFDYTYEKLPPYLERQKAEAKEWFEKKGGK

SEQ ID NO: 6710 - protein, 581 aa, Oryza sativa
MAGRSELVVSFGEMLIDFVPTVAGVSLAEAPAFVKAPGGAPANVAIAVARLGGGAAFVGKLGDDEFGRMLAAILRDNGVDDGGVVFDAGARTALAFVTLRADGEREFMFYRNPSADMLLTHAELNVELIKRAAVFHYGSISLIAEPCRSAHLRAMEIAKEAGALLSYDPNLREALWPSREEARTKILSIWDQADIVKVSEVELEFLTGIDSVEDDVVMKLWRPTMKLLLVTLGDQGCKYYARDQKKLEEAIKFANACGAITATKKGAIPSLPTEVEVLKLMEMLEAWKYCDAVMLLLLYMMQKLPWCLVWYEVDATSHVFGWKPEAAWPREPARVPEPRHSIRRASRCKPRARAVVADRPVAAAVSLCTRLSPVSPLRSKPPRRHRRRHRPAPPLRAQAAKGQRQHPSSLCRVAPAHLLLFPESAKGQAPFLPLLFPFFLLAGVILPVAALAATAERQLAPLTAQVGSQTDIAAHLNPSLPFPSSSIRLRAIAAAPVLCLASAVLRRAPGEPVRSRTRKGTSAALSSSSSPARGRRDYSRAVGLSSQRPVPHGATSAPAQPRSGRADPGQSLPVRAFHREP

SEQ ID NO: 6711 - protein, 216 aa, Chlorobium tepidum TLS
MSEYFSNIKTSVTTIATGMGITLKHFFNAVKRKGDAGIDDADYFRQVDGLCTLQYPKEAIPTPPHGRYRLYCNINDCIGCKQCERACPVECITIETIKTTSDDLEACGKTSGGQQKRMWVPVFDIDLAKCMTCGICQSVCPTDCLYHTPVADFSEFDVSNMMYHFGNLSKIEAEAKRKKLAEQQAQAAKEKAAAGGAPAPKPAPKAAPQPNPGDAR

SEQ ID NO: 6712 - protein, 652 aa, Glycine max
MQWAATSHASSCLLNRIKSLIHNDMALSRLRHPLFSRSLRILSSPARSLSRTSNSSIFTLGGDHHNIIRPAFCSRLTGIHDRSLKSKWTDVKYFSSSDSSHEVLGMPALSPTMTQGNIAKWRKKEGEKIEVGDVLCEIETDKATLEFESLEEGFLAKILVPEGSKDVPVGQPIAITVEDENDIQNVPASAGGETRVEEKKPTREDVTDERKSESTSAIINASELPPHVLLEMPALSPTMNQGNIAKWRKQEGDKIEVGDILCEIETDKATLEFETLEEGYLAKILAPEGSKEVAVGHPIAITVEDASDIEAIMNSVSRSSTNQQKAPQRDTKSEAKAQKNNIIRISPAAKLLITEYGLDASTLNATGPYGTLLKGDVLSAIKSGKLSPKPASSKEKVSSFQSHQQVAASQESKSDLKLSDAYEDFPNSQIRKVIAKRLLDSKQNTPHLYLSSDVVLDPLLSLRKDLKEQYDVKVSVNDIIVKVVAAALRNVPEANAYWNVETGEVVLNDSIDICIAVATEKGLMTPIIKNADQKTISAISSEVKELAAKARAGKLKPHEFQGGTFSISNLGMFPVDKFCAIINPPQACILAVGRGNKVVEPVIGTDGIEKPSIATKLSLTLSADHRVFDGKVGGAFLSALQSNFSDIRRLLL

SEQ ID NO: 6713 - protein, 409 aa, Nostoc sp. PCC 7120
MKAVVFHGIGDIRLDNVPEPKIKEPTDAIIRLTSSAICGTDLHMIRGTFTGMKPGTILGHEGVGIVEELGSNVRNLQVGDRVVVPSTIACGYCSYCRSGYHAQCDNANPHGHNAGTAFFGGPEAAGPFDGLQAEYARIPYANAGLVKLPKEVTDDQAILLSDIFPTAYFGADIAEITPGDTVAIFGCGPVGQFAIVSARLFGAGRIIAVDTIPSRLEMARDLGAEVIDYNAEDPIEAIRELTGGIGVDRVIEAVGVDANAPDSGPAAKKARQEAQQFQQQLQQIAPETNPQNGNWHPGNAPSQALEWSIQALAKAGTLSIIGVYPPTHNFFPIGTAMNKNLTINMGNCNHRKYIPLLVDLVRNGTVDPTKVLTQVEPLMSVIDAYKAFDQRQPGWVKVELVPGAALANV

SEQ ID NO: 6714 - protein, 183 aa, Pseudomonas fluorescens Pf-5
MTFRALVTLAEGIDDLQSVTLIDVLRRAEVEVLAASVEGRRMLTCARGTRLTADAMLVDVLAQRFDLIVLPGGAVGAQHLAAHQPLQQLLKDQAAAGRLFAGIAEAPALALQAYGVLRQRRMTCLPSASHHLLGCTFVDQPVVVDGNCITAQGSAAALAFALALVEALCGRAKRAQVAAELLV

SEQ ID NO: 6715 - protein, 343 aa, Arabidopsis thaliana
MTTNKQVIFKDHVSGFPKESDFNFTTTTVELRVPEGSKSVLVKNLYLSCDPYMRSRMGKPDPSSALAQAYAPGKPIYGYGVSRVIESGHPDYKKGDLLWGIVGWEEYSVITPMAHMHFKIQHTDVPLSYYTGLLGMPGMTAYAGFYEVCSPKKGETVYVSAASGAVGQLVGQFAKMMGCYVVGSAGSKEKVDLLKTKFGFDDAFNYKEESDLSAALKRCFPKGIDMYFENVGGKMLDAVLLNMNPHGRIAVCGMISQYNLENQEGVHNLSNIIYKRIRIQGFVVADFYDKYPKFLELVLPRIKEGKITYVEDVADGLEKAPEALVGLFHGKNVGKQVVVIARE

SEQ ID NO: 6716 - protein, 109 aa, Zea mays
MCICWHLSSRPMIVAQVTENGKQERHLVATVGKYSVVWNFLQVKNSHHECYQYQEGLKSCYCYKVIPKDESIVASRFMHDRYSVSDSPEAPLVVATPMKVTSFSISSRH

SEQ ID NO: 6717 - protein, 394 aa, Nitrosomonas europaea ATCC 19718
MKTSDIHDVAIVGAGPAGLSAAYELIRTGFTPLVLERTPAVGDVWRNHYDGLRLNSGRFFSALPGSKFPLSAGGWPSRDEVVSLLETFPARGGFTVQTGIEVEKVSHDRERDIWLITSNDNRQFESRAVVIAAGANRIPIIPEWEGKNTFTGTIIHSSQFKSAQDYAGKHVLVVGSGNSAAEIASRLAKYADSVTMSVRTPPQILPKSIYGIPLIGIGVWTRYLPRALVDGLLNFLRRTMIGDLSVYGLPSPTISMSKQYAINNVVPILYGPFIDDVRSGRIKIVGPVQKISGGTVEVLSTVESALNGDQATTTLQPDIIVAGTGFRTGFPELIQVPGITDEKGRSKISGDQEFKGAPRLYFIGQINPLSGQLREIRLEAGRIARKLDKQLRAK

SEQ ID NO: 6718 - protein, 417 aa, Frankia sp. EAN1pec
MVSGEPAATRGDCAVDRGSRRLRDLIGMSVSKMDGIEGIMDDVTAESEPESRRGNVLLLSGSLGMGHDVMAEACATSLERRGFHTRTADCLRMTDGRNGTLGQNAFRGLIAVPGVYDALHFSQLRTGGRVARAIERTSSHFLVPRLREDIRAEPADLVISIFASAAAAVSRLKSEFPGMTTAVFSSDCCVHRIWVQDNTDLFLVTSQTAARYVRRFAPQARIAVVPTPVRTPFYDPPTQEEARGNLGIPLESRCVLLMSGSWGLGPLVEAAEALAAAGVWVLAVAGRNEKLAARLSALAQRDHRVIPFGFTNRIPELMAASNLVVTSSGDTCSEARVIGRDLLLMDVVPGHGRDNLQKELDRGHAEVTSTDSLSLTRSALACLDRVKPPSQRVAVSPQAWEQAFGAALAQIGLGVHW

SEQ ID NO: 6719 - protein, 369 aa, Nitrosomonas europaea ATCC 19718
MSQSDYYEVLGVGRDADENELKKAYRKLAMKYHPDRNAGDTKAEERFKNIKEAYEILSDPNKRAAYDQFGHAGLNGGMGGAGAQGFSDAFSDIFSDLFGMRGGGRSSVHRGADLRYNLEITLEQAARGAETQIRIPRQEVCDTCHGSGAKPGTSPKTCPTCNGHGQIRMQQGFFSIQQTCSHCQGSGKVVSDPCGDCHGAGWVKRQKTLSVRIPAGVDEGDSIRLTGEGEAGANGGQAGDLYIVIHLASHPVFQREGNHLHCEIPISFTVAALGGEIEVPTLDGHARIKVPAGTQTGKIFRLRSKGITGVRNQSTGDLLCHVAVETPVDLTARQKELLEEFESISQKDGSRHHPRAKSWMEKAREFFAE

SEQ ID NO: 6720 - protein, 1060 aa, Gibberella zeae PH-1
MGKRTTNSSSASFSSSSKQSLSRKSSASSSLAERVGDRVVDDYPTLRQDVALQPLTSSSSSSTTRSTVTVSPSHPVQDQGHVLLYQAPASDILPLPLLTTTATPAASASASVSAPQPVLVDYQNAAPPSPEHTNTDDSLDATPQPSNADLDMASKKTPFLRSAARSDAAPYGSVSLTPSRNNSPAGSDRWDPDSHQLRHVTDTMRSETSHRSGLSKKSSSRLSEEIDGAVLVSGLEGRMGLGEPTHPGVLEGSLKDDLSEDGALLDDDSSATSNTEYQENSPHEAVRASVPPTDNTTLSINTPRMWCLSVLFAILGSSTNLFFSLRYPSVAITPVIALLLVHPLGHLWDFVLKRPYDPEEDFVDGVRVPLVSDDAHSLHKVKKRTRVRRWLAQGRWNEKEHTCVYVSSNVAFGFAFATDVIVEQTQFYNQEAPIVYQLLLTISTQILGYGFAGLTRRFLVRPSGMIWPGTLMSAAMFSTLHKQENKPAGGWTISRWKFFYIVWTVSFLFYFLPGLLMPALSYFNVITWFAPKNVVIANLFGVSSGLGLFPLTFDWAQVTYVGSPLLVPFWAAMNVIGGLAVVMWIIAPIFYYTNVLFSSYMPILSAAVFDNTGKVYDVSKILTPEFLFDREAYQNYSRVFLPITYVLSYGVQFAGLSALLTHTACWHGQDIWKSWKRALQEAREDGQAKYEPVADSPGSLPRQSTDESGRRMSSVSHVDGIISREDIHSKLMKRYKDAPLSWYLITFLTMTAIGIFVVEYYPVHLPWYGLLLALAIGALFFIPNGIIMAVTNQHSSIYLICQLICGVVFPGRPIANMVFVTYGYISSAQGIKFASDLKLGHYMKIPPRILFLVQIVATLVSSLTQIGVLNWMFANIRGICTSEAINGFTCPIARVHFNGSILWGVVGPNEFFGPKAIYRSLVWFFPLGALLPIPLWLYSRRHRSSILRKVNLPVIFGAMSWIPPATGLNFSVWVLVCYVFNYLIKNRHNAWWSKYTMTLSAALDSGLAFGIVVVFFGFIYPGFAQNLKWWGTEVYKQGCDWQACSYNTLQEGEHFGPKTW

SEQ ID NO: 6721 - protein, 869 aa, Gibberella zeae PH-1
MAQDSEVPKAADKGKGKAVDDAKKDKQQPNGKKEDEKIETAEEELNEEDQQLKNELDMMVERLTESNPELYKPALEAMKTSIKTSTSSMTAVPKPLKFLRPHYETLTKLYEQWPQSEDKTSLADVLSVIGMTFSDEDRQDTLHYRLLAPTSDISSWGHEYTRHLALEIGEVYIKRINNEEQTKDLIDLALVLIPLFLKSNAEADAVDLMSELEIIEEMPKFVDENTYARVCLYMSSMVNLLTYPDNETFLKTAHDIYMEYKQFAQAIVLAIRLHDIDLIRADFEKAEDPALKKQLAFLIARQRIALDIDDDSDESDAITESLSNIKLSEHFKALGKELNILEPKSTEDIYKSHLESSRVAGMTNLDSARHNLAAAFVNAFVNAGFGNDKMMLVDGEKETWVWKTKADGMMSTVASMGTLLMWDTENGLDKIDKYTYSTENEISAGAMLAIGIVNSGVRTDSDSAVALLADHEKLNHPDPLVRTACIMGLGLAYAGSNREDILEHLQPMISDSSCDMQISAMAALSCGLIFTGSSHPEISEAIVTTLMDDDRKSQLTDKWTRFLALGLGLLFFGRQEEVDVILETLKAIEHPMAKSTAVMAEICAWAGTGAVLKIQELLHICNEHQEETDEKKGDELLQAYAVIGIALVAMGEDIGQEMVLRQFGHLMHYGEANIRKAVPLAMGLISPSNPQMKVYDTLSSYYHRDQDALFMVRIAQGLLHMGKGTLTISPFHTDRQVLSRVSAAGLLATLVAMIEPKEFITGQSHYLLYFLVTAMHPRFLVTLDENLKPLKVNVRVGQAVDVVGQAGRPKTITGWQTQSTPVVLGYGERAELEDEEYISLNSTLEGLVILRKVSSITPISFTEELGSQF

SEQ ID NO: 6722 - protein, 167 aa, Magnaporthe grisea 70-15
MISSRFMGGNILRQASRTACRAPAHSIAAPTLLRQLQAQQQRRLLTSEVRQAIDKAVASAPVVLFMKGTPETPQCGFSRASIQILSMQGVDPEKFAAYNVLEDQSLREGIKEYSEWPTIPQVYIDKEFVGGCDILVSMHQSGELGKMLAEKGVLVKGQEGEADNKSE

SEQ ID NO: 6723 - protein, 639 aa, Lactobacillus reuteri
MCGIVAFVDNEKPQIKDQLIQKMKDRIIHRGPDAEGQYVDDDVALGFRRLSFIDVKSGNQPIFNEDSSKAIEFNGEIYNFEELREELISKGHTFKTHADTEVILHGYEEWGKDVVNKLRGMFGFVIWDFKTKEMFGARDHFGIKPLYYAKMNGTFFVGSEIKAFLDHPNFKKELNKEALKPYMTFQYPVTQETFFKGVYRLPEGHYFTYKDGQFEMTQYWDENFEPEDETFDEAVNKIDEVVKNSVKAHTFADKGIKVGSFLSAGVDSSLVTALMRPDNTFSIGFDSTYDETKQARELAAKMGLKNTDEKLTNEEAFHAFPMIQYYLDEPDSNPSVVPLYFLNKLAKDNGYKALLSGEGADELFAGYIDYGFNTKVKFIRWVTDQLKKMPRERRYKFAKWLDGKHFHGQEHMYRNLAPARDTFIGQAYIFSPEEAADYLQPEFDCGPSIADILNPLFDKMEDKDIDEVAKKQYVDLHRFMPGDICLKADKMSMANSVEIRVPLLDKEVMKVAETTPTKYLFNYKDTKWAFRMAANRHLPEEWATRPKMGFPTPVRAWLREKKYYQEVRELFEQDFVKEFFDQEKLLKLADDNFEGKVDGRRKIWTIYTFLTWYKLYFIDNFKPDESGIDRAQKAATTEV

SEQ ID NO: 6724 - protein, 421 aa, Rhodobacter sphaeroides 2.4.1
MDHFLYRNGSLHAEEVPLSDIAATVGTPFYCYSAATLERHYRLFTEALTPLPHLVCFAIKSLSNLAVLKLLGDLGAGMDVVSAGEYLRARAAGVPGDRIVFSGVGKTREEMRIALEGGIRQFNVESEPEMRALSEVASSMGLRAPIAVRVNPDVDARTHEKIATGKKENKFGIPIERASEVYAEAAALPGLEVMGIDVHIGSQLTELEPFEQAYLKVAELTGRLRAEGHEIRRLDLGGGLGIPYTRSNEAPPLPTDYGALIKRTVGHLGCEIEIEPGRLISGNSGVLVSRVIYVKNGEGRDFLILDAAMNDLVRPSMYGAHHDIVPLAEAAPGTESQPYDVVGPVCETGDTFAKARALPPMAEGDLVAFRSAGAYGAVMASEYNSRPLVPEVLVRGDHFAVIRARPTFDEMLGRDSIPEWL

SEQ ID NO: 6725 - protein, 199 aa, Nostoc sp. PCC 7120
MTHSTDIATLARWMAADFSNQAQAFENPPFYAHIRVCMRPLPWEVLSGVGFFVEQAYDYMLNDPYRLRVLKLMIVGDRIHIENYTVKQEENFYGASRDLNRLQTLTSESLEKLPGCNMIVEWTGNSFKGTVEPGKGCIVVRKGQKTYLDSEFEINEEKFISLDRGRDLETDAHIWGSVAGPFYFVRLHNFADEVKISAE

SEQ ID NO: 6726 - protein, 429 aa, Magnaporthe grisea 70-15
MSLANASIDSVTRPLRGFLANSRPAVPSISKSQRQRLYSTHPPNARLNVPIDYSTTPLLAHSSQTALSNPELSPEVRNGATKRMNLFQAINDALSTALAEDESVMLFGEDVAFGGVFRCSMGLAEKHGGERVFNTPLCEQGIMGFAIGMAAEGMRPVAEIQFADYVFPAFDQMVNEAAKFRYRDGANGRSAGGLTVRMPCGLVGHGALYHSQSPESLFTHIPGFRVVMPRSPVQAKGLLLAAIRSNDPVVFMEPKVLYRAAVEQVPMASYTLPLSKAEILKEGKDLTIISYGQPLYICQNAIATAEKDLGISVELIDLRTIYPWDKECVFESVRKTGRAIVVHESMVNQGVGAEVAACIQEDADTFNRLEAPVERVAGWSIPTPLAFEKFNAPDAASKSFSSRKFCHITRTDPLQTAGVYDRIKRVMEY

SEQ ID NO: 6727 - protein, 162 aa, Hordeum vulgare
MSAAEGAVVFSEEKEALVLKSWAIMKKDSANLGLRFFLKIFEIAPSARQMFPFLRDSDVPLETNPKLKTHAVSVFVMTCEAAAQLRKAGKITVRETTLKRLGGTHLKYGVADGHFEVTRFALLETIKEALPADMWGPEMRNAWGEAYDQLVAAIKQEMKPAE

SEQ ID NO: 6728 - protein, 557 aa, Desulfotalea psychrophila LSv54
MDLTKEEILPYGHHVAKLDYRKILDRCADRPDGKYIDVTAITPTPLGEGKSTSVMGLVQGLGKRDKSVVGAIRQPSGGPTMNIKGSAAGGGRSQCIPLNEFSLGLTGDINSIMNAHNLGMVALTARMQHEANYTDAQLAQRNLKRLDIHPKKIQFSWIIDFCAQALRNITIGIGGKMDGPTIQSSFAIAVSSELMAILAIANDLADMRARIAKVVVAYDKQDRPITTADLEVDGAMTAWMVQAINPNLMQTLEGQPVLVHAGPFANIAIGQSSVIADRVGLKIAGYNVTESGFGADIGFEKFWNLKCRFSGNKPNCAVIVATIRALKCHGGAPIPVPGKPMPEEYAKENVGWVEEGCKNLLHHINTVKKAGINPVVCINAFYTDRPNEIKAVKRICEHAGARVAVSTHWEHGGDGALEFADAVIDACEEKNDFKFLYELDTPLEKRIELIAKEVYGADGVSYTPEARTKLTQLAKDPEMAELGTCMVKTHLSLSHDPKLKGVPKGWTLPIRDILTYKGAGFVVPVAGAISLMPGTGSDPAYRRVDVDLQTGRVKGVF

SEQ ID NO: 6729 - protein, 485 aa, Oryza sativa (japonica cultivar-group)
MVNGEAEAECTRASLLGRYEIGRTLGEGNFGKVKYARHLATGAHFAIKILDRNKILSLRFDDQIRREIGTLKLLKHPNVVRLHEFFREVHLGFLRTVLICVICPDEEPVAASKTKIYMVLEYVNGGELFDKIAVKGKLSEHEGRRLFQQLIDAVSYCHDKGVYHRDLKPENVLVDRRGNIKISDFGLSALPQHLGNDGLLHTTCGSPNYIAPEVLQNRGYDGSLSDIWSCGVILYVMLVGYLPFDDRNLVVLYQKIFKGDTQIPKWLSPSARDLLRRILEPNPMKRINIAGIKEHEWFQKDYTPVVPYDDDDDNYLDSVLPIKEQIDEAKQEKPTHINAFQLIGMASALDLSGFFEEEDASQRKIRFTSTHSPKDLFDKIENVVTEMGFQVQRGNSKLKVMKNGRGSKNLRNPSSFLVCTEVVELGPSLYVVELKKSHGDPILYRQLCERLSDELGVCKTEQIQRTESLEDDLESFDSGSSLPGF

SEQ ID NO: 6730 - protein, 284 aa, Pseudomonas fluorescens Pf-5
MSRQASVLAGLIGAGIQASRTPALHEQEGDAQHLRYLYRLIDLDQLGLDSSALPELLRAAEQMSFTGLNITFPCKQSILPLLDELSPEARGIGAVNTVVLKDGKRVGHNTDCLGFAEGFRRGLPDVARRQVVQMGAGGAGAAVAHALLSEGVEQLNIFDVEPQRAQSLADNLNQHFGSARARAGGDLSSALHSADGLVNTTPMGMAKLPGMPVPVELLRAQLWVAEIVYFPLETELLRNARALGCRTLDGGTMAVFQAVKAFELFSGQRADPQRMLAHFHSMNG

SEQ ID NO: 6731 - protein, 466 aa, Bradyrhizobium japonicum USDA 110
MATYDLVVIGTGPGGYVCAVRAAQLGMKVAVVEKNATLGGTCLNVGCMPSKALLHASEMFEEAAHSFAKMGVSVSEPKLELPAMMNFKQQGIDGNVKGVEFLMKKNKIDVLKGTGKILGTGKVEVSADGKSQVVETKSIVIATGSDIARLKGIEIDEKRIVSSTGALSLDKVPGKLLVVGAGVIGLELGSVWKRLGAEVVVVEFLDRIMPGMDGEIAKQFQRILEKQGFAFKLGAKVTAVDTSGKTLKATIEPAAGGAAETLEADVVLVCIGRVPYTDGLGLKEAGVALDNRGRVQIDPHFATSLKGVYAIGDVVAGPMLAHKAEDEGVAVAEIIAGQAGHVNYDVIPGVVYTTPEVSSVGKTEEELKQAGVAYTVGKFPFTANGRSKVNQTTDGFVKILADAKTDRVLGVHIIGREAGEMIHEACVLMEFGGSAEDLARTCHAHPTRSEAIKEAALAVGKRAIHM

SEQ ID NO: 6732 - protein, 414 aa, Bradyrhizobium japonicum USDA 110
MTEIRVPTLGESVTEATIGRWFKKAGDPVAVDEPLVELETDKVTIEVPAPSAGTLSEIIAADGATVAVGALLGQITEGAAGAAKPAAAPAKPAAAPAAAAAAAAPAPAAKAPPADAPLAPSVRKLSAETGIDASTVPGSGKDGRVTKGDMLAAIERAASAPTPVNQPAAAVQVRALSPADDAAREERVKMTRLRQTIARRLKDVQNTAAMLTTFNEVDMTNVMALRAHYKDAFEKKHGSKLGFMGFFTKAVVQALKDIPAVNAEIDGTDLIYKNYYHIGVAVGTDKGLVVPVVRDCDHKSIADIEKGIADFGRRARDGQLKIDEMQGGTFTITNGGIYGSLMSTPILNAPQSGILGMHKIQERPMVVAGKIEVRPMMYLALSYDHRVIDGKEAVTFLVRVKESLEDPARLVLDL

SEQ ID NO: 6733 - protein, 577 aa, Gibberella zeae PH-1
MAVEKVTSDAPVVGEKSVVRDVDERAPEAFTATGEEYEQEDFMTRTGLNAKSFTRKHYGLGLVELDRKMKPRHLQMVAIGGSIGAGFFVGSGSALSKGGPATLFIDFFLVGVMVFNVVYAMGELAVMYPISGGFYTYAARFIDPAFGFAMAWNYCLQWAATLPLELTVCAITIQYWAPDSNPGIWIAVFLIAIIILNMFGTMGYAEEEFWAACFKLTSISIFMIIALVLVCGGGPSSGSYSTYQGFKLWEDPGAFKNGFKGFCSVFVTAAFSFAGSELVGLAAAESRNPTESVPKAIKQVFWRICLFYIVALLFVGMLVSCNDENLLSSSSYSNSAASPFVLVGKYSGLKGLDHYMNAVILSSVLSLGIASVYGGSRTLLALAQQGFAPKIFTWVDRAGRPLPSVGFIIAFGCLAFLNLDAAGPVIFDWLLALSGLAMLVCWGSICLAHIRFRAAWKYNGHTLDEIPFKAIGGVYGSWVGLIFVVVILIAQFYVAIVAPVGESGMGTVEDFFMQYLGLPIVLAFWAGGVIWKRTSWISIDKIDIDTGRREHDWDSINAWRAELATFPWWKRLMYTLF

SEQ ID NO: 6734 - protein, 709 aa, Magnaporthe grisea 70-15
MCGASVIVSLRRKHEETNGAAAAKTSDKESRLAKSLDALAHRGPDARGVWIDPTGEVGLAHTRLAIIDLSAEGNQPLHDDQDHIHAVITGEIYDHDRLRRECVEAGYRFKGHSDSEVVVALYQRYGAPGFLEHCRGEFSMVVYDDRSGEVFACRDRSGIKPLFYTIVQNELWFSSEVKGFLGMGWKPEWALESIAMGVTQVGSSTIFQGVNRIEPGFYMKVTADGDITHSKYWDFDYPDKTVVDNRSMEDMVQELREALVDAVRLRLRADVPVGIYLSGGLDSSMIAGIAKKLIDEEGATAGSQKASERMTTFTLAVNSDQDNSVYNEASIASRTAKFLGVKEKTLNADEQLLASTFEDACWHIEQPISTLSMCAKVALSKLARDSGVTVILTGEGADETFAGYPWMLPDLTAEADHSRPDAPINRDIDNLRGPIRKQLFDMWANLGSTEMPKLLQQVKPETWAKMNFVSTPVVSDGSSGVGLIHPKLRAKYNLDDRISKTQDCIGEDVLKKVREKWHPLNSSLYLNHKTLLANTIIPSNGDRTEMANSVEGRPPILDHKVLELASKLPPSVQVGYFPDGANLNSGKTVFRSNNADGELMARFREKFLLREAARPFVTDEIYSRPKHSFMASSNYHAGGPIHQVLKRLLTKENVEAVGFLDWPKIEAHLASAFDPQLAHVAGQNFAPCLQAASFVTISQKFGVARASVE

SEQ ID NO: 6735 - protein, 557 aa, Schizosaccharomyces pombe 972h-
MDFNNIPLATIKSSDDKGKDFIVEMTTRPSETKKKVPFSEDMREIPSLPNEEEANATDPQANEVADENGEGFEAEKISSWIWVLSAVAGISGLLFGYDTGVISGALAVLGSDLGHVLSSGQKELITSATSFAALISATTSGWLADWVGRKRLLLCADAIFVIGSVIMAASRNVAMMVVGRFIVGYGIGLTSLIVPMYITELAPARLRGRLVIIYVVFITGGQLIAYSLNAAFEHVHQGWRIMFGIGAAPALGQLISLFWTPESPRYLLRHNHVEKVYKILSRIHPEAKPAEIAYKVSLIQEGVKVDFPEGNKFQHFFHSLKVLFTVPSNRRSLFIGCFLQWFQQFSGTNAIQYFSAIIFQSVGFKNSISVSIVVGATNFVFTIVAFMFIDRIGRRRILLCTSAVMIAGLALCAIAYHFLPADTTQNTNSGWQYVVLASIIIFLASYASGIGNIPWQQAELFPMEVRALGAGFSTAINWVGNLIISASFLTMMESITPTGTFALFAGFCFVGLVTSYFTYPELAGMSIENIHKLLEKGFWQAVKESTKRVRKGRIDEA

SEQ ID NO: 6736 - protein, 289 aa, Oryza sativa (japonica cultivar-group)
MSHFGRSGPPDIRDTFSLLVLNISFRTTADDLFPLFDRYGKVVDVFIPRDRRTGDSRGFAFVRYKYAEEAQKAIDRLDGRNVDGRNIMVQFAKYGPNAEPIRKGRIIEEVEKSRDRSRSRSPRRRHRDDHRDRERRGRSRSRSRERHGRDRDRDHRRHSRSRSRSRSRSRSRSLSPDYKNRRRGRDDDKRRSKSKSKSKSRSKSRSRSKSRSKSRSRSRSRSRSRSFHSASPTRHSASPPLKGSTPRRSPARNGSPEKETNGKGSPPSRSVSPSPQRAGSRSPGSDDKE

SEQ ID NO: 6737 - protein, 316 aa, Arabidopsis thaliana
MPSLAEEICIGNLGSLQTLPESFTWKLTAADSLLRPSSAVSFDAVEESIPVIDLSNPDVTTLIGDASKTWGAFQIANHGISQKLLDDIESLSKTLFDMPSERKLEAASSDKGVSGYGEPRISPFFEKKMWSEGFTIADDSYRNHFNTLWPHDHTKYCGIIQEYVDEMEKLASRLLYCILGSLGVTVEDIEWAHKLEKSGSKVGRGAIRLNHYPVCPEPERAMGLAAHTDSTILTILHQSNTGGLQVFREESGWVTVEPAPGVLVVNIGDLFHILSNGKIPSVVHRAKVNHTRSRISIAYLWGVVQLVMCKSHLSLS

SEQ ID NO: 6738 - protein, 1186 aa, Arabidopsis thaliana
MDLLSNLPDELLCHILSFFTTKEAALTSVLSKRWRHLFALVPNLDIDDSMFLYPEEGKRDRNEIQQSFVEFVDRLLLLQGKSPTRKVSLKCISMSDPDRLDDWISNVLARGVSELDLSIDLCMDEYILLSSKRFESKNLVRLKLHRICIGQPENPIGWLAGGILLPMLKTVLLESVGFYVDEVFLRALPVLEELVMDVIVSNASLKTLTMSSNHYTGTMSFDTPSLVYFCYSDYVAKDYPLVNMENLLEARIKLLLTDDQVERAREPNNDGVEADEDDVVLQFANVGKLMNGIRNVQYLVFSANTLEVLSLCFESMPVFNNLKSLTIEGKKRRGWQALPVLLSNCPYLETLVLEGLLHYVTDKCGDACGCISREDKGRSLTSCPVKVIEIKGFQGKKKEMHMIKHFLVYFPCLKEIKIYIEENALEVSKVIAKRINRYNKVSNCNVQLLAQIFFRAEKMDHVSSLPDGVLCHILSFLTTKEATLTSILSKRWRNLFAFVPNLDIDDSIFLHNEDFKEDRVLAMQGDSPIKKLSLKFRTGFDSHRADGWISNTLITIFCLQNVSRPRICALPALEELVLFVVPWGEKMDLLRNIPDELICHILSFLTTKEAALTSVLSKRWRNLLAFVSNLHIDDSIFLHPEEGKRDRNEIRQSFLDFVGRILALQGNCPVKKVSIKFLFKLDSDRVDGWISNVLARGVSELDLSIDLCMDEYFLLSSKRFESKNLVRLKLHRLCIGQREKTVGWLAGEIFLPMLKTLELDYVGFYGDLLFLRALPALEELVIVDAFWFTTFTDVTVSNPSLKTLTMSSNIYSGSISFDTPSLVYFSHFKYVAKDYPLVNMENLLEARINLGVTEGQIRRAREPNNNDEVVLRFPNVGKLMNGIRNVQCLDLSANTLEMLSLSCESMPVFKNLKSLSIKSAENRGWQAMPVLLRNCPHLETLVLEGLLHFVTDKCGDACDCVSREEKGRSLTSCPVKTLEIKEFHGTMEEMYMITHFLDYFPCLKELKIYIEGNDHAQREVSEVIAEKIKLYNKSSSSNVQLMRARVSAVYEGKERNRSSNGEETRREQSKHARMTAKARMNVYKESMKPLPPKRKKSLMIISLMRKKEDTQDDQNNVTVVEKEKEEKEKGTVQNIRENAEMLSSKCVEEWPHMLTYEEEWTWFAFAFGWGWWQRYDAVMSGKSWFN

SEQ ID NO: 6739 - protein, 208 aa, Kluyveromyces lactis NRRL Y-1140
MSQAVGNVASIRRKLVIVGDGACGKTCLLIVFAKGKFPQVYVPTVFDNYVADVEVDGRRVELALWDTAGQEDYDRLRPLSYPDSNVVLICYSIDLPDSLENVMEKWISEVLHFCQGVPIILVGCKADLRNDPQVVEELRAQGLQPVSQAQAQEVADQIGAVDYIECSAKTGYGVREVFEAATRASLVGKQGKSKPKTKSSKKKKCVVL

SEQ ID NO: 6740 - protein, 1103 aa, Tropheryma whipplei TW08/27
MPNPRDIGSVLVIGSGPITIGQACEFDYSGTQACRVLKEEGIRVILLNSNPATIMTDPEFSDATYIEPMTIEVLEAILDKERPDAVLPTLGGQTALNLAMQLHNKGLLEKYGTQLIGATPEVIARGENREMFRHIVLSSGAEVATSEVITSVEGAVLFAQKNGYPLVIRPSYTMGGLGSSLVHTESELVDSVKQGIEASPNGQVLLEESIVGWKEYELELMRDVAGNTVIVCSIENIDPVGVHTGDSVTVAPAMTLTDREYQNLRNIAIAIIRMIGINTGGCNIQFAVNPTDGRVVVIEVNPRVSRSSALASKATGFPIAKLAAKLALGYRLHEIKNDITKKTFASFEPSLDYVAVKIPLFAFEKFPKANPELTTSMKSVGEVMAIGRNFTTALQKAMRSLDQPHMCFHWQPFESPGHSIASDVPDPREYYLDFIRTPLPSRLVAIQQALRFGASIDEVHEASRIDKWFVSQIDLINKTADSLKDLSMDCLSRAKRHGFSDRQIADLLRIDEEDVRKRRSALGIAPVYKTVDTCAGEFPAVTPYYYSSYDSENEAIPSPSRKVIIIGSGPNRIGQGIEFDYSCVHAAMALSGMGIETVMINCNPETVSTDYDTSDRLYFEPLTLEDVLEVISVEQRNGDLLGVIAQLGGQIPLSLAKSIQHEGIPILGTSPESIDLAENRDLFSNLLRSLNLPTYEHRTVSNKDEAIIAANKMGFPVLLRPSFVLGGRGMKVIHDSQALEDYFNTFHAVDSEHPLLIDKFLSDAIEVDVDALYDKHELFIGGIMEHIEEAGIHSGDSSCTIPPVTLGKNIVNQIVSTTHAIARTLSVLGPVNIQFAIASGILYVLEANPRSSRTLPFVSKATGIPLAKAATRIMLGHTIEDLQREGLLPQRDMRFFNPTDPIAVKEVILPFKRFRTKSGEFLDTLLGPEMQSTGEVMGIGPTFPIAFAKSQQAAFSELPRTGAIFVSVADHDKRKVVLPAMRFYKLGFKIFATSGTADTLRRFGIDVVTIQKFSEAKKTSSRSVVDLIREGRISLVINTPSGGVSIADGYEIRVTALACEIPVFTTISEMNAAVISLESGSHEIASLQELYSSRARSAENLCG

SEQ ID NO: 6741 - protein, 446 aa, Triticum aestivum
IRAWDLFRYRNFKTFTTPSPRQFVSLTADQSGEVICAGTLDSFEIYVWSMKTGRLLDVLSGHQGPVHGLMFSPISAILASSSWDKTVRLWDVFESKGAVETFQHSHDVLTLAYRPDGRQIACSTLDGLINFWDPFDGLLMYTIEGRRDISGGRLMTDRRSAANTSIGKYFTTLCYSADGSYILAGGNIKYICMYDIGEQVLLRRFQITRNLSLDGVLDFLNSKNMTDAGPLDLIDDEDSDVEDGIDQQTRGSLGHGLPGSMANRGRPIARTKCVKFAPTGRSFAAATTDGVLLYSVDESFIFDPTDLDIDVTPEKVEEALAENQQQRALVLSLRLNEDSLIKKCIFAVDPSNVRAICSSVPFKYLQRLIDAFADLLESCPHLEFILLWAQELCKVDGSYIQQNSRTLLPALKSLQKSITKLHQDLADTCSSNEYMLKYLSSAGTKS

SEQ ID NO: 6742 - protein, 386 aa, Haemophilus influenzae 86-028NP
MSVIKMTDLDLAGKRVFIRADLNVPVKDGKVTSDARIRATIPTLKLALEKGAKVMVTSHLGRPTEGEFTPEDSLQPVVDYLKNAGFNVRLEQDYLNGVDVKDGEIVVLENVRINKGEKKNDPELGKKYAALCDVFVMDAFGTAHRAQASTYGVAEFAPIACAGPLLAAELDALGKALKEPARPMVAIVGGSKVSTKLEVLNSLSKIADQIIVGGGIANTFIAAAGHNVGKSLYEADLMPVAKELAANTDIPVPVDVRVGLEFSETAAATEKAVNEVKDDESIFDIGDKSAEQLAEIIKNAKTVLWNGPVGVFEFPHFRKGTEIISHAIANSDAFSIAGGGDTLAAIDLFGIADKISYISTGGGAFLEFVEGKVLPAVEILEKRAKN

SEQ ID NO: 6743 - protein, 404 aa, Lactobacillus reuteri
MKEVVVLGAGYAGLKTVVLLQKKLKNNVHITLVDRNNYHYEATDLHEAAAGTQSASRITYPISDVINPQITTFIQDEVVKIDPDKKTVKLAGHEELLHYDYCVLGLGFVSETFGIPGAEENALPMTNVKEALAIYDHIIAKMKDYRTTHNPDDLQIVICGGGFTGIELAGALVDARASYAKIAGVSPDEIKITLIEASTRLLPMFSEKLAEYGVNLVKSLNVQLLDGSRISKIEPGKVIYKHGDDDEESLNAGIIIWTTGVSGNPLMEECGFDAKRGRVIVTDHLTDPKHDDIYIIGDVAAVMPPDGKRPYPTTAQIALAMADYTAEDIVSRIKTGKHEAKPFTYKSLGTVASVGNTRAFGEAMGHELRGYPASAMKKIIADRSLLETGGLKELFAKGRFDLYH

SEQ ID NO: 6744 - protein, 668 aa, Methanococcus maripaludis S2
MDDKKIHELRLYLVDYLKAYHLDDFRLEKYRVKVDIKNIYENYGFEFVNYLEEEPKEAVNLLEEAYTEAYYSVKGDKPHFVLSIYNLPDTINKKSGKVVTIEDINVETHGRLLEVEGIIVLATKIKMALKRGVHLCTSCGEKKIEYIEKPFEAQFEPVCPKCAQNMMLLEDDSKTKYVNFQELKLQQPLDLMSDPEEPPKFITVLLENSPGFYTGRVKVTGIPIKIQRNKKVPMYDLVFSGIHCEPVSEKLESDFTENEIESFEKIAKNENVIEILADRLIPDLKGYMTVKKAVFLQQVKGVKKGNKRNDSHILLITDPGTGKSLSLRKIAKIPGNVYGSVNMASGVGLTASVVQEKTEIGDNTYVIKPGLLVKANGGTACIDEFATNKKLHENLLEAMESQTIHISKGGLNTKLPSECAVLAAGNPRWGRFDPNVSIMEQINISPPILSRFDLIFPLIDEPDRTKDRGIAHHIISIHRAHLDKGKDKEIDLTSKVIDDIEIDFGFICKYITYARQLEPKITDEAENILTDYYLKMRKGVVQITARQLEAAIRLSEAIAKARLKTEVTCEDALEAVELINESLKETAFDPETGQYDVDKIMGVSKKERSRLTEVYDAIKDLGSIKDLVLYDDLLEALKMKETILKEAIKKLITNGDIDEPKTGMYRII

SEQ ID NO: 6745 - protein, 581 aa, Desulfotalea psychrophila LSv54
MMENIKMSDCAEQLFSRFVVANAHRQSDYFSLIKTIIPCAKKHGNDCGSPLRAAYALLEREILENRHSPTKEISFGTSGWRGVLGKDINIYTVSCVTAAIVDMFQQIDVNRQLARLLLVDSFAEAQERGCVLGFDNRFGGEILARAVAGVLLAAGFRVHYAGESTTGVLSAAVLQLGASCSINLTPSHNPLEYGGYKFNGADAGPAASGVTEYITKKSRLIVEDGRDVSLLTEETFLADDRVHLLDSLQLWKDLVSQNRDKHGLDLSEISAKLLQRDDISVAVDSVHGASRLHIDALLGEEAGAKIKQLRNTADVTFGGVAPEPSSANMQGLVTYLQGIETPLKLGAIIDPDGDRIRFTDGDREISMNQFGAIAYHFLHEEKGVHGLLAKTVASSNLANRIAESFSEEIFEPRVGFKEFKPVVGRAVVCFEESDGISIIGHTPEKDAYIGLLLALDIVLTTGENLGTYLGKIEACYGSYYPEVGSVAVSMEGLALAEALEKLSSLLPGQTLEVAGEEREISQVIDIDGRKIIFADASWLMIRPSGTEPKVRFYVESRTRSGASALIKTARQLLIDIGLLSL

SEQ ID NO: 6746 - protein, 740 aa, Arabidopsis thaliana
MRSYNLFHESNPTISFSFVGAETMAPNLHIKKAFMAMRAMGIEDARVKPVLKNLLALYEKNWELIAEDNYRVLADAIFDSHEDQAIQESEEKKADEVKEDEGCAAEVDRGKKKLHESIEDDEDVMAESDRPLKRLRRRGEGGSALASPSLGSPTLEGPSINDEENAPILLPYHPVPIENDHDAGELILTKVEPITNMPLSSIPDSVDRGDSSMLEIDKSNGHVEEKAGETVSTADGTTNDISPTTVARFSDHKLAATIEEPPALELASSASGEVKINLSFAPATGGSNPHLPSMEELRRAMEEKCLRSYKILDPNFSVLGFMNDICSCYLDLATNGRDSANQLPKNLPFVTTNIDALKKSAARMAYTSQASNDVVEICSNEHMRDAENGAVGDSMALVVVPECQLSADEWRLISSVGDISLGKETVEIPWVNEVNDKVPPVFHYIAQSLVYQDAAVKFSLGNIRDDQCCSSCCGDCLAPSMACRCATAFNGFAYTVDGLLQEDFLEQCISEARDPRKQMLLYCKECPLEKAKKEVILEPCKGHLKRKAIKECWSKCGCMKNCGNRVVQQGIHNKLQVFFTPNGRGWGLRTLEKLPKGAFVCELAGEILTIPELFQRISDRPTSPVILDAYWGSEDISGDDKALSLEGTHYGNISRFINHRCLDANLIEIPVHAETTDSHYYHLAFFTTREIDAMEELTWDYGVPFNQDVFPTSPFHCQCGSDFCRVRKQISKGKNVKKRA

SEQ ID NO: 6747 - protein, 335 aa, Zea mays
  misc_feature (209)..(209): Xaa can be any naturally occurring amino acid
MGSDFKSIPLIDIGPLVEKIDDPSMANDKDLLQVVRLLDDACKEAGFFYVKGHGIDESLMREVRNVTREFFQLPYEEKLKIKMTPQSGYRIGENITKGKPDMHEAIDCYTPIRPGKYGDLAKPMEGSNLWPKYPSNFEVLLENYIKLCRDISRKIMRGIALALGGAIDAFEGDTAGDPFWVLRLIGYPVDIPEEQRTDTGCGAHTDYGXKKNSICETVDDGLLTLVNQDDDICALEVQNRSGEWIYATPIPGTFVCNIGDMLKVWTNGIYQPTLHRVVNNSQHYRVSVAFFYESNFDAAVEPVEFCREKTGGAAKYEKVVYGEHLVQKVLTNFVM

SEQ ID NO: 6748 - protein, 430 aa, Yarrowia lipolytica CLIB122
MDRTRTHDENSLHEYRKPTAAGGAPTKRVALGTVTNTASVATKAKVAISKPPQRITRQPLVAQNQNIPPLAAQTSTTSLVQPCPGSDDTVDEEVDTQTADVEPTQIEDDFYESDEEGPTQRFAVSESNPQALYPVVDKESMAELNRVATYFSTNNGVDLDENDDDTYDISMVAEYAEEIFTYMKELEVRFQPNPGYMDSQTEIHWAMRSILVDWLVQVHHRFSLLPETLFLTINYIDRFLTIKTVSLSKLQLVGAVALFVAAKYEEINCPSVQEIAYMVDNGYHVDEILKAERYMIDLLDFNLGWPGPMSFLRRTSKADDYDLETRTLAKYLLEVTIMEKTFVGAPPSWLAAAAHFLSRRMLNRGHWTDGHTYYSGYTEKQLLPAVMRIIQCCRDPLTHHKAIFEKYKDRKFKRASVYVQEWMDHEENNH

SEQ ID NO: 6749 - protein, 361 aa, Tropheryma whipplei str. Twist
MSAKNYKKTLLVNPISQDELQKRLSAPGFGSVFSEHMVSADWHRDLGWHDYRVEPYGPISLAPSAMVFHYGQEIFEGLKIFRHSQDSSVRAFRPLENAKRFQKSSERIALPVLPVEDFLQSLREWVMVDGRWVPNAPSCVYARPFMIATEEALGLRATCSARYTLICCPVGDLFGQIRPIRVRVSSKYSRASRGGTGSVKFGGNYAASILPQVEAGNDGFDQVLFLDSASYKNIEELSASNIFFVLSSKTLITPSLGGTILPGVTRDSIIRIAEDLGFVVEQRQISLDEVTHLFSQDKVTEMFCCGTAASVTPIGSVSFDGGTLGSGQAGPVTMLLREYLRDIQFGNRPDKYNWMVNLEDT

SEQ ID NO: 6750 - protein, 490 aa, Pseudomonas aeruginosa PAO1
MARFEEQKLYIGGRYVEASSGATFETINPANGEVLAKVQRASREDVERAVQSAVEGQKVWAAMTAMQRSRILRRAVDILRERNDELAALETLDTGKPLAETRSVDIVTGADVLEYYAGLVPAIEGEQIPLRETSFVYTRREPLGVVAGIGAWNYPVQIALWKSAPALAAGNAMIFKPSEVTPLTALKLAEIYTEAGVPDGVFNVLTGSGREVGQWLTEHPLIEKISFTGGTSTGKKVMASASSSSLKEVTMELGGKSPLIIFPDADLDRAADIAVMANFFSSGQVCTNGTRVFIHRSQQARFEAKVLERVQRIRLGDPQDENTNFGPLVSFPHMESVLGYIESGKAQKARLLCGGERVTDGAFGKGAYVAPTVFTDCRDDMTIVREEIFGPVMSILVYDDEDEAIRRANDTEYGLAAGVVTQDLARAHRAIHRLEAGICWINTWGESPAEMPVGGYKQSGVGRENGLTTLAHYTRIKSVQVELGDYASVF

SEQ ID NO: 6751 - protein, 506 aa, Oryza sativa (japonica cultivar-group)
MASQPPALDILVREPDGFSVWSGPPYPTGSAPPVRLPKTACSATYFSSDGSRLLATVASASATVYDCRTLSVVRSFELPGLLAAALSPAGTFLQTFQKSSSPQEKNVTVWHVDTATALYQHYQKNMSKATWPMVQFSADESVACRMMTNEIQFFDPKDFTKGFVYKLRMPGIAAMQLASAPGSHVAGFVPEAKGVPASVQIFSCDKDAQGQAVARRSFFRCSTVQFHWNKGSTGLLVVAQADVDKTNQSYYGETKLNYLTTDRAFEGIVPLKKDGPVHDVQWSYSGSEFAVVYGCILAVSVFTCNAVSHDLPGDILDLILSTSYRFSRAFWDYSEKKLVGKTKAECSVTSEWSPDGRHFMTATTAPRLQIDNGIKIFDHNGSLQFKKMFEKLYQADWKPEAPEKFSDIADLTISLGSIKIEETKKQAQGSKSAQPSSKAPANIAAKPTAYRPPHSKNSADVQDKLFGGLASTGGEMSKNALRNKKRREKQKEKKAAEGSGASADDN

SEQ ID NO: 6752 - protein, 428 aa, Neisseria meningitidis Z2491 [sequence omitted]

SEQ ID NO: 6753 - protein, 307 aa, Arabidopsis thaliana
MNSSSPISIDLIAEILSRVPSKSVARFRCVSKPWASMIRRPYFTELFLTRSSPKPCILFATVADGVWSFFSLPQYPYEKSSSASVAASAKFHVKFPPNNMRIGHNSDRRYFSYGYTSGLIYLYGDSSDDRSVICNPYTGEYAILPYLQRYRKTYSFLVFEPIEKQFKILFMAYLSGDRDHKILTVGTGNMKWRTIRCSLRYEIVSEGVSINGVLYYLGETSAWDNKDYDLKYDYAIVCFDIRSEKFIFFEIERFCRLINYKGKLAVIYFEDDVNYQSCLYRKKNYVEPDAINKLNVWVLEDVEKQEW

SEQ ID NO: 6754 - protein, 163 aa, Mangifera indica
FWGGVPGSRQGLPEFQTEITVLSKIRHRHLVSLVGYCEEQSEMILVYEYMEKGPLKSHLYGSKHPPLSWKQRLEICIGSARGLHYLHTGSAQGIIHRDIKSTNILLDENYVAKVADFGLSRSGPCLDETHVSTGVKGSFGYLDPEYFRRQQLTDKSDVYSFGI

SEQ ID NO: 6755 - protein, 394 aa, Leuconostoc mesenteroides subsp. mesenteroides ATCC 8293
MHFEESDLLKTLPKQFFATLVAKVNAKIAAGKDVINLGQGNPDQPTPEYIVESLQAAAENPADHKYSLFRGEERFKKAIAEFYADEYGVSIDPETEVAILAGSKIGLVELPWALMNPGETLLLPDPGYPDYLSAAALGRVNYEAVPLKQENNFLVDYEAIPNSVAEAAKFLYLNYPNNPTGAIATSEFYQQTVRFAEENQVGIVSDFAYGAIGYDGHKPLSFLQTENSKSVGIETYTFSKTFNMAGWRVGFAVGNAEMIEALNLIQDHLFVSLFPAVQDAAIEALTNRAAREKAVTDLTNLYQRRRDVFINAVREFGWEPYVPRGAFYVLMPVPKGYTSSEFADLLLEEANVAVADASGFGKGGQGYIRVGLTIVEERLAEAAKRISKLPIFSK

SEQ ID NO: 6756 - protein, 385 aa, Oryza sativa
  misc_feature (174)..(174): Xaa can be any naturally occurring amino acid
  misc_feature (192)..(192): Xaa can be any naturally occurring amino acid
  misc_feature (199)..(199): Xaa can be any naturally occurring amino acid
  misc_feature (210)..(210): Xaa can be any naturally occurring amino acid
MEKALVLIVGAGPSGLATAACLGQLSIPYVIIEREDCTASLWRKHTYDRLKLHLAKEFCEMPHMPYPEDTPTYIPKIQFLRYIDDYVEHFNICPKFNSSVESCLYDDVQKYWVVTTHDQVNGMVSKYAARFLVVASGENSAGNIPSIPGLEDFSGHVIHSSSFRSADSYAAQRXCLLVGCGNSAMEIAYDLXSHGAIPXIVIRSPLHVMXKELIPMGMKLASWSLPVKFVDFILVVLAYLWFGNLSKYGIVRPNKGPLLLKANTGRSAVIDVGTVELIKKGDIKVFGTISCIKGNVVEFDDGKESYFDAIVFATGYTSTANNWLKNGEDMMNKEGMPKKDFPNHWKGSNGLYCVGFARRGLSGIAHDAKNVANDVKAFLDLMAPF

SEQ ID NO: 6757 - protein, 178 aa, Mangifera indica
FGGVYRGHLKDVKLDVPIKRVSRESRQGRKEYVSEVKIISRLRHRNLVQLVGWCHDRGEFLLVYEFMPNGSLDSYLYSPAAGLGWPARHKIALGLASALLYPHEEWEQCVMHRDVKPSNIMLDSAFNAKLGDFGLARLVDHDRNLQTTDLAGTRVYIAPECFYTGKPSKESDIYSFGI

SEQ ID NO: 6758 - protein, 480 aa, Xylella fastidiosa Temecula1
MSFLPSFLKRKSIDLITVHEEGRRLVPTLSWPHLIAFGIGAIVGTGIYTLIGVGAEKAGPAVLLSFVIAGVICACAALAYAEMATMMPVAGSTYTYSYVALGEGIAWIVGWSLILEYSLVVSTVAVGWSGYMTGFLKSVGVDMPLALTAGPYAGGIINLPAAVITCVVAGLLIVGTKESTTLNAVLVVVKIIALSVFVVIALPHFDMAHLKPFMPYGFIKSIDTGGVERGVMAAAAIIFFAFYGFDAISTAAEETKNPSRDLSIGIIGSMIGCTLIYVLVALAAIGAMHYTVFGPSTEPLALILRQLDQGNTARLIGAAAIIALPTVLLAFLYGQSRILFVMSRDGLLPRGLSTVNARTGTPIATTLFTAVLVATAAGLVPLGEIAALANAGTLTAFIAVALCLLVLRVREPQRVRAFRTPLAWVVGPIAIAGCLYLFWSLPKMTQYLFLLWNALGLCVYLVYGRHTSLLSKAVSIDTPR

SEQ ID NO: 6759 - protein, 179 aa, Mangifera indica
FGSVYRGEMDEGMTVAIKRANPQSEQGLKEFETEIEMLSKLRHRHLVSMIGYCDEQNEMILVYEYMANGTLRSHLFGSDLPPLTWKQRLHACIGAARGLHYLHTGAEGGIIHRDVKATNILLDENFVAKMADFGLSKDGPAFDHTHVSTAVKGSFGYLDPEYFRRQQLTQKSDIYSYGI

SEQ ID NO: 6760 - protein, 225 aa, Haemophilus influenzae 86-028NP
MSNTVATMINKRNIMRNYIKIGVAGPVGAGKTALIEKLTREIASKYSVAVITNDIYTQEDAEFLTKNSLLPPERIMGVETGGCPHTAIREDASMNLEAVDEMVTRFPDVEIVFIESGGDNLSATFSPDLADVTIFVIDVAQGEKIPRKGGPGITRSDLLVINKTDLAPFVGVDLSVMERDARRMRNGQPFIFTNLMKKENLDGVIGWIEKYALLKNVEEPASLVR

SEQ ID NO: 6761 - protein, 321 aa, Solanum lycopersicum
MGSKYSKATNSINDALSSSYLVPFESYRVPLVDLEEATNNFDHKFLIGHGVFGKVYKGVLRDGAKVALKRRTPESSQGIEEFETEIETLSFCRHPHLVSLIGFCDERNEMILIYKYMENGNLKRHLYGSDLPTMSMSWEQRLEICIGAARGLHYLHTRAIIHRDVKSINILLDENFVPKITDFGISKKGTELDQTHLSTVVKGTLGYIDPEYFIKGRLTEKSDVYSFGVVLFEVLCARSAIVQSLPREMVNLAEWAVESHNNGQLEQIVDPNLADKIRPESLRKFGDTAVKCLALSSEDRPSMGDVLWKLEYALRLQESVI

SEQ ID NO: 6762 - protein, 311 aa, Triticum turgidum
TLFFLRGDGRLTPLAIELSEPVIQGGLTTAKSKVYTPVPSGSVEGWVWEFAKAYVAVNDSGWHQLVSHWLNTHAVMEPFVISTNRQLSVTHPVHKLLSPHYRDTMTINALARQTLINAGGIFEMTVFPGKFALGMSSVVYKDWKFTEQGLPDDLIKRGMAVEDPSSPYKVRLLVSDYPYAADGLAIWHAIEQYVSEYLAIYYPDDGVVQGDVELQAWWKEAREVGHGDLKDAPWWPRMQAVGELAKACTTIIWIGSALHAAVNFGQYPYAGFLPNRPTVSRRRMPEPGTDEYAELERDPERAFIHTITSQI

SEQ ID NO: 6763 - protein, 304 aa, Triticum turgidum
TLFFLRGDGRLTPLAIELSEPVIQGGLTTAKSKVYTPVPSGSVEGWVWEFAKAYVAVNDSGWHQLVSHWLNTHAVMEPFVISTNRQLSVTHPVHKLLSPHYRDTMTINALARQTLINAGGIFEMTVFPGKFALGMSSVVYKDWKFTEQGLPDDLIKRGMAVEDPSSPYKVRLLVSDYPYAADGLAIWHAIEQYVSEYLAIYYPNDGVVQGDVELQAWWKEVREVGHGDLKVAPWWPRMQAVGELAKACTTIIWIGSALHAAVNFGQYPYAGFLPNRPTVSRRRMPEPGTEQYAELERDPERAFI

SEQ ID NO: 6764 - protein, 210 aa, Triticum turgidum
YIYASRTLLFLKADGTLKPLAIELSLPHPDGIQHGAKSTVYLPADIDSGVDGQIWQLAKAYASVDDSAWHQLISHWLNTHAVIEPFVIATNRQLSVVHPVHKLLSPHYRDTLNINALARTTLINAGGVFEMTVFPEKYALEMSSIVYKNWKLTEQGLPDDLVKRGMAVPDSSSPYGVRLLIKDYPYAVDGLVIWWAIERWVNEYLAIYYP

SEQ ID NO: 6765 - protein, 333 aa, Rhodobacter sphaeroides 2.4.1
MGLDEVSQKPHERLAAWLAEDMAAVNGLIRERMASKHAPRIPEVTAHLVEAGGKRLRPLLTLAAARLCGYEGPYHIHLAATVEFIHTATLLHDDVVDESHRRRGKPTANLLWDNKSSVLVGDYLFARSFQLMVETGSLRVMDILANASATISEGEVLQLTAAQDLRTTEDIYLQVVRGKTAALFAAATEVGGVVAGVPEAQVEALHAYGDALGIAFQIVDDLLDYGGVDAQIGKNTGDDFRERKLTLPVIKAVAQADAEERAFWQRVIEKGDQREGDLEQAHAIMSRHGAMEAARQDALRWVTVAREALGQLPEHPLREMLHDLADFVVERIA

SEQ ID NO: 6766 - protein, 125 aa, Triticum aestivum
  misc_feature (103)..(103): Xaa can be any naturally occurring amino acid
TVDTRAVFSFAMASGTDEKAKMESLTSPAAFVEGGVQDACDDACSICLEAFCESDPSTLTGCKHEFHLQCILEWCQRSSQCPMCWQPVSMKDPTSQELLEAVXRERNIRTNQTRNTTIFHHPALG

SEQ ID NO: 6767 - protein, 514 aa, Oryza sativa (japonica cultivar-group)
MALSAETGKVVQWRRWAFANLGSVLSNFGSLWLLLAPLLAAYAPRRLFKTYFNLFLRRHARRLLAVVDPYVTVDVSEPGGASAHYSRVKAYLSDGCAGEARELRAEGASEGDGVVISMRDGQDVADEFRGRRAVVDVSGPGGRAGAARGRTPGGARALRFHHRDRRLVVDEYLPHVRRKGREILFSNRRRRLYTNNKSGDSFRYDYKAWSYIDFDHPTTFDTLAMDTARKREIIDDLDAFRSDRDFYRRAGKPWKRGYLLHGPPGTGKSTMIAAMANYLDYDIYDVELTVVKDNNDLRRLLIETTSKSIIVIEDIDCSLDLTGDRAATQRRGRQNDRDDGSRRHDRDGSMVTLSGLLNFIDGLWSACGGERIVVFTTNHVDKLDAALIRRGRMDMRIEMSYCGIEAFKTLAKNYLDVDDHRLFGPVGEILGRESITPADVAECLMTAKRAGSDDESSRLEIVIDELKQTAEANAKAKAEAEAKAKAEAEEEAKAAEMDRDNTREEQNGRKSPKI

SEQ ID NO: 6768 - protein, 444 aa, Thiomicrospira crunogena XCL-2
MTLEEAKKLLADNDVKYILAQFVDIHGVAKTKSVPANCLEDIVTSGAGFAGFAVWGLGLEPHQSDYLAKADLSTLSLVPWQPGYARVACTGHVNGQPYAYDSRYIMLKQIERLSEKGWTLNTGIEPEFSLLRKDENGQMVPFDKTDVLDKPCYDYKGMSRSRQFLETFVDSLQQVGFDVYQIDHEDANGQFEINYTYSDAKTSADRITFVRMAGSEIANEMGMTCSFMPKPNSSRTGNGFHYHLSITDEQGRNLFSDDSDENNLGLSEMAYHFLGGLIHHAKALCAFSAPTVNSYKRLVVGRSLSGATWAPAFISYGDNNRTAMVRVPYGRLEFRLPDSGSNSYLVTAAIIAAGLDGIEKKMDPGTPKNINHYSLSMEELADLGVETLPQSLSEAIHELERSTLFHEQFGEAFVKEFIDIKRMEWVEYQRHVSDWEINRYVEFF

SEQ ID NO: 6769 - protein, 629 aa, Streptomyces coelicolor A3(2)
MSRPRIVIVGAGFAGYRTARTLSRLTRHQADITLLNPTDYFLYLPLLPQVAAGILEPRRVSVSLSGTLPHVRLVLGEADGIDLDGRTVHYTGPEGGEGTLAYDRLVLAAGSVNKLLPIPGVAEHAHGFRGLPEALYLRDHVTRQVELAAAADDRAECAARCTFVVVGAGYTGTEVAAHGAMYTDAQVRRHPMRTGMRPRWMLLDVAPRVMPEMDERLSRTAERVLRQRGVDVRMGTSVKEATHDGVVLTDGSTVDTRTLVWCVGVRPDPLVESLGLPMERGRLLVDPHLQVPGRPELFACGDVAAVPDLNQPGQYTPMTAQHAWRHGKVCAHNVVASLGRGQRRAYRHRDMGFVVDLGGAKAAANPLGLPMSGPAAGAVTRGYHLAAMPGNRVRVAADWLLDAVLPRQAVQLGLVRSWSVPLESSSPEVARVPGRPEQSGKDAGTAGSAGTAGKHADGDEGKKQPGGEPAKGQPGGEPGKNQPGGEPGKNQPGGEPGKNQPGGEPAKNQPGGEPAERGPDASAGSRSHGERAKRSQSGSPRASGKPRRAVEAAGPRSARGGSGKPGKSSRASGTGSAGKRPTAPSGPSRSAGQPADPGPEPPAHQPPPGPDIAPGPVRRTDGRAVEGDS

SEQ ID NO: 6770 - protein, 586 aa, Yarrowia lipolytica CLIB122
METEKTFTTTTVDSDPDTHGEVVVNTKKMNAWQRFKDGFGPADVSHIDTEGLTPMEIAALKTANAPLNRGLKGRHLQMIAIGGSIGTGLFVGSGASLATGGPAALLIAYGIIGCMLLCTVHALGELAVAFPVSGAFSTYFTRFIDPAWGFAMGWNYTLLWFAILPLELVAASITVEYWNEQNGTNINPAAWISLFWALIAGINLFGVKGYGEAEFVFSIIKVAAVIGFIIMGIVFVCGGGPKGYDYDKYIGGSMWQNPGAFAHGFKGVCSVFVTAAFAFAGTELVGLAAAETEDPRKMLPTATKQVFWRICLFYLISLTLVGLLVRFDDPRLLNGTSNVDIKASPFVIAILNAGVKGLPSVMNVVIMIAVLSVGNASVYGFSRTIAAMALRGEAPAFWGYIDKNGRPIYGIFAVLAFGLFAFIAAASADIRNKVFMWLLALSGLSSILVWGSINLAHIRFRQALKFRGRDTSELTFVAGFGVWGSVFGLTLNCLVLVAQFWIALYPIGGEPNAEAFFAAYLAAPIVIVFWIFWKVWKRPPFLKVSDLDIDTGRRDTDLDRVRAETTAEREYIASRNFFYRVYKFWC

SEQ ID NO: 6771 - protein, 2195 aa, Neurospora crassa
MTDHHRDVSQYKYSAMSNLVLQADRRFVTRRTDEATGDPESLAGRLSIKDMGSRVARDSAPKPKKAGAMPDVERGSLREGADILQREKKKGKLESATRGGGILTGADALIEGLRYRPRTQPTRDAFNLILTIVAEHLGDVPHEVVRSAADAVLEYLKDDDLKDFDKKKEVDDILGVSMGPKQFNELINLGKKITDYDAQDEDEDAGDARQEGDDEIDGRQGVAVNFENDEDDDGMVDVVRDESSDEEDFAEDEELPDSNEVVDGEGGQEEVVEDILNGEAMVIDSAPEGKKSGSDDNSIPARDIDAFWLQRQIGRLYPDAHIQHDKTMSALKTLSGEPDEPGGEEKQLRDIENDLMELFDYEHHELVQKLIANREKVVWLTRLARAENEEERNTIKREMASEGLRWILDELEGKTDGGQKKIKMDIKMDIDSGAFADKEGQKPERPEGQLVGGLQPRKLINLENLIFDQGNHLMTNPKVRLPEGSTKRTFKGYEEIHVPPPKKRNDPSDAHVPISEMPEWAQIPFSTAKSLNKIQSKCYPTAFGDDGNMLVCAPTGSGKTNVAMLTILREIGKHRNEAGEIDLDAFKIVYIAPLKALVQEQVGNFGKRLEPFGIRVAELTGDRQLTKQQISETQIIVTTPEKWDVITRKATDLSYTNLVRLIIIDEIHLLHDDRGPVLESIVARTIRKTEQTGEPVRIVGLSATLPNYRDVASFLRVDTNTGLFHFDGTFRPCPLRQEFIGVTDRKAIKQLKTMNDITYQKVLEHVGQNRNQMLIFVHSRKETAKTARYIRDKALEMDTINQILKHDAGTREVLSEASNSVNNTDLKDILPYGFGIHHAGMSRADRTDVEDLFASGHIQVLVCTATLAWGVNLPAHTVIIKGTQVYSPEKGSWVELSPQDVLQMLGRAGRPQFDTYGEGIIITTQGEMQYYLSLLNQQLPIESQFASKLVDNLNAEIVLGNVRSRDEGVEWLGYTYLFVRMLRSPGLYQVGAEYEDDEALEQKRVDLIHSAATVLKKSNLIKYDEKTGKLQSTELGRIASHYYISYGSMDTYNKLIQPSITDVELFRVFAQSAEFKYIPVRQEEKLELAKLLAKVPIPVKESIEEPTAKINVLLQAFISRLKLEGLALMADMVYVTQSAGRILRAIFEITMKKGWASVAKLALNLCKMAEKRMWPTMSPLRQFPNCPVEIIRKAERIDVPFSSYFDLDPPRMGELLGLPKAGKTVCSLVAKFPRVEVQAQVQPMTRSMLRIELAITPNFEWDADIHGLSESFWIIVEDCDGEDILFHDQFILRKDYAESESNEHIVEFTVPITEPMPPNYFISVISDRWMHSETRLPVSFRKLILPERFPPHTELLDLQPLPVNALKAKDYSALYPDWQQFNKVQTQTFKSLYETDNNVLICSPTGSGKTEHGRAVYIAPFQELVDLRFQDWQKRFANLRGGKDIVKLTGETTTDLRLLEQGDLIMATPLQWDVLSRQWKRRKNVQTVELFIADELHLLGGQMGYVYEIIVSRMHYIRTQTELPLRIVGLSVSLANARDVGEWIDAKKHDIYNFSPHVRPIPLELHIQSYSIPHFPSLMLAMAKPTYLAVTQLSPDQSALIFVPSRKQTRATARDILTACLADDDEDRFLHVDVEQIQKLLDRVQEAALAEALKHGVGYYHEALSLNDKRIVKHLYNNGAIQVLIASRDVCWELDCTAHLVVVMGTQYFEGREHRYVDYPLSEVLQMFGKALQQNKAGRGCGVLMVPAVKREYYKKFLNEALPVESHLHNFLHDAFVTEISTKMIESGEDAINWATFTYFYRRLLANPSYYSLTDPTHDGLSQYLSDMVEATLKDLAESKIIDFDEDDGTVAPQNAAMIAAYYNISYITMQTFLLSLTAKTKLKGILEIVTSATEFEAIQIRRHEEVILRRIYESVPVKMAEPVFDSPHFKAFVLLQAHFSRMNLPIDLAKDQEVILTKVLSLLSATVDILSSDGHLNAMNAMEMSQMVVQAMWDRDSPLKQIPNFTTEVIKTANKYGIRDIFDFMEKMNPEENADYASLVRDLGLSQAQLAQAAEFTNNKYPDVSLEFELEDKDNIRANEPAYLKINIEREVDEDEEFDPTVHAPFYPGKKTENWWLVVGEESSKTLLAIKRVTIGKKLNVRLEFTVPTPGRHDLKLMLMSDSYVGVDQDPAFSVMVEEGMDVDESDEEEEEEE

SEQ ID NO: 6772 - protein, 360 aa, Pseudomonas syringae pv. syringae B728a
MSKQILILPGDGIGPEIMTEAVKVLELANEKYQLGFELTHDVIGGAAIDKHGVPLADETLERARAADAVLLGAVGGPKWDTIERDIRPERGLLKIRSQLGLFGNLRPAILYPQLADASSLKPEIVAGLDIMIVRELTGGIYFGAPRGTRVLDNGERQAYDTLPYSESEIRRIAKVGFDMAMVRGKKLCSVDKANVLASSQLWREIVEQVARDYPEVELSHMYVDNAAMQLVRAPKQFDVIVTDNLFGDILSDQASMLTGSIGMLPSASLDTANKGMYEPCHGSAPDIAGKGIANPLATILSVSMMLRYSFNLTDAADAIEKAVSLVLDQGIRTGDIWSEGKVKVGTQEMGDAVVAALRNL

SEQ ID NO: 6773 - protein, 109 aa, Magnetococcus sp. MC-1
MSDIQATIQEHVNSHAVVLYMKGNPSFPQCGFSGAAAKMLAACDLSNDDFLAVDVLMNPDIREGIKAFANWPTIPQLYIKGQFVGGADIMREMYQSGDLKTQLDAALGR

SEQ ID NO: 6774 - protein, 574 aa, Kluyveromyces lactis NRRL Y-1140
MCGIFASFRNPDVQAYKPKALQLSKRIRHRGPDWSGNIVKNSTILVHERLAIVGLDSGAQPITSEDGSYTLAVNGEIYNHIMLREECASYPFKTLSDCEPIIPLYEKYDIDAPKHLDGMFAWCLYDSKKDRIIAARDPIGITTLYMGRSSASPKSVWFSSELKCLTDDCDEIIAFPPGHVYDSETDKLTRYFTPDWLDESRIPTTPVDFKAVRESLEKAVRKRLMAEVPYGVLLSGGLDSSLIAAIAARETEKTNAELDPVVYDSDPHQLAGLDEQGHLHAAGWSRLHSFAVGLPNAPDLQAARKVATFIGSIHHEHTFTLQEGLDALDDVIYHLETYDVTTIRASTPMFLLSRKIKAQGVKMVLSGEGSDEIFGGYLYFAQAPSAAEFHVESVKRVKNLHLADCLRANKSTMAWGLEARVPFLDRDFLQLCMNIDPNDKMIKPAEGKIEKYILRKAFDTTDEPDLKPYLPEEILWRQKEQFSDGVGYSWIDGLKDAAESTISDEQFAQPKAEWGDDIPTTKEAYWYRLKFDALFPQKTAASTVMRWIPKADWGCAEDPSGRYAKIHEQHVDKK

SEQ ID NO: 6775 - protein, 1161 aa, Ustilago maydis 521
MCYSIGVDPLSSSTRSSGGLAGLWSDMLGLGDWQYELGVQIIDVCVSTRDVNGGVISMDDLITRVTRLRTGSTSTSTAKGKADKDASSEITQDDIVRSIKMLAPLGCGYEVFSLGNGGQKMVRSVPRELDTDTMVVLGMLLSSSSSTATVAAAAGRAAELPFLTEDTLVTRQKARGWTRDRARAVLENMALREGFPTTLLLIGHSRDRMNHANVHHRGCMTAMLRPFHSPSASSTMRLSYRRSPLVPALHLATLCLVSTALPSPAYEAPLGLASMLLAPVGNSSLINANNTADCTNCTNLGNFINPIPVSWLDPVIQLRNGSYAGITIQPIAASATLSGFGTNRTQEAFLGIPYAQQPVDELRFRRPYSLNESWDEVRSAKRYSELCFGAGVDDDYQPPYVTYKLGERCLTLNVVRPAGVSSENGDKLPVFVWIYGGGFSYGGSADRRYNGSFIVDKSVELEQPLIFVSFNYRVNVLGFPVGDGAKQAGIENLGLYDQRLALNWIRENIAAFGGDQDKVSIVGESAGGASILFHLSAYGGRDDRLFRSAVVQSGYWASQLETKSNRVRWNQQWGSLVEYANCSARADAIGCLRTTPLDTIKQWSQRNNATVNAFSPVVDGDLVAGDLQHSFLQARIVKDASVLLNNNLDEGLSFGRRGVNNSGDIVEALSVSQALPDGWLSRDTESNLTRAYPDNEDIYPPFQAGAGVLPRTHGVLGTNDRRSCAIFGDLLFVGPRRQAAELLAKSSNKPIYVSRFDQLSYKSAITSGAQHFQEVAYMFRNALDTQNALGPLAKDTQLAEEMSSYWINFVASGDPNGAKKQGRRTQGASRVGEYCISETRTGDKPRGASASAVVSRSEGRDYGVIKVSAGWESLDHHCHHPARRRVVCKLDTSHGLFVGHAIQDHYYATTLLRYYATTPLRDRSLPASVRAITMALVLLHLPTLALNAAATLVYPLYSSYKAVTSSKTSLPDMEVWLVYWSVFACWTLLESVFGFLWSWLPFYYEFRLLFNIWLVAPQTRGATYIYTNHLHPFLQSNQQQIDAWIEDAKRNVKAKMDDSLGGLLSAWSGGSAAEGGAAPQPNDARHRAPAMTNAAAPTPAPAPPTQHNPAQASIDCVGQGVAGNQTAATKRVGIYDPRFRIVVETDGSPKTARSDGAPTTT

SEQ ID NO: 6776 - protein, 212 aa, Triticum turgidum
YIYASRTLLFLKADGTLKPLAIELSLPHPQGMQHGAESKVYLPAGIESGVDGQIWQLAKAYASVDDSAWHQLISHWLNTHAVIEPFVIATNRQLSVVHPVHKLLSPHYRDTLNINALARTTLINAGGVFEMTVFPEKYALEMSSIVYKNWKLTEQGLPDDLVKRGMAVPDSSSPYGVRLLIKDYPYAVDGLVIWWAIERWVNEYLAIYYPND

SEQ ID NO: 6777 - protein, 212 aa, Triticum turgidum
YIYASRTLLFQKADGTLKPLAIELSLPHPDGIQHGAKSTVYLPADIDSGVDGQIWQLAKAYASVDDSAWHQLISHWLNTHAVIEPFVIATNRQLSVVHPVHKLLSPHYRDTLNINALARTTLINAGGVFEMTVFPEKYALEMSSIVYKNWKLTEQGLPDDLVKRGMAVPDSSSPYGVRLLIKDYPYAVDGLVIWWAIERWVNEYLAIYYPND

SEQ ID NO: 6778 - protein, 850 aa, Agrobacterium tumefaciens str. C58
MASTDYHVDLTNCDREPIHIPGYIQPHGCLIACDNAMRMVLRHSENCGELLGLEGDLNGRTAEDVLGKKLVHDLRNALTVTGRTTRPAMLPAMETSDGRSFDISLHRYKSTTIIEFEPSGSDAQPLGTARKMVDRIREADSVESLISRTTRLVKATLGYDRVMIYRFQEDGAGKVVSEAKQPELESFLGQYFPASDIPQQARALYLKNTLRIISDASGTRIPVLPAVDVSGEPLDLSYAHLRSVSPIHCEYLRNMGVAASMSISVIVDGALWGLIACHHYSPRVLSMPVRIAAEMFGEFFSMHLQVLKQKRRLDTINHAHAALDRFLRLAAHHANIEELLVDSFQDFADLMPCDGVGLWVGNNWHGHGATPPHDAIPRLARFVASASEGRVWATHALSQAIPEAEIYAGTAAGMLAIPLSQVKSDYLLFFRKEIVQNLNWAGNPEKSYETGPMGDRLTPRKSFAIWKETVRLQAQPWSEADREIAEAARIALVEVAFHHSELMAGERERAEVRQRMLNEELNHRVKNVLAIIKSLVGNPSQEGKTLQEYVTALKGRIQALSFAHDQIIRGEGGGALRDLLEAELSPHRSPETTVKLEGPQITLDSRAFSVMALVLHELATNAAKYGALSQNGGQLHVRWDVNENRDCEISWRETLLTTLPAPSRAGFGTALISRSIPYDLGGRSTIRYLPNGLEAEILLPFRHVSSVSAAFETKTEAETLPQPRRYNREEPLKVLLVEDQMLIAMDVENMLEDNGIKAIETATSSAMAIEKLKTYLPDVAILDINLGSDTSIPVARELHRRGIPFLFATGYADGSMVPDEFGAVPVIRKPYDEDALMAGIGVLVGDTERV

SEQ ID NO: 6779 - protein, 159 aa, Aspergillus oryzae
MVDQTRSMESRTGRKNQRYGSKGERLVAGVVPLSTDKSQVLMIQSAGRGGWVLPKGGWETDEETAQQAACREAWEEGGIICTVLRDLGMIPDMRPSTLLTSHAPKASYQFFEVIVDREEAQWPEMHKRKRQWVSYAQAAAALASRPELLEALNRSSMKR

SEQ ID NO: 6780 - protein, 400 aa, Rhodobacter sphaeroides 2.4.1
MAFLSDTLARVKPSQTIAVTNKARELAAAGRDVIGLGAGEPDFDTPDNIKAAAKRAIDAGRTKYTAVDGIPELKRAICEKFERENGLKYTPAQVTVGTGGKQILYNALVATLNPGDEVIIPAPYWVSYPDMVLLAGGTPVSVAAGMETGFKLTPEQLEAAITPRTKWFIFNSPSNPTGAAYTRAELAALCEVLMRHPQVWIMSDDMYEHLVFDDFDFTTPAQIEPGLYDRTLTCNGVSKAYCMTGWRIGYAAGPVELIRAMGTIQSQSTSNPCSIAQYAALEALSGPQEFLATNREAFQRRRDLVVSMLNEAKGVTCPNPEGAFYVYPDISGCIGKTSAGGAKITDDEAFASALLEETGVAVVFGAAFGLSPNFRISYATADEVLREACARIQAFCAGLS

SEQ ID NO: 6781 - protein, 361 aa, Streptococcus mutans UA159
MKPSIYSLTRNDLIAWTIEHGEKKFRATQIWDWLYRKRVQSFEEMTNLSKDFIALLNENFLVNPLKQRIVQESADGTVKYLFELPDGMLIETVLMRQHYGLSVCVTTQVGCNIGCTFCASGLIKKQRDLNNGEITAQIMLVQKYFDERGQGERISHVVVMGIGEPFDNYDNVLKFLRTINDDNGLAIGARHITVSTSGLAHKIRDFANEGVQVNLAVSLHAPNNELRSSIMRINRSFPLEKLFAAIEYYIETTNRRVTFEYIMLNGVNDSPENAQELADLTKKIRKLSYVNLIPYNPVTEHDQYSRSPKERVDAFYDVLKKNGVNCVVRQEHGTDIDAACGQLRSNTMKRDREKATAGTAQ

SEQ ID NO: 6782 - protein, 349 aa, Streptococcus pyogenes MGAS8232
MKAATYLSTGNLQLIDKPKPVIIKPTDAIVQLVKTTICGTDLHILGGDVPACKEGTILGHEGIGIVKEIGDAVTNFKIGDKVIISCVTSCHTCYYCKRGLSSHCEDGGWILGHLINGTQAEYVHIPHADGSLYHAPDTIDDEALVMLSDILPTSYEIGVLPSHVKPGDNVCIVGAGPVGLAALLTAQFFSPANIIMVDLSQNRLEAAKTFGATHTICSGSSEEVKTIIDDITNGRGVDISMECVGYPATFDICQKIISVGGHIANVGVHGKPVDFNLDELWIKNITLNTGLVNANTTEMLLNVLKTGKIDATRLITHHFKLSEVEKAYETFKHAGANNALKVIIDNDIS

SEQ ID NO: 6783 - protein, 510 aa, Streptococcus pyogenes MGAS8232
MENHKNEFTFSNKSIIAYVWRGVIVGIIAGVIVSLFRLLIEVTADWVIEWYRYAHINSLLLLPILSVSLLAVLFVGFLVKSDSDIKGSGIPHVEGELKGLMSPDWWSVLWKKFLGGIMAISMGFMLGREGPSIQLGAMSAKGLAKFLKSSRLEKRVLIASGAAAGLSAAFNAPIAGLLFVVEEIYHHFSRLIWITALVASLVANFISLNIFGLKPVLAMSEAMPFLGLNQYWLLLLLGLFLGCLGYLYEIVILNFNKLYVILGSWLHLPAYFYGIIMVFLILPIGYYLPQLLGGGHGLILSLSNQQLPLMTIFFYFIIRFIVSMFSYGSGLPGGIFLPILTLGALAGLLFGQIASQLGLLNQSFLSLFLILGMAGYFAAISKAPLTGMILVTEMVGDLKPLMAIAVVTFVSYLVMDLLNGQPIYEAMLDKMAMKHPTNLVEPTLIELTVGDKIAGKYVKELKLPENVLITTQIHHQKSQVVSGNTRLLSGATIFLVVNEADTGFVREVLM

SEQ ID NO: 6784 - protein, 224 aa, Eucalyptus globulus
MNSSSYISHPNSFSFDFAEPPFSLLLSHDRSAAPGNFSGEEVRLASDHPKKPAGRKKFRETRHPVYRGVRLRDSGKWVCEVREPRKKSRIWLGTFPTADMAARAHDVAALALRGQSACLNFADSAWRLPVPASPNTKDIQKAAAKAAEAFQLLESEDVMSGNEKKLHSEEGVLYDEEDIFGMPGLLANTAEGMLLSPPECSGDLYAGLDDGNLDAYASLWSYSM

SEQ ID NO: 6785 - protein, 698 aa, Tropheryma whipplei TW08/27
MEYNVSRERRASALTVFVWDDKDDLAVNTARVLAADAVENVGNGHPGTAISLAPAAYLLFQKVMRHNPSDPSWAARDRFVLSCGHSSLTLYIQLFLAGYKLSLQDLRGLRQWGSLTPGHPEYGHTPGVEITTGPLGQGLASAVGFAYSARFQRGLFKTDIFDHYVYVIASEGDIEEGVTSEACSLAGLQQLGNLLVILDRNYISIEDNTDIALSEDIKSRYLSYGWQVIEVPWRRAGAEYREDVLSLYEALLEAQKDTDRPSLIILETVIAWPSPGKQNTGAAHGAALGVNEVKDLKRILGFDPEKTFEVPDGVLQHTKGALDRGQSQQDNWENVFSSWRQEHPIEAALFDRLQNGVTPDIDHVLPVFSSEKPISTRAASGQVINRIAEVMPELWGGSADLAESNNTTIKSANSFLPESVTVDHWKSDRYGRILHFGVREHAMAAIINGIVLHGNTRVFGGTFLVFSDYMRPAVRLAALMKIPSIFVWTHDSIGLGEDGPTHQPVEHLWALRAIPGLSVIRPADANEVAWAWKEILERRDGPVGLVLSRQNLPVLDRTCLAPASELRKGAYILADGSRYPRLILIATGSEVSLAIGAREVLENRGIPTRVVSAPCLEWFDQQEKSYRNHVLPPDVETRISVEAGLSLGWSKYIGDKGASVSIEHYGASAAGDVLFERFGFTVENIVKTADALLGGCGE

SEQ ID NO: 6786 - protein, 126 aa, Bradyrhizobium japonicum USDA 110
MNLIKQLEQEQFDKLSAGKDIPEFGPGDTVIVNVKVVEGDRTRVQAYEGVCIGRSGGGLNESFTVRKISYGEGVERVFPVMSPMIDSIKVVRRGKVRRAKLYYLRNLRGKSARIVEKQDRQAAVGE

SEQ ID NO: 6787 - protein, 502 aa, Synechococcus sp. RS9916
MAAEHFFLELEPPEERLRHAPHVVIVGGGFAGVSACKALANADVRVTLIDKRNFNLFQPLLYQVATGLVSRGDVATPLRQLVGKQRNVQVLLGEVTEINPTDKQIVFNSKAYDYDHLVLATGSGSTFFGHEQWRTFAPPMKILEHAEEIRRRLLMAIEQAEQSPDEAARQFLQTVVIVGGGPTGCEMAGAVSELMRNAMRREFKQLNPDHTRIVLVDPGERLLKAMPESLSKQAQTTLEKLGVEMQFKARVQTMQPGEVTMSTPEGDLRLQAATVIWTAGVRPSHLGKKLADATGCELNHGRVVVQPDFSIKEHPEIRVVGDLCSYHHTSSGNPLPGMAGPATQAGGFVGKDIAAIVAGSKRPNFNWFDFGSMAVLDRVDAVADLRGFKFSGGIGWILWALAHLAFMPERENRWTLLIKWMFAVVSQKRASMLLTGMPSQHIGLDAPDAPFPMHSGTGPSIAAPDAALKAAMEYYSNQMSGQRDQADGTTEGSAGDSAAAIR

SEQ ID NO: 6788 - protein, 219 aa, Triticum aestivum
  misc_feature (44)..(44): Xaa can be any naturally occurring amino acid
  misc_feature (144)..(144): Xaa can be any naturally occurring amino acid
PPRDLLFRSQKHHNLVQLVGRAPVVGPDFPRLNYAGQAAAPHCXRYALVVLNEATKNLNIDPIASNKILRVEPHFEVQQPCLSQQSEAEAGSSVTHTGLYKQDLTQAYETKKDKDNDYTCSLTTTYDGMTLLLYLDLDLGESGXTADATDSLASVVVRHIPPYDAAADTSDKAYLFDEILTSIYGHTFMISSNTFDQDIWSDRLCESCLPLCEYCACTS

SEQ ID NO: 6789 - protein, 439 aa, Arabidopsis thaliana
MMSNLPLDLVEEILSRVPATSLKRLRSTCKSWNNCYKDQRFTEKHSVIAAKQFLVLMLKDCRVSSVSVNLNEIHNNIAAPSIELKGVVGPQMQISGIFHCDGLLLCTTKDDRLEVWNPCTGQTRRVQHSIHYKTNSEFVLGYVNNNSRHSYKILRYWNFYMSNYRVSEFEIYDFSSDSWRFIDEVNPYCLTEGEVSLKGNTYWLASDEKRDIDLILRFDFSIERYQRLNLPILKSDYETEALSVVREKQLSVLLKRNDTLEREIWVTTNDKIDHTTKNLLWIKFLAIDQRTCYHWSCVSFFIDEEKKMAVFCDGYIGGINETSRRMFYIIGEDKYYRELYVGDSPIRSHRPFVFNYVPSLVQIPQATVIPKRRRQQLSLVLQRCRASKVDVWITDKIDTKEVQWSKFFTVDVDIGGRAMLSYDSFFIDKEKGMALLCGL

SEQ ID NO: 6790 - protein, 239 aa, Zea mays
MEPGLASRVARSAAQPLSGCLSRHSLSPWLKIQNHIYPMPSLCHKVPSTGKCHASMTTSYMETSDVTDLDWENLGFGLIETDFMYVAKCGTDGIFSKGEVLPFGPIALSPSARVLNYGQGLFEGLKAYRKTDGSILLFRPEENAIRMLSGAERMCMPAPTVEQFVDAVKQTVLANKRWVPPTGKGSLYIRPLLIGSGAVLGLAPAPEYSFIIFVSPVGNYFKVRIAFPFTSNSTKICRH

SEQ ID NO: 6791 - protein, 61 aa, Zea mays
  misc_feature (35)..(35): Xaa can be any naturally occurring amino acid
  misc_feature (49)..(49): Xaa can be any naturally occurring amino acid
  misc_feature (54)..(54): Xaa can be any naturally occurring amino acid
ERIYGLGPGPKVKVLQQLQQMLQPQGLKLPFIEGXLAALKNVIKKPALXNWNLXLVKWGFN

SEQ ID NO: 6792 - protein, 656 aa, Crocosphaera watsonii WH 8501
MENIKMGEEWSILAPEEIGSQDFFTDLLEDLYQRFLEVKEGENATYIPELAKADPDLFGISIMTTEGRIYSIGDTSELFTIQSISKPLVYGMVLEELGEEYVINKIGVEPTGEPFNDIMEPREIQERKYNPMVNAGAIITTSLIKGDTLEEKQEKLFNMFSRYLGRNVNLKESIFWSRKTGDSWNRAIAYMMLNFGLIEGNVEEILDLYFQQCSILVNCQDLALIAAILANKGLNPITGQRTINENYTKNLLSVMFTSGLYDFSGQWAYRVGLPAKSGLSGSIIGVIPNKMGIAVFSPPLGTQNKSVRGVKIFEEISQRFKLHIFKPDYSNNPLNKKKKVISSLFKKQDYLPSFLQHLYDKYLPLQEGKIYVSEPDLVEHDPNCFSICIVTVDGTVYTVGESEKPFLIQSISKVFAYGMALEDHGRDYILTKVEVEPTGDSYNSIIKVEENSKRPYNCMVNTGAIAMTSLIKGKSPAHKLNRLLKMYQRYVGHPVYVDTSAVVSEQNQGDRNWAISYLLRNFGMISGDIKQTLDLYLQQCSAIINCRDLAVMAATLANQGINPITDQSAINPEYVKDLLSVMFTCGMYDFAGEWCYKVGFPAKSGVGGGILGVVPGVMGIGVFSPPLDKRGNSIRGIKVCEELSQQFQLHIFQPLN

SEQ ID NO: 6793 - protein, 350 aa, Bacillus halodurans C-125
MESIKVVIVGGGQAGIAMGYYLVKEKVPFMILDANEQVGDSWRNRYDSLVLFTPRTYSQLPGFPMDGAPNGFPTKDEMASYLQQYANHFNLPMRHHTKVDRVTRQQNGRFHLKTTNGWIEAEKVVIATGAFQKPYLPPVLDSANNEMSQVHSSAYRNPAQIPGKSVLVVGGGNSGAQIAVELAKERNVTMAISHPFRFLPLKLLNKSMFSWLEWGGLLYAGIDTTRGRWFKKQKDPIFGKELKSLIKKGQIHLKPRVMNVQGKEVEFADHSRLSFDRIIWSTGFSPSYEWIDIDGVIATNGWPIHNRGITNIRGLYFLGLPWQYQRGSALVCGVGRDAEYLVPFIKHGDK

SEQ ID NO: 6794 - protein, 384 aa, Oryza sativa
MRQGQIARESVAGPIGHAENRAMNFRRNSAAGAAPPSPYYSPYPAQSTFLPPHVYLPQPLINATTYNFAQAPAAPAPPPHVNVPQPAMHAAAAPAPPLWLRTMTAANLDSEMGLIGEMMVQYPYVTIDVEFAGVVHHPPYTGSRPTPDEIYAALKSNVDEVPAVQIGITLSDAEGNLPTRSSSSPEQEIAWEVVFSDFDAGRDPHVVDSVEFLKNQGIDFDLARQIGVTSTAFGEKLLAILPPPSRRGELTWSAFGGAYDMGYLLKMLTGGQPLPETRQQFMQLVKSRLGGGRIFDSKYLVEHDRQDLRNAGLRHTADVLGVRQQEGVKMLAGHKSVVAAAIFATIRPAGGARWERRASAVSDAATSNAAATTQEKGRWRLQRK

SEQ ID NO: 6795 - protein, 1186 aa, Agrobacterium tumefaciens str. C58
MRAPAGDPSPWLVLCATKKRNERAMPKRQDIKSILIIGAGPIVIGQACEFDYSGTQACKALKEEGYRVILVNSNPATIMTDPGLADATYVEPITPEVVAKIIAKERPDALLPTMGGQTALNTALSLKRMGVLDRYNVEMIGAKPEAIDMAEDRALFREAMARIGLETPKSMLANATEIKDADRKTHEAARTELKAKLSGAELDKALDNLENQWNLGETDRKQRYISHAMAIAAQAIDVVGLPAIIRPSFTMGGTGGGIAYNRSEFFEIIGGGLDASPTTEVLIEESVLGWKEYEMEVVRDKADNCIIICSIENIDPMGVHTGDSITVAPALTLTDKEYQMMRNASIAVLREIGVETGGSNVQFAVNPKDGRLVVIEMNPRVSRSSALASKATGFPIAKVAAKLAIGYTLDELENDITGGATPASFEPSIDYVVTKIPRFAFEKFPGASPILTTAMKSVGEVMAIGRTFAESLQKALRGMETGLTGLDEIEIPGYEEGEGSKNAIRAAIGTPTPDRLRMVAQAMRMGMSEEEVHENSKIDPWFIAQLKAIVDMEARIREHGLPQDAENLRMLKAMGFSDARLASLTSKRPKEVAELRNSLNVRPVFKRIDTCAAEFASPTAYMYSTYETPFVGAARSEAQVSDRKKVVILGGGPNRIGQGIEFDYCCCHAAFALKDAGFEAIMINCNPETVSTDYDTSDRLYFEPLTAEDVIEIMRAEQEKGELVGVIVQFGGQTPLKLAEALEKNGIPILGTAPDMIDLAEDRDRFQKLLMKLDLAQPNNGIAYSVEQARLVASEIGFPLVVRPSYVLGGRAMQIIHSEGQLQTYLLDTVPGLVPEDIKQRYPNDKTGQINTLLGKNPLLFDSYLTNAVEVDVDALCDGENVFVSGIMEHIEEAGIHSGDSACSLPSRSLSKETLDELERQTTALAKALKVGGLMNVQYAIKDGTIYVLEVNPRASRTVPFVAKTIGAPIAKIAARVMAGEKLDAAIAAYGEKPDPRNLKHIAVKEAVFPFARFPGVDILLGPEMRSTGEVIGLDTDFALAFAKSQLGAGVDLPRSGTVFVSVRDEDKEGVLSAIRILVESGFKVLATGGTQRFLAEQGINAEKINKVQEGRPHIEDAIRNRQVQLVINTTDSNKAISDSKSLRRATLMQKVPYYTTMAGAEAAALAIKALKAGNLEVKPLQSYFN

SEQ ID NO: 6796 - protein, 187 aa, Triticum aestivum
  misc_feature (3)..(3): Xaa can be any naturally occurring amino acid
RGXLVEAIVLPMTHKEQFQKLGIRPPKGVLLYGPPGTGKTLMARACAAQTNATFLKLAGPQLVQMFIGDGAKLVRDAFELAKEKAPCIIFIDEIDAIGTKRFDSEVSGDREVQRTMLELLNQLDGFSSDERIKVIAATNRADILDPALLRSGRLDRKIEFPHPTEEARARILQIHSRKMNVHPDVNF

SEQ ID NO: 6797 - protein, 133 aa, Glycine max
FGSRFLSNFLLRKAFAKRFGAVQNERGKKKDLSPQDAALLIQISFRAYLIRRSKALRALRELAIAKSKLKEIRAQFNNFSYRRHVARDAEERQRFSEKIIVLLLTVDAIEVVISIFGSFFVEQIELFPQFLNC

SEQ ID NO: 6798 - protein, 258 aa, Aspergillus oryzae
MSHSHSHDQGISHSHDDFGGHGHSHEILDGPGSYVNREMPLIEGRDWRDRAFTIGIGGPVGSGKTALMLALCQALRDDEDAEFLNRHKALASKRIRAIETGGCPHAAVREDISANLLALQSLHKQFQTDLLLIESGGDNLAANYSRELADFIIYVIDVAGGDKVPRKGGPGITGSDLLVVNKCDLAHIVGADLDVMDRDARKMREGGPTVFAEVKNGKNVQNIIDLIISAWKGSGAYELSLERWNAGATRGSGSVDEQ

SEQ ID NO: 6799 - protein, 125 aa, Triticum aestivum
EQATNVRATYHYYRPAQNNWDLGAPAVSAYCATWDASKPLSWRSGYGWTAFCGPAGAHGQASCGKCLQVTNPATGAQITARIVDQCANGGLDLDWDTVFTKIDTNGIGYQQGHLNVNYQFVDCRD

SEQ ID NO: 6800 - protein, 705 aa, Oryza sativa (japonica cultivar-group)
MAEPSCVVAVPRALPLQPPRCPPRRDAVVIPFASSCDVGGASAGKTRRRRGVRCGAQGTEPSLSQGCDAPRPEGAPEKPRHSEKPTKCGAQGTEPSLSQGWRRAAARGGSGRSPDTPRSPPSTPEYVKMVNDVIGSIQFESKGGKMLPKACKLQPTNRRRFSPIFFFSPALQSRNPPKTLNPPWAPPVPTAAARLVLRRLLSTAVAEAEAAAVAPAAEKAAAKGAKTAAAAGEEKDARSLYRRLSALGGAGEGSVSRVMNKWVREGREARAADLAKYVKELRKYKRHAHALELMEWMVNTKGMNMSYTNHAIRLDLIYKVRGIEAAEQYFAGLPDPGKNHKTYGALLNCYCSAKMEDKATDIYRKMDELGISSSTLPINNLMSLYVKIGQHRKVTSLFEEMKVKNVKPDNLTCCLLMSSYAALNKIDTVGEVLKEMEEKKVALGWSAYSTLASLYVNANMVEEAESALKKLESLIDVQAGRQPFDFLMSLYASVGNLSEVNRVWNLIKANFQKVTNTSYLGMLQALYKLNDDDRMKQIYEDWESNYENYDARLTNMMTRAHLRNGLTKEAELLWEKVKEKGAEFDSKTCELFLEHYMGKGDMTSALNWVENMTKLPRKKSKLDQEKISCFLKYFEEHKDVEGAERFLNCLRTSGCIDGKAYESLLRTYLAAGKTSRSIRQMIKEDKIEICYGIGKLLKRIADKGR

SEQ ID NO: 6801 - protein, 172 aa, Yarrowia lipolytica CLIB122
FHVITTVPPQPQLTIAVPKSYILLGFVGFYFILIFLNIGGIGQLLSNIAGLVIPGYYSLLALETPGKADDTQYLTYWVVFATLNVFEFWSKAILYWVPFYYLFKTAFLLYIGLPQYGGAELVYKAIVKPLAQKLVNIQPHGGPSDSLKAQAQSAVDAAESHVPQGHSTGVSH

SEQ ID NO: 6802 - protein, 783 aa, Oryza sativa (indica cultivar-group)
MATPDVILPGPSLRPMPYMRSSPSARPEYHECATCHGPAKTRCSRCKSVRYCENGAAIGSYEKNDYSIDGEVPSSEILSGNKGLNNSSGSGENCGNRDVIYPLNSVVHQPNNYAPEIRKRPKASITVYESDKGVYLTSDMISSGEGPYASAAESLQRSNSSGNVTGKGNMIHKKPPYPSGSTKTAVSTNSSLQGCNGISKAGASKVEALKKPSKFLKTSLVGLINDNKRSKVLFPYEDLVKFFQYEVRGISPRGLFNCGNSCYANAVLQCLMCTKPLMIYLLLRLHSKDCNTKTQAPTLLGVVVKSLTISDFFDIDCFILLGCSKNWCLMCELEQYASTLRESGGPVSPSRILSNLRNIGCRLGGGSQEDAHEFLRHLVMSMQGACLDGLGGEKQVEASLQETTLIQQMFGGRLKSKVKCLRCYHESERYENIMDLTLEIHGWVESLQDALTQFTAPEDLDGENMYKCGRCSAYVKARKQLSVHEVPNILTVVLKRFQTGKYGKINKCVTFPDMLDMVPFVTGAGDNPPLYFLYAVVVHVDTENASFSGHYISYVKDMQGTWLRIDDSEVQAVSLNQVMSEGAYMLFYMRSFPRPPKIYIEKGLSSVPTCSKRHSSKSSKGSKQDLNHTESLFASSDQTYGIYDFRPDNGYIQDQHAALRTRNFYHTDDAFADSISTDFSDATSSEWSLFTSSDESSFTTESTRDSFSVVDYGDNAGLDPISSIFGPYYAQDHPPGSFASCTRLSPSNPQTRFLTHGTLKGGIPALELQGNICNSPKISAKAE

SEQ ID NO: 6803 - protein, 446 aa, Polaromonas sp. JS666
MATVPTHVFHRNLQNTPPVAVSGQGVYLTDAQGKRYIDASGGAAVSCLGHGHPDVLAAMHAQIDKLAYAHTSFFTTEVAEALADKLIQTAPQGMSHVYFVSGGSEAMEAALKMARQYFVEIGQPQRQHFIARRQSYHGNTLGALAIGGNPWRREPFAPILIEATHLSPCYPYREQQAGETPGQYGLRLAQELEQAIFEKGADRVIAFVAETVGGATAGVLAPVPGYFKAVREVCDRYGVLLILDEVMCGMGRTGTLHACEQEGVLPDLLAVAKGLGGGYQPIGAVLAQANIVDAMRDGSGFFQHGHTYLGHAVACAAALAVQQVIERDQLLAQVRVRGGFLQQLMRSNWGEHPHVGDIRGRGLFWGIELVQERASKTPFDPARKLHARIKQEAMARGLMVYPMGGTVDGRYGDHVLLAPPFIASEAELTMMVERLGSAMDAAIAAA

SEQ ID NO: 6804 - protein, 462 aa, Ralstonia metallidurans CH34
MHAPDNQGTLKRGLKNRHIQLIALGGAIGTGLFLGIAQTIKLAGPSVLLGYALAGVVAFFIMRQLGEMVVDEPVAGSFSYFANKYCGHFAGFMSGWNYWVLYILVSMAELSAVGIYVQYWWPGIPTWISALAFFLIINAINLASVKSFGEMEFWFSIIKVAAIVGMIGFGGYLLATGTAGPDASIANLWQHGGFFPNGFSGLVMAMAVIMFSFGGLELVGITAAEADSPEKSIPKATNQVIYRILIFYVGALAVLLSLYPWEKVVTGGSPFVLIFHAMNSNVVATVLNIVVLTAALSVYNSGVYCNSRMLLGLAQQGNAPRSLMRVNRRGIPLTALAVSAIATGICVVINYFMPGEAFELLMGLVVSALIINWAMISIIHLMFRRAKAAAGKTTRFQSLGYPLTNYVTLAFLAGILVVMFLTPGLRISVYLIPVWLGVLGVSYRLRQKKAGSAMPAASAQIQ

SEQ ID NO: 6805 - protein, 141 aa, Synechococcus sp. CC9605
MIEVTAVQNHPMSAKAITTQDAPAPVGPYNQAVLAGEWLYCSGQIPLDPATGEMVGNGDVAAETHQVLKNLCAVLKEAGATPAQVVRTTVFLADLGDFQTVNGIYAEVFGEGVSPARACVQVAALPKGARVEIDCVAWLGS

SEQ ID NO: 6806 - protein, 306 aa, Xanthomonas axonopodis pv. citri str. 306
MSYRDTIDIRMPHVDIHCRAMTHTDIPTPLADWIVAQAVAGHPPEQALQPLLDQGWNEQDAIDAVEALVRAHIQQHAQANGLPMPVRVPALQQDTDASLLALGDREVRVLVSLLLPRVVVLGGFLSDGECDALIALARPRLARSRTVDNANGEHMVHAARTSDSMCLRVGQDALCQRIEARIARLFDWPVDHGEGLQVLRYATGAEYRPHYDYFDPDAAGTPILLQAGGQRVASLVMYLNTPERGGATRFPDAHLDVAAVKGNAVFFSYDRPHPMTRSLHAGAPVLAGEKWVATKWLRERAVRMPT

SEQ ID NO: 6807 - protein, 429 aa, Pseudomonas syringae pv. syringae B728a
MADKKAQLIIEGAAPVELPILTGTVGPDVIDVRGLTATGRFTFDPGFMSTASCDSKITYIDGDNGILLHRGYPIEQLAEQSDYLETCYLLLNGELPTAEQKAQFVAVVKNHTMVHEQLKTFFNGFRRDAHPMAVMCGVVGALSAFYHDSLDINNPQHREISAVRLVAKMPTLAAMVYKYSMGQPMMYPRNDLSYAENFLHMMFNTPCEIKPISPVLAKAMDKIFILHADHEQNASTSTVRMAGSSGANPFACIAAGIAALWGPAHGGANEAVLTMLDEIGDVSNIDTFIAKAKDKNDPFKLMGFGHRVYKNRDPRATVMKQTCDEVLKELGITNDPQLELAMRLEEIALTDPYFIERSLYPNVDFYSGIILKAIGIPTSMFTVIFALARTVGWISHWKEMLSSPYKIGRPRQLYTGNVQRDIVALQDRK

SEQ ID NO: 6808 - protein, 273 aa, Synechococcus sp. RS9916
MSIRPLLALVLAFCLTVVTACSGGADAVERSNITYDDIRNTGKANDCPVLAESARGSISLTPGGSYELKGICMHPTRVFAKGEPSNKRQEAQFVEGKILTRFTSSLDEVYGDLTVSDSGITFEEKGGIDFQPITVLVPGGEEFPFTFSSKSLNASADGAAITTSTDFEGTYRTPSYRTSNFIDPKGRALTTGVQYAQGLVALGGDEEGLEKDNTKRYIDGVGQMSLSITKVDPETGEFAGVFSAIQPSDSDMGGREVVDIKISGDLYGRLEEA

SEQ ID NO: 6809 - protein, 356 aa, Tropheryma whipplei TW08/27
MRMKALVYHGPGKRSLDTVDDPTIKLGTDVILEMETTTICGSDLHILKGDVAAVKPGTVLGHEGIGKIVEVGKDVKSHSVGDRVIVSPMSSCGVCRFCRANNNGHCLGDSEGPGGWRLGGLINGVQAQFARIPLADNSLHKLPSGLDPKVGILVSDVLPTGHEVGAQAGQVTLGSVVAVIGCGPVGLGAIVTSLLYSPSKVIAVDADSNRLELARKLGATDTVRVNRERPLDAIEDVKKLTEGGFGVDVAIEAVGVPVTFSMALGIAAPGGRVANIGVHGAPVDFPLQDLWDKNIAVTLGIVSTHTIPLLLAALSEGKIDASQFVTHEFDLSDLERAYDVFSAAAQHNVVKVAIRA

SEQ ID NO: 6810 - protein, 844 aa, Galactomyces geotrichum
MTFPLLPAYASVAEFDNSLSLVGKAVFPYAADQLHNLIKFTQSTELQVNVQVESSVTEDQFEELIDNLLKLYNNGINEVILDLDLAERVVQRMIPGARVIYRTLVDKVASLPANASIAVPFSSPLGDLKSFNNGGSRTVYAFSETAKLVDVTPTVASGIIPIIDARQLTTEYELSEDVKKFPISEILLASLTTDRPDGLFTTLVADSSNYSLGLVYSSKKSIPEAIRTQTGVYQSRRHGLWYKGATSGATQKLLGIELDCDGDCLKFVVEQTGVGFCHLERTSCFGQSKGLRAMEATLWDRKSNAPEGSYTKRLFDDEVLLNAKIREEADELAEAKSKEDIAWECADLFYFALVRCAKYGVTLDEVERNLDMKSLKVTRRKGDAKPGYTKEQPKEESKPKEVPSEGRIELCKIDVSKASSQEIEDALRRPIQKTKQIMELVKPIVDNVRQNGDKALLELTAKFDGVALKTPVLEAPFPEELMQLPDNVKRAIDLSIDNVRKFHEAQLTETLQVETCPGVVCSRFARPIEKVGLYIPGGTAILPSTSLMLGVPAKVAGCKEIVFASPPKKDGTLTPEVIYVAHKVGAKCIVLAGGAQAVAAMAYGTETVPKCDKIFGPGNQFVTAAKMMVQNDTSALCSIDMPAGPSEVLVIADKYADPDFVASDLLSQAEHGIDSQVILLAVDMTDKELARIEDAVHNQAVQLPRVEIVRKCIAHSTTLSVATYEQALEMSNQYAPEHLILQIENASSYVDQVQHAGSVFVGAYSPESCGDYSSGTNHTLPTYGYARQYSGVNTATFQKFITSQDVTPEGLKHIGQAVMDLAAVEGLDAHRNAVKVRMEKLGLI

SEQ ID NO: 6811 - protein, 315 aa, Magnaporthe grisea 70-15
MFGFFETKFNPTKDIPDLSGKVILVTGGNIGLGQSSVLELARHNPKHIFLAARNEEKARKAIESVSWELGTDKASVVSFLPLDLSSFDSIRKAAETVNSKTDELHILLNNAGIMMTPATTTKEGYEEQFGTNHMGHALLTRLLLPVLEKTAQGGKVDVRIVNLSSAGEGLAPTNAFDDLSRYKSPMEDVASHTRYGVSKLANIYHAQMLARKYPSIKAVSVHPGVVNTNLTRGLKETYPWIVPYVAPIAGALFFKTPAEGAKNQLWASTNEKVISGEFYWPVGLLGKGSEKSKDTEAAEKLWDWTEKELDAYLKQ

SEQ ID NO: 6812 - protein, 1562 aa, Botryotinia fuckeliana
MFYTHAERMYAERPIEGREGAQIPLHSDNYRGEPIQPHDSSSSESEINNDGTWGEHEQGGPVNCSTAMHEYEDLRHQLTHLSKTRSQKSVATARKASAMKRTMTNASRRSRATAGEDIEAQEEEEKLEEAAADEDEFVLGDFLKDGHFEKRNTKGSAKKVGVIYKNLTVQGVGATSTYVKTLPSAIMGTFGPDLYKLLTRFIPALPKPGSNGQRRDLIHDFTGCVRDGEMLLVLGRPGSGCSTFLKAISNKRGDYAGVTGEVSYGGISAEEQAKHYRGEVNYNEEDDQHFPSLTVEQTLDFSLLNKTKKHEKGDIPTIITALLKMFGISHTRHTLVGDAFVRGVSGGERKRVSIAETLPTKKTVVSWDNSTRGLDASPALDYANSLRVMTDISNRTTLVTLYQAGEQIYELMDKVLVIDEGRMVYSGPAGDAKKYFERIGYYCPPRKTTADFLTACTDPAERRFQKDFEGPIPKGPVELEKAFRESEDYRLLQEDVESYERMLHETDHADARQFKASVEETKSKTVGPRSPYTVSFFRQVLACTKREVELTLGDKTTLYTKFFIIISNSLIVGSLFHGQSSNTLGNFSRGGTLFFSILFLGWLQLSELMKAVGGRPIISRHKDYAFYRPSAVVVARVVQDFPLLLLQVVPFSIVVYFITGLDVDAGKYFIYVLFIYLTTICITSLYRMFAALSPSIDDAVRFSGIGLNLLIIYTGYVIPKPQLVSEYIWFGWLYYINPLSYSFEAGISDEFYNKNITCAPDQIVPSGPGYTNPEFQGCASTGAEVGSLSVSGARYLEQSFNYSRSHLWRNFGVVIAWTVLYIIVTAIATEVFDFTTGGGGALEFKRSKAAKNKVKAENATPDEENSPASTSPVPTSGASSSNTLEPPQEEALKDITGSESVFTWENVEYTVPYLGGERKILNGVNGYPKPGIMVALMGASGAGKTTLLNTLSQRQKTGVVTGDMLVDGRPLGTAFQRGTGFCEQMDLHDGTDTIREALELSAILRQEHTVPRAEKIEYVDKIIDLLELGDMQDALVRSLSVEQRKRVTIGVELAAKPNLLLFLDEATSGLDSQSAYSIVRFLKMLSAAGQAIVWSIHQPSSVLIQEFDMILALNPGGNTSYFGPVGENGSAVVKYFGDRGVQCPPLKNVAEFILETAAKGGKRRDGKKINWNEEWLNSNENKTVMQEIVRIKSERGKIAAPEASSQREFGSPVTLQTTELTKRLFTQYWRDPSYLYGKLFTSVIIGIFNGFTFWQLGHSIIDMQNRMFTSFLIILIPPTIVNAVVPKFYQNRALWEARELPSRIYGWVAFCTANIVAEIPIAIVGVVIYWALWYWPTGLPSDSSTSGYVFLMTMLFFLFQASWGQWICAFAPSFTVISNVLPFFFVMFGLFNGVVRPYSQISVFWRYWLYYVNPATYWIGGIIAATLSNVPIECASNEAAYFNPPSGQTCSSYASDFVTSAGVGYLTNPDAPPKLRILPYPSGEEYMKTLHVTPQDKWRNFGIFLGILYQQLGVGLFLHQQRGESEDGVSDSPTLFGGLGKMVGKVKSPFKGKEKKSVPESK

SEQ ID NO: 6813 - protein, 527 aa, Oryza sativa (japonica cultivar-group)
MPLRDLHSHLSPRPRPVNWDPGGPASFSVRLFRLSLSSGSPQAPSRDHLRVDHGVTSASARGSVASVATRDSSAVDVATSYGSPPPPPRATPPVARSYVASPPRAIVHHVFECMSLRLMRMSNKCMRPTALEASTYDFISSLPDELLQHILSFMTAREAVQTCVLSSRWRHIWKSLQCLNIKGSEFTSEAAYVNFMDNLVLRRGCVPLDSLLLCNSYGRVSLNHDRANLWFGYALRSNVREINIQEKHFEYSNLDHSSFISSHLKILCLNYVSISDLFIENLFSGCPALQDLVMVDCCVYATRFSSSSLKNLTFTSHSPDNGDLVHDDFKDLVIDTPSLVSLHLEYLPFLAPCLLNASSVEKAYFRLDDMSFPCFHMKYNILSALSNVKNLKLLIGQFNDDAFQLMQNEVLKRDLWRCRTFNSLKKLSVSDWCVDGELHTLIHLLRCSPILEKLTLHLGVIGGLAWEQWMSYPQSEMPDMSFICEHLKKVKITCANDDKRVPAIVNAILVNANSLPEIVIKPYTRLD

SEQ ID NO: 6814 - protein, 510 aa, Ralstonia metallidurans CH34
MSNTNTTPAVPVPGLRRELRARHLTMIAIGGSIGTGLFVASGATIAQAGPGGALAAYILIGAMVYFLMTSLGELAAYMPVSGSFATYGALYVDEGFGFALGWNYWYNWAVTIAVELAAAQLVMQYWFPDTPGVLWSALFLGLMFALNAISVRGFGEAEYWCALIKVLTVIAFIVIGTLMIFGIMRGDFSHAGGLANLTTGDAPFVGGLPAMIGVAMIAGFSFQGTELIGVAAGESDEPAKNIPRAVRQVFWRILLFYVLAILIIGILIPYTDPSLLKTDVETVGVSPFTLVFRHAGLAFAAGVMNAVILTAVLSAGNSGMYASTRMLYNLATEGRAPRIFAQLTRNGVPLVALLATTAVGGLCFLTSLFESKSVYLWLLNLSGMTGFIAWLGIAVSHYRFRRGFMAQSLDLNRLPYRSPFFPYGPIFAFVLCMIVTLGQNYQAFSEGKIDWVAVTATYVGIPIFLLIWLGYRLVRKSRFVPYAEMKFPALPEIEKDDSPVTRPLAPASAE

SEQ ID NO: 6815 - protein, 543 aa, Ustilago maydis 521
MTEAIHSQYDSILILDFGSQYSHLITRRCRELNVYCEMLPCTQKIKDLDWKPKGIILSGSPYSVYDEVAPRVDPDVFTAGVPVLGICYGLQEIAWNHGGKVDPHDKREYGHAMVEVVKHGVPHLDALFKNWEGSVQVWMSHGDQLSKAPEDFVVIAKTPTAPFAAMAHKSKPIYGVQFHPEVTHSLRGVELFDSFVDICACRRDWTMETFIDKEIKRIREIVGPKGQVLGAISGGVDSSVAAKLMHEAIGDRFHAVMVDNGVLRTNEAAQVYEMLSKDLGVNLTVVDASEQFLSRLKDVEDPEQKRKIIGNTFIHVFEAEVAKLEKQAEDEEAAALAAGKPQEAKGKFEYLLQGTLYPDVIESISFKGPSATIKTHHNVGGLLEDMKLKLIEPLRELFKDEVRALGKLLGIPAHLVGRHPFPGPGLAIRILGPVTREQVKILQHADSIYIDEIRAAGLYDQISQAFAVLLPVRAVGVQGDKRTYDQVIALRAAATTDFMTATWYPFPAEFLSKVSNRITNEVQGVNRVVLDISSKPPATIEWL

SEQ ID NO: 6816 - protein, 602 aa, Yarrowia lipolytica CLIB122
MNDIEKNQDAASVASYSKQDAPAYDDEPSAIGSVHEHKAGKWQNFKDSFKPADLSQYDTTGMTEVEKAALATANSPLSRGLKPRHLQMIAIGGSIGTGLFVGSGTSLATGGPAALLIAYGIIGVMLFCTVHALGELACTFPVAGSFATYSTRFIHPAWGFAMGWNYTMSWFVVLPLELVAASITVNFWQDMNHTDINNAAWIAIFWALIVCINLFGVKGYGEAEFVFSLTKVVAILGFCILGIVLVAGGGPHQGYIGGKWWHRLPEGTVGPRGGAFAHAFKGVCATFVSAAFAFTGTELVGLAAAETENPRKMLPSATKQVFWRILIFYIVSLTLVGLLVPFDEPHLLKGSSSVDATASPFVIAIRNAGISGLPSVMNVVIMIAVLSVGNSAVYGFSRTIAGLAAMGHAPKWFAYIDRQGRPIVGILVVSFWGLFAFICAAPVATQNAVFGWLMALSGLASIFTWGSINLCHIRFRLALKKQGRTTRELVFTAALGIWGSVLGLTLNCLVLIAQFWIALFPIGAPKPTAEAFFNAYLAAPVVLFFALVWLVWKRDPWLSIDQLDIDTGRRDTDLVKLEAELEQERYELSQRKWFYRVYKAWC

SEQ ID NO: 6817 - protein, 309 aa, Rhizobium etli
MADLQATLDSIYTDILPRIGEGKVADYIPELAKIDPRQFGMAIVTVDGQVFRVGDADIAFSIQSISKVFMLTLALGKVGEGLWKRVGREPSGSTFNSIVQLEHESGIPRNPFINAGAIAVTDVVMAGHAPREAIGELLRFVRYLADDESITIDDKVARSETQTGYRNVALANFMRAYRNLDHPVDHVLGVYFHQCALAMSCEQLARAGLFLAARGSNPMTGHSVVSPKRARRINALMLTCGHYDGSGDFAYHVGLPGKSGVGGGIFAVAPGIASIAVWSPGLNKVGNSQLGAVALEMLAARTGWSVFGD

SEQ ID NO: 6818 - protein, 427 aa, Streptococcus pyogenes MGAS8232
MTHSTKQEHSHSQSAVLGLQHVLSMYAGSILVPIMIAGALGYSARELTYLISTDIFMCGVATFLQLKLTKHTGVGLPVVLGCAFQSVAPLSIIGAQQGSDAMFGALIASGIYVILVAGIFSKIARFFPPIVTGSVITVIGLSLVGVAMGNMGDNVKEPTAQSMMLSLLTIVIILLVQKFTKGFVKSISILIGLVAGTLVSAMMGLVDTTPVVEASWIHVPTPFYFGMPTFEITSIVMMCIIATVSMVESTGVYLALSDLTNDQLDEKRLRNGYRSEGIAVFLGGLFNTFPYTGFSQNVGLVQISGIKTRRPIYYAAGILVGIGLLPKFGAMAQMIPSPVLGGAMLVLFGMVALQGMQMLNRVDFQKNEYNFIIAAVSISAGLGFNGTNLFASLPETAQMFLTNGIVIATLTSVVLNLVLNGKDKQDE

SEQ ID NO: 6819 - protein, 411 aa, Pseudomonas syringae pv. syringae B728a
MAIEIKAPSFPESVADGTISKWYKKEGDAVKRDEMLVDIETDKVVLEVLAEADGVMGTITKEEGAIVLSNEVLGTLNDGATASAAPAPAAAPAAAPASAPAAAPAATAGEEDPIAAPAARQLAEENGINLASVKGTGKDGRITKEDIVAAVEAKKSAPAAAPAAKPAAAAAPVVAAGDRTEKRVPMTRVRATVAKRLVEAQSNMAMLTTFNEVDMTEVMALRSKYKDLFEKSHNGVRLGFMSFFVKAATEALKRFPAVNASIDGSDIVYHGYADVGVAVSSDRGLVVPVLRNAEHMSLAEIEGGIATFGKKARDGKLSIDEMTGGTFTITNGGTFGSMMSTPIVNPPQAAILGMHNILQRPMAVNGQVVIRPMMYLALSYDHRLIDGKEAVTFLVTIKNLLEDPARLLLDI

SEQ ID NO: 6820 - protein, 218 aa, Brassica napus
MSEASSMSLTERIYNHLCLFDVSLALLGLFVFCCVREKLAKKPGPTTWPVFGVTPEFFFNRNDVYGWVTRCLKTCRGTFLYRGIWLGGSYGAVTCVPANVEYMLKTNFKNFPKGVFFNERFNDLLEDGIFNADHESWKEQRRIIITEMHSTRFVEHSFQTTQDLVREKLLNVMESFEKSQEAFDLQDVLLRLTFDNICIAGLGDNPGTLDSDLPIAPF

SEQ ID NO: 6821 - protein, 478 aa, Pseudomonas syringae pv. syringae B728a
MSQKFDVVVIGAGPGGYVAAIKAAQLGLKTACIEKYQDKEGKLALGGTCLNVGCIPSKALLDSSWKFYEAKNGFSVHGISTSDVSIDVPAMIGRKSTIVKGLTGGVASLFKANGVTTLQGHGKLLAGKKVELTAADGTVEIIEADHVILASGSRPIDIPPAPVDQKIIVDSTGALEFQQVPQRLGVIGAGVIGLELGSVWARLGAQVTVLEALDKFIPAADEAVSKEALKTFNKQGLDIKLGARVTGSKVEGEQVVVSYTDAAGEQSITFDRLIVAVGRRPVTTDLLASDSGVDLDERGFIYVDDYCTTSVPGVYAIGDVVRGLMLAHKASEEGIMVVERIKGHKAQMNYNLVPSVIYTHPEIAWVGKTEQTLKAEGVEVNVGTFPFAASGRAMAANDTGGFVKIIADAKTDRVLGVHVIGPSAAELVQQGAIAMEFGTSAEDIGMMVFSHPTLSEALHEAALAVNGGAIHIQNRKKR

SEQ ID NO: 6822 - protein, 167 aa, Zea mays
  misc_feature (11)..(11): Xaa can be any naturally occurring amino acid
  misc_feature (89)..(89): Xaa can be any naturally occurring amino acid
  misc_feature (104)..(104): Xaa can be any naturally occurring amino acid
  misc_feature (122)..(122): Xaa can be any naturally occurring amino acid
  misc_feature (128)..(128): Xaa can be any naturally occurring amino acid
YSSEALLYLAXTETQTEILSILLHEWAILAPLKEHSVAVDDYYTPLLFLKGSVVTPENLCESMLLCKKGMKIRLPIREGTCALCHHVEXEILIMLKDPSVQLEXIDLLSTRCCKAQSYEQHXSGWPSXYIPLILVKVLKFLETTDDCSEIHACEAGALASMEAMPLS

SEQ ID NO: 6823 - protein, 558 aa, Oryza sativa (japonica cultivar-group)
MQQRRKSVFASAPFAMKQAALGAGVAARRNGAPLSLAAVVFALFVFATFLYNEDIKSIADFPFGAGALRAKSPDLHVLQETVGAAHLAAGSIAKRGEEVIVRVLDAPASTAMAAAAGSSSNNSTIEVAKANANANANAADAGVKVDEGQERERDVTLPSVKEGGADEARRREDEEAAEKESSAKAAAATAALRTVVSVPDTCDLYRGNWVYDEVNAPVYKESQCEFLTEQVTCMRNGRRDDSYQKWRWQPTDCDLPRFDARLLLERLRNKRLMFVGDSLNRNQWESMVCLVQSVIPKGKKTLTKFVNGGNSNIFYAHEYNATVEFYWAPFLVESNSDNPQVHSVPDRVIQWHSIAKHAHNWLGVDYLIFNTYIWWLNTLDMKVLKGSFDQGATEYVEVDRPVAYKEVLKTWAKWVDRNIDPNRTTVFFMSMSPNHITPEAWGNYGGIKCAMETLPITNRTTSLDVGTDWRLYAGAQEVLQTFRRVPVHLVDITALSELRKDAHTSVHTLRQGKLLTPEQQSDPKTYADCIHWCLPGLPDTWNQFLYARIASAPWSSDQ

SEQ ID NO: 6824 - protein, 211 aa, Brassica napus
  misc_feature (174)..(174): Xaa can be any naturally occurring amino acid
EKRWALRRLTAVMAVAFGIGLVYYGMPLALSNLDFNVYMSAAFNALMDLPANLITLFLVDKLSRRNALIGFTALGGVSSVLIFALPNMRIGSHGALQLVLDLISYFCACSAFNIEMIYTIELFPTCVRNSAIAMTRQALVLGGVFSPIMVAAGRKNGFWSFGLFGLAIGLLGLXFAVALPETRGSDLCDTMDEEECKDRQGNNDIISSVIA

SEQ ID NO: 6825 - protein, 174 aa, Nicotiana tabacum
AFLKSVAAGTYDAVIVDSSDPIGPAQELFEKPFFESIARALRPGGVVSTQAESIWLHMHIIEEIVANCRQIFKGSVNYAWTTVPTYPSGMIGFMLCSTEGPAVDFKNPINPIDADASHNKTLGPMKFYNSELHKASFCLPSFAKRVIESKGNDLENSSRTMEAANHNNNGQEGD

SEQ ID NO: 6826 - protein, 552 aa, Pseudomonas aeruginosa PAO1
MYVYDEYDQRIVEDRVKQFRDQTRRYLAGELTGEEFRPLRLQNGLYIQRYAPMLRIAVPYGLLSSRQLRKLAQIARDYDKGYAHISTRQNVQFNWPELEDVPEILAELATVQMHAIQTSGNCIRNTTTDQFAGVARDELVDPRPWCEIIRQWSTFHPEFAHLPRKFKIAVNGAVSDRAAIEVHDIGLEAVKNEAGELGFRVSVGGGLGRTPIVGSFINEFLPWQHLLGYLDAILRVYNRYGRRDNKYKARIKILVKALTPEVFAERVEAEWANLKDGPSTLTEAEVQRVAAHFVDPAYKALDDLDESLARLDAEHPGFARWRARNTFAHKKPGYVAVTLSLKPTGTAPGDVTDKQLEAIADLADRYSFGEVRNSHNQNIILADVEQGELFALWGELRELGFATPNVGLLTDIICCPGGDFCSLANAKSIPIAEAIQRRFDNLDYLFDIGDIDLNISGCMNACGHHHVGHIGILGVDKKGAEFYQVSLGGSSARDASLGQILGPSFAQEQMADVIDKIIQVYVERRTEEEPFIDTFRRIGIDPFKERVYAANH

SEQ ID NO: 6827 - protein, 346 aa, Pseudomonas aeruginosa PAO1
MRSQDLHQRLADLGAKPLHCGRIVRAWLQGRALDACTARQRAEDFLPLGVRHGLPQVAAELEGIARLHSEHPASDGSSRLLVELADRQMVESVLLPRGGLCVSTQVGCAVGCVFCMTGRSGLLRQVGSLEMVAQVVLARRRRAVKKVVFMGMGEPAHNLDNVLEAIDLLGTDGGIGHKNLVFSTVGDPRVFERLPRQRVKPALALSLHSTRAELRRQLLPKAPPLSPEELVEAGEAYARRVDYPIQYQWTLLEGINDSLEEMDGILRLLKGRFAVMNLIPYNSMDGDAYRRPSGERIVELVRYLHSRGVLTKVRNSAGQDIDGGCGQLRARATQGTAERRIPARQA

SEQ ID NO: 6828 - protein, 127 aa, Xylella fastidiosa Temecula1
MSFQIIHTEKAPAAIGPYSQAVRVGNTVYFSGQIPLDPATGTIVAGDLAVQARRAFDNLRAVAETANGSLSKIVRLGLYLTDLEQFSVVNAVMQEYFQAPFPARSTIQVSGLPKGADFEVDAVMVID

SEQ ID NO: 6829 - protein, 241 aa, Haemophilus influenzae 86-028NP
MLKIQKLSIAALMVSAVISGQVFAEDNTFDEKAASYAVGTLMGSQMKDLVDSHKEVIKYDNARILDGLKDALEGKVDVRKDEKIQKTLESIEAKLVAASKAKAEAIAKQAKEEGDKFRAEFAKGKDVKTTQSGLMYKIESAGKGDTIKSTDTVKVHYTGKLPNGKVFDSSVERGQPVEFQLDQVIKGWTEGLQLVKKGGKIQLVIAPELGYGEQGAGASIPPNSTLIFDVEVLDVNPKSEK

SEQ ID NO: 6830 - protein, 1072 aa, Bacillus halodurans C-125
MRKNKASKVSVLFMIVLLVLSLFTPIMPMHEANADTEADTLRIHYQRSDQQFENLGLWLWGDVRYPSENWPSGGTPFEPEKMTDYGAYVDIELKENAENIGFLVLNTATGDKDGNDKHVQLLSPEMKEIWIKEGSDDVFLYEPVDLPDHTVRIHYERSDQSYHHWGLWTWKDVASPSEHWPSGANPFSDEQTSRYGAYLDVELADDANEIGFLVVNRENGDKDGDDKTFADLANHPQLFIRQGDDTVYTNPYYQTIEGLVSGELISLTEMELRFTSTIWLSEDDLAEQIHLTDTNGASVAFDHVTIHDEKTVILHGSFDAELAPYHVTFADKTVVARAGWRLIDALYGYDGELGAVLHEDGSSTLTFWSPLADHVSVVLYDKDDQYRIIKDDIDMTKGDQGVWQVTLHSENTGLDNLAGYYYHYKIERDGDTKLGLDPYAKSMAAWNNEGSYSIGKAAIVDPSSIGPELDFAEIEGFEKREDAIIYEVHVRDFTSDPGIEEELTAQFGTFASFVDKLDYIEDLGVTHIQLLPVMSYYWGDELANHERELAYSSSGNNYNWGYDPHSYFSLSGMYSENPEDPELRIKEFKHLIDEIHRRGMGVILDVVYNHTAAVEIFEDLMPNYYHFMDADGTPRTSFGGGRLGTTHKMSRRILVDSITYWVEEYKVDGFRFDMMGDHDAETIQIAYDRAKELNPNIVMIGEGWRTYVGDEHGGDIMPADQDWMQHTESVGVFSDEFRNELKSGFGSEGQPRFITGGARNIEQIFDNLTAQPHNFTATNPGDVVPYIEAHDNLTLHDVIAQSIRKDPEYHQEEIHKRIRLGNTMVLTAQGTAFLHAGQEFGRTKQFRADTGGQAPYKSTYMTDENGKPFVYPYFIHDSYDSSDAINKFDWGKATNKEKYPIHHLTRTYTAGLIELRRSTNAFTHGTLVDVQANVRLLDIPEISETDLVIGYRATSTDNTGTYYVFVNADTKERTLSLTDDLTEGVVIVDSDEAGIVAVSDPSGFDLTPNEITIDPLTAVIIRVGGDFQENPHDGHPGKGGGKAKGRPDHAGQPGPPPHAGEKGKPDHASKKK

SEQ ID NO: 6831 - protein, 222 aa, Zea mays
  misc_feature (74)..(74): Xaa can be any naturally occurring amino acid
  misc_feature (101)..(101): Xaa can be any naturally occurring amino acid
  misc_feature (108)..(108): Xaa can be any naturally occurring amino acid
  misc_feature (121)..(121): Xaa can be any naturally occurring amino acid
MAYSMLSSAAVVTSPAQATMVAPFTGLKSSSAFPVTRKANNDITSIVSNGGRVSCMKAWPPVEKRKFETLSYLXPDLTEVELGKEGDYLLPAQGDSLGVKXKLEHGFXYRGARKAPPGYYXGRYWDKGEAFPLFGGAPPLLKGVKEAQKGETKGNPKPPFSGILGSQNKPGKAGGSFSFPQKQPQVSRGVKTPSKKKKPFPLFSSKKRGVFFFSLGDFRKKK

SEQ ID NO: 6832 - protein, 400 aa, Agrobacterium tumefaciens str. C58
MAFLADILSRVKPSATIAVTQKARELKAKGRDVISLGAGEPDFDTPDNIKEAAIDAIKRGETKYTPVSGIPELRKAIADKFKRENGLDYKPEQTIVGTGGKQILFNAFMATLNPGDEVVIPAPYWVSYPEMVAICGGTPVFVNATLEDNFKLKPEALEKAITPKTKWFVFNSPSNPSGAAYSHDELKALTDVLVKHPHVWVLTDDMYEHLTYGDFKFVTPVEVEPSLYDRTLTMNGVSKAYAMTGWRIGYAAGPLPLIKAMDMIQGQQTSGASSIAQWAAVEALNGTQDFIPENKKIFEGRRDLVVSMLNQAKGISCPSPEGAFYVYPSCAGLIGKTAPSGKVIETDTDFVSELLEAEGVAVVQGSAFGLGPNFRISYATSETLLEEACKRIQRFCADCR

SEQ ID NO: 6833 - protein, 583 aa, uncultured bacterium 463
MPQAQQTSDSNATVNGLFSRFGAPSFTAQPTQDNTPTLWVERHKLLEVLAHLRAEFPMLLDLFGIDERLREHRPEAALDFTIVYHLLSLEAREEIRIKVGVSSDDASVPSAHLIWPNANWYEREAWDMYGVEFSGHPNLRRILLPPTWEGHALRKDHPARATEMEPFSLDEEKQAAEQEALLFKPEEWGMARATEDTEFMFLNLGPNHPSVHGVFRIALQLDGEVIVDAVPDIGYHHRGAEKMAERQTWHSFIPYTDRIDYLGGVMNNLAYVMAIEQLAGIEVPPRAKIIRIMMAELFRISSHLVFYGTFAQDVGQMSPVFYMFADRERLFGIIEAITGGRMHPAWFRIGGVAQDLPQGWDKMVREFIDSMPARMDHYQTMAMDNSILKQRTVGIGEYDTAEALSWGITGASLRATGMDFDLRRDRPYGGYDEFEFEVPIGNRGDSYDRAAVRVEEIRQSLRIIRQCLDNMPEGPYKSEHKLTTPPPKERTMQDIETLIHHFLSVSWGPVMPVGEASFPIEATKGINNYHLVSDGGTTSYRTRIRTPSFPALQQIPDFCKGLLIPDLIAIIASIDFVMADVDR

SEQ ID NO: 6834 - protein, 307 aa, Aspergillus oryzae
MSVIDWGVVAPWTRCSFVLTGASEGGLGGATALALASARPSHLVLLARTENKVRTVISTIKEISPETQPAFVHIELEDLDSVRRAAADVLSLTSKIDVLINNAGVMAIPWSKSKSGLEKTLAINHIGHFLLTKLLMPSILAAGPGSRIVNVTSAAYRMAPFFFDDWNFSDGQTYHPLAAYGQSKTANILFTVGLAQRYKEHGILSFAAHPGYIPGTSLLLHGPDLDPSAMDEVARKNTGFPFGPDPPKSLEQGISTTLVAALSPELTDASGAYMEDCQVCEAREYARDPKLADRLWSLSEELASEAF

SEQ ID NO: 6835 - protein, 216 aa, Gossypium hirsutum
MDFLVQDYDMVDSGSVSESGTDRPVNFSDGYVMLASSYPKRRAGRKKFRETRHPVYRGVRRRNPGKWVSEVREPNKKSRIWLGTFPKADMAARAHDVAAIALRGKSACLNFADSAWKLPVPASSDPKDIQKTVAEVAETFRTAEHSSGNSRNDAKRSENTEMEKGFYLDEEALFGTQRFWANMAAGMMMSPPRSGHDGGWEEHEVDDYVPLWSYSI

SEQ ID NO: 6836 - protein, 175 aa, uncultured bacterium 463
MFKALMSQVRTIWTILQHSFTRAETVQYPEQKPYLAPRYRGRIVLTKDPDGEERCVACNLCAVACPVDCIALQQGVKEDGRWYPEFFRINFSRCIMCGMCEEACPTNAIQLTPDFEMCEYNRSSMVYEKEHLQIEGTGKYHDYNFYRVAGLAITGKDKGQAQNEATPIDVKSLLP

SEQ ID NO: 6837 - protein, 81 aa, Arabidopsis thaliana
MPISATMVGALLGLGTQMYSNALRKLPYMRHPWEHVVGMGLGAVFANQLVKWDVKLKEDLDVMLAKARAANERRYFDEDRD

SEQ ID NO: 6838 - protein, 482 aa, Ralstonia metallidurans CH34
MQLKDPSLFKQLAYVDGQWISADSGATFDVTDPATGEVIARVADLGAAETTRAVAAAEVAQKAWAAKTGKERANILRRWFDLMLANTDDLAYLMTREQGKPLAEAKGEIAYAASFIEWFAEEAKRVDGEVLATPAADKRLVTLRQPVGVCAAITPWNFPAAMITRKVAPALAAGCAIVIKPAELTPLSAFALAELAHRAGVPAGVLQVVTGDARNIGGVLTASPIVRKLSFTGSTEVGRILMAQSAPTIKRLSLELGGNAPFIVFDDADVDAAVEGAIVAKYRNGGQTCVCANRFYIQDGIYDAFAAKFAERTAQLRVGNGLEAGVVIGPLIEDAAIEKVNSLVEDATSKGGKVLAGGGKHPLGGTYYTPTVIGNATADMRMAREEIFGPVAPLFRFKQDDEAVAAANATEYGLAAYLYTRDISRAWRTAEALEYGMVGLNTGLISNEVAPFGGIKQSGVGREGSRHGIEEYLEIKYLCLQM

SEQ ID NO: 6839 - protein, 1606 aa, Ustilago maydis 521
MEANTSAAHPAPPIANTSVNEYSDAVDVGGTAAATTFAGSPVINSDGQHSSTDHNHASSAPEMPPVERIKSGRGSVPLSSIDPQGMAELTRRLTEHSMRARSRTTDGDGGEEALGFDPFDKNGKFDLERFLRLVMQQAEGAGNEVREMGLVWQNLTVTGLGSGYALGDTVGSLPLKPFEALKNIKSLLHPPVKVIIDNFEGCIKPGEMLLVLGRPGAGCTSFLKTLASYRDGFQDITGTLLYQGMDHTVIDKRLRGDVVYCPEDDIHFPSLTVWQTLAFAVATRAPQARRRLNLLQSEDTQTRDGYIKTLVEVVATILGLRHTYNTKVGNDFVRGVSGGERKRVSVAETFASRAKVALFDNSSRGLDSSTALEFVKSLRVSTDIANTTTAASIYQAGEGLTQLFDKVLVINEGRQVYFGPTSEAPDYFKEMGYIPQERQTTADYLVACTDAHGRRLREGYEKRAPRTAEEMAKYWQASPQGHKNRQEVEAYLEELTSKVDDAAVKRYKEVAREEKAKNTRKGSAYIISLPMQIRLAVKRRAQITWGDIATQVIIACASMFQAIIMGSVFLLMPKNTSGFFSRGGVLFFALLYNSFTAMSEITAGYAQRPIVIRHRRFAMIHPFSDALANTLLDMPIRLMTLTLFDVILYFMVGLQYTAGQFFVFYSTTALITFTMVAFFRMLSAATKSESLATMLGGLAIIDFALYTGYVIPRPSMVVWWKWLSYCNPVAFAFEILLTNEFRTLNVPCANFIPAGQAYADVSDQYKTCAVASAQPGQDIVIGSEYLAQSYGYTWSNAGRNAGIIFGFWFFFLIVYSLASEFQKDPSASGGVMVFKRGAAPKEVVQAAKASGDVEAGDAAGHTERVDREQDEQADKAVGKLESSTSVFAWKNVNYDVLIKGTPRRLLNDVSGFVAPGKMTALMGESGAGKTTLLNVLAQRTDTGVVRGLFSVNGAPLPKSFQSNTGYCQQQDVHLGTQTVREALQFSALLRQPRETPKEEKLAYVENVISMLEMESWAEALVGEVGMGLNVEQRKRLTIGVELAAKPKLLLFLDEPTSGLDAMAAWSVVRFLRKLADAGQAILCTIHQPSGELFNQFDRLLLLQKGGKTVYFGDIGPNSTKLVEYFGERADKRCGENDNPAEYILDVIGAGATATTDKDWHELFRNSYLFTDMMKEVERIDSLGADHPATAEEEAMGMREYAEPFSVQMTQVMRRAFMHYWRDTTYIMSKLMLNIIAGLFIGSSFWGQGRTQTSASLQNKIFAIFMALVLSTSLSQQLQPVFIQFRALYEVRERPSKMYSWPVAVTAALVVEIPWNLLGGTLFWASWYFMVGFPYGKTAALVWGMYMLFQIYYQTFAAAVAAMSPNPMIASILFSTFFSFVIVFCGVVQPPPLLPYFWRSWMFVASPFTYLLESMLGAVLNNQPVRCSAQEYNRITPPPGQSCAAYLANFVTSLDGPNLGTGYYIDGPNGSCDYCQFRIGNDYLRSIELNASNRFRDIGIICIYIVFNVLLCFTLFYFFRVFKLSSFKKKDGEKQPTIADQDEKPTVAAETVSRADAGAEKAVHALTSTSAAAKGPGHEGASQPGLVANPFGGGAGQHGVQDVQAKL

SEQ ID NO: 6840 - protein, 632 aa, Podospora anserina
MNQQQQYQQPSRRTDAYSSQHDELHLPSSSSMAHQGQHPLQQQQQQLPTRQYSSGPGVPPHIKLEQSPNPQQHHHQSAGVVPNVLQPGGLQTRPPVISSNTAPVLPTMQQQQPPDYQPHQTPTKSNSMNLSHNYPRSSPAAPYEGGSGYSAYAPNTPGGAGSSSQYMSPTDSKYSQSSGSQRIPSNAPLGLADIRPRADSSLSDGIPGTTSYEHANTQSRTSNYMAPWALYAFDWCKWAPQGNSAGKVAIGSYLEDGHNYIQILDAQVSPTPSDVYSPAGSRYTMDFTRIAEATHSYPVTRLLWEPPSSQKQSTDLLATSGDHLRLWSLPSDPQVQTPGSSITSRNGRDMPITKLTPLALLSNSKTPDHTAPLTSLDWNTVTPSLIITSSIDTTCTIWDIPSLTAKTQLIAHDKEVYDVRFCANSVDVFVSCGQDGSVRMFDLRSLEHSTIIYEPTGKEERDANGGRISPTLAQQTMSHPPPLLRLATSPHDQHLLATFAQDSNVIRILDVRQPGQALLELRGHGGALNCVEWSPLRRGTLASGGDDCQVLIWDLLNNNNTSNAATISTNGAAPPTGAQAAASTDNVRSPVAAWQCEYEVGNLGWVPHLAGGEYGDWLGVSAGRGVWGVKLG

SEQ ID NO: 6841 - protein, 345 aa, Prochlorococcus marinus str. MIT 9515
METHLERISNLQDFKKAKLDRETGLFLYEDMTLGRRFEDKCAEMYYRGKMFGFVHLYNGQEAISTGVIGAMKRKHDWFCSTYRDHVHALSAGVPSFEVMSELFGKATGCSKGRGGSMHLFSKEHHLLGGYAFIGEGIPVALGSAFSSKYKKVVAGDSQSDSVTAAFFGDGTCNNGQFFECLNMAQLWKLPIIFVVENNKWAIGMAHDRATSDPEIWRKASAFGMHGEEVDGMDVLAVRGAAQRAVERARAGEGPTLLECLTYRFRGHSLADPDELRAEEEKEFWGKRDPIKKLAKLMIEGDFAKEEELKSIEKKIDLEISESVKNALEAPEPPANELTKYIWAED

SEQ ID NO: 6842 - protein, 127 aa, Silicibacter pomeroyi DSS-3
MDLIAQLEAEQIAALGKDIPDFKAGDTIRVGYKVTEGTRSRVQNYEGVCISRKNGSGIAGSFTVRKISFGEGVERVFPLYSTNIDSITVVRRGRVRRAKLYYLRARRGKSARIAEVANYKPKADAEA

SEQ ID NO: 6843 - protein, 522 aa, Prochlorococcus marinus str. MIT 9515
MKEIGWPTIDSKHLVVYSKQMLDLENRMFSKGMPQEALMEKAGIQISRWLLKRKFLLNKGVIVLIGPGHNGGDGAVIAKELFLKGYLVKLWCPFPLKKTLTINYVNYLTTIGVEKLLEPPNPDEKHLWIDAIFGNNQKRKVDEELIELLNKKFNKKSGKVVSVDVPTGLCPNSGKPFSQNAVKANYSLVIGLNKIGLLQDTALAYVGELHHIDIGITKDQLSKLKSQITKITLEDLKTINLPLLPKNSSKYKRGRSLLIAGSEKYPGAARLAIKGAISSGAGFVSAILPELVAKSIWQVEPEVVIKGRLKSDLDGNSILFDALKNIDLSCYDSIVIGPGIGLNYGDWEKSTEYLLGFKGLLILDADALNRISKSNLGSKFFLERKSQTWITPHNKEFLRLFPEMDSTNRVELAIKAAKEFNISILLKGANSVIANYERAWQLCETDAETARAGLGDLLSGFIGGCSSIDLSHPSNLIKTESLAKYVFLHSIAASKCKKGSTSSVIGDELSKLMRKTKARQMS

SEQ ID NO: 6844 - protein, 152 aa, Triticum aestivum
  misc_feature (15)..(15): Xaa can be any naturally occurring amino acid
  misc_feature (25)..(25): Xaa can be any naturally occurring amino acid
  misc_feature (48)..(48): Xaa can be any naturally occurring amino acid
  misc_feature (100)..(100): Xaa can be any naturally occurring amino acid
APGQVTISQKEMTRXQDMLPNLRSXVNQMLSALNMPSFANRNSLLGPXRKPEAMTRMVGLDNNGLVGLQRQIMKGHLMEICLEQLEETVARPKHIALAVXRRAASHSRIIDHLHQRVDLTDSRLRREHKNLAVLNKPIEGGCSCKCIATIGW

SEQ ID NO: 6845 - protein, 497 aa, Mycobacterium sp. MCS
MATISTPEYLLDQAKRRFTPTLNTIPGMGIVEKRLRDKLQNQEWKQFVLAEPPAGSGLKPVMGDSGLPVLGHMIETFRGGPDYLLQVYKTYGPLHYAYSPALPAVVALGPDATQAVFSNKNKDFSQRGWHPVIGPFFNRGLMMLDFDEHMYHRRIMQEAFTRTRLAGYVEHIDRVASQVIANDWVENDARFLFYPAVKELTLDIASVVFMGHEPGTDKELVTKVNDAFTMTTRAGGAIIRTGLPPFKWWRGLQARKVLDNYFEQRVKEKRGSEGTDMLTVLCHTADEDGNTFSDQDIVNHMIFLMMAAHDTSTSTLTTMAYHLSRNPEWQERCREESERLGDGPLDIEALEKLETLDLVINESLRLVTPLPFNVRQTVRDTELLGHYIPANTDVVLWPSVNHHLPELWTDPEKFDPARFTEPRNEHKQHRYAFAPFGGGAHKCIGMVFGQLEIKTVMHRLLRRYRLEPPRPGYVSKLDYAGMPVPMDGMPIVLRPLR

SEQ ID NO: 6846 - protein, 444 aa, uncultured archaeon GZfos12E1
MEEEKRKAGEKHLRTINKHEPEKVASEYHSYYRGKIEIGLKAPVRSYDDFAIWYTPGVAEPSREIKNSRERVFEYTNKGNSVAIVTDGTRVLGLGDVGAEAALPVMEGKAMLFKYLGGVDAFPLCLDTSDAEDIINTVKWVAPTFGGVNLEDIESPKCYYILERLQEELGMPVWHDDQQGTALVILAGAINALKVVGKRLSEIAISLVGAGAANMNVAKYLCLAGAKEGNIVMVDSKGILNRERMEDVKRDENKRDMCEKTNKEGRKGGIKEAMRDTDLCIALSTPGPGVIKKEWVADMANDAIVFACANPVPEIWPVEAEEGGARIVATGRSDFNNQVNNSLGFPAVFRGALDVRAARITDGMCIAAANAIARYTEEEGKGKEKGISESRIIPRMEESEMYVCEAVAVGMKAIEQGVAEKGMSMKALEERVREKISDKTTKPF

SEQ ID NO: 6847 - protein, 61 aa, Triticum aestivum
ACTMWRLETNWIVSIIICAIIRAVGACGYVLVTSFLIRENIFQLITVNIHASLTYLGRDHA

SEQ ID NO: 6848 - protein, 635 aa, Crocosphaera watsonii WH 8501
MVKTPISPAQKVSKLENIKEHSNFLREPLASELLEDTNRFSQDAIQILKFHGSYQQYNRDKRAKGQEKDYRMMLRTRNPGGFISAQLYSTIDGLSDEYGNNTLRVTTRQGLQIHGILKKNLKASISAIVKSMGSTLGACGDINRNVMAPPAPLKNRPDYGYAWEYADKIADLLRPQSNAYYEIWLDGEKAISVEEDPEVTAARQRNINGTNFEEGEEPLYGQHYMPRKFKCSVTVPGDNSIDLYTHDVSLVVITDDSGELLGFNVLTGGGMGRTHNREETFPRLADPLGYVAKEDVFDLMKAILATQRDYGDRVQRRHARMKYLIEDWGIDKFRSQVEEYLGKALEPFKPLPPWEYKDFLGWHEQGDGKLFLGISIENGRIQDQGDFRLKSALQKITKEYSLPMRLTANHNLIFYEINPIDQADIESILLHCGIVSDPEKIDSLTRYSMACPALPTCGLAVTESERALPGILERINNVLARVGLAGEEIVIRMTGCPNGCARPYMAELGFVGSAPESYQVWLGGDANQTQLAQPYIDKLPDKDIESFLEPLFAYFKQDKTKQETFGQFCQRVGFEALRTFSENYTPPKPRRVRKNQHRVSVQDAMFARLKQASQDEKRPMNQIVQQALEAYFAEE

SEQ ID NO: 6849 - protein, 294 aa, Glycine max
SYVGPPPPKTITCRVLSIDTLKTLVETSLIGDDVEQSMLKVENQEDQGKLHWLSDANKKPSIVLAGLHSCGDLSVTMLKTFVECKDVKAVVSLGCCYNLLSEEMIKDGESQFGFPMSHAVRSIGLSLGKSARDLACQSAERWRSLDMHAGIHNFELHAFRAAFQMVLSKYYPEIVMSTPSIGLIKSDDKLSHFENFCQSGLSHLGIKHSQDINLQGIWKEAEPFADLVGPYWSLRAALGPLLETLIILDRLLFLQEQGSALEACLLPIFDPKISPRNVAIIAKKIDKDLRSSCC

SEQ ID NO: 6850 - protein, 403 aa, Magnaporthe grisea 70-15
MKQLLSVAIVAPESGFSGFVVYRPSIYYQRQITFCPRQIKLLGMKSYSIASIPADGIGPEVIDASIAVLNTLADTLGSFNIEFTHFDWSSDTYKKTGKYIPDGGLDKLKKHDAILFGAVGSPEVPDHVSLWGLRLAICQPFQQYANVRPTKIFRGTRSPLRDCATSDLDWVIVRENSEGEYAGQGGRSHRGLPWETATEVAIFTRHGVERIMRFAFELARNRPRKLLTVVTKSNAQRNGMVLWDEVAAEVARDFPDVTWDKMLVDAMTCRMVLKPESCDTIVASNLHADILSDLAAALAGSIGIAPTSNLDPSRQNPSMFEPIHGSAFDITGKGVANPVATFWTSAEMLAWLGEKDASMKLLEAVERVCEKGVVTADLGGTATTKQVTDAVIDEIKALYGKSS

SEQ ID NO: 6851 - protein, 364 aa, Brassica napus
MGKGGMSQGEGSKVEEENMAAWLVGLNTLKIQPFPLPTLGPHDVRVRMKAVGICGSDVHYLKTMRCADFIVKEPMVIGHECAGIIEEVGEGVKHLVVGDRVALEPGISCWRCNLCKEGRYNLCPEMKFFATPPVHGSLANQVVHPADLCFKLPENVSLEEGAMCEPLSVGVHACRRAEVGPETNVLVMGAGPIGLVTMLAARAFGVPKIVIVDVDDNRLSVAKRLGADGIVKVTTSLEDVGSEVEQIKKAIGSNIDVTFDCAGFNKTMSTALAATRCGGKVCLVGMGHGIMTVPLTPAAAREVDVVGVFRYKNTWPLCLEFLTSGKIDVKPLITHRFGFSQKEVEDAFETSARGSNAIKVMFNL

SEQ ID NO: 6852 - protein, 431 aa, Sorghum bicolor
MALHLMLAAAAAFAVLAPPAASSGPTPAPPALGINYGQVADNLPPPQAALLLLRALNATRVKLYDADARVLRAFAGSGVDFTVGVPDRLVPRMATDPSAAASWVRSNLLPHLPATSITAVTVGNEVLSGTNAAMLRSLLPAMESLHAALAACNLTSRVSVTTAHSLAVLSSSFPPSSAAFRREVVPYMAPLLGFLARTGAPFLVNAYPYFAYKADPDRVDLGYALFEANSAGVADAATGLRYDNMLHAMVDAARAAICRANYGKALEIRVSETGWPSQGDDDEAGATPENAARYNGNLMRLVAQGKGTPAAPGEPLQVYVFALFNEDQKPGPASERHYGLFKPDGTPAYDVGVKAPTITLPKGNGSSGSGNNGTGGLVVAQGPGGADGVGPGTGYYTVSAAAMNKVKSRRRRCMESLVAAAAVLAMVSGPC

SEQ ID NO: 6853 - protein, 321 aa, Leptospirillum ferrooxidans
LEEGEKTRSFASGMGAISAILIHLAKKHPEIAFPKVLYGGTRAFIEQYLIPSGCLIHWFDPREEGWDEELSRRLSPDTGAIFAETPSNPVMTVIDLEKLSSAAKKVGAPLVVDNTFATPILQKPLVLGADIVVHSATKYLGGHGDLLGGTVTGKASLIDRLSFEEGSYLGATLSPFNAWLLLRGMKTLPLRMDAHCRGAMMVAEFLSGHPGVKSVHYPGLSKDPGHKIASSQMKGFGGMLSFSLGDDQRARRVASGLELFKIAVSLGDPESLIEHPASLSHRQMTAEERMTLGIDPGFLRVSVGLEDPEDLVMDLKRALER

SEQ ID NO: 6854 - protein, 344 aa, Streptomyces rochei
MRSLTYSQAISEATVQCMEADPAIVLAGQSVDDYKGVYGTTGEAFARFGSARVIDIPNGENAFAGIAIGAATMGLRPLLVHTRDDFMFLAMDALINLAAKWRYMYGGKRGVPVVSRGVVGRGWGQGATHSQSLQSLFGHFPGLHVATPASPADAKGLLVTALQGDTPVVLLENRGLYDLRGEVPSEPVAVPFGKGRVVRAGDDVTIVAASLMVHEAERAAGVLAARGISAEVVDVRSIRPLDDALICASVAKTGHLVVADTSWARYGFTAEVVAVVAENVPGALKAPVRRVTPPDCPAPVSWPLENAFNPGAETVVRACLEVLGVAGGAVPRIRNVMAGFAGPY

SEQ ID NO: 6855 - protein, 375 aa, Paracoccus denitrificans
MRTRAAVALEAGKPLEVMEVNLEGPKAGEVMVEIKATGICHTDEFTLSGADPEGLFPSILGHEGAGVVVEVGPGVTSVKPGNHVIPLYTPECRQCASCLSGKTNLCTAIRATQGQGLMPDGTSRFSMLDGTPIFHYMGCSTFSNYTVLPEIAVAKVREDAPFDKICYIGCGVTTGIGAVINTAKVEIGAKAVVFGLGGIGLNVLQGLRLAGADMIIGVDLNDDKKPMAEHFGMTHFINPKNCENVVQEIVNLTKTPFDQIGGADYSFDCTGNVKVMRDALECTHRGWGQSIIIGVAPAGAEISTRPFQLVTGRVWKGTAFGGARGRTDVPQIVDWYMDGKIEIDPMITHTLSLDDINKGFDLMHAGESIRSVVLY

SEQ ID NO: 6856 - protein, 256 aa, Brassica napus
ILTKIFFKKREGGKEERVRIGSCVSTRGGAGRDASSAARRLPSQHLTSSSYAGDPPGLFKSKPRTPVDLVRQTRDLLLYADRSNSSSLPDSKRHEKMAELSRNIRDIKFILYGNSEAEPVAEACAQLTQEFFRQDTLRLFITSLPILNLETRKDATQVVANLQRQQVNYKLIASDYLEANLDLMDVLILGFENLDMALHYGAMFRECIRHQIVAKYVLESEHVKKFFDYIQLANFDIAADAAATFKELLTRHKSTV

SEQ ID NO: 6857 - protein, 134 aa, Arabidopsis thaliana
MCPSSFRLILSVILIAFLFVGLCEAHRHINVDIINDIGPNVQLGLHCKSKGKDLGPQSLAPHQHWGFTASLNVWETTLFFCHFVWENQSRWFDILKEKRDTIVCKYHPCVWSIRPSGPCRLTDHEKCYPCNADI

SEQ ID NO: 6858 - protein, 366 aa, uncultured crenarchaeote 74A4
MGHWSLILGHGQKNVKESIKKQIEKSWMYGTVNEQTIKLSELISKAVPVAEKIRYVTSGTEATMYAVRLARSVTGKKIIAKIDGGWHGYTSDLLKSVNWPFKESESSGTVNDEKIISIPYNNLEGSLKILKKHSKNLAGVIIEPVLGGGGCIPATKEYLKGIQEFVHKNKSLFILDEIVTGFRFRYGCLYPTMKLDPDIVTLGKITGGGMAIGVICGKKEIMEHADTTGKKKSERAYIGGGTFSANPTSMTSGYATLNYLKTNKSTYSKINAIGDYARKELEKVFDGKVVVTGKGSLFMTHFIKNGVTEISNSTDVAKCDSEMLQKYHFKMISKDGIFFLPGKLGAISISHTKEDIEKIILASESF

SEQ ID NO: 6859 - protein, 222 aa, Prochlorococcus marinus str. MIT 9515
MQVVIVTGIIAGFVHVVSGADHLIAMAPSAITSPKIAAKNSISWGLGHSSGVIFLAVLAVFIKDITPLSKFSNFAEFFVGISLLIVGVFAIKNSLPLNIHSHSHQHNGVAHHHLHFHSEAKKKDNKHSHALTGLGLLHGLAGGSHILAVLPALALPLISASAYLISYLIGSLASMILFTGLISLTTLNTGQKFLRRLIAFAGGLSFSMGLFWVQKSTALFLT

SEQ ID NO: 6860 - protein, 328 aa, Ustilago maydis 521
MCVIFWTVNDPQYELVIASNRDEFLSRPTRAAEWHSFDSRSASPRVLSARDSTGGGTWLGVSENGAFAALTNFTESAPRIPVGMDGFESRGGLVRDWLTLQAAMCGGKRSLQEVSTQVQEYLNSVGAKGDRYPGFNLLVGALSLQGMVVGYVTNRTLQGQVVRDATVDMFLPLPHGATEASSATSPPVGMSNSILAQPWRKVTSGSHSFCQIVSSHHTQSTTLEDMTEQLFDLLWTSSNPPPSQRSELQNSVLISPLELPASASTERDWYATRTSTVITIAKDGSARLVERDTFQLRDAQPVLVNGPEATAALAGRDGGQRMFAWHIQ

SEQ ID NO: 6861 - protein, 144 aa, Glycine max
MGAFTEKQEALVSSSFEAFKANIPQYSVVFYTSILEKAPAAKDLFSFLSNGVDPSNPKLTGHAEKLFGLVRDSAGQLKANGTVVADAALGSIHAQKAITDPQFVVKEALLKTIKEAVGDKWSDELSSAWEVAYDELAAAIKKAF

SEQ ID NO: 6862 - protein, 168 aa, Oryza sativa (japonica cultivar-group)
MDSSNNNNNNKRARDAEDEADEAKRLRAEDLLDMLDDDTDAGGAAGDLASVMRSFEEEIVAGDVAGDVAPTTQPELGFLLEASDDELGLPPATASSSEEEAGAGEPEDAIGFGGQIWGFEDEIGGGGYAGFALTSPEAVCRRLEVNGNAGEEFTKLPWNHPFFTTPNL

SEQ ID NO: 6863 - protein, 171 aa, Brassica napus
RPTRPVTRLLKALEAPKDARIYWAGGEPLGGKEALEPLTKEFPHLYNKHDLALPGELEPFAKKASVMAAIDYIVCEKSDVFIPSHGGNMGHALQGQRAYAGHKKYITPNKRHMLPYFMNASLPESEFNRIVKDLHRESLGQPELRTGRGGKDVTKHPVSECMCSDRQQQQQ

SEQ ID NO: 6864 - protein, 326 aa, Streptomyces rochei
METRQLLRTMVRIRCIEEEIADVYRDEQQMRTPVHLSIGQEAVAVGVCAALRTEDVVYSGHRCHAHYLAKGGGLGAMVAELYGRETGCAAGRGGSVHLVDEAAGFGASSAILGEMISVATGAAWAFARQEAPRVAVTFFGDGASEEGVFHESLNFAALHRLPVVYVCENNQYSLSSPLAARQPPGTSISGRARGYGIPAARVDGNDVAAVHAAAVTAVEHCRSGTGPYFLELDTYRWREHVGPGWDHECGARRPDEVLSWTKRCPIRRAADALRGADPDVDEWITAWEREFRAETHAAIAAAEAAPFPRVEDLLVGTYGDRGTHAG

SEQ ID NO: 6865 - protein, 244 aa, Neisseria gonorrhoeae FA 1090
MAKLEKHTGKPKGWLDRKHRERTVPETAAESTGTAETRIAETASAAGCRSVTVNRNTCETQITVSINLDGSGKSRLDTGVPFLEHMIDQIARHGMIDIDISCKGDLHIDDHHTAEDIGITLGQAIRQALGDKKGIRRYGHSYVPLDEALSRVVIDLSGRPGLVYNIEFTRTLIGRFDVDLFEEFFHGIVNHSMMTLHIDNLSGKNAHHQAETVFKAFGRALRMAVEHDPRMAGQTPSTKGTLTA

SEQ ID NO: 6866 - protein, 993 aa, Dehalococcoides sp. BAV1
MRSQFSRRDFLKISGGTAGLFATAGLFRGPIKGVEPKMVDTRPRWVKETTTICPFDASGCGFICYTDSAGNLTNMEGDPDNPVNRGSACSKGASLIQLHNNKHRLEKVLYRAAGANDWEEKSWDWAFGEIAKKVKASRDSGFVAKNAAGKTVNRTEAIASLGGATLDNEECYLLSKMLRALGIVYLDSQARLSTASSLEALAASFGRNAMTNSWTDVSNANVILDMGGNPAENYPACFSHLGEAMGKGAELISVDCRLTRTAAKAGTFVAARSGSEIAFIGGLIKYVISDIEAHPANYNLTYITEYTTASMVVNSNFKGPADLDGMFVGYNTASHSYDQSNWNFTKASNGEPVIDKTLTNPNCVFQLLKKQYARYTPEMVSATCGCSQADFAKVCASFAATGKADKAGAIVYAMSSTQHTSGAQTVRAYAVLQMLLANIGVSGGGLFALGGESNVQGAADNGVSWNKLPGYLSAPNEDDTTFAAYASKAGDQSAASLLKAWYGSNASSSNGFGFGFLPKTDNNTNYSYINAIKQMAAGKIKGAFAWGANPVVESAAAGQATQALAKLDWLVVTDMFESETAAFWKKDGVTSQTEVFLLPTACSYEKEGSVTNADRWIQWRNKAVSASGEAKSELEVISSLLSRLQTLYQGESGLNAEAITKLSWTYSTNPSAADVAKEMNGYKISSLQQLESPEDLRADGTVACGNSLYIGSFTNAGNQMARREQTGAFHAGWAWSWPMNTRIMNNRASVDLSGKPFNAAKPVISWNGISWTGDNVDGKNAPFNQSGGLPFKGTNGNTAQLFAAMADGPMPEHYEPWESPVDNALSGTQNNPTAMVFEGDTQGSAGEYPVICTTIRTVEHSLGGQLTRNMPFLVELAPAAYVEISEQLASEKGIKAGDIVKLTSARGSVSVAAAVTKRLKPFSIGGKTVHQVAIPNHWGFMGIAQGDSANVLAPNTADSNSSTPEFKAFLVKVEKAADGTVPTITGRYKVLED

SEQ ID NO: 6867 - protein, 341 aa, Sorghum bicolor
MQHLGVLLVLAALTASPLAAAWRPWPPRANGTTAGLGASKKFEGSSEFVKLEYHMGPVLASAITVHPIWYGAWPAAQKRTIRAFLRSLAPPPDSSARIPPPSVSAWWRTVRLYTDQTSANVSAAVTLGAEKCDARMSRGARLSRMDIQSVVRDAVTARTRPLPVDSSGGVYLVLTSPDVSVEDFCGQVCGFHYFTFPSVVGYTLPYAWVGNSARRCPEVCAYPFAIPSYVPGRKAEAPPNGDVGVDGMVSVIAHELAELASNPLANAWYAGSDPSFPTEIADLCEGIYGTGGGGAYTGQLLTDARSGAAYNVNGVGGRRFLVQWVWNPVLSYCSGPNALDQ

SEQ ID NO: 6868 - protein, 428 aa, Novosphingobium aromaticivorans DSM 12444
MTAIIDIHAREILDSRGNPTVEVDVLLEDGSFGRAAVPSGASTGAHEAVELRDGDKARYLGKGVTKAVTAVNSDIAECILGLDAEDQRDIDLAMIELDGTENKSRLGANAILGTSLAVAKAAADARGLPLYSYVGGVSAHVLPVPMMNIINGGEHADNPIDFQEFMIMPVGAPSLAEAVRWGAEVFHTLKKGLHEKGLATAVGDEGGFAPNLASTRDALDFVMASIEKAGFKPGEDMMLALDCAATEFFKNGKYEISGEGLSLSPDAMADYLAALCDAYPIISIEDGMGEDDFEGWAALTAKVGKRVQLVGDDLFVTNPKRLEMGIGKGLANSLLVKVNQIGSLTETLEAVSIAQRNGYTAVMSHRSGETEDATIADLAVATNCGQIKTGSLARSDRLAKYNQLIRIEEELGVSARYAGKTAFGRLGA

SEQ ID NO: 6869 - protein, 277 aa, Streptococcus mutans UA159
MIIDDLLTKKIIKPRPLNSHKGTFGRVLLIGGNYPYGGAIIMAALACVNSGAGLVTVATHKDNITALHSHLPEAMAFDMVEKDRLSEQITAADVVLMGPGLAEDDLAQTTFDVVWQAIEPKQTLIIDGSAINLLAKRKPAIWPTKQIILTPHQKEWERLSGLTIPEQIEAATQTALAHFPKETILVAKSHQTKIYQGQKIGHIQVGGPYQATGGMGDTLAGMIAGFVAQFHTDRFEVAAAAVFLHSYIADQLSKEAYVVLPTRISAEITRVMKEMSE

SEQ ID NO: 6870 - protein, 422 aa, Pennisetum glaucum
MALRLVLAAAFAVLAPALAAAGAPALGINYGQVADNLPPPQAAAVLLRALNATKVKLYDADARVLSAFAGSGADFTVGVPDRLVPRFATDPSAAPAWVRANILPHVPATSITAVTVGNEVLTGTDTTMLRSLLPAMEALHAALAACNLTSRVSVTTAHSLGVLSSSFPPSDAAFRRDVLPYMSPILGFLAKTGAPFLINAYPYFAYKADPDGVDLSYALFEPNAGVSDAATGLRYGNMLHAQVDAVRAAICRANYGKALEIRVSETGWPSQGDDDEAGATPENAARYNGNLMRMVMEGKGTPAAPGEALQVYVFALFNEDQKPGPASERHYGLFKPDGTPAYDVGVKAPTISGWKGSGSGSGNGTSGSAGLVVAQGPGGADGVGPGTGFYTVSASANKMKRRWQCAESLLVAAFLAMVSGLC

SEQ ID NO: 6871 - protein, 816 aa, Mesorhizobium loti MAFF303099
MTERLVIIGNGMAPGRMLEHLLEQAPSRYSVTIFNAEPRVNYDRIMLSPVLSGEKAYEEIIIHGDGWYIANNITLYKGHKIVAIDRAAKTVTSDHGVTEPYDKLVIATGSVPFIIPVPGHNLPGVLTYRDLDDVQAMMLAAQSRAKAVVIGGGLLGLEAAAGLNAQGMDVTVLHVMPTLMERQLDPAAGYLLQRAVEQRGIKVITKANTQAITGNGKVEQVELADGTVIPATLVVMAVGIRPNSALAKEAGIAVNRGIVVDAGMRSNDPDIYALGECAEVNGMVYGLVAPLYEMARVAAHQLAGNEAAAFVHMDTPTKLKVTGIDLFSLGDFAEGEDRQEIVLRDAAAGVYKRLVLKDDRIIGTVLYGETADGAWFNDLKKKQTDISQMRDTLIFGQSYQGGAPLDPMAAVAALPDDAEICGCNGVCKGKITGAITAKGLTSLDDVRAHTKASASCGSCTGLVEKLMVLTLGDSYNPAAVQPMCTCTTLGHDEVRRLIKAKHLKTIPAVMQELEWKTSCGCAKCRPALNYYLVCDWPDDYADDYQSRFINERVHANIQKDGTYSVVPRMWGGVTNAAELRAIADVVDKFEIPMVKVTGGQRIDMLGIRKEDLPAVWADLGQAGFVSGHAYAKGLRTVKTCVGSDWCRFGTQDSTGLGIRIEKFMWGSWTPAKVKMAVSGCPRNCAEATCKDVGVICVDSGYEIHFAGAAGLDIKGTEVLGLVKTEDEALEHIVALTQMYREQGRYLERIYKWAKRIGIPEIKRQIMDDDAKRKTYYERFVFSQKFAQVDPWSERVSGKDKHEFRPMASVGFAEAAE

SEQ ID NO: 6872 - protein, 424 aa, Escherichia coli CFT073
MLNLYAKKFRCPDVLTSINTMFTLVPDISPTKPRELHHMTRKQATIAVRSGLNDDEQYGCVVPPIHLSSTYNFTGFNEPRAHDYSRRGNPTRDVVQRALAELEGGAGAVLTNTGMSAIHLVTTVFLKPGDLLVAPHDCYGGSYRLFDSLAKRGCYRVLFVDQSDEQALRAALAENPKLVLVESPSNPLLRVVDIAKICHLAREVGAVSVVDNTFLSPALQNPLALGADLVLHSCTKYLNGHSDVVAGVVIAKDPDVVTELAWWANNIGVTGGAFDSYLLLRGLRTLVPRMELAQRNAQAIVKYLQTQPLVKKLYHPSLPENQGHEIAARQQKGFGAMLSFELDGDEQTLRRFLGGLSLFTLAESLGGVESLISHAATMTHAGMAPEARAAAGISETLLRISTGIEDGEDLIADLENGFRAANKG

SEQ ID NO: 6873 - protein, 972 aa, Mesorhizobium loti MAFF303099
MRTTCPYCGVGCGVLAKVAADGQVSVRGDPDHLANFGRLCSKGSALAETIGLDGRLLHPEIHGRRTGWNEALDIVASTFSQTIAEHGSDAVAFYVSGQLLTEDYYLANKLMKGFVGSANIDTNSRLCMASSVAGHRRAFGSDTVPGTYEDLERADLIVLVGSNVAWCHPVLYQRIAAAREKRPEMKIVLVDPRRTMTSDIADMHLAIAPDGDVALFTGLLAWLGQHNALDRAYITAHTTGFGQALFAASALDLAGVAAATGLSEDELGGFYSLFAATAKTVTVYSQGVNQSSSGTDKVNAIINCHLATGRIGKPGAGPFSVTGQPNAMGGREVGGMANMLAAHMEIENPEHRDRVQRFWNAPGIAQKPGLKAVEMFQGVADGRIKALWVMATNPVDSMPDADAVEAAIKACPFVVVSDVLASTDTVRHAHVRLPAAAWGEKDGTVTNSERRISRQRSFLSAPGEARPDWWIIAEVARRMGFGEAFAHETPAEIFGEHAALSGFENDGGRDFDIGAYAGIDSVSYASLEPFQWPAPSQGTPLWPAGHIPRKGGDQPSLLPSPIVNVSERVAGPKLPISPLEGGEEWSAQRTESQLLGFPNDERPERQRRAGTGRTEGGDQARHLQQANGTTERDPTRFFANGHFYTADRKARFIAIRPTTETRTTPDFPLILNTGRIRDHWHTMTRTGKSPRLSQHIAEPFVEIHPLDAQHHGIGDADIVRISSPRGDVLVRALITPRQRQGSVFAPMHWTDQFAAKGRLDALTAPLIDPVSGQPALKHVAARIEKFAAKAFAFAVMRRRPEAIAADYWAVARCRGGWRVELAFANDDADWTAFAGSLFEAPSTEMLAYHDRDAGQHRIAAFDGEHLTGALFVARGPVAVSRGWAAEQLEEVQASQRERFRIVAGRAGAERPDAGATVCSCFSVGANQIVAAVAAGCTTVEAIGGALKAGTNCGSCRSEIRALIQASRVQAAE

SEQ ID NO: 6874 - protein, 399 aa, Pyrococcus horikoshii OT3
MSVMSGDEVQFQGDYDDYITYLKRRIRQLELQVRMLEADKERLERELSRLRSEMSRLRQPPAFAGTVIEVLDEDRAIVQNYNGPRFVVRIAPWIDRKKLRPGTRVALDQRTMAVVEILPTSKDPTVLGFEVIERPNVTYNDIGGLKKQLQELREAIELPLKHPELFEEVGIDPPKGVLLYGPPGCGKTLMAKALAHEVNATFIRVVGSELVRKYIGEGARLVHELFELAKEKAPTIIFIDEIDAIGAKRMDETTGGEREVNRTLMQLLAEMDGFDPRGNVKVIAATNRPDILDPALLRPGRFDRLIEVPLPDFEGRLEILKVHTRRMKLKGVDLRAIAEMTEGASGADLKAIATEAGMFAIRERRTYVTQEDFLKAVDKVLGNERKLLQQITSHEVIYG

SEQ ID NO: 6875 - protein, 504 aa, Mesorhizobium loti MAFF303099
MTIAKETAELLAKLGVAKDALVGGDLIVRSPVTGEQIAALKTISPADAAKTIDAAHKAFQSWRLVPGPKRGELVRLLGEELRAHKAELGRLVSIEVGKIPSEGLGEVQEMIDICDFAVGLSRQLYGLTIATERPGHRMMETWHPLGVVGVISAFNFPVAVWSWNAALALVCGDAVVWKPSEKTPLTALACEAIFKRAVKRFGADAPQGLAPVLIGDRAVGEILVDHPKVPLVSATGSTRMGRDVGPRLAKRFARAVLELGGNNAGIVCPTADLDMALRAIAFGAMGTAGQRCTTLRRLFVHESVYDALVPRLKKAYQSVSVGNPLETSSLVGPLIDKAAFDAMQKALTEAAAHGGKVAGGARVENGHPDAYYVHPALVEMPKQVSPVTEETFAPILYVMKYSDFDAVLDEHNAVGAGLSSSIFTRDLQESERFLGVDGSDCGIANVNIGTSGAEIGGAFGGEKETGGGRESGSDAWKAYMRRATNTVNYSKALPLAQGVSFDID

SEQ ID NO: 6876 - protein, 256 aa, Oryza sativa
  misc_feature (51)..(52): Xaa can be any naturally occurring amino acid
GGETVSLCSSLPSSLPSLPMAAAAATAAAHLLSTPPLRPLQYTPLPMPASXXRPPDQRRRNPLLPHEGVRLFPPRFLSFPAAAAAPRVEPRGRPYLREHSCLIFPPSPRGRRPLAVVKFLGGAFIGAVPEVTYSHFLKLLAQEGFLVVSVPYNVTFDHEAAAREVYERFHGFYGALLSSGLPAAGLSAMDIAELPLYSVGHSNGALLQLLVGSYFSEKIPKANAIVSFNNRPASEAVPYFEQIGPLFSQVMPMMEA

SEQ ID NO: 6877 - protein, 445 aa, Bacillus pseudofirmus
MSADWSYLREKSASRLAPSMAKDHPNLPVVKEEGCYYYGVDGVKYLDFTSGIAVTNVGHRHPKIVQAIKEAADHLTHGPIGVIQYESILKLADELADILPGDLDCFFFANSGTEAIEGALKLAKFVTKRPYVVSFTGCFHGRTQGSLGVSTSKSKYRKFLQPNGLTYQVPYFKPSDPRILDEEGEVVESLACELLEEEFTNLFKYHVSSEEVAAVILEPVLGEGGYIIPPASWLAKVREICNRHDILLIFDEVQTGFGRTGEWFAAQTFGVTPDIMAIAKGIASGLPLSATVANHTLMQQWPLGSHGTTFGGNPIACSAALATLDVLKEENLLDNAREVGAYARERLNLLKEKYEMIGSIRSVGLMIGIEIIDPQTKKPDGAAVLRILDLALQEGVLFYLCGNEGEVIRMIPPLSVTKEQIDDGLDMLQRALVKYKEETHQPASL

SEQ ID NO: 6878 - protein, 348 aa, Neisseria meningitidis MC58
MKMQAVVVNKNVAGDVEVIEREVRPLEYGEALVEVEYCGVCHTDLHVAAGDYGEKPGRVLGHEGIGLVKEVADGVKNLKVGDRVSIAWLFQSCGSCEYCNTGRETLCRSVLNAGYTADGGMATHCIVSADYAVKVPEGLDPAQASSITCAGVTTYKAIKVSGVRPGQWIAIYGAGGLGNLGVQYAKKVFGAHVVAIDINDDKLAFAKETGADLVVNAAKEDAAKVIQEKTGGAHAAVVTAVSAAAFNSAVNCVRAGGRVVAIGLPPESMDLSIPRLVLDGIEVVGSLVGTRKDLEEAFQFGAEGLVVPKVQLRALDEAPAIFQEMREGKITGRMVIDMKKECGCGHHH

SEQ ID NO: 6879 - protein, 401 aa, Brucella suis 1330
MDAQLRERAERVIPNGMWGHQRASSLPQGYPQYFASGKDACVTDVDGNSYIDFMCAWGPIILGHRNPLVDAAALSQIELGDSLNGPTAHAVELAELLVATIPHADWALFQKNGTDATTSCVTIARGTTKRRKVLVAKGAYHGAAPWCTPSLVGVTAEDRVHLIHYVYNDVESLTAAAREAGDDLAAILVSAFKHDLAIPQESPTKEFAQAARALCDAAGAALILDDVRGGFRIDLGGSWRGTGIEPDMAAYSKAIANGYALAAVAGSDRFREAARQAYMTGSFWYGGASMAAAVATIKELRRIDGPALMKHAGERLRSGLDAQAARYGFDLLQTGPAVMPLVQFAGDSDAALGARFCQEALKRGVYLHHKHNMFISCAHTDDVINDALSRTEDAFKAISTK

SEQ ID NO: 6880 - protein, 280 aa, Triticum aestivum
MHIVPKLVLFHLCRNKIKILDAGALEPLLGYLQSSDLNLQEYAAAAILTLSASSTNKPIISASGAIPLLVKVLEEGNPQAKNDAVMALYNLSTIADNLQTILSVQPIPPLLELLRAGKRSSKTADKCCALLESLLAFDQGRVALTSEEGGVLTIVEVLEEGSLQGREHAVGALLTMCESDRSKYRDLILNEGAIPGLLELTAHGTPKSRVKAHALLDLLRNSPYSRSKLQPNTLENIVSNIASQIDGEDRGGKAKKMLAEMVKVSMEQSLRHLQRRASFA

SEQ ID NO: 6881 - protein, 317 aa, Bacillus halodurans C-125
MDVVTFGETMVVFEPVEMGALRYVDRFKKGVGGAESNVAIGVAKLGHSVGWVSKVGNDELGKYVISAIRGEGVDTSQVVLDDGAPTGLYLKEKLRDDFNRVYYYRAGSAASRLGVEDINWAYMKQAKIIHITGITPLLSDSCYELCHAVLDFAKENGIFASFDPNLRMKLLANVPDGKERLLALASKADLVMPGRDEAAFLFDTDELAQMFSRLLTGRTTSVVIKDGAKGAHFMEEGKEPQFVPSCPVDKVVDPVGAGDGFAAGVLASLLEGKSMEEAVSVGTQIGALVVMAKGDMEGLPEREQLEAFSQARSDVLR

SEQ ID NO: 6882 - protein, 412 aa, Zea mays
  misc_feature (166)..(166): Xaa can be any naturally occurring amino acid
  misc_feature (169)..(169): Xaa can be any naturally occurring amino acid
  misc_feature (223)..(223): Xaa can be any naturally occurring amino acid
MLLLPGRPALSPALQYSPSPSPSRLRPLPCTSNAPTSASTAADAATPSSFSVEDYLVIRCNLYANVAARVAPELSAIRSPSKPDAVLAFLANTLELSPPLIAVAVARDPTILTCSVPRTLAPRAEELCALGFTAFQMGLIVARCGAAAFRSRALVPSVQFWLPYLXWSXDKLVAALKGNPGLLTADLRTVKSTVALLQEEGTLTDGDVGWFAISYCSKLLVAXPDEVDSRLARADEFGVPRKTRAFKDAIIAAFSVTPERLAWKVAFFRDELGWTEAQVKTAAAKMPTLMTVSAERIRRNWEFLTTEVGMDAERVASFPALLRYDLEGRLVPRFQVMRVLQARRLWRGRDFNNIAAITEEDFVAKFIRPFLVKVPSLAKIYGAAVIEKEGPVAGWCIISGMLDNRRADDPCR

SEQ ID NO: 6883 - protein, 589 aa, Zea mays
  misc_feature (559)..(559): Xaa can be any naturally occurring amino acid
  misc_feature (574)..(574): Xaa can be any naturally occurring amino acid
MCGILAVLGCSDWSQAKRARILACSRRLKHRGPDWSGLYQHEGNFLAQQRLAVVSPLSGDQPLFNEDRTVVVVANGEIYNHKNVRKQFTGTHNFSTGSDCEVIIPLYEKYGENFVDMLDGVFAFVLYDTRDRTYVAARDAIGVNPLYIGWGSDGSVWIASEMKALNEDCVRFEIFPPGHLYSSAGGGFRRWYTPHWFQEQVPRTPYQPLVLREAFEKAVIKRLMTDVPFGVLLSGGLDSSLVASVTKRHLVETEAAEKFGTELHSFVVGLEGSPDLKAAREVADYLGTIHHEFHFTVQDGIDAIEEVIYHDETYDVTTIRASTPMFLMARKIKSLGVKMVLSGEGSDELLGGYLYFHFAPNKEEFHRETCRKVKALHQYDCLRANKATSAWGLEVRVPFLDKEFINVAMGMDPEWKMYDKNLGRIEKWVMRKAFDDDEHPYLPKHILYRQKEQFSDGVGYNWIDGLKSFTEQQVTDEMMNNAAQMFPYNTPVNKEAYYYRMIFERLFPQDSARETVPWGPSIACSTPAAIEWVEQWKASNDPSGRFISSHDSAATDHTXAVSRRWPTAAATAPXNGTVNGKDVAVAIAV

SEQ ID NO: 6884 - protein, 426 aa, uncultured bacterium 463
MSTSQQLFERASKHIPGGVNSPVRAFKAVGGTPVFIERSEGACIFDSEGKRYIDYVLSWGPMLMGHNHPAVREAVVRQSEKGLSFGAPTELETQLADRICNIMPNMDMVRMVNSGTEATMSAIRLARGYTGRDTIVKFEGCYHGHSDSLLVKAGSGALTLGVPSSPGVPAALADHTMTLTFNDPEGVRAAFAEHGDKIACVIVEPVAGNMSCIPPSPGFLETLREVCDNSGAVLIMDEVMTGFRFGLQGAQGFYGIEADLTALGKVIGGGMPVGAFGGKREIMEQIAPLGPVYQAGTLAGNPIAMAAGLATLEVISAEGFYEPVFKRTEQLCAGLREAANENGVAFTTNSAGTMFGGFFTESSKIENYAQVMACDTERFNRFFHMMLQAGIYLAPASYEAGFLSSAHTDADIEATVDAARSAFAAL

SEQ ID NO: 6885 - protein, 1113 aa, Rhodobacter sphaeroides 2.4.1
MGPQMPKRTDISSIMIIGAGPIIIGQACEFDYSGAQACKALREEGYRVILVNSNPATIMTDPGLADATYIEPITPEVVAKIIEKERPDALLPTMGGQTGLNTALALADMGVLEKFGVQLIGANREAIEMAEDRKLFREAMDRIGLENPKATIIAAPKLENGRYDINAGVAEAMAAIEYVGLPAIIRPAFTLGGTGGGVAYNRDDYEAICRSGLDASPVAQILVDESLLGWKEYEMEVVRDRADNAIIVCSIENVDPMGVHTGDSITVAPALTLTDKEYQIMRNGSIAVLREIGVETGGSNVQWAINPADGRMVVIEMNPRVSRSSALASKATGFPIAKIAAKLAVGYTLDELDNDITKVTPASFEPSIDYVVTKIPRFAFEKFPGSKPELTTAMKSVGEVMAIGRTFHESMQKALASLETGLSGFDEIEIPGAPDKAAVIKAISAQTPDRLRLIAQAMRHGLTEDEIQAATAFDPWFLARIREIVEAEAEIRAKGLPVTEAALRRLKMMGFTDARLAKLTGRDEGQVRRARRNLGVKAVFKRIDTCAAEFEAQTPYMYSTYEAPAMGDVECEARPSGAKKVVILGGGPNRIGQGIEFDYCCCHACFALTAAGYETIMINCNPETVSTDYDTSDRLYFEPLTLEHVLEILRVEQDNGTLHGVIVQFGGQTPLKLAQALAAEGIPILGTTPDAIDLAEDRERFQQLLHKLDLKQPHNGMARSRDEAFRIAGEIGYPLVIRPSYVLGGRAMEIVRDDAQLERYIREAVQVSGTSPVLLDSYLSGAIEVDVDALCDGENVHVAGIMEHIEEAGVHSGDSACCLPPHSLSAETIAELKRQTVEMARALHVVGLMNVQFAIKDGVIFVLEVNPRASRTVPFVAKATDSAIASIAARLMAGEPLSAFPVRAPYPAGVGPDTDLPLADPLTLADPITPWFSVKESVLPFARFPGVDPLLGPEMRSTGEVMGWDRSFALAFLKAQMGAGTHLPESGRVFLSVKDADKTAALAKAAAGLTAMGFEIVATKGTAAWLTGQGIASTSVNKVYEGRPNIVDRLKNGDITLVMNTTEGAQAISDSRDIRRVALMDKIPYFTTAAASIAAVEAMQARGEGYGVRTLQG

SEQ ID NO: 6886 - protein, 130 aa, Haemophilus influenzae
MDRLIRRTFYREQTMAEETIFSKIIRKEIPANIVYQDELVTAFRDISPQAKTHILIIPNKVIPTVNDVTEQDEVALGRLFSVAAKLAKEEGVAEDGYRLIVNCNKHGGQEVFHLHMHLVGGEPLGRMLAK

SEQ ID NO: 6887 - protein, 461 aa, Rhodobacter sphaeroides 2.4.1
MPAHRKRPMADFSTLGLSERLMQGLAKAQFTQPTPIQVEAIPYVMQGRDLMGLAQTGTGKTLAFGLPLLHRLLGVGHPPPPRTIRALILAPTRELVTQIATNLELFTKGTPVKVVTITGGASINRQTERLARGADIMVATPGRLIDLLDRNAVVLDHTGYLVLDEADQMLDMGFIHSLRKIARFLPLKRQTLLFSATMPKLIEELAHTYLREPVKVQVAPPGKPVEKIAQGVHFTPQGDKAKLLESYLQKHPGEQALVFGRTKHGSEKLMKLLVSWGFKAGSIHGNKSQNQRDRTLTEFRDGSLDVLVATDVAARGIDIPGVRHVYNYDMPNVPENYVHRIGRTARAGAEGSAVAFVAPAEMEEFRAVEKLLKQPIPVIGGAPWAADIVAAAPRPGQKPRQGGRPKTGAKPQGKPQAKAQPKPQGAAKAHPRAGRPAGAPGGHAAPKRAARGPRRGDAARG

SEQ ID NO: 6888 - protein, 1107 aa, Novosphingobium aromaticivorans DSM 12444
MPKRTDISSILIIGAGPIIIGQACEFDYSGTQAVKALKEEGYRIILVNSNPATIMTDPDMAHATYVEPITPEVVARIIEKERPDALLPTMGGQTALNTALALFNDGTLEKYGVQMIGANADAIDKAEDRQRFREAMDKIGLESARSGVAHTIDEALEVLERTGLPSIIRPSFTMGGTGGGIAYNKEEFVKIVKGGLEASPTTEVLIEESLLGWKEYEMEVVRDRKDNAIIICSIENVDPMGVHTGDSITVAPALTLTDKEYQIMRNASIAVLREIGVETGGSNVQFAVNPADGRLIVIEMNPRVSRSSALASKATGFPIAKVAAKLAVGYTLDEIMNDITGATPAAFEPTIDYVVTKIPRFAFEKFKGSEPLLGTAMKSVGEVMAIGRNIKESMQKALRGLETGLDGFNRVVELEGASRDEITAALARATPERLLVIAQAFREGLSVDEVHAVTKYEPWFLRHIHEIVSEEKAIQQDGLPNDAAGLRRLKAMGFSDKRLATLAVRSVGVAGGLGETQAKRSGLLHDTLRAMAGATSEDEVRALRHKLGVRPVFKRIDSCAAEFEAVTPYMYSTYEGALFGEPENEANPSDRKKIVILGGGPNRIGQGIEFDYCCCHACYALDEAGFETIMVNCNPETVSTDYDTSDRLYFEPLTAEDVLEILAVEQSKGELVGVIVQFGGQTPLKLAQALQDAGIPILGTSPDSIDLAEDRERFAALVARLGLKQPANGIARSRDEAVAVASRIGYPVLIRPSYVLGGRAMEIVDSQAQLDDYIATAVQVSGDSPVLIDQYLRDAIECDVDALADGDEVTVAGVMQHIEEAGIHSGDSACTLPPYSLPAEIVAEMERQAVLLARGLDVRGLMNIQFAVKDGEVYLIEVNPRASRTVPFVAKAVGQPIAKFAARIMAGEKLTDLPPIKREIDYMAVKEAVFPFARFPGIDPVLSPEMKSTGEVMGIDGTFAVAFAKSQLGAGVRLPQGGTLFVSVKDSDKPVVLPAVRKLAELGFRIVATGGTARYLSDEGVNVERVNKVAEGRPHIVDRIIDGEIALIFNTTEGWQSHKDSQSIRASALGAKVPYFTTAAASVATVEAIEALRTAELEVRSLQDYYG

SEQ ID NO: 6889 - protein, 289 aa, Streptococcus mutans UA159
MKDKIKSINQAIKHYYAQTHVSQDLIEAVLYSVDAGGKRIRPLLLLEILQGFGLVLTEAHYQVAASLEMIHTGSLVHDDLPAMDNDDYRRGQLTNHKKFGEATAILAGDSLFLDPFGLLAKADLRADIKIKLVAELSDAAGSYGMVGGQMLDIKGEHVQLNLDQLAQIHANKTGKLLTFPFVAAGIIAELSEKALARLRQVGELVGLAFQVRDDILDVTASFSELGKTPQKDIEADKSTYPSLLGLDKSYAILEDSLNQAQAIFQKLALEEQFNATGIETIIERLRLHA

SEQ ID NO: 6890 - protein, 369 aa, Triticum monococcum
MSSFAGLTVVANGKRCSDWTPDTGATDGSGYHLLLIQDYSRTRRQVTTGEHISSHPFTVGGHRWSVRYYPNGDKPNCAGFVSLYVDLLDDTFEKPIDVQFDFSFVDPAVKHKKPANIGESGTPVPDVFSQVNSAWGREKFIEKDAVERWAKHMGNYLAIRCDIVVVRDHAELVLPDIGQHLHHLLETELGADVRFEVGGELFAAHRYILAARSSVFRAQLFGPMKEGATTMPGAIVIEDMKANVYRAMLSFIYTDTLPTMEKAEEDEEGVMWLQDLLVAADRYDLQRLKFLCEEKLSEHIRVSTVASTLALAERHHCRMLKEACFQLLQVQTPSCLQEVMASSGWEHIVMAYPSVLNELIAKLISLNQK

SEQ ID NO: 6891 - protein, 227 aa, Neisseria gonorrhoeae FA 1090
MELVFIRHGQSEWNAKNLFTGWRDVKLSEQGLAEAAAAGKKLKENGYEFDIAFTSVLTRAIKTCNIVLEESDQLFVPQIKTWRLNERHYGRLQGLDKKQTAEKYGDEQVRIWRRSYDTLPPLLDKDDAFSAHKDRRYAHLPADVVPDGENLKVTLERVLPFWEDQIAPAILSGKRVLVAAHGNSLRALAKHIEGISDEDIMGLEIPTGQPLVYKLDDNLKVIEKFYL

SEQ ID NO: 6892 - protein, 240 aa, Triticum aestivum
MATDRRIQPARSGGGGGSSPGGGGVEPGLGRRLLHVLRAVYHMLRRGLCRKRLMMDLHLLLGRGKLAGRHFRDLLAHQPLAGGHRFGAAAAAGASPSALSMYQHDPRDVEFSCGSTPVHEQAVFPFKIGRGRGRGRSYGGLDAATVAAAFEMMNAHAAGNSGGDTPGVSRATPSPMLALSLGRCPAGARQLRVTDSPFPVEPEGVDERVDAEADSFIKRFYEQLKMQQSTTPDNCTRRRG

SEQ ID NO: 6893 - protein, 247 aa, Oryza sativa (japonica cultivar-group)
MADYEQEQEMEVEALQAILMDDIKEIDPSESGLSTTARCFQIVLSPQDDDFDESAYVPVQLALIFAHTEKYPDEPPLLNVKSVRGMKSEDLASLKEKLEQEATENLGMAMVYTLVTSAQDWLSEKYGQNAGDGESEENEAEEEEVIVPHGEAVTVESFLAWRDRFEAELALQRAKLMPESALTAPKEKKLSGRQYFESGRHTMKGASTTADEEEEEEEDIDFDEDFDDDEEDMLEHYLAEQSGKSAA

SEQ ID NO: 6894 - protein, 140 aa, Rhizobium leguminosarum bv. viciae 3841
MAIERTFSMIKPDATKRNLTGAITKMLEDAGLRVVASKRVWMSRREAEGFYAVHKDRPFFGELVEGMTSGPTIVQVLEGEGAILKNREIMGATNPANADEGTIRKVHALSIGENSVHGSDAPETAAQEIKYWFSDTEIVG

SEQ ID NO: 6895 - protein, 512 aa, Triticum aestivum
MSDLLFCFSSFPLTAQAESIVKHVASGGSWHGLHSFSEASARGFSSEPSLQAHSTEEIGFKGHGMLAPFTAGWQSTDVHPLVIDRSEGAYVYDINGKKYIDALAGLWCTALGGSEPRLVKAATEQLNKLPFYHSFWNRTTKPSLDLANDVLSMFTAREMGKVFFANSGSEANDSQVKLVWYYNNAMGRPDKKKFIARSKSYHGSTLISASLSGLPALHQKFDLPAPFVLHTDCPHYWRFHLPDETEEEFSTRLANNLENLILKEGPETIAAFIAEPVMGAGGVILPPKTYFEKIQAVLKKYDVLLIADEVITAFGRLGTMFGCDMYNIQPDLVSIAKALSSAYMPIAAILVSPEIADVVHSQSSKLGSFAHGFTYSGHPVACAVAIEALKIYKERNITEHVNTIATRFQEGIKAFSGSPIIGEIRGLGLILGTEFADNKSPNDPFPAEWGVGSIFGAECEKRGMLIRVAGDNIMLSPPLIMTPDEVEEIVSKYGGALKATEERIEELKSAKR

SEQ ID NO: 6896 - protein, 280 aa, Pyrococcus horikoshii OT3
MRDMEFIEWYPRGYGVAFKVKRKILEEQSEYQKIEVYETEGFGKLLAIDGTVQLVTEGEKSYHEPLVHPAMLAHPNPRRVLIIGGGDGGAIREVLKHEEVEEVIMVEIDKKVIEISAKYIGIDGGILEKMLSDKHEKGKLIIGDGVKFIEENSGFDVIIVDSTDPVGPAEMLFSEEFYKNAYRALNDPGIYVTQAGSVYLFTDEFLTAYRKMRKVFDKVYYYSFPVIGYASPWAFLVGVKGSIDFMKVDAEKGKKLGLEYYDPDKHETLFQMPRYIVQML

SEQ ID NO: 6897 - protein, 536 aa, Kluyveromyces lactis NRRL Y-1140
MKPIVGSLPFNARIAVVGGGVSGLTFTYFLSKLRPDVKVTLYEKQDRCGGWIHSDIIDDGEGNRVMVEKGPRTLRGVSDGSVIIVQTLRDLGKQDVVQYIAADSEANRKFLLDKNNVLTQVPDSPISALKFFAGSLGKGFISGILGEPFRSAKVTGTDESAHSFIHRRFGNEHISKNVFSALFHGIYAGDIKKLSAKRTIGKMVEMENTSGSLIKSMFNKMIIKYKNRNDTRSHKIEISPLLKKFAEATGQSEKQLISLSQRLKAFPMVGFRSGLDCYPKTLSEYITGLPNVSVKHEAVESVIPGKDGKNVVIVSDSGESTFDHARLTVNPNVLENIIPFEPLAKKLREVHSNTVILVNFYLPRKDVISNYHGFGYLVPQSNQNHEKLLGVIFDSVIEKNFKPVFGVQNESKSPDDDKRYTKVTAMLGGHYLNNEGEQNIPSKSIIINSVKYAFMKHLHIDENDLEDGTWEVTVAKDCLPQYHVGYDDWVQQTAKLVQEQYSNYVSLGGMAFSTGPGVPNVIEDGFESAYVLSKAE

SEQ ID NO: 6898 - protein, 294 aa, Bacillus halodurans C-125
MKTPNITVVGSINMDMVTITDVVPVQGETVLGKDFRTVPGGKGANQAVAAARLGANVRMIGRVGDDPFGHVLTENLAKEGIITDSVKPVTDCTSGVATILLSDRDNRIIVTKGANEHVTPDYVAAFEQELAASDVVLLQLEIPLETVAYVLEFCAKHHVTTVLNPAPAQKLPDAAWTDATYISPNENECLQLFGDEPDANLRQKLIMTKGADGVQFYENDEQVQVESFRVEPVDTTGAGDTFNGAFAVALGGGTVKEAVRFANAAAALSVQSFGAQGGMPTKAQVQSFLQEQGG

SEQ ID NO: 6899 - protein, 522 aa, Triticum aestivum
KHLPTPLITMSISFSQELLISTLAIILLPLMLYLRSSRSKNPSVLPINWPIVGVFPYLIANFHNLHDYLAVVLAGSGHNFRAHGPPGTGLRFFITCEPANVRHIFTTNHANFPKGAEFAAIFDIAGGSFFTTEGEPWRRQRARAQRVLSNPRLLACMTACCRDKVENGLLPVLMHMASTGTTFDLQDLTIRLVLDMTATPLFGVDPGLLSSDMPPMDAAVAMDTVMEVALFRHIVPTSGWKVMRRLNIGPERKLAAAHTVLRGFIEEMMERRKRKEHAGNEGAPSVDILSSYIDDPDYQQNDGLLHATLINYMIAGRDTIGTALTWVFYNLAQNPHVVSFIRHELSPIASQKAATGANNSSTMVIFEPEETKSLVYMRAAIHESLRLHPPVPIERKTAVAHDVMPSGHVVHAGDTLLISLHSMGRMEGVWGKDCREYNPDRWLSEDGKKLRYVPSYNFLSFSSGPRLCLGKDVSFMQMNTIVAAMVWNFDVEVVEGQRVQPKMSCVLQMKNGLMVKLKKREM

SEQ ID NO: 6900 - protein, 308 aa, Kineococcus radiotolerans SRS30216
MPTATAAQPLRPFGTVLSAVVTPFTASGAVDLDAAAALAVHLVEHGHDGLVVSGTTGESPTTSDEEKDRLLRAVLDAVGDRVHVLAGVGTNDTAHTLELARAAEKAGAHGLLVVTPYYNKPPQAALAHHFTTVADGTGLPVMLYDIPGRSGVPIETETLVRVAEHERIVAVKDAKGDSWGTSWVLARTELAYYSGDDAVNLPLLAQGASGIVSVVSHVAGREYAAMVAAVDAGDLVTARAIHTRLLPAVRGIMTRTQGVVAVKAALELTGVLSGRAVRPPLLPATPEEVAALAADLALAGLAPAPLDA

SEQ ID NO: 6901 - protein, 433 aa, Carboxydothermus hydrogenoformans Z-2901
MARRIIQVEEKLPLLETLPLSFQHLMAMFGATVLVPLLFKIDPAIALLMNGIGTLLYTYITRGGIPAYLGSSFAFIAPTLLIMSKWGYPVAQSGFIFFGLFFIVVSGIIYIAGTKWIDIVLPPPVMGAVVAVIGLELAPVAAQMAGIAPSGQNWTMNPKVVMVSMFTLLVAIIGSVVFRGFLQIIPVLIAIIAGYFFAWTQGMVDFSLVAKAPWFKIPTFSTPQFNLNAIIVMAPAALVVLAEHIGHLIVTGNIVERDLVKKPGLHLSLFADGVTNVISGFTGSPPNTTYGENIGVMAITRVYSVWVIRGAAVLAIILSLIGKLAAAIQTIPRPVMGGISLLLFGVIAVSGIRMLIEQMVDYGKNVNLVLSAVVFIVGVSGAKVTLGTVEIKGMALAAVVGVILSLIIHGLNYLGLLNENLTVSENLVRKNES

SEQ ID NO: 6902 - protein, 228 aa, Nostoc punctiforme PCC 73102
MLAAILFDLDGTIVNTDPIHYRAWREMLLNYSLEIDETFYKSRISGRLNPEIVKDILPQLSTTEGQKFADEKEALFRKLASNLKPLNGFSELLAWTETHELKRALVTNAPRLNAEFMLEVLGIKEAFHTVVVADDCVAGKPDPAPYQVALNKLAISAEEAIALEDSPSGIRAAVSADIRTIGIASTHDPQFLQEVGAFMAIPDFTDLQLWTLLNSLIEPDLSAIASNL

SEQ ID NO: 6903 - protein, 370 aa, Saccharomyces cerevisiae
MLLGYCGSGYYGMQYNPPHKTIEGEILTKLFDVGAISEENSLAPKKNSFMAAARTDKGVHAMLNLLSLKITLREDTVAKLNAALPPEIRVWGIQPVNKKFNARSACDSRWYQYLIPEFILIGPPRSSLLHRNVGGCYREDGSQEVWDTFLEQTRGRFSGDELCRLQDTAQKLSESDPLVQDYVGLLSGTLSGYCLSPSKLDAFEAAMQEYVGTHNFHNFTTGKLWGDPSAQRHIKKVVVSQASPGWICVRIHGQSFMLHQIRRMVALAVLAARCQLPPNIVRNYFNAGPRKYIPRAPAQGLLLEGPVFDGYNTKLRNLLYCEIRPDDITLERMCRFRERQICTAIAHEETQRHVFCHFVRQMNRLATPLI

SEQ ID NO: 6904 - protein, 358 aa, Cordyceps bassiana
MAEFVRAQIFGTTFEITSRYSDLQPVGMGAFGLVCSARDQLTNQNVAVKKIMKPFSTPVLAKRTYRELKLLKHLRHENVISLSDIFISPLEDIYFVTELLGTDLHRLLTSRPLEKQFIQYFLYQIMRGLKYVHSAGVVHRDLKPSNILVNENCDLKICDFGLARIQDPQMTGYVSTRYYRAPEIMLTWQKYDVEVDIWSAGCIFAEMLDGKPLFPGKDHVNQFSIITELLGTPPDDVINTIASENTLRFVKSLPKRERQPLRNKFRNADDSAIDLMERMLVFDPKKRITAAEALSHDYLAPYHDPTDEPVAEEKFDWSFNDADLPVDTWKIMMYSEILDYHNVEAGASGLEDGSVPAQ

SEQ ID NO: 6905 - protein, 565 aa, Pseudomonas putida
MQAMCHPYLRASTHQCQRNLLWRAYATGITCPGFTLFSIERVLTVDENNNVNLGTLSSRSARYWPERLAVIDRHTRLTFAQLEQRANQLASALLAQGIATGEHVAILAPNRAELVEAEVAFYKAGLVKVPVNARLAPDEVIQVLNDACSVALIADAQLAQALLDRRQEVPSLRLIVTLGERGGDITYAALLAQGSSQPISCDLPDDALAVLHYTSGSSGVLKAAMLSVGNRKALIRKSLASPTRRAAPGDVMAHVGPITHASGMQLMPLLAVGACNLLLERYDDQLLLETIQREGVTRLFLVPAMINRLVNFPDVERYDLNSLRLVMYGAAPMAPALVKRAIEVFGPILAQGYGAGETCSLVTVLTEQDHLCEGGDYRRLASCGRCYFETDLRVVNDHFQDVQPGEVGEIVVKGPDIMQGYWRAPHLTAEVMRDGYYLTGDLATVDEQGYVFIVDRKKEMIISGGFNIYPSEVEQVLYSMPQVFEAAVVGVPDEQWGEAVRAVIVLKPGMALQEQDVIEHCAQALAGFKKPRAVDFVSELPKNPNGKVVRRLIRDAYWQNSERRI

SEQ ID NO: 6906 - protein, 230 aa, Streptococcus mutans UA159
MVKLVFARHGESEWNKANLFTGWADVDLSEEGTQQAIDAGKLIKEADIKFDLAFTSVLTRAIKTTNLALEYSDQLWVPVEKSWRLNERHYGGLTGKNKAEAAEKFGDEQVHIWRRSYDVLPPAMAKDDPYSAHTDRRYANLDDTVIPDAENLKVTLERALPYWEDKIAPALKDGKNVFVGAHGNSIRALVKHIKQLSDDDIMGVEIPNFPPLVFEFDENLNVTAEYYLGK

SEQ ID NO: 6907 - protein, 238 aa, Triticum aestivum
  misc_feature (231)..(231): Xaa can be any naturally occurring amino acid
MSDSKKEGAYGGAPSGDTDFRKTWDLEEYAAKGKEREAKEKEEGKARYEAKLAGKKYFKPLTGDETYTSARRHVIDFTQQIGKTQLVPGGAGVGKRGRGAGQYCEACDLTFKDNRQYIEHITTPQHLMNTGQTMNVKRATAEEVHERIEAYIRRQEDLEKEKQTSLHERLQLREEEAEKEAEERRKRRRDEMERKRLKQEEATKVKTEYGEDVRIEGEHDEDDMMASMGFXGFGTSKK

SEQ ID NO: 6908 - protein, 487 aa, Arabidopsis thaliana
MQPWRRKFPLFETGVTMKQRKNSNLSIFVVVFSVFLFGIFMYNEDVKSIAEFPFSTSKPHDVHDEATPITEITTLPVQESIKNSDPIQESIKNADSVQDSVKDVAEPVQEEVSKTEEVKKIELFAATEDEEDVELPPEECDLFTGEWVFDNETHPLYKEDQCEFLTAQVTCMRNGRRDSLYQNWRWQPRDCSLPKFKAKLLLEKLRNKRMMFVGDSLNRNQWESMVCLVQSVVPPGRKSLNKTGSLSVFRVEDYNATVEFYWAPFLVESNSDDPNMHSILNRIIMPESIEKHGVNWKGVDFLVFNTYIWWMNTFAMKVLRGSFDKGDTEYEEIERPVAYRRVMRTWGDWVERNIDPLRTTVFFASMSPLHIKSLDWENPDGIKCALETTPILNMSMPFSVGTDYRLFSVAENVTHSLNVPVYFLNITKLSEYRKDAHTSVHTIRQGKMLTPEQQADPNTYADCIHWCLPGLPDTWNEFLYTRIISRS

SEQ ID NO: 6909 - protein, 394 aa, Zea mays
  misc_feature (351)..(351): Xaa can be any naturally occurring amino acid
  misc_feature (362)..(362): Xaa can be any naturally occurring amino acid
VRPAEGKPQQINRPITRSFGAQLVKNVQANAAIKNAAILPARHAPRQERKAPAKQPPPEDVIVLSSDSEQSRTQLESSASSVRSRKKVINTLSSVLSARSKAACGITDKRRQVVVIEDIDKLDVNNELAVVEYIEDIYTFYKIAQHDRRPCDYIDTQVEINPKMRAILAGWIIEVHHKFELMPETLYLTMYIIDQYLSLQPVLRRELQLVGVSAMLIACKYEEIWAPEVNDFILISDSAYSREQILSMEKGILNSLEWNLTVPTVYMFLVRFLKAATLGNKVEKEMENMVFFFAELALMQYGLVTRLPSLVAASVVYAARLTLKRAPLWTDTLKHHTGFRESEAELIECTXRCWSAHTRRPXADSKLRAVYKKYSSEQFGGVALRPPAAAVEIK

SEQ ID NO: 6910 - protein, 210 aa, Eucalyptus occidentalis
MVRGKIQLRRIENTTSRQVTFSKRRNGLLKKAYELSVLCDAEVAVIIFSQKGRPYEFSSNSEIQKTIDRYRRSTYDMDTYKTNLDQCILHLKQETTDMERKIELLEVSLRKLSGECLGSCSIDEIQMIGDQLERSLSSIRARKAQLFDDQIQHLQAKERSLKEENAKLLAKCLANPGQSTAHPRAAALHSRSSRSTDVETRLFIGLPELN

SEQ ID NO: 6911 - protein, 180 aa, Potamogeton crispus
YMFVQCPAVSSFEWHPFSITSAPGDDYLSIHIRQLGDWTRELKRVFTEACEPPVTGRSGLLRADETTKKSMPKLMIDGPYGAPAQDYRKYDVLLLVGLGIGATPLISILKDLLNNIIKSEEQADSNSDLSRSTDASPWSFDSTSGNRVSPKRKKTLKTTNAYFYWVTREQGSFDWFKGVM

SEQ ID NO: 6912 - protein, 419 aa, Oryza sativa (japonica cultivar-group)
MPATDYQGSSSTHSHPSPFSSFGRSLLSLRRDSPAAAAGASPAMASGEEADLEAFQRHVAAHLADLRGGEDELLSIEWIRRLLEAFLLCQEEFRVVVALARRRGALSAAAEKMVGDFYERAVKALDVCNAARDGVDQVRRWERLAGIAASVLLAPGEIHEGQLRRARKALSDLSVLLIDDAAAAAGGGGVASFLSSHRNRSFGRARASPSRSATLASSSSSSSSSSSSSHFRSLSWSVSRNWSAARQLQAIGSGLAAPRAHEGGLVAPVYSMGCLLHLAAWALVAAVPCPDRAAALQAHHLPAAPPRAAFPWAPPLLALQERLTEEGKRKDRRNSCGLLKEIHALEKCTQRLAEAIDAAPVPLSGEREAEVREAAAELAAVCAAMRAGLEPLERQVREVFHRIVRSRMEGLDSPMLNAD

SEQ ID NO: 6913 - protein, 672 aa, Ustilago maydis 521
MTYENNTHQQNGAGTADIESRFANMSVQNGAAGGAPRKAYVPPHLRSQQQPASLNSSAASFSPRAPAAFNGNGNSNGNGNGPAAPAAPAAFQSFNRGAPRGGAGGWDAPSSGGYGGARNGGGYGGGARNDGFGQWKDGKHVPGPHNPRLQKELFGEEGDGLHQSMGINFDKYGDIPVEATGRDVPEPVTTFTSPPIDAHLLENIKLARYTNPTPVQKYSIPIIKLGRDLMGCAQTGSGKTGGFLFPILSALFTHGPPPPSAAEMAQGGYNRRKAYPSTLILAPTRELVSQIHDEARKFTYRSWVKPAVVYGGADIVTQLRQIERGCDLLSATPGRLVDLMERGRISLSNVRFLVLDEADRMLDMGFEPQIRRIVEGEDMPGVMDRQTLMFSATFPRDIQLLAKDFLKEYVFLSVGRVGSTSENITQKIEYVEDDDKRSVLLDVLASMPSGGLTLIFVETKRMADMLSDFLLRSKIGATSIHGDRTQRERERALELFRSGKTPIMVATAVAARGLDIPNVTHVVNYDLPSDVDDYVHRIGRTGRAGNVGHATAFFNRGNKNIVRDLIELLKEANQEVPQWLEAVARESMFGAGGGSRGGRGRGRGRGGASSFGNRDARTMNGPSSGGGRGFGGGYGGGMGGGLGGSYGAGAAAYGGPPPASNGGSYGGNSSWW

SEQ ID NO: 6914 - protein, 1739 aa, Oryza sativa (japonica cultivar-group)
MTSGGDSFVRMMSEDTDVEVLMPNEDLRTSTNGAKGSAKRSSNYTRKEDIQLCISWQSISSDPIIGNEQPGKAYWQRIAEHYHANRDFESDRNANSLEHHWGNIQKEVSKFQGCYNQIERHHPSGIPHQELVLEAEALYSSTAPKNRAFQFNHCWLKLRNSPKFQTLESHKRPRSRKSLTPIERAGEEDEGDDASKSTAPDLSQPSAKKRPIGRKQAKEKLKNGGEDGPYKEAMKDLLDAKEKEAKLKEERWKETKEIQERKLLFAERKLVWDQEQKIMFCDVSTLEPDVRTYVLAMRAQIAASKVAALNGGFDGSSGFGDIESPKYISSDEDINTIDTSMSPHIQHDGPITRARARQLNYQDECPRGRVDAHHKFAATIGDGPEDKDEEGASHSPRTKGIIQYFTRQESTQISTNTKLTGLETAVARIDTSLAALVRHFDALNAGGNGGGNDDDIDGEYIEDNLEDEYIADTEQDDRDAQDRRRLHNNRRGMGGRRRREVRNNDDAFSKIKFKIPPFDGKYDPDAFLSWEIAVDQKFAYHEFPENTRVRAATSEFTDFASVWWIEHGKKNPNNMPQTWDALKRVMRARFVPSYYARDLLNRLQQLRQGAKSVEEYYQELQMGLLRCNLEETEDTAMARFLGGLNREIYDIVDYKDYTNMTRLFHLACKAEREVQGRRASAKANFSAGKTSSWQTRTTPPAGRTASPSSTPTTSRAAPPPSSDKSVTKAAQPAPSASSMVSTGRMRDVQCHRCKGFGHVQRDCPSKRVLVVKNDGEYSSASDFDDDTLALLAADHADNEPPEEHIGAAFADHYESLIVQRVLSAQMEKAEQNQRHTLFQTKCVLKERCCRMIIDGGSCNNLASSEMVEKLALSTKPHPHPYYIQWLNNSGKVKVTKLVHINFAIGNYHDVVECDVVPMQACNILLGRPWQFDRDSMHHGRSNQYSFLYHDKKIVLHPMSSEDILRDDVAKAAKSKCESDKKAQSDGKKPETINLKPKCLLATKSDITELIASPSVAYALEYSDVFPKEVPPGLPPVRGIEHQIDLIPGASLPNRAPYRTNPEETKEIQRQVHELLDKGYVRESLSPCAVPVILVPKKDGSWRMCVDCRAINNITIRYRHPIPRLDDMLDELSGSIVFSKVDLRSGYHQIRMKLGDEWKTTFKTKFGLYEWLVMPFGLTNAPSTFMRLMNEVLRPFIGKFVVVYFDDILIYSKSMGEHFNHLRAVFNALRDARLFGNLEKCTFCTDRVSFLGYVVTPQGIEVDQAKVEAIQSWPTPKTVSQVRSFLGLAGFYRRFVQDFSTIAAPLNALTKKGVPFTWGTSQENAFHMLKDKLTHAPLLQLPDFNKTFELECDASGIGLGETWQHYLWPKEFVIHSDHESLKHIRIQGKLNRRHAKWVEFIESFPYVIKHKKGKENIIADALSRRYTLLTQLDYKIFGLETIKDQYAHDADFNDEAHGGSLMGHFGAKKTHDILASHFFWPQMRRDVGRAVLKKNIKMWEECLPHIEFAYNRSLHSTTKMCPFQIVYGLLPRAPIDLMPLPSSEKLNFDAKQRAELMLKLHETTKENIERMNAKYKFAGDKGRRELNFEPGDMVWLHLRKERFPDLRKSKLMPRADGPFKVLAKINENAYKIDLPADFRVSPTFNVADLKPYLGEEDELESRTTQMQEGEDDEDINTIDTSTSPHIQHDGPITRARTRQLNYQDECPCGRVDAHHKFAATIGDGVSVAKVQRLWTVVVGP

SEQ ID NO: 6915 - protein, 249 aa, Streptomyces rochei
MGQLDGKTAVVTGGNSGIGLASAKRFAAEGAHVFITGRRQEALDAALAEIGPNATAVRSDISDPADIDRLYAAVADQGRRVDVLFANAGGGEFSTLEQVTEQHFDTTFDTNVRGTLFTVQKALPLLNDGASVILTGSTAATSGGEAFGVYAASKAAIRSFSRTWANELRHREIRVNTLVPGPIETPGNAGLAPDADEATKLWGFFASQVPLGRMGRPDEAAAAALFLASDQSSFITGTELFVDGGLNQI

SEQ ID NO: 6916 - protein, 252 aa, Triticum aestivum
  misc_feature (143)..(143): Xaa can be any naturally occurring amino acid
  misc_feature (177)..(177): Xaa can be any naturally occurring amino acid
  misc_feature (185)..(185): Xaa can be any naturally occurring amino acid
  misc_feature (200)..(200): Xaa can be any naturally occurring amino acid
  misc_feature (218)..(218): Xaa can be any naturally occurring amino acid
  misc_feature (228)..(228): Xaa can be any naturally occurring amino acid
MGRKFFVGGNWKCNGTVEQVESIVNTLNAGQIASTDVVEVVVSPPYVFLPTVKAKLRPEIQVAAQNCWVKKGGAFTGEVSAEMLVNLGVPWVILGHSERRSLMGESSEFVGEKVAYALAQGLKVIACVGETLEQREAGSTMEXVAEQTKAITGKIKDWTNVVVAYEPMWAICTGKVXTPAQAQEXHCNLRELLKDHVKPXEVLHPHRSFIGGSGTGAXCKDWAGQPQXQGFLCWGSFLLNLGLYDIINGPHR

SEQ ID NO: 6917 - protein, 313 aa, Streptomyces rochei
MPVPAVDPEIRTLLETADTGIFPVYGLDAVLADPQPYALLRAYPDTPADDQVTVLDLHIPGPAGGDLRVRVYRPDTTEVLPVILYITRRRLHYGSPEAEEGRSLRYARDARAVVVSVDYRLAPEHPYPAAADDAYAALIWIAANPAELGGDRARIAVAGGSAGGNIAASTVLRARDQAGPHILFQLLTYPGVDGSLTSASVREFTDTPVLNRGAMELAWQYYAKDTHPHPYASPIRATDLGALPPTYIAVAEIDPLRDEGRDYAARLSAAGVTTELVQVPGAVHGFDILFPSARISERSLADQVRALHDALHP

SEQ ID NO: 6918 - protein, 76 aa, Arabidopsis thaliana
MAVTSKLFWRTTAIHSRRRRRKTSKGYNDITFITSNGGRDNCMQVWPSIGKKKFETISYLPDLTDYELANESDYLI

SEQ ID NO: 6919 - protein, 502 aa, Silicibacter pomeroyi DSS-3
MPDLSTRLADLDRHLQRFRRDGVMNRIGGQDVPGGAGRFDSISPVDRSVICSVARGDAADMDAAARAAHAAFPAWRDMPATERRAILIRIAEGIEARAEEIALCECWDTGQAWRFMSKAALRGAENFRYFADQVVQARDGQHLKSPTLMNITTRVPIGPVGVITPWNTPFMLSTWKIAPALAAGCTVVHKPAELSPLSARLLIEIAEEAGLPPGVLNLVNGFGEDAGKALTEHPLIKAVAFVGESRTGSLIVKQGADTLKRVHLELGGKNPVIVFDDADTERALDAVIFMIYSINGERCTSSSRLLVQDTIREEFEARLVERVNNIKVGHPLDPTTEIGPLIGEEHFAKVTSYFDIARQDGATVAAGGEVVGDQGYFVRPTLFTGANNRMRIAREEIFGPVLTAIPFSTEEEALQIANDTPYGLTGYLWTNDLTRALRFTDKLEAGMIWVNSENVRHLPTPFGGVKASGIGRDGGDWSFEFYMEQKHIGFATGQHKIQRLGA

SEQ ID NO: 6920 - protein, 477 aa, Bordetella pertussis Tohama I
MTESTSSDAPVTDAPTRTFADFGLHPLLLKLIADTGYTNPTPIQAQAIPVVVEGRDVMGAAQTGTGKTAAFTLPILHRLMPLANTSASPARHPVRALILTPTRELADQVYESVKRYSLHTPLRSAVVFGGVDIGPQKEALRRGCEVLVATPGRLLDHVEQKNVNLSQVGILVLDEADRMLDMGFLPDLERIIRLLPAQRQGLLFSATFSNEIRKLGRSYLNHPVEIEVAARNATADTVTQIAYQMHGDTKRAAVVHLVKSRGLKQVIVFSNTKIGTARLARQLERDGVKAESIHGDKTQGDRMKALEAFKAGDLEVLVATDVAARGLDVAGVPCVINYDLPYNAEDYVHRIGRTGRAGASGEAIALFTADEERYLLDIEKLIKRQVPRGKLELPADLVARSHGRDRDAPRERGADRHRGERCTSGAAAPRQPVDELFYKPYEPANGQPASPETPEQEGRSNAPKRQLAVLLGGSRKG

SEQ ID NO: 6921 - protein, 545 aa, Glycine max
MELSPQEFIFRSPLPDIPIPTHLPLYSYCFQKLSQFHDRPCLIDGDTSETLTYADVDLSARRISAGLHKIGICQGDVIMLVLRNCPQFALAFLGATHRGAVVTTANPFYTPAELAKQAMATKTRLVITQSAYLEKIKSFADDSDVMVMCIDDDYSSENDGVLHFSTLTNADEREAPAVKINPDDLVALPFSSGTSGLPKGVMLSHENLVTTISQLVDGENPHQYTHSEDVLLCVLPMFHIYALNSILLCGIRSGAAVLIVQKFEITTLFELIEKYKVTVASFVPPIVLALVKSGETHRYDLSSIRAVVTGAAPLGGELQEAVKARLPHATFGQGYGMTEAGPLAISMAFAKVPSKIKPGACGTVVRNAEMKIVDTETGDSLPRNKHGEICIRGTKVMKGYLNDPEATERTVDKEGWLHTGDIGFIDDDDELFIVDRLKEWIKYKGFQVAPAELEALLIAHPNISDAAVVGMKDEAAGEIPVAFVVRSNGSEITEDEIKTYISQQVVFYKRIGRVFFTDSIPKAPSGKILRKVLTARLNEGLVVAN

SEQ ID NO: 6922 - protein, 112 aa, Idiomarina loihiensis L2TR
METVDRIKQQIEENPILLYMKGSPKLPSCGFSSQASQALMGCGQAFAYVDILQNPDIRAELPKYANWPTFPQLWVEGELVGGCDIIMEMFQNGELQELVSEVAERHPEPSAE

SEQ ID NO: 6923 - protein, 600 aa, Triticum aestivum
  misc_feature (523)..(523): Xaa can be any naturally occurring amino acid
MKFMKLGSNPDTFQDDGSEVRIVETELVSDITVRLGNTKFYLHKFPLLSKCARFQKLIPTTGDENIDIHIHDIPGGPKAFEICAKFCYGMVVTLNAYNVVAARCAAEYLGPPATGDVGPPLPQIDVFLSSSIFRSWKDSIIVLGTTKAHLPWSEDLKLVSHCIDSIASKANVDTSKVEWSYTYNRKKLSAENDLDMQWNGVKKQPAVPKDWWVEDLTDLDIDSYKQVISAIKTMGMVPKDAVGEAIKAYTYKKLPSLSKVSMIHGDGKVRAMLVTITCLLPSEKGSVSCSFLLKLLRATNLLKCGEMCRKELVKRIGRQLDEASVSDLLIPTVDGETTGYDIDMILSIVEEYVRQDSKNAQKHNAEVNGHVQAPSASMITVAKIVDGYLTEVAKDPNTPVLKFINLAEAISGNSRPFHDGIYRAIDMYMKEHPSLSKSDKKKLCCLMDCKKLSPEACAHAVQNERLPLRTVVQVLYHEQTRASAAATVRADSICIGSYESSRSGATTNTEDEWDGVIAVEDLXPFIKDHEPGEMPQRREEPRAAAGAPPTARPWAARPQNGLGKILPGAYGWEKRTLEPIWGPGHPRGPSGTQTPGCATP

SEQ ID NO: 6924 - protein, 126 aa, Streptococcus pneumoniae TIGR4
MAKTIHTDKAPKAIGPYVQGKIVGNLLFASGQVPLSPETGEIVGENIQEQTEQVLKNIGAILAEAGTDFDHVVKTTCFLSDMNDFVPFNEVYQTAFKEEFPARSAVEVARLPRDVKVEIEVIAEIG

SEQ ID NO: 6925 - protein, 195 aa, Streptococcus pneumoniae TIGR4
MELNTHNAEILLSAANKSHYPQDELPEIALAGRSNVGKSSFINTMLNRKNLARTSGKPGKTQLLNFFNIDDKMRFVDVPGYGYARVSKKEREKWGCMIEEYLTTRENLRAVVSLVDLRHDPSADDVQMYEFLKYYEIPVIIVATKADKIPRGKWNKHESAIKKKLNFDPSDDFILFSSVSKAGMDEAWDAILEKL

SEQ ID NO: 6926 - protein, 419 aa, Thermus thermophilus
MPLKAYRPPEDPGLWDTYLEWLERALKVAGVHPTTLEYLAHPKRLVTLSLPVVMDDGKVRIFQGYRVVHDIARGPAKGGVRLDPGVTLGQTAGLAAWMTLKAAVYDLPFGGAAGGIAVDPKGLSPRELERLVRRYTAELVGLIGPDSDILGPDLGADQQVMAWIMDTYSMTVGSTVPGVVTGKPHALGGSEGRDDAAGLGALLVLEALAKRRGLDLRGARVVVQGLGQVGAAVALHAERLGMRVVAVATSMGGMYAPEGLDVAEVLSAYEATGSLPRLDLAPEEVFGLEAEVLVLAAREGALDGDRARQVQAQAVVEVANFGLTPEAEAYLLGKGALVVPDLLSGGGGLLASYLEWVQDLNMFFWSPEEVRERFETRVARVVDAVCRRAERDGLDLRMGALALALERLDEATRLRGVYP

SEQ ID NO: 6927 - protein, 252 aa, Streptococcus pneumoniae TIGR4
MSRKPFIAGNWKMNKNPEEAKAFVEAVASKLPSSDLVEAGIAAPALDLTTVLAVAKGSNLKVAAQNCYFENAGAFTGETSPQVLKEIGTDYVVIGHSERRDYFHETDEDINKKAKAIFANGMLPIICCGESLETYEAGKAAEFVGAQVSAALAGLTAEQVAASVIAYEPIWAIGTGKSASQDDAQKMCKVVRDVVAADFGQEVADKVRVQYGGSVKPENVASYMACPDVDGALVGGASLEAESFLALLDFVK

SEQ ID NO: 6928 - protein, 174 aa, Silicibacter pomeroyi DSS-3
MAPSSYQAPTRGDKAEKTTYSQSASSNLAQSQSTVADLLGGKGEAVFSVRPGDTIGQVVGVLKDKRIGAVLVTDQNGALLGILSERDIVRRMADTPGQTLPQQAEGLMTRAVQTCAPDETLNVVLKRMTEGRFRHLPVMRDGKLCGMITIGDVVNFRLRELEYEALKMKQMIVG

SEQ ID NO: 6929 - protein, 520 aa, Onion yellows phytoplasma OY-M
MKTTPNQKPKFFLSTAIAYASGIPHIGNVYESILADAIARFKRLEGFDVLFQTGTDEHGQKIAAKALQQGKNPQEYVDQISLEIKRIYDLMQVSYDKFAKTTNPHHKQTVQAIFYKLWQQGDIYLGKYQGLYSVAEESYVAAKDLIDGKTFNGETPILISEETYFFKLSKYQAQLLQYLENNPSLIKPDAQRKELLNLLKEPLADLSVSRTSFKWGIPVPFDPKHVIYVWIDALSNYLTGLDYNPTSKNSQFNRYWPCDMHVIGKDILRFHLIYWPILLMALEISLPKQFLTHPWILFDKNKMSKSKGNVLYVDDLLKYFPVDSIRYFVLSEIPYAQDGNITYELLVERHNSDLANVLGNLVHRVFGMVKSYRQNNLSKTLITTNLDPKFDLSKQALATLPLVRLKMQDCKVGDSLKEIMNLARFANKYIDLVEPWNLFKNPEKQQLLDHTLYSLVETLRFLGVLLQPFLPQTAHKILTQLKASDITFESLDTFGLLSSQKLDNYHILFNRLEIDEVLPR

SEQ ID NO: 6930 - protein, 170 aa, Streptococcus pneumoniae TIGR4
MNLKDYIATIENYPKEGITFRDISPLMADGNAYSYAVREIVQYATDKKVDMIVGPEARGFIVGCPVAFELGIGFAPVRKPGKLPREVISADYEKEYGVDTLTMHADAIKPGQRVLIVDDLLATGGTVKATIEMIEKLGGVMAGCAFLVELDELNGREKIGDYDYKVLMHY

SEQ ID NO: 6931 - protein, 474 aa, Leptospirillum ferrooxidans
RSGYDAFPPEVLNLRLRWWGVYPQGDGAGKAGGSVPFFMLRTRIAGGILKAAALRQMAYISERYAKSTADITVRQNIQFHWVTPSDLPEIFRLLGEVGIDSMGACGDVTRNITGCPVSDLSGDPLAQRHRNLLEEANAALKGHPDFWNLPRKFKITIASCKSQCSLPEINDVGIVPVTHPVHGDGYAIRVAGGLSTRPHFSVPLHFFFRYEEVIPVLRGVASLFRDRSELRENRDRARLKFLFLEHGWDRSRFEEALLPYLSFSPVVWEPSGIEVEGFKSARDHIGVHQVPDGSGRYYIGLSINQGALSPEVMRGLADLSESLGNGEIRLTSMQNLILTGVEEKNLSLVLEKIALLGLNASDGSFLSRTVSCTGNVFCRLALVETKEFSRDLASTLHERFGELSNPINLHVTACPNDCGQQRISEIGLQGVSIKNEEGAPVDGYELFLGGQTGSRKSFNQRTGVRLSGEQVAPV

SEQ ID NO: 6932 - protein, 1028 aa, Haemophilus influenzae
MQVSRRKFFKICAGGMAGTSAAMLGFAPANVLAAPREYKLLRAFESRNTCTYCAVSCGMLLYSTGKPYNSLSSHTGTNTRSKLFHIEGDPDHPVSRGALCPKGAGSLDYVNSESRSLYPQYRAPGSDKWERISWKDAIKRIARLMKDDRDANFVEKDSNGKTVNRWATTGIMTASAMSNEAALLTQKWIRMLGMVPVCNQANTCHGPTVASLAPSFGRGAMTNNWVDIKNANLIIVQGGNPAEAHPVGFRWAIEAKKNGAKIIVIDPRFNRTASVADLHAPIRSGSDITFLMGVIRYLLETNQIQHEYVKHYTNASFLIDEGFKFEDGLFVGYNEEKRNYDKSKWNYQFDENGHAKRDMTLQHPRCVINILKEHVSRYTPEMVERITGVKQKLFLQICEEIGKTSVPNKTMTHLYALGFTEHSIGTQNIRSMAIIQLLLGNMGMPGGGINALRGHSNVQGTTDMGLLPMSLPGYMRLPNDKDTSYDQYINAITPKDIVPNQVNYYRHTSKFFVSMMKTFYGDNATKENGWGFDFLPKADRLYDPITHVKLMNEGKLHGWILQGFNVLNSLPNKNKTLSGMSKLKYLVVMDPLQTESSEFWRNFGESNNVNPAEIQTEVFRLPTTCFAEEEGSIVNSGRWTQWHWKGCDQPGEALPDVDILSMLREEMHELYKKEGGQGIESFEAMTWNYAQPHSPSAVELAKELNGYALEDLYDPNGNLMYKKGQLLNGFAHLRDDGTTTSGNWLYVGQWTEKGNQTANRDNSDPSGLGCTIGWGFAWPANRRVLYSRASLDINGNPWDKNRQLIKWNGKNWNWFDIADYGTQPPGSDTGPFIMSAEGVGRLFAVDKIANGPMPEHYEPVESPIDTNPFHPNVVTDPTLRIYKEDREFIGSNKEYPFVATTYRLTEHFHSWTAQSALNIIAQPQQFVEIGEKLAAEKGIQKGDMVKITSRRGYIKAVAVVTKRLKDLEIDGRVVHHIGLPIHWNMKALNGKGNRGFSTNTLTPSWGEAITQTPEYKTFLVNIEKVGEA

SEQ ID NO: 6933 - protein, 137 aa, Glycine max
SGYVEIGNNLNDIFCGKVLNCLDIGGEGSALIAAGGSDPVLRIWDPRKPGTSAPVFQLASHTSWVSACKWHDQSWFHLLSASYDGKVMLCDLRTAWPLSVIEYHRDKVLSADWWKTDSVISGGADSKLCISSEIPVQ

SEQ ID NO: 6934 - protein, 707 aa, Oryza sativa (japonica cultivar-group)
MGCVASKNAVSVTPAADSSGALRERSLPRAPEAAATVVSVTASSLRCSSAAAAGRRSEKKRDEAAVAAAGEEPSEKAVIAAATASRSFRLRSLRRSLEGEQVAAGWPPWLSAVAGEAIQGWIPLKADSFEKLEKVGQGTYSSVFRARELDTGKIVALKKVRFDNFEPESVRFMAREIQILRRLDHPNVMKLEGLITSRLSCSLYLVFEYMEHDLAGLSSSPDIKFSEAQVKCYMNQLLSGLEHCHSRRIVHRDIKGANLLVNNEGVLKIADFGLANYFDPNKNHPLTSRVVTLWYRPPELLLGSTHYDAAVDLWSAGCVFAEMFRGKPILQGRTEVEQLHKIFKLCGSPADEYWKKSKLPHATIFKPHCPYQSTLQDVFKEMPANALRLLETLLSVEPYKRGTASAALTSEFFKTKPYACDPSSLPKYAPNKEMDAKLREDSHRRKASRGHGPEASRKSRLSRAARETTTVNKQTDGKEESKTKANGTKDNSILDRTKVNGDARLFSDIQPVSVAQVKERSRHVKNDSREEIPFSGPLIVSSSSGFAWAKKPPEDRSFARSRTKSSSRGQFTAELDQDNKMPAKENQNLGLKEQPNRDMHIARANSKVREPHDAAKRAVLKKWSQLGRPDSFDSYDTYHSQNFSNAMYLGDTLSSKNSIKGDHDQGERVEYSGPLLSQSHKVDELLEKHERHIRQVVRKSWFSRGKK

SEQ ID NO: 6935 - protein, 121 aa, Neisseria meningitidis MC58
MNLIQQLEQEEIARLNKEIPEFAPGDTVVVSVRVVEGTRSRLQAYEGVVIARRNRGLNSNFIVRKISSGEGVERTFQLYSPTVEKIEVKRRGDVRRAKLYYLRGLTGKAARIKEKLPARKG

SEQ ID NO: 6936 - protein, 394 aa, Capsicum annuum
MDGPAQQTDTVMAEAAAAQQPAPPSQPVAGIDNIPATLSHGGRFIQYNIFGNVFEVTAKYKPPIMPIGKGAYGIVCSALNSETNEHVATKKIANAFDNKIDAKRTLREIKLLRHMDHENIVAIRDIIPPPQREAFNDVYIAYELMDTDLHQIIRSNQGLSEEHCQYFLYQILRGLKYIHSANVLHRDLKPRNLLLNANCDLKICDFGLARVTSETDFMTEYVVTRWYRPPELLLNSSDYTAAIDVWSVGCIFMELMDRKPLFPGRDHVQQLRLLMELIGTPSEAEMEFLNENAKRYIRQLPLYRRQSFVEKFPHVNPAAIDLVEKMLTFDPRRRLTVEDALAHPYLTSLHDISDEPVCTTPFSFDFEQHALTEEQMKELIYREGLAFNPEYQHM

SEQ ID NO: 6937 - protein, 429 aa, Cryptococcus neoformans var. neoformans B-3501A
MSHLLPPNLLKLFAPRPQPPFLKPLTRDERIRGPNNLGGVAGLAKRIKEEAEDAEVKQGMGMNPEKALDEQKEENVKMELKQDGEDGEVAEDSGKEKKKKTARDKIAEMGIIGEEAVKMRKELRKKRQEEYKKNAESNYKPQDDAQAIGDPYKTLFISRLSKKANETDLRREFEMYGPIERIRIVRNRKGKSNGYAFIVYERERDMKAAYKDAEGIPIHHKKILVDVERGRTVKGWKPQRLGGGLGGRPKPVAPEASPAPYVAPSNLRGGRGGFRGGGRGGGGGFRGGFQGNRGGFGGGNRGGFGGGDDRGGFAGRGGFRGGFQNRGDRGPGGFGQQQGGFGGPGGPGGYGGQGGGYGGGGGGFGGPGQQNGVQGGQGGGGFGGGGGYKRDYDNAGGPGGYGGGGGGGGGGFGGGGGGYQDRDPKRMRY

SEQ ID NO: 6938 - protein, 318 aa, Arabidopsis thaliana
MILAHLPRFHLSILAKPSFSLSSSHFSFLNPKPSVTVSRTLFSFASKSNLATVEPIPLSVSDSTDLDDAPAEIALDKLFIPPETDISGEDSASLTTRILKGSNIVLSKYARDAQVVQADYVKSSVKTEDCPADGLPEFALVGRSNVGKSSLLNSLVRRKRLALTSKKPGKTQCINHFRINDKWYLVDLPGYGYASAPHELKQDWNKFTKDYFLNRSTLVSVFLLVDASIPVKPIDLEYASWLGQNQVPMTLIFTKCDKRKKKKNGGKKPEANIKEFQDLIQGFFETTPPWIMTSSVTNQGRDEILLHMAQLRNYWLKH

SEQ ID NO: 6939 - protein, 415 aa, Burkholderia xenovorans LB400
MSVQHLVIVGAGQAGFQTAASLRQAGFTGGIALVGDEPGVPYQRPPLSKAYLLGKIGTAALRFRPDEWFDQQHVERLQATVAAIDRDARCVVLADGARLAYDHLVLATGARNRVPSVDGIELDGVFGIRTLADADALSSRVDAARNVVVIGAGFIGLEFAAVAAAKGLSVRVIELGQRPMARALSEPMSALFGDAHRSWGVVFDFGQTVTRFIGKDGKVTAVETGSGEWVPADLVVYGIGVLPNTEIAAAAGLCVDNGICVDEQLVTSDPAISAIGDAVSFPCAWSATRVRLESVQNAVDQARAVAARLVGTPAPYNALPWFWSDQGDLKLQIAGLSGGHDEAVVIGSIEQRQFSVLCFREDRLIAVESCNRATDHMAARKLLARGTALRVADARTPGFDFRAYESSSRDVPVCQ

SEQ ID NO: 6940 - protein, 411 aa, Magnaporthe grisea 70-15
MSTSGKKATATALAQKYAPQIANKTVLVTGVSPNSLGATFVTAIAVASPALLILAGRNAAKVEETTKAIQAAAPHVPVRFLNLDLADRESVRKAAGEVLSWQDVPGIDVLVNNACLIGSEYKLIDGFEAHFVVNYLHPFLFTNLLLPKVIAVKGRVVNVASDCHRWHHIRFSDLNFDVSVSWKISQRSAARLQPRQNGKIYNMWQAYGQSKTANMLFSLALARRLGGRGIVTNSVHPGIIQTNAASHLDPAEILRLIAAEEVERQCGLANQAFLSYKTVDEGTATHVYAAFEPGLKDHNGAYLLDSHVADPVEDPVAPWGTSEADAEKLWRLITRRIPPSKSHIKGGKSKHLEANYYDQRLAPLLKRPDRSHPPDDFCREIPPAAPKQDKKIVYINTHNAKRINLVNLNEA

SEQ ID NO: 6941 - protein, 86 aa, Triticum aestivum
MGSEAITEPRQATREEMRDAKLPLAYRDSCAHLLIPLNKCRRDTWYAPWKCSDERHSYEKCQYVEFKKRVAKMDELRESKGGARSN

SEQ ID NO: 6942 - protein, 522 aa, Candida glabrata CBS 138
MKSTRSLLLQRRYLSLTHRRVLSSSVRQPLLRRGFHSTSSVKQEFKDPYETLGVKKSSSQSDIKKAYYKLAKKYHPDINKEAGAEKKFHDLQNAYEILSDESKRKQYDQFGAAAFSGGAGAGPGGPGAGPGGFNPFGNGFGFDFSGGQAGGAGGFGGINFEDLFGTAFGGGPFGSSSNSGRRSSSMFREYKGDTIEVIQNLDFKDAVFGKKNVSIKFRALDPCGTCNGSGLKSGASKTTCPSCHGSGTTVHVRAGFQMMSTCQTCGGEGTTVNASDFCKSCHGEGVNVNTQKTITVDLPHGLQDGDVVRIPGQGSYPDIAVDKEMAKSVKLSRGDILVRIRVNKDPHFSIKNKYDIWYTKEIPITTAALGGTVSIPTIEGTKIRIKVPAGTAPEQVISIPNMGVPKSSPYRNSAVQARGDMKIQYKVVIRKPQSKAEQCLWEALADVTNDTNAKRTMESFASSVEKSVEDKLSDNDNKTSNNSKETYNTTEDNSMNPDAPSTLGRLEKFISNTFKKIKGDKN

SEQ ID NO: 6943 - protein, 354 aa, Petroselinum crispum
MKKGNLGPGLKLSLPPPDEDSLTKFLTQSGTFMDGDLLVNRDGVRIVSQTDVQAAPPIQATDNQLSLADFDAIKVVGKGSGGIVRLVQHKWTGQFFALKVIQMNIQESARKQIAQELKINQSSQCLNVVVCYQSFYDNGAISIILEYMDGGSLADFLKIVKNIPEPYLAAIFKQVLKGLWYLHHEKHIIHRDLKPSNLLINHRGEVKITDFGVSAILATTSGQANTFVGTYNYMSPERISGGQHGYSSDIWSLGLVLLECATGYFPYSPPEQDEGWSNVFELMDTIVNQAPPCAPPDEFSPEFCSFVSACVQKDPRKRPSANELLRHPFINMYEHLNIDLAGYFTEAGSPLATL

SEQ ID NO: 6944 - protein, 356 aa, Petroselinum crispum
MKSAQPPPPTAANRQRPRRRPDLTLPLPQRDPAIAVPLPLPPNSAPSSTTAASAAAAIQPINFSELDRINRIGSGSGGTVYKVAHRPTGKLYALKVIYGNHEESVRRQICREIEILRDVDNLNVVKCHDMYDHAGEIQVLLEYMDRGSLEGIHITNEAALADLTRQILSGIHYLHRKRIVHRDIKPSNLLVNSRKQVKIADFGVSRVLAQTMDPCNSSVGTIAYMSPERINTDLNQGRYDGYAGDIWSLGVSILEFYMGRFPFAVSRGGDWASLMCAICMSQPPEAPPTASRQFREFISCCLQRDPHRRWTANQLLRHPFVVQTNNGTPPNGSGGGSQVNQAHQLLPPPRPHPSSA

SEQ ID NO: 6945 - protein, 146 aa, Medicago sativa
MASDSFTDKNAVFRKLKTKSENKSCFDCNAKNPTWASVTYGIFLCIDCSAVHRSLGVHISFVRSTNLDSWSPEQLKMMSFGGNSRAQVFFRQHGWNGDGKVEAKYTSRAAELYKQLLSKEVAKSMSEEAALSAPPAASSQSAQGAN

SEQ ID NO: 6946 - protein, 357 aa, Candida glabrata CBS 138
MGKKIVFNISSDFQLKSLLGEGAYGVVCSAVHKPTGEIVAIKKIVPFDKPLFALRTLREIKILRRFQHENIISIFDIQKPESFEKFNEVYIIQELMQTDLHRVIATQTLTDDHIQYFIYQTLRAIKTLHGSNVIHRDLKPSNILINSNCDLKVCDFGLARIIDSGENGDNEVDKIGMTEYVATRWYRAPEVMLTNAKYSRAMDIWSCGCILGELFLKRPLFPGKDYRHQLLLIFGLIGTPDSSDKSMECIESRRARQYIASLQKYPPVRPLQKAFPGVNPVGVDLLSRMLVFDPRERISADDALAHPYLSTYHVPEDEPAGEPIPPDFFQFDQYKEVLTTKDLKKLLWNEIFHEQAT

SEQ ID NO: 6947 - protein, 218 aa, Oryza sativa (japonica cultivar-group)
LVEHDKALGLWTIKLPSADTVVVKRTLSTVTQHPEGLPGVEESTDFAEHRKSFWSSVKPAHFGVKLTSKSLLGIAQFIFTGLCIGLLGGFSFGRSLLLKFPSFFSAGWFRKSGPTEEQVSSASFKMWFVGRGYSDAARASDRGSKPDKEIITRVSGPEIGYITTPIVLVQCALVLLSQRGNLPKGGVYTPGAVFGPTDIQQRLQENGLSFDLVSTRTL

SEQ ID NO: 6948 - protein, 225 aa, Zea mays
  misc_feature (69)..(69): Xaa can be any naturally occurring amino acid
  misc_feature (93)..(93): Xaa can be any naturally occurring amino acid
  misc_feature (118)..(118): Xaa can be any naturally occurring amino acid
  misc_feature (120)..(120): Xaa can be any naturally occurring amino acid
  misc_feature (153)..(153): Xaa can be any naturally occurring amino acid
MASLLARQAAQALRARQTAQLGPAASAMQGHLRTYMNAGIPKRFKEDEEKEQLAKDLAKDWNAVFERSXNTLFLTEMVRGLMLTLKYFFDRNXVTINYPFEKGPLSPRFRGEHALRRXEXGEERCIACKLCEAICPAQAITIEAEEREDGSRXRTTRYDIDMTKCIYCGFCQEACPVDAIVEGPNFEFATETHEELLYDKEKLLENGDRWETEIAENLRSESLYR

SEQ ID NO: 6949 - protein, 504 aa, Brucella suis 1330
MSKLDDNVAKAKTYLARFEKGVLNRIGGEDVAAADGATFETISPVDLKPLATVALGKAADIDRAARAAKAAFPEWAAMSGDARKKLLHKIADAIVARAEEIAFVECMDTGQSLKFMAKAALRGAENFRFFADRAPEARDGKTLRGPGQVNMTTRVPIGPVGVITPWNTPFMLSTWKIAPALAAGCTVVHKPAEFSPLTARLLVEIAEEAGLPKGVWNLVNGFGEDAGKALTEHPDIKAIGFVGESRTGSLIMKQGADTLKRVHFELGGKNPVVVFADADLERAVDAAVFMIYSLNGERCTSSSRLLVEASIYEKFTALVAEKAKRIKVGHPLDPETVVGPLIHPVHEKKVLEYIEIGRSEGATVAAGGAKFAGPGGGCYVSPTLFTAAHNGMRIAQEEIFGPVLTAIPFKDEAEALALANDVKYGLTGYLWTNDVTRAFRFTDALEAGMIWVNSENVRHLPTPFGGVKNSGIGRDGGDWSFDFYMETKNIAFANAAHAIAKLGG

SEQ ID NO: 6950 - protein, 556 aa, Idiomarina loihiensis L2TR
MDKIWLENYPAGVPETIDPDHFASLVDILEQSIEKYGEKTAFVNMDSEMSFKELGLKTRDFAAYLHSTGLKKGDAVAVMMPNLLQYPVALFGILRAGMTVVNVNPLYTPRELKHQLVDSQAKALVILENFAQTYEKIKAEAPLDLVVTTQIGDQLPLLKRSLVNFVVKYIKRMVPSHNLKGTVSFNQALAKGTMADYKRPEVTGDDIAFLQYTGGTTGVAKGAMLSHRNMVANLEQVSSVITPIMNDGEETIITALPLYHIFALTANCLTFIKHGGKNVLITNPRDMPNFVKELNKYPFSMISGVNTLFNGLLNTKGFKDVNFSNLKIALGGGMAVQRAVADEWERVTKSRLLEGYGLTECSPVVTVNPYDIEHYTGSIGLPVPSTDMRIVDPETREEVALGEPGELEVKGPQVMVGYLNRPDATAESIKDGWFATGDMATVDERGYFKIVDRKKDMILVSGFNVYPNEIEDVLADHPKILESAAIGVPHESSGEAVKVFIVAKDKSLTEREVIDFSRENLTGYKVPKLVEFRDELPKSNVGKIIRRELRDEEDEA

SEQ ID NO: 6951 - protein, 377 aa, Cryptococcus neoformans var. neoformans B-3501A
MATEFDDVLTNQPVVIDNGSGNIKAGFAGEEQPSCYIPSFVGRPKHPRVMAGAIQDNLFIGRRAQEFRGLLKIKYPMEHGVVMDWDDMERIWGWVYGEGLKALSEEHPVLLTEAPLNPRQNRDIAAQIFFETFNVPAFFTSVQAVLSLYSSGRTTGIVLDSGDGVTHAVPVFEGFSMPHAVRRIDLAGRDITDHLQLLLRKAGHNLHTSAEKEVVRTIKEKTCYLALNPAKEEKDQGGAWEEFKLPDGKVIQLGTERFLAPEILFNPELVGQEYPGVHQVIVDSINRTDLDLRKSLFSNIVLSGGSTLCTGFGDRLLNEVKKLAVKDVKLKIYAPPERKYSTWIGGSILAGLSTFKKMWVSADEYKEDPDIIHKKAF

SEQ ID NO: 6952 - protein, 501 aa, Rhodococcus sp. RHA1
MTAVVHTPAGLDPRVVDFVSSPKRMFVDGRWVDSASGRTFETVDPATGQVITTVPHAGIEDVDRAVAAARRAFESGPWRSLTPAERQRILWKIGEGILARADQFAQLESIDNGKSVAVAKAVDVTWAAEIFFYYAGWATKIEGRTIPVSVPWAPGARFHAFTTREPVGVCAQIIPWNFPLVMAAFKVAPALTCSNTMILKPAEQTPLTALLLAEVIAEAGVPDGVFNVLTGFGDIGAALSSHDDVDKVAFTGSTEVGKKIVNAASGNLKKVSLELGGKSPQVIFSDADLEAAIPGVAGGFLFNHGQACTAGTRLLVEDRIFDEFTSGVADFAKSQKIGPGLDPTNDVGPLISQEQLGKVTGYIDAGLADGARALSGGHRHGDTGFYVEPTLLVDVNRDFSVYQEEIFGPVAVAVPFNREEGVRAAANDTPYGLAASVWTRDVSRAHEVAAEIKAGTVWVNCHNAFDTALPFGGYKQSGWGRELGEGAIAEYTQSKSVNIAL

SEQ ID NO: 6953 - protein, 143 aa, Triticum aestivum
MASLVAVQPVAVRGLAGSSISGRKLAVRPASAAVSRSTRRARGAAVVAKYGEKSVYFDLDDIANTTGQWDLYGSDAASPYNGLQSKFFNTFAAPFTKRGLLLKVLLLGGGSLLAYVSATASPDLLPIKKGPQLPPTPGPRGKI

SEQ ID NO: 6954 - protein, 334 aa, Erwinia carotovora subsp. atroseptica SCRI1043
MEYMTIKVGINGFGRIGRIVFRAAQERSDIEIVAINDLLDAEYMAYMLKYDSTHGRFNGTVEVKDGHLVVNGKTIRVTAERDPSNLKWNEVNVDVVAEATGLFLTDETARKHIAAGAKKVVLTGPSKDDTPMFVMGVNHKTYAGQEIVSNASCTTNCLAPLAKVINDNFGIVEALMTTVHATTATQKTVDGPSHKDWRGGRGASQNIIPSSTGAAKAVGKVIPELNGKLTGMAFRVPTPNVSVVDLTARLEKPASYKEVCAAIKAAAEGELKGVLGYTEDDVVSTDFNGEKLTSVFDAKAGIALNDNFVKLVSWYDNETGYSNKVLDLIAHISK

SEQ ID NO: 6955 - protein, 452 aa, Brucella suis 1330
MRDSNFLIENNARHLWHPMAHPAEMQANPPRIVNGGEGVEVIDIHGKKVLDAVGGLWNVNLGYSCEPVKKAIRDQLDSLPYYSTFRGTTNSPLIELSYELAEFFKEDGLTRAFFTSGGSDSVETALRLARQFHKINGQPERTKFVSLKKGYHGTHFGGASVNGNANFRRNYEPLLPGVFHLAAPYPYRNPFNMDDPAAIAAAIARQFEDEIAFQGADTIAAFIMEPVLGAGGVIVPHESFMLLMREICDRHGILLIADEVITAFGRTGAWTGSRGWGVKPDMMTTAKAITNGYFPFGAVMISDKVASVFEANKNSLGAIGHGYTYSGHPVGAAAALATLKETARANTAANAGARGVELMAGLNQLKEKHELVGDVRGKGLMAALELVSDREKKSAAAKTVVQKVYDVAYEEGVMVRTSGANVIISPPLVITSADVNRIVSALDAGLSAAKGQ

SEQ ID NO: 6956 - protein, 289 aa, Erwinia carotovora subsp. atroseptica SCRI1043
MHNTIFSLPVTKQISATLSQRQLDQLPIIVVDHPEVRAAVALQGAHLLSWQPTNEEPVLWLSDNTPFTHHVAIRGGVPICFPWFGPFAEPNHGFARLLPWEFTAHSEDEHGVQLTFTLRDNEETRKSWPHEFTLIARFKLGKECGIELEAHGDYSITSALHTYFNIGNISDIRIAGLGEPFIDKVDQGKLATQQGDLVFTDRTDRIYTKPQDTSVVHDAVLKRAIEVHHTHHSDVVSWNPGAELSRTISDMPDEGYKTFVCVETARINQPFVASDNAPARLTTVIRIKK

SEQ ID NO: 6957 - protein, 579 aa, Phaseolus vulgaris
MCGILAVLGCSDSSQAKRVRVLELSRRLKHRGPDWSGLHQYGDCYLAHQRLAIVDPASGDQPLFNEDKTIAVTVNGEIYNHEELRKQLPNHTFRTGSDCDVIAHLYEEHGENFVDMLDGIFSFVLLDTRDNSFIVARDAIGVTSLYIGWGLDGSVWISSELKGLNGDCEHFESFPPGHLYSSKEREFRRWYNPPWFSEAIPSAPYDPLALRHAFEKAVIKRLMTDVPFGVLLSGGLDSSLVAAVTARYLEGTNAAKHWGTKLHSFCVGLEGAPDLKAAREVADYIGTVHHEFHYSVQDGIDAIEDVIYHIETYDVTTIRASIPMFLMSRKIKSLGVKWDICGEGSDEIYGGYLYFHKAPNKEEFHQETCRKIKALHKYDCLRANKSTFAWGLEARVPFLDKEFIEVAMNVNPEYKMIKKEEGRIEKWVLRRAFDDGEHPYLPKHILYRQKEQFSDGVGYGWIDGLKGHAEKHVTDRMMLNAANIFPFNTPTTKEAYYYRMIFERFFPQDSARLSVPGGPSVACSTAKAVEWDAAWSNNLDPSGRAALGVHASAYGNQVKAVEPEKTIPKMEVSPLGVAI

SEQ ID NO: 6958 - protein, 161 aa, Lactobacillus salivarius subsp. salivarius
LLNQSKDTIIYLCVLKKQHLFQSDKPESIETTLKNAADGRDIRLIVVTDAEGILGIGDWGVDGVDIAIGKLMVYTAAAGINPAQVLPVSIDAGTNNKELLNDPLYLGNKHKRVYGEKYNELIDKFVAAVQKLFPESMLHFEDFGRSNADVILNKYKDKILT

SEQ ID NO: 6959 - protein, 162 aa, Lactobacillus rhamnosus
VVADSIEQYNELFLDPQNAAFVSVDAPEDIEATLKNAADGRDIRLVVVTDAEGILGMGDWGVNGVDIAIGKLMVYTAAAGIDPSQVLPVSIDAGTNNQKLLDDPLYLGNRHKRVSGEQYYDVIDKFVAAEQQLFPDSLLHFEDFGRDNAQVILDKYKDQIAT

SEQ ID NO: 6960 - protein, 358 aa, Haemophilus influenzae R2866
MQSYNIAVLAGDGIGPEVIAEAIKVLNKVQEKFGFKLNFNEFFVGGAAIDHCGYPLPAETLKGCDEADAILFGSVGGPKWTNLPPDQQPERGALLPLRKYFKLFCNLRPATLYKGLEKFCPLRADIAAKGFDMVVVRELTGGIYFGQPKGREGEGAQTKAFDTEVYYKYEIERIARAAFDAAMKRNKKVTSVDKANVLQSSILWRETVTEVAKEYPEVTLEHIYIDNATMQLIKAPESFDVLLCSNIFGDIISDEAAMITGSMGMLPSASLNEEGFGLYEPAGGSAPDIAGKGIANPIAQILSAAMMLRYSFNLNEAADAIENAVQKVLASGHRTADLADDSTPVSTAEMGILIAQAI

SEQ ID NO: 6961 - protein, 153 aa, Lupinus luteus
GALTESQAALVKSSWEEFNANIPKHTHRFFILVLEIAPAAKDLFSFLKGTSEVPQNNPELQAHAGKVFKLVYEAAIQLEVTGVVVTDATLKNLGSVHVSKGVADAHFPVVKEAILKTIKEVVGAKWSEELNSAWTIAYDELAIVIKKEMDDAA

SEQ ID NO: 6962 - protein, 178 aa, Lactobacillus brevis
NPVVYDPTVADSIEQYSHLFTDPQNAAFISVDAPEDIEATLKNAAGDRDIRLVVVTDPKNFGYGPTGVLTGLDIAVGKLMVYTAAAGMIQHKSCQLALMAGTNNQTLLNDRYYLGNHHERVYGDKYHAVIDQFVAAEQKLFPESLLHWEDFGRSNAQVILDKYKDKIATFNDDIQGTG

SEQ ID NO: 6963 - protein, 210 aa, Brassica juncea
MLCSEYESPVTLGGEYCPKLASSCPKKPAGRKKFRETRHPVYRGVRLRKSGKWVCEVREPNKKSRIWLGTFLTAEIAARAHDVAAIALRGKSACLNFADSAWRLRIPETTCPKEIQKAAAEAAVAFQAELNDTTADHGLDVEETIVEAIFTEESSEGFYMDEEFMFGMPTLWASMAEGMLLPPRPYNSDLTMTSTEMLTCPFGVMSTCNH

SEQ ID NO: 6964 - protein, 577 aa, Zea mays
KLVYGRKHFAVEKEKPSQLFGTYDFDSSPFDWGDNYKLPNLPETDLVIYEMNVRAFTADESSRLAPAIRGSYLGVIDKIPHLLELGVNAVELLPVFEFDELELKRFPNPRDHMVNTWGYSTINLFAPMSRYASAGGGPVAASKELKQMVKAFHNSGIEVILDVVYNHTNEADDVNPYMTSFRGIDNKVYYMLDLNNSAQLLNFSGCGNTLNCNHPVVKELVLDSLRHWVKEYHIDGFRFDLASVLCRGPDGSPLDAPPLIKERGKDSVLSRCKIIAEPWDCGGLYLVGRFPNWDRWAEWNGKYRDDIRRFIKGDPGMKGVFATRVSGSADLYQVNNRKPYHSVNFVIAHDGFTLCDLVSYNSKHNDANGEGGRDGCNDNYSWNCGIEGETNDLNVLSLRSRQMKNFHVALMISQGTPMMLMGDEYGHTRYGNNNSYGHDTHINNFQWGQLEERKDGHFRFFSEMIKFRHNHPILRRDRFLNKNDVTWHENRWENQDSKFLAFTIHDHSSGGDIYLAFNAHEYFVDAVIPPPPHHKSWSRVVDTNLESPKDIVPEGVPFTGSGYRIAPYSSILLKAKP

SEQ ID NO: 6965 - protein, 180 aa, Lactobacillus fructivorans
NSVVYDPTIADSIENYSRLYVNPQNAAFLSIDHDDPETIRESLKNTAAGRNIKLIVVTDGEGILGIGDWGTQGIDIPVGKLMVYSAAAGIDPSEVLPVVMDVGTTNKSLLDNPLYLGNHQDRDYGQKYYDFVDKFVKEAEDLFPNLYLHFEDFGRRNASNILDKYKDDYLVFNDDIQGTG

SEQ ID NO: 6966 - protein, 330 aa, Glycine max
MESESNKSKQKQKLEVSDILWESVVIYFRNLNFIIFTFLTSIPLFCIMVYFEIFLQELLVETSNIVNLPHESHDDSIVFTDYDFIDYRNSYRPDLIIDRFNKDYVLKLILTGFIYMVPLYVLEFVSAIVTIALASKLHSKEKKMTLKEMVQKPFDLSKLRGSFVTSVYVLFLTTTHQLGLLFIVLNYHVYLKDSSFYLLFAVICSAAFAKVLRMYLEWSAMWNMSLVMSVLEGIYGVDALAVSAYFSRGCHRRGLFLMLIFFAWGHLLRLSCYHIGGYEQGNAIFVQVGLYCMVNPLKWVACMIYVHDCKERKLEKKADEESGKDVKNGS

SEQ ID NO: 6967 - protein, 73 aa, Leptospirillum ferrooxidans
RPFLDPDRAKSMHDETLPHEVFKTAEFCSMCGPKFCSMHINEELRKEAGAPILLDPRTSPSPNISLEVANAER

SEQ ID NO: 6968 - protein, 199 aa, Neisseria gonorrhoeae FA 1090
MALKTSNLEHAMLVHPEAMSVGALADKIRKIENWPQKGILFHDITPVLQSAEYFRLLVDLLVYRYMDQKIDIVAGLDARGFIIGAALAYQLNVGFVPIRKKGKLPFETVSQSYALEYGEAAVEIHTDAVKPGSRVLLVDDLVATGGTMLAGLELIRKLGGEIVEAAAILEFTDLQGGKNIRASGAPLFTLLQNEGCMKG

SEQ ID NO: 6969 - protein, 137 aa, Zea mays
GGPLLTIGDLLSDLAVDGGDDPLVGVGDASAPSSPSATQQAGKADPSDLSRLFEEHYNNLMKALEEKDPSWPSLMLKLCAALKTADKLVSCANMNAEQLLEKVKALEGVLERSDHAVAEIVEALQKSGLAKDRQGSQ

SEQ ID NO: 6970 - protein, 220 aa, Helianthus ciliaris
QYGRETRHTGDYENPIHSTGGQYDQDVRQTDEYGNPVRITDEYGNPVHSATGGTMGDYGSTGLGQGTGGLGTGVGHTTGGTGTDYTSGGRSTGQTGYQGLGTESEFGGTTGTFQNQPSATPIGGTGLSSGTGAGFGGIGTGTGTGILHRSGSGSSSSSEDDGQGGRRKKKGVMQKIKEKLPGGHSQEEQYQSQTTTTGYGETHEKKGMMEKIKEKLPGHH

SEQ ID NO: 6971 - protein, 461 aa, marine gamma proteobacterium HTCC2080
MARWECIVCGLIYDEKEGWPDDGIPAGTKWSDVPDDWLCPDCGVGKDDFELIAGSEDEPVGETDTTTSAGESSVATNNRHIVIVGSGLAGYGLVSALRKLDPEVAITLITRDGGESYSKPMISTGYTKNLSAEKLAAQSPEAMAEQLAVTMLTRKTVVSIDPSSKQLNLDDETVIAYSELVLTLGAELIRPPMGGDAAGDVMGVNDLDDYRSFRDTLESKGVRKVAVIGAGLIGCEFSNDLLNGGFEVEAVDPMSWCIPTLLPEPAGRAVQAALEARGARFHFGPLATEVNHSATGYQVLLNNGEHIEADAVLSAVGVRPRTQLAASAGLEVGRGIKTNRLLETSSAGIYALGDCAEVAGHVLVYVAPLLAAGRALAATLTGNPTEVTYPAMPVTIKTPACPVCVSPVAKDTEGSWTLTGEGSDIKGLFHSPDGQLLGFALTGAAVKERMALTKELPPILD

SEQ ID NO: 6972 - protein, 353 aa, Medicago truncatula
MGSYVGTPFSLSSLMCHEQDESTLIFEEDEDESTFFINSSLDNNNNNPWFLLDDEEEYIQYLFKQETGLGFGSITHFLCYDDHDVEVEDDDSSKSLFWLRNARLHAIDWIFNTQAKFGFTVQTAYLSINYFDRFLSKRSIDESKPWAIQLLSVACLSIAAKMEEQSVPPLSEYPIEYRFENKVIKNMELLILSTLEWKMGLPTPFAYLHYFFTKFCNGSRSETIITKATQHIVTMVKDFNLMNQRPSTIASASILAAFDSTLTKKEIDLRISLVSSCGNLESEHVFSCYNVIQEKIRDKVNKTPSSDLLSTESNSTCVVVENKFNACVGVKRKLSYEEMNIEDFPPGQKLRQP

SEQ ID NO: 6973 - protein, 198 aa, Leptospirillum ferrooxidans
MRQEWIKKRSGVVTQMHFARKGVITEEMAYVAEVEKLDPELIRSEIARGRMIIPANIKHPELVPMAIGIAATCKINANIGNSAVVPDIQNELDKLKVCIKYGADTAMDLSTGPKIPEIREEIIRRSPIPIGTVPIYEAIQNVGDPLDLSPEDLLNVIRSQAEQGVDYMTVHCGILREFIPLTTRRITGIVSRGGALMG

SEQ ID NO: 6974 - protein, 297 aa, Triticum aestivum
  misc_feature (15)..(15): Xaa can be any naturally occurring amino acid
  misc_feature (131)..(131): Xaa can be any naturally occurring amino acid
MRAPMRGGGGRGGGXGFGFGGRSDGGGRSGGRGFGGRSAGRGRGGGRGGGRGGPGMKGGAKVVVVPHKHDGVFIAKAKEDALCTKNMVAGESVYGEKRVSVQNEDASKVEYRVWNPFRSKLAAAVLGGVDXIWIAPGTRVLYLGAASGTTVSHVSDIVGPTGLVYAVEFSHRSGRDLVNVAKKRTNVIPIIEDARHPAKYRMLVGMVDVIFSDVAQPDQARILALNASYFLKNGGHFVISIKANCIDSTQAAEAVFASEVEKLKADQFKPSEQVTLEPFERDHACVVGGYRMPKKQK

SEQ ID NO: 6975 - protein, 247 aa, Zea mays
  misc_feature (228)..(228): Xaa can be any naturally occurring amino acid
MSAMQSSYLPATTESIAMAQEAKDASESILILYRVLEDPSSSSDAVRTKEVAITNLTNYLTKENRAQELRNLLTQLRPFFALIPKAKTAKIVRGIIDAVSKIPGTSDLQISLCKEMVEWTRAEKRTFLRQRVEARLAALLLESQEYTEALTLLSGLIKEVRRLDDKLLLVDIDLLESKLHFSLRNLPKAKASLTAARTAANAIYVPPAQQGTIDLQSGILHAEEKDYXTAYSYFFEAFEGLMHWAAP

SEQ ID NO: 6976 - protein, 635 aa, Escherichia coli CFT073
MERAMSATKLTRREQRAQAQHFIDTLEGSAFPNSKRIYITATQPGVRVPMREIQLSPTLIGGSKEQPQYEENEAIPVYDTSGPYGDPQIAINVQQGLAKLRQPWIDARGDTEELTVRSSDYTKARLADDGLDELRFSGVLTPKRAKAGRRVTQLHYARQGIITPEMEFIAIRENMGRERIRSEVLRHQHPGMSFGARLPENITAEFVRDEVAAGRAIIPANINHPESEPMIIGRNFLVKVNANIGNSAVTSSIEEEVEKLVWSTRWGADTVMDLSTGRYIHETREWILRNSPVPIGTVPIYQALEKVNGIAEDLTWEVFRDTLLEQAEQGVDYFTIHAGVLLRYVPMTAKRLTGIVSRGGSIMAKWCLSHHQENFLYQHFREICEICAAYDVSLSLGDGLRPGSIQDANDEAQFAELHTLGELTKIAWEYDVQVMIEGPGHVPMQMIRRNMTEELEHCHEAPFYTLGPLTTDIAPGYDHFTSGIGAAMIGWFGCAMLCYVTPKEHLGLPNKEDVKQGLITYKIAAHAADLAKGHPGAQIRDNAMSKARFEFRWEDQFNLALDPFTARAYHDETLPQESGKVAHFCSMCGPKFCSMKISQEVRDYAAAQTIEVGMADMSENFRARGGEIYLRKEEA

SEQ ID NO: 6977 - protein, 156 aa, Trollius ledebouri
YETPSNDVIDEARLERVFRTNFFSYLFVTRHALKHMREGSSIINTASVNAYKGNPIVLDYTSTKGAVVGFTRSLALQLVSRGIRVNGVAPGPVWTPLIPASLSEEVISKFGLEVPMKRARQPHEIAPSYVFLASNDCSSYFTGQVLHPNGGDVVNA

SEQ ID NO: 6978 - protein, 162 aa, Zea mays
  misc_feature (65)..(65): Xaa can be any naturally occurring amino acid
MKAGRKNLRRACDEGAAVTLAEGESIMQVLTLRGSNVIEVIDGEGIKSLALFPAKFQKSFWIKNXGRDQALESGSKIACVVSQVLYHEQVRALEKSGSPGPAIFNSTPNEASEAGTQAQIAAKIDELPDSDEDDNLPPVEANTNRNRPYELYYDSDSGGSDS

SEQ ID NO: 6979 - protein, 123 aa, Nocardioides sp. JS614
MTTLDPAIAGRLKRNPDGLVPAVVQQHDTGEVLMLGWMDDEALARTLTTGRATYWSRSRQEYWLKGETSGHVQWVKEVRLDCDGDTILVKVDQVGAACHTGDRTCFDADLLSGADRPGPDARG

SEQ ID NO: 6980 - protein, 492 aa, Brucella suis 1330
MQDKIDRLRQQAVPPQSLFINGRWQPAADGNVMAVISPIDGTQLTTIAAATAIDVDRAAAAARHSFEKGTWAKAAPAERRKVLLKIAELIERNALELAVLGVRDNGTEISMALKAEPGSAANSFRYYAEAIDKVYGEIAPTAENILGLVHRAPVGVVGAIVPWNFPMMIGAWKIAPALAAGNSIVLKPAEGASLSLLRLAELCAEAGLPEGVLNVVTGAGPVTGEALGLHPDIDVLAFTGSGFVGRKLLEYSARSNLKRVHLELGGKSPNIVFADAPDLAQAAKVSAYGIFRNSGQVCVAGSRLLVERSIAGEVAEKVSTIAAAIKGGDPLGLTTEAGAISSEAQLRKNLDFAEQALSEGAGLRTGGKRILEETGGFYMQPTVFNVEPGMTLAREEVFGPILSIIPFDNEEDALKIANDSDYGFASAVWTSNLSRAHRMVRGIRAGVVHVNTYGGADNTVPLGGVKQSGNGHDKSLHALDKYIDLKTAWIQL

SEQ ID NO: 6981 - protein, 522 aa, Arabidopsis thaliana
MPAGGFVVGDGQKAYPGKLTPFVLFTCVVAAMGGLIFGYDIGISGGVTSMPSFLKRFFPSVYRKQQEDASTNQYCQYDSPTLTMFTSSLYLAALISSLVASTVTRKFGRRLSMLFGGILFCAGALINGFAKHVWMLIVGRILLGFGIGFANQAVPLYLSEMAPYKYRGALNIGFQLSITIGILVAEVLNYFFAKIKGGWGWRLSLGGAVVPALIITIGSLVLPDTPNSMIERGQHEEAKTKLRRIRGVDDVSQEFDDLVAASKESQSIEHPWRNLLRRKYRPHLTMAVMIPFFQQLTGINVIMFYAPVLFNTIGFTTDASLMSAVVTGSVNVAATLVSIYGVDRWGRRFLFLEGGTQMLICQAVVAACIGAKFGVDGTPGELPKWYAIVVVTFICIYVAGFAWSWGPLGWLVPSEIFPLEIRSAAQSITVSVNMIFTFIIAQIFLTMLCHLKFGLFLVFAFFVVVMSIFVYIFLPETKGIPIEEMGQVWRSHWYWSRFVEDGEYGNALEMGKNSNQAGTKHV

SEQ ID NO: 6982 - protein, 358 aa, Idiomarina loihiensis L2TR
MSQKPILFIDRDGTLVEEPVTDKQLDSLEKLVFEPNVVPALLKLQQAGYQLVMVSNQDGLGTDSFPQADFDAPHNLMMAVFESQGIRFEDVLICPHFDSDNCSCRKPALGLVKSYLKEGRVDFTNSYVIGDRETDLQLAENMGIEGLRYSRSELNWDAIVHQLLDNPRTASVTRTTRETDINIKVDLDSQTPREFNTGIGFFDHMLEQIATHAGFSLSVKVKGDLHIDDHHTIEDTALALGQALRSALGDKRGIGRFGFALPMDECRAECLIDLSGRPYLKWEADFTRDKVGELSTEMVEHFFRSLTDAMAMSLHLSTTEGNTHHQVESLFKVFGRALRQAITKTGDQQLPSSKGMLA

SEQ ID NO: 6983 - protein, 956 aa, Ralstonia eutropha JMP134
MDCRDVIDFGTPASESTEMVTLEIDGVSVTVPAGTSVMRAAMEAEVSVPKLCATDSLKSFGSCRLCLVEIEGRRGYPASCTTPVEAGMKVKTQSDKLSDLRRGVMELYISDHPLDCLTCPTNGNCELQDMAGEVGLREVRYNDGGPIATHTDMKKDESNPYFTYDPSKCIVCNRCVRACEETQGTFALTISGRGFDSRVSPGTSQSFMESDCVSCGACVQACPTATLTETSVIKLGQAPRSVVTTCAYCGVGCSFKAEMKGNEVVRMVPYKDGKANEGHACVKGRFAWGYATHQDRILKPMIRAKITDPWREVSWEEAINYAASEFKRIQAKHGKDSIGGIVSSRCTNEEGYLVQKLVRAAFGNNNVDTCARVCHSPTGYGLKQTLGESAGTQTFKSVEKSDVIMVIGANPTDGHPVFASRMKKRLRAGAKLIVADPRKIDLVDSPHIRADFHLQLRPGTNVALVTSMAHVIVTEGLLADEFIAERCEDRAFQQWRDFVSQPENSPEAMAEVTGVPADTLRGAARLYATGGNAAIYYGLGVTEHAQGSTTVMGIANLAMATGNVGREGVGVNPLRGQNNVQGSCDMGSFPHELPGYRHVSDSTVRALFESAWNVEISPEPGLRIPNMFEAALGGSFMGMYCQGEDIVQSDPNTQHVAEALSSMECIVVQDIFLNETAKYAHVFLPGSSFLEKDGTFTNAERRISRVRKVMPPKAGYADWEATILLANALGYPMNYKNPSEIMDEIARLTPTFHGVSYKRLDELSSIQWPCNEDAPEGTPTMHIDRFVRGKGKFIITKYVPTTEKITRAYPLILTTGRILSQYNVGAQTRRTENVHWHDEDRLELHPHDAEERGIKDGDWVGVQSRAGETVLRAIVSERMQPGVVYTTFHFPESGANVITTDNSDWATNCPEYKVTAVQVMPVAQPSEWQKQYQAFNAQQLQLLEAASTDSAQAAVG

SEQ ID NO: 6984 - protein, 326 aa, Erwinia carotovora subsp. atroseptica SCRI1043
MKIGLVISGGDVSGINNFIFQVNRMTASDIVIFDGGINGLIDNCCKVLTRRDLVDYSLSSMPLVTSGRKTGKCRKTDYEKIVKNIQKQKLDALIMAGGDGSFQFLKKLSCYGIHCYGIGMTIDNDISGNSYTIGFSTACEQVMSEVEKLRNTGRGLQGRVFMIELLGGYCGELTLQAALKSNADIALIPESPWDIDALSQCILDKIAEQNSVIILCSEGYTHEYTPGFQGAIDTIIKKLEHKIGIRIRKTILGYGLRNGAPTGEEIIQGTLLAEEVVRCINAGLTNKIIIINNNNKAIPIDLEDSERRLVDIESHFYKLAKSHHLI

SEQ ID NO: 6985 - protein, 178 aa, Oenococcus oeni
PIVYDPTIADTIENYSELFVEPQGAAFLDINHPENIQSTLKNAANGRDIKLLVVSDAEGILGIGDWGVQGVDIAVGKLMVYTVAAGIDPSTVLAVVIDAGTNNEKLLKDPMYLGNKFNRVRGDKYYDFIDKFVNHAESLFPNLYLHWEDFGRSNASNILNSYKDKIATFNDDIQGTGI

SEQ ID NO: 6986 - protein, 198 aa, Shigella flexneri 2a str. 301
MNMSASALVCLAPGSEETEAVTTINLLVRGGIKVTTASVDSDGNLAITCSRGVKLLADAPLVEVADGEYDVIVLPGGIKGTECFRDSTLLVETVKQFHRSGRIVAAICAAPATVLVPHDIFPIGNMTGFPTLKDKIPAEQWQDKRVVWDARVKLLTSQGPGTAIDFGLKIIDLLVGREKAHEVASQLVMAAGIYNYYE

SEQ ID NO: 6987 - protein, 256 aa, Oryza sativa (indica cultivar-group)
MSREENVYMAKLAEQAERYEEMVEYMEKVAKTVDVEELTVEERNLLSVAYKNVIGARRASWRIVSSIEQKEEGRGNEEHVTLIKEYRGKIEAELSKICDGILKLLDSHLVPSSTAAESKVFYLKMKGDYHRYLAEFKTGAERKEAAESTMVAYKAAQDIALADLAPTHPIRLGLALNFSVFYYEILNSPDKACNLAKQAFDEAISELDTLGEESYKDSTLIMQLLRDNLTLWTSDLTEDGGDEVKEASKGDAGEGQ

SEQ ID NO: 6988 - protein, 178 aa, Lactobacillus hilgardii
PVVYDPTIADTIENYSHLFLDPQNAAFLSIDDQDDIEASLKNASAGCDIKLIVVTDGEGILGIGDWGVQGVDISVGKLMVYTAAAGVDPKSVLPVVLDVGTNRKELLADDLYMGNHTQRVTGDKYYNFVDKFVETAENLFPDMYLHFEDFGRSNAANILNKYKDNILTFNDDIQGTGI

SEQ ID NO: 6989 - protein, 178 aa, Leuconostoc mesenteroides subsp. mesenteroides
PVVYDPIVAESIEQYNEIYTNPQNAAFLSIDHPENIESSLKSVADGRDIELVVVTDAEGILGMGDWGVNGVDIAVGKLMVYTAAAGIDPATVLPVSIDAGTNNKILLENPLYLGNKHERIAGEKYLEFIDEFVTAEQKLFPASLLHWEDFGRSNAQVILDKYKDSIATFNDDIQGTGI

SEQ ID NO: 6990 - protein, 357 aa, Acidovorax sp. JS42
MKIAVLPGDGIGPEIVAEAVKVLEALDLKLEMETAPVGGAAYEAAGHPLPESTLNLAKSADAILFGAVGDWKYDTLARPLRPEQAILGLRKHLGLFANFRPAICYEQLTHASSLKPELVAGLDILIIRELTGDIYFGQPRGRRTAADGHFPGAEEAFDTMRYSKPEIERIARVAFEAARKRNKKVTSVDKANVLETFQFWKDVVTEVHKDYPDVELQHMYVDNAAMQLVKAPKAFDVIVTGNMFGDILSDEASMLTGSIGMLPSASLNDKKQGLYEPSHGSAPDIAGKGVANPLATILSAAMMLRFSLNQEEAARRIEAAVQQVLAQGLRTPDIYSDGTTKVGTAQMGDAVVKALAA

SEQ ID NO: 6991 - protein, 177 aa, Lactobacillus plantarum
NPVVYDPVVADSIEQYNELFLDPQNAAFVSVDAPEDIEATLKNARGRRDIRLVVVTDAEGILGMGDWGVNGVDIAIGKLMVYTAAAGIDPSQVLPVSIDAGTNNQKLLDDPLYLGNRHKRVSGEQYYDVIDKFVAAEQQLFPDSLLHFEDFGRDNAQVILDKYKDQIATFNDDIQGT

SEQ ID NO: 6992 - protein, 161 aa, Pediococcus parvulus
IADTIENYSDLFIQSQNAVFLSIDDPDSMKASLKNAADGRDIRLIVVTDAEGILGIGDWGTNGVDISVGKLMVYTAAAGIDPSQVMPVVLDVGTNNQDLLKNPMYLGNRHERITGDRYYKFVDQFVNTAEDLFPKLYLRFEDFGRDNAANILNKYKDQITT

SEQ ID NO: 6993 - protein, 338 aa, Glycine max
MNPSLTSSSSTLSSSSSSWFSGIVRAGRSNSVKMSNNSAVAPSADTVGPVVRKNQFRGVLFKYGPNPIQVAFKTGDYKRQVIFIGGLTDGFLATSYLEPLAIALDHENWSLVQFLMSSSYSGYGTSSLQQDAKELDQLINYLINKEDSEGVALLGHSTGCQDIVHYMRTNFACSRAVRAAIFQAPVSDREYQATLPHTASMIDLAAKMISEGRGLELMPREADPSAPITAYRYHSLCSYNGDDDMFSSDLSDDQLKMRLGHMSSTHCQVIFSMADEYVPDYVDKKALVERLCRAMGGAEKVEIEYGNHSLSNRVEEAVDAIIDFLKREGPKGWDDPWS

SEQ ID NO: 6994 - protein, 377 aa, Glycine max
MADAEDIQPLVCDNGTGMVKAGFAGDDAPRAVFPSIVGRPRHTGVMVGMGQKDAYVGDEAQSKRGILTLKYPIEHGIVSNWDDMEKIWHHTFYNELRVAPEEHPVLLTEAPLNPKANREKMTQIMFETFNVPAMYVAIQAVLSLYASGRTTGIVLDSGDGVSHTVPIYEGYALPHAILRLDLAGRDLTDSLMKILTERGYMFTTSAEREIVRDMKEKLAYVALDYEQELETAKSSSSVEKNYELPDGQVITIGAERFRCPEVLFQPSMIGMEAAGIHETTYNSIMKCDVDIRKDLYGNIVLSGGSTMFPGIADRMSKEITALAPSSMKIKVVAPPERKYSVWIGGSILASLSTFQQMWISKGEYDESGPSIVHRKCF

SEQ ID NO: 6995 - protein, 131 aa, Cyanophora paradoxa
MHTQQLISQIESQYLKDNLPEICVGDTVKVGVLIQEEDNKNSGEKERIQFYEGVVISLSKLKNINGTIRVRRILQGIGIERTFLVHSPLIKSINIIRRSKVRRAKLYYLRTLTGKATRLKQRLIKHYRLIY

SEQ ID NO: 6996 - protein, 569 aa, Hordeum vulgare subsp. vulgare
LGGACRVLAGMPAAGATALAGGVNFAVYSAEPPRALCLFTPEDLKADRVSEEVPLDPLMNRTGDVWHVFLEGELHGMLYGYRFDGTFAPHCGHYFDVSNVVVDPYAKAVISREEYGVPAHGNNSWPQMAGMIPLPYSTFDWEGDLPLRYPQKDLVIYEMHLRGFTKHDSSNVEHPGTFIGAVSKLDYLKELGVNCIELMPCHEFNELEYATSSSKMNFWGYSTINFFSPMTRYTSGGIKNCGRDGINEFKTFVRESHKRGIEVILDVVFNHTAEGNENGPILSFRGVDNTTYYMLAPKGEFYNYSGCGNTFNCNHPVVRQFIVDCLRYWVMEMHIDGFRFDLASIMTRGSSLWDPINVYGAPIEGDMITTGTPLVTPPLIDMISNDPILGGVKLIAEAWDAGGLYQVGQFPHWNVWSEWNGKYRDIVRQFIKGTDGFAGGFAECLCGSPQLYQAGGRKPWHSINFVCAHDGFTLADLVTYHNKYNLPNGEDNRDGENHNLSWNCGEEGEFARSSVKRLRKRQMRNFFVCLMVSQGVPIFYMGDEYGHTKGGNNNTYCHDSYVNYFRWEK

SEQ ID NO: 6997 - protein, 382 aa, Triticum aestivum
  misc_feature (218)..(218): Xaa can be any naturally occurring amino acid
  misc_feature (249)..(249): Xaa can be any naturally occurring amino acid
MHWNVVNKVQSYLNCGIHSTSQISFLAKMGVYLSTPKTDKLSEDGENDKLKFGLSSMQGWRASMEDAHSALLDLDNETAFFGVFDGHGGRVVAKFCAKYLHSQVLKSEAYSSGDLGTAVHKAFFRMDEMMRGQRGWRELSALGDKMNKFSGMIEGLIWSPRGSDSKNAEDDWTLEEGPHSDFDGPTCGSTACVALVRNNQLVVANAGDSRCVISRAGXQAYNLSRDHKPELVAERERILKAGGFIRMGXRINGSLNLARAIGDMEFKQNKFLPPEKQIVTSNPDINVVELCNEDDFLVLACDGIWDCMSSQQLVDFIHEHINTESSLSAVCERVLDRCLAPSTMGGDGCDNMTMILVQFKKPVSDKKKADVGEQSAKGKEES

SEQ ID NO: 6998 - protein, 271 aa, Coccidioides immitis RS
MSAIEDAKRAAAREAVANHYPQNPKFVGIGSGTTIVYVVEAIKALGIDTSSTSFVPTGFQSNQLIVNAGLTPIAFDALPEGAVLDIAFDGSDEVDDDLNCIKGGGACLFQEKLVALQAKEFIVVADYRKLQPRLLTAWPSIPIEVAPLASRRVITALQALGSPEPKLRQSLISQEGPVKTDQSFFLIDAPFPQLLTSSDIQSGKTASAKEGIWEVETLAKEIKQIPGVLEVGLFYGPTGPQAQATGGVGGQKPIAAYFGMADGSVSVRKVK

SEQ ID NO: 6999 - protein, 327 aa, Triticum aestivum
DLPLRYPQKDLVIYEMHLRGFTKHDSSNVEHPGTFIGAVSKLDYLKELGVNCIELMPCHEFNELEYSTSSSKMNFWGYSTINFFSPMTRYTSGGIKNCGRDAINEFKTFVREAHKRGIEVILDVVFNHTAEGNENGPILSFRGVDNTTYYMLAPKGEFYNYSGCGNTFNCNHPVVRQFIVDCLRYWVTEMHVDGFRFDLASIMTRGSSLWDPVNVYGAPIEGDMITTGTPLVTPPLIDMISNDPILGGVKLVAEAWDAGGLYQVGQFPHWNVWSEWNGKYRDIVRQFIKGTDGFAGGFAECLCGSPHLYQAGGRKPWHSINFVCAHD

SEQ ID NO: 7000 - protein, 184 aa, Medicago sativa
YARMPRVKIRELKDDYMKFELRDTDASVANALRRVMISEVPTIAIDLVEIEVNSSVLNDEFIAHRLGLIPLTSERAMAMRFSRDCDACDGDGQCEYCSVEFHLRVKCITDQTLDVSSKDLISSDHTVTPVDVPGGDASVESDGRGIIIVKLRRGQELRLRAIARKGIGKDHAKWSPAATVTFMY

SEQ ID NO: 7001 - protein, 202 aa, Idiomarina loihiensis L2TR
MKIDLNNIDELAWEKMSGLLPCTVQHSLTGEVLMQAYMSTEAIKESLASGKTTFYSRSKERLWTKGESSNNYLRLEGIYSDCDYDALLVQAIPDGPTCHLGNRSCFAEAPKPLLHELDSLIASRKGADTNESYTASLFSKGLKRVAQKVGEEGVEVALAAATADKDELANESADLLYHLLVALRANELSLDDVLEVLAKRRG

SEQ ID NO: 7002 - protein, 332 aa, Solanum tuberosum
DLPLKFPQRDLVIYEMHVRGFTNHESSETKYPGTYLGVVEKLDHLKELGVNCIELMPCHEFNELEYYSYNSVLGDSKFNFWGYSTVNFFSPMGRYSSAGLSNCGLGAINEFKYLVKEAHKRGIEVIMDVVFNHTAEGNENGPILSFRGIDNSVFYTLAPKGEFYNYSGSGNTFNCNNPMVRQFIVDCLRYWVTEMHVDRFRFDLASILTRSSSSWNAVNVYGNSIDGDVITTGTPLTSPPLIDMISNDPILRGVKLIAEAWDCGGLYQVGMLPHWGIWSEWNGKYRDMVRQFIKGTDGFSGAFAECLCGSPNLYQKGGRKPWNSINFVCAHD

SEQ ID NO: 7003 - protein, 132 aa, Brassica napus
  misc_feature (2)..(2): Xaa can be any naturally occurring amino acid
  misc_feature (11)..(11): Xaa can be any naturally occurring amino acid
  misc_feature (16)..(16): Xaa can be any naturally occurring amino acid
  misc_feature (32)..(32): Xaa can be any naturally occurring amino acid
  misc_feature (35)..(35): Xaa can be any naturally occurring amino acid
  misc_feature (40)..(40): Xaa can be any naturally occurring amino acid
  misc_feature (47)..(47): Xaa can be any naturally occurring amino acid
  misc_feature (51)..(51): Xaa can be any naturally occurring amino acid
  misc_feature (60)..(61): Xaa can be any naturally occurring amino acid
  misc_feature (64)..(64): Xaa can be any naturally occurring amino acid
  misc_feature (67)..(67): Xaa can be any naturally occurring amino acid
  misc_feature (70)..(70): Xaa can be any naturally occurring amino acid
  misc_feature (75)..(75): Xaa can be any naturally occurring amino acid
  misc_feature (84)..(85): Xaa can be any naturally occurring amino acid
WXSSMLSSAAXVTSPXQATMVAPFTGLKSSAXFPXHPAKXTTNITSXASNXRKELTCMKXXPPXWKXKVXNLSYXPDLTEIELXXEVEYPPPRGFPWVPWKGFPGSGKGLGFGKGENFPPFGRPQRGPKGKG

SEQ ID NO: 7004 - protein, 630 aa, Candida albicans SC5314
MGVLGKIFSSSSNLAQLEHQQKQQQQQQPPPSTKLLSKQSPPQPPPPVKTKPSPSNGTTVPDEDDEILSQVENDIVTPLRQIKQPQPQHPTSVNTPTVNSVRSNNSSPRLIKTRSVSPSNGLSSSTTSPMSLELLEDKLKNHQIASPTGSSTQPVAISSNDKPSTGRPSPTVSRTSSFRKPPSRATSVKTRSNSVSSTNLSGSSTNTNPVNNLPRFVMLESGNHEHHLRSAKRQEKLSNMLKDLLGAKKLRGEAKSAVPDIFQGAMQSSTSQLSQQQQQQPQPVKPPTLFAGLVNSVKNSTSPYHQPGTTDVVCSTPLSAATGTSANGIDCRSFAEKYGRCQEVVGRGSFGVVRISHKKLDSTSTTEKLFAVKEFKRKPNESEKKYNRRLTSEFCISSSLKHNNIIDTLDLLKDAKGDYCEVMEFCSGGDLYTLIIAAGKLEYAEADCFFKQLIRGVNYMHDMGVAHRDLKPENLLLTQNGVLKITDFGNSECFKMAWENEIQYSDGICGSSPYIAPEEYNQESFDPRCVDIWSCGVIYMAMRTGRQLWKLADPKKDEFFEEYLVKRKESSGYEPIESLKRARCRNVIYSILDPKPERRITGKQILSSEWGREIKVCEAGEGHLNELGKQ

SEQ ID NO: 7005 - protein, 433 aa, Xanthomonas campestris pv. campestris str. ATCC 33913
MSSQGNESPALVRAVSRWQIVGLSINDVIGSGIYLLPAATAALLGPMSLWAVMLAGLAVALLVLCYAQAASYFDTPGGSYLYTREAFGPFTGFQIGWMIWLTRISSAAALSNGLADAVARFWPAAGSDGWERLLVVVGSLGLLTAINVIGVKSAARTGVALVIGKLVPLLLFVAIGLFYVDWSWAFAGSTPDLRDLGNLGEAALLLLFAYAGFENIPAAAGEYRNPRRDVPFALITMIVTVTLIYAAVQVVAQGTLPNLAASPTPLADAASRFGGEALALILTVGATISILGTTSNTVMLGPRFLFALAQDGYGPALLARVHPRFHTPAAAVLTQGVLSLALALSGSFTQLALLSMVTRLFAYIGTAAAVIVLARRYRARTDALRLPGGPLIPIAALLLSLGLLASASWQNLAAAGLALLVGCVFYLFPRKPA

SEQ ID NO: 7006 - protein, 202 aa, Nocardioides sp. JS614
MTRTARIERQTSESKVLVEVDLDGTGRHDVSTGVGFYDHMLTAFARHALVDLTVQTDGDTHIDAHHTVEDTAIALGQALRQALGDKRGIRRFGDATVPLDEALVQAVVDVSGRPYCVHTGEPEGQQYVQLGGTTPAYLGSLTQHVFESIAFHGHFALHVRVLAGREPHHIVETQFKAVARAFRDAVALDPRETGIPSTKGAL

SEQ ID NO: 7007 - protein, 507 aa, Oryza sativa (indica cultivar-group)
MATAPAPVSLSAAASTVPARLLVGRGAAAAPVARRRARMVVVRAKIREIFMPALSSTMTEGKIVSWSAAEGDRVAKGDAVVVVESDKADMDVETFHDGIVAAVLVPAGESAPVGAPIALLAESEDDLQAALAKAQELSKAQPQQAPPPSDAAAPPPPPPPPAAAPAAPAPVAAGTKGIATPQAKKLAKQHRVDLAKVAGTGPFGRITPADVEAAAGIEPKPKVVPAASAAPVPLSAPAIGAVPQAAELPPVPGATVVPFTGMQAAVSKNMVESLAVPAFRVGYPIVTDKLDELYEKVKSKGVTMTVLLAKAAAMALAQHPVVNASCRDGKSFTYNTNINIAVAVAIDGGLITPVLEDADKLDIYLLSQKWKELVKKARAKQLQPNEYSSGTFTLSNLGMFGVDRFDAILPPGQGGIMAVGASKPTVVADKDGFFSVKSKMLTPCITDSQWQRQELCLVINELPHVYNLGWLGVVNVTADHRIVYGADLAAFLQTFAKIIEDPESLTL

SEQ ID NO: 7008 - protein, 146 aa, Pediococcus acidilactici
TIADTIENYSELYVQSQNATFLSIDDPDNMETALKNAADGRDIRLIVVTDAEGILGIGDWGTNGVDISVGKLMVYTAAAGIDPSQVLPVVLDVGTNNEKLLKDPMYLGNRHERIKGDRYFEFVDQFVQTAENLFPNMYLHFEDFGA

SEQ ID NO: 7009 - protein, 141 aa, Populus nigra
MASKSTASLALFLALNLLFFSLVTACGGGCPSPKPKPKPKPKPKPTPTPTPSPSGGKCPKDALKLGVCADLLGSLLNVTVGTPPVKPCCSVIQGLLDLEAAVCLCTAIKANILGINLNIPLSLSLLLNVCGKKVPKDFQCS

SEQ ID NO: 7010 - protein, 392 aa, Pseudomonas aeruginosa UCBPP-PA14
MWFNGFLDLSPWQLVAVTLVLTHITIVSVTVYLHRYSAHRALDLHPALQHFFRFWLWLTTGMNTREWTAIHRKHHAKCETVEDPHSPVHKGLFTVLRAGAELYKAEAKNQDTLRIYGKNCPDDWIERNLYSRFPIGGVVLMALIDLALFGALGLTVWAVQMAWIPFWAAGVVNGLGHAVGYRNFECRDAATNLVPWGILIGGEELHNNHHTYPNSAKLSVKKWEFDLGWAWIKLFSFLRLARVARVAPIAHRVEGKHSLDMDTAMAILNNRFQIMAQYRKLVIAPLVKQEVAKADESVRHLFRRAKRLLSRETSLLQDRHHVRIDSMLAHSQALKVIYEKRLALQQIWAKTSANGHDMLAAIKDWVHEAEASGIQSLKEFAAQLKTYSLRPA

SEQ ID NO: 7011 - protein, 473 aa, Bacillus megaterium
GAMTIKEMPQPKTFGELKNLPLLNTDKPVQALMKIADELGEIFKFEAPGRVTRYLSSQRLIKEACDESRFDKNLSQALKFVRDFAGDGLFTSWTHEKNWKKAHNILLPSFSQQAMKGYHAMMVDIAVQLVQKWERLNADEHIEVPEDMTRLTLDTIGLCGFNYRFNSFYRDQPHPFITSMVRALDEAMNKLQRANPDDPAYDENKRQFQEDIKVMNDLVDKIIADRKASGEQSDDLLTHMLNGKDPETGEPLDDENIRYQIITFLIAGHETTSGLLSFALYFLVKNPHVLQKAAEEAARVLVDPVPSYKQVKQLKYVGMVLNEALRLWPTSPAFSLYAKEDTVLGGEYPLEKGDELMVLIPQLHRDKTIWGDDVEEFRPERFENPSAIPQHAFKPFGNGQRACIGQQFALHEATLVLGMMLKHFDFEDHTNYELDIKETLTLKPEGFVVKAKSKKIPLGGIPSPSTEQSAKKV

SEQ ID NO: 7012 - protein, 551 aa, Candida glabrata CBS 138
MSNEDILVPAALSTHQDESDFTFQKFDSDSMERSFYLGPLSSQDELWDKLMQYYSIDKLIAYLQRNPEYVQITLQFPDTLVKDSSFIIRALQDKLDGDGAGRKFWALADTAYSACCVDEVAAEHVKGDLVIHFGDACLNAIQKLPVVYDFGKPFLDTDVLLACFTEEFKDKDQKICLMSNASYTHHIPDLYSRLKSNGYTNVVYSVVNTGLLTETAEIIDNTTPLSDTDELFTLGNRVLMGARQEEDIDEETLRNEYALFHITMPHDPHLLYLTTVFESIHTYDVADQVISNGPYPSLTRRYKNMHKARTAGCIGILVNTLSIRGTRETVNKLIKLIRENGKKHYLFVVGKPNVPKLANFEPVDIWCILGCGQSGIIVDEFGEFYKPIITPYELTLALNFEVTWTGKWIIDFQKAITEIDNSLAELGIDDSKHGNDSDHDLDAPEFDAVTGKYVSSSRPLRALNHLQLDAPSNEDKQVMARVNGGTVIKGTVSTAVEHLANRAWTGLGSDYKDDEGYEEDGATVEEGISGIARGYEFDQEDAARKSQNQSQ

SEQ ID NO: 7013 - protein, 177 aa, Zea mays
MAAALWTLLVAVALSAALALASNRPVAATATAAAEAANEVLRAHQLPGGLLPAGITAFRHDAATGAFEARLDAPCTARFEVGLRYNATVSGVISPGQIADISGVAAQDLFMWFPVHDIKVDIPSSGVIYFNVGVVKKHLPLAVFDAPPACTPDPLLQRLEDVGEGGLAVVGAAASRR

SEQ ID NO: 7014 - protein, 379 aa, Gossypium hirsutum
MSTAGQVIRCKAAVAWESGKPLSIEEVEVAPPQKDEVRIKILFTSLCHTDVYFWDAKGQNPLFPRILGHEAGGIVESVGEGVTDLKPGDHVLPIFTGECKECPHCLSEESNMCDLLRINTDRGEMINDGKSRFSINGKPIYHFLGTSTFSEYTVVHVGQVAKINPEAPLDKVCVLSCGMSTGFGATVNVAKPKKGQSVAIFGLGAVGLAAAEGARVSGASRIIGVDLNPSRFELAKNFGVTEFVNPKDHKKPVQEVIAEMTGGGVDRSVECTGSIQAMISAFECVHDGWGVAVLVGVPNKDDAFKTHPVNLLNERTLKGTFFGNYKPRTDIPAVVERYMNKELELDKFITHSVPFSEINKAFEYMLAGEGLRCVIRMVA

SEQ ID NO: 7015 - protein, 183 aa, Brassica napus
MSTNNDVTGKVIVIMGVSGAGKSTIGKLLGTALSCDFLDADDFHSSSNRDKMRQGIALSDEDRMPWLEKIQESLRERLLNGETVVLACSSLRKQYREILRGSDPDYKPGSYSSCKVKFVLLEGNAEVIAARLQKRASEGEHFMPLTLLRSQFDLLEADDCEKIFKVSVVLTPEVIVNSVLELL

SEQ ID NO: 7016 - protein, 317 aa, Candida albicans SC5314
MVELSDYQRQEKVGEGTYGVVYKALDTKHNNRVVALKKIRLESEDEGVPSTAIREISLLKEMKDDNIVRLYDIIHSDSHKLYLVFEFLDLDLKKYMESIPQGVGLGANMIKRFMNQLIRGIKHCHSHRVLHRDLKPQNLLIDKEGNLKLADFGLARAFGVPLRAYTHEVVTLWYRAPEILLGGKQYSTGVDMWSVGCIFAEMCNRKPLFPGDSEIDEIFRIFRILGTPNEEIWPDVNYLPDFKSSFPQWKKKPLSEAVPSLDANGIDLLDQMLVYDPSRRISAKRALIHPYFNDNDDRDHNNYNEDNIGIDKHQNMQ

SEQ ID NO: 7017 - protein, 177 aa, Idiomarina loihiensis L2TR
MESATTDIRDSIGSIPDYPKPGIIFRDITPLLQNPDAFRLTINTLKQRYAGQGITQIAAVEARGFIFGSALAYAMGCGVTLLRKPGKLPGKVTRQNYELEYGSDELQMHENALTENDRVLIVDDLLATGGTVVAASQLIKSSGADVVEAAFVVSLPELGGEDKLQQAGVACYTLCQF

SEQ ID NO: 7018 - protein, 368 aa, Medicago sativa subsp. x varia
MRPIQLPPPTATGSATASGSPNNNNNSRPQRRRKDHLTLPLPQRDTNLAVPLPLPPSGGSGGSGGGGNGSGSGGASQQLVIPFSELERLNRIGSGSGGTVYKVVHKINGRAYALKVIYGHHEESVRRQIHREIQILRDVDDVNVVKCHEMYDHNAEIQVLLEYMDGGSLEGKHIPQENQLADVARQILRGLAYLHRRHIVHRDIKPSNLLINSRKQVKIADFGVGRILNQTMDPCNSSVGTIAYMSPERINTDINDGQYDAYAGDIWSLGVSILEFYMGRFPFAVGRQGDWASLMCAICMSQPPEAPTTASPEFRDFVSRCLQRDPSRRWTASRLLSHPFLVRNGSNHNQSPPNMHQLLPPPPRSLSS

SEQ ID NO: 7019 - protein, 406 aa, Mycobacterium tuberculosis H37Rv
MNAHVTSREGVNEFDDGIVIVGGGLAAARTAEQLRRAGYSGRLTIVSDEVHLPYDRPPLSKEVLRSEVDDVALKPREFYDEKDIALRLGSAAVSLDTGEQTVTLADGTVLGYDELVIATGLVPRRIPSLPDLDGIRVLRSFDESMALRKHASAARHAVVVGAGFIGCEVAASLRGLGVDVVLVEPQPAPLASVLGEQIGQLVTRLHRDEGVDVRTGVTVAEVRGKGHVDAVVLTDGTELPADLVVVGIGSTPATEWLEGSGVEVDNGVICDKAGRTSAPNVWALGDVASWRDPMGHQARVEHWSNVADQARVVVPAMLGTDVPTGVVVPYFWSDQYDVKIQCLGEPHATDVVHLVEDDGRKFLAYYERDGVLVGVVGGGMAGKVMKVRGKIAAGAPIAEVLDQTQA

SEQ ID NO: 7020 - protein, 477 aa, Leptospira interrogans serovar Copenhageni str. Fiocruz L1-130
MSLLPTVCIIGAGPSGIAVCKALKDKGIPFECYEAGSEVGGNWKFKNDNKMSSIYKSLHTNTHKDKMQYKDYPMPNSYAAYPDHQKISEYFINYVNHFGFRDHIFFKTPVTHVKHEEDGTWSILTQDGKQKYYDVLIVSNGHHWSQRWPKPDFPGKFTGDIIHSHSYIDPNKPIQLTGKRVVILGMGNSAMDIAVELCRPGISSKVFLAARRGAYIIPNYLFGKPLDKIATLFPVHTPFWLKSLIIKFALKLGVGNVEDFGLQKPDHKPGAAHFTISQDILVRLGRGDIIPKPNIESYNGNKVKFVDGSEEEIDVIIYCTGYDVKFPFFDENFLSAKDNHLPLFHRMVKPEFKNLFFVGLFQPLGPIAPLSEFQGKWISEYLVGNYEFPSEEKMNQSIEKYESKMKRRYITSARHTMQVDFEVFLYDMKSELKKGIKRAAKNGNKLPVPALARNKSILSNDIPVKRFKNKTELFSEI

SEQ ID NO: 7021 - protein, 722 aa, Oryza sativa (indica cultivar-group)
MPPIPSLWIRVFFSWLLLSLPAAAAADFSHCGGCDDGDGGGGIWSTDNILQCQRVSDFLIAMAYFSIPLELLYFATCSDLFPLKWIVLQFGAFIVLCGLTHLITMFTYEPHSFHVVLALTVAKFLTALVSFATAITLLTLIPQLLRVKVRENFLRIKARELDREVGMMKRQEEASWHVRMLTHEIRKSLDRHTILYTTMVELSKTLELQNCAVWMPSESGSEMILTHQLRQMETEDSNSLSIAMDNPDASNFKGGTPEVMETSYAILVLVLPEDGSLGWGEEELEIVEVVADQVAVALSHAAVLEESQLIREKLAAQHRDLLRAKHETTMATEARNSFQTAMYDGMRRPMHSILGLVSMMQQENMNPEQRLVMDAIVKTSSVASTLMNDVMQTSTVNREYLSLVRRAFNLHLLVKEAISVVRCLTGCKGIDFEFEVDNSLPERVVGDEKRVFHIVLHMVGTLIQRCNAGCLSLYVNTYNEKEERHNQDWMLRRANFSGSYVCVKFEIRIRESRGNLLSSSSSRRLQGPNSTSSEMGLSFNMCKKIVQMMNGNIWSVSDSKGLGETIMLALQFQLQHVTPVSGASSDLFRSAPIPNFNGLQVILVDSDDTNRAVTHKLLEKLGCLVLSVTSGIQCINSFASAESSFQLVVLDLTMRTMDGFDVALAIRKFRGNCWPPLIVALAASTDDTVRDRCQQAGINGLIQKPVTLAALGDELYRVLQNN

SEQ ID NO: 7022 - protein, 162 aa, Glycine max
MKFQRLPGPVGQGYRLELEKKKKLFEMARTKQTARKSTGGKAPRKQLATKAARKSAPTTGGVKKPHRYRPGTVALREIRKYQKSTELLIRKLPFQRLVREIAQDFKTDLRFQSHAVLALQEAAEAYLVGLFEDTNLCAIHAKRVTIMPKDIQLARRIRGERA

SEQ ID NO: 7023 - protein, 328 aa, Candida albicans SC5314
MSVILASAGYDHTIRFWDALTGVCSRTIQHPESQVNRLEITSDKRFLAAAGNLYVKLYDIRQTGNSGNGANGTTNTSASTSSSNQNNSNNNPVMTFEGHKNNVTSLQFQADNKWMVTSSEDGTVKVWDVRSPSVQRNYKHQCPVNEVVIHPNQGELISCDQDGNIRVWDLGENSCTHHLIPEDDVPINSLSVASDGSMLVAGNNKGNCYVWKMQNQRDATVLTPVTKFRSHSKYITRVLLSTDMKHLATCSADHTARIWSTEQNFNLETTLQGHQRWVWDCAFSADSAYLVTACSDHYVRLWDLSNSETVRQYNGHHKGAVCVALNDV

SEQ ID NO: 7024 - protein, 902 aa, Chromobacterium violaceum ATCC 12472
MDKTETRTTCCYCGVGCGVLISSENGRIVGVRGDPDHPANYGRLCGKGLSLAASAASDSGRALHPEMRMARDVPRLRVGWDQALDAAADRFADIIRRHGPDAVAFYASGQLLTEDYYLFNKLAKGVAGTNNIDTNSRLCMSSAVTAYKMAFGADGPPACYEDLESAGCVLFAGSNMAYAHPVLFRRLEDARRDWSDARWIVVDPRRTDTAAMADLHLQIQPGTDVALFHGMLHHLIWEGLTDAGYIAAHTEGFDALKRMVRDYTPKMAAEICGVRAEDIATAAEWFGRSPASLSLYCMGLNQSSQGTAKNLALINLHLATGQIGRPGSGPFSLTGQPNAMGGREVGGMATMLAAHRDIANPDHRREVAAHWGVPEARLSSRPGLPAVAMFEALARGEIKAVWIVCTNPAHSLPDLALARQALSRAELVVVQDAFAATDTTAFADILLPAASWGEKEGTVTNSERRVSRVRAAVPPPGEARPDGWIAAEFGRRLAARLHPGEADHFAYADAGQVFDEHRALTVGRDLDMGGLDYRLLEEKGPQQWPLPAGQAEGQARRYVDGVFATDNGKARFHAIDYQPPVDKISAHYPFRLITGRLRDQWHGMSRTGRVPGLFSHSPEPELCMHPEDAERRNLCDGDLVRVASKRGQWVLPLKTDGDLMRGCVFAAMHWSRQFLSSGGCNEATIPAVDGLSFQPELKHAAVRVEKAELPWRALAALRHPDLPALQARLAPLLGDMDYAAMALAGRDTLLLRAAGASPRLDWLMRVLDALALFPGPDVLEYRDDGRGALKRVAWDGDRLAWLVFAGGAQDDRDAGERLLQSLLDGEPWRGPRLAAFSPAAAGAARRDRIVCQCKQVGEAAILARLAQGGGVAELQAELGCGMVCGTCAPELARMASGYRQHA

SEQ ID NO: 7025 - protein, 239 aa, Glycine max
  misc_feature (78)..(78): Xaa can be any naturally occurring amino acid
  misc_feature (103)..(104): Xaa can be any naturally occurring amino acid
  misc_feature (107)..(108): Xaa can be any naturally occurring amino acid
  misc_feature (119)..(119): Xaa can be any naturally occurring amino acid
FAVRILSTPKARPVLVNSAVRKGERLIPSSAFEILVRVTFPPSSTRVKATERFEAIYPTLKEVALGGSAGSKAMKQVXLQIFSFAIKAAGENNPELSKEAVGXXIWXXSQNTECYKQWXKVYQDNIEASVSVLEKLSDDWKELSTKLSPHDPLRDTIKNLKQKNEKVLDSETDAARHAHFKDADKYCKIILGRVSRSHGCMTCLTFTVLALAVGAAVSLSPNLESLDFKKLSELFNVQH

SEQ ID NO: 7026 - protein, 473 aa, Nostoc punctiforme PCC 73102
MTTPQELLKKIQDEKIQLIDLKFIDTVGTWQHLTLYQNQIDETAFTDGVPFDGSSIRGWKAINESDMTMVLDPNTAWIDPFMEVPTLSIICSIKDPRTGEPYNRCPRVIAQKAVDYLVASGIGDTVFFGPEAEFFLFDSARFAQTANEGYYFLDSEEGAWNSGKEGTAEKPNLGYKPRFKEGYFPVAPTDSFQDIRTEMLLTMAELGVPIEKHHHEVATGGQCELGFRFGKLIEAADWLMTYKYVIKNVAKKHNKTVTFMPKPIFGDNGSGMHCHQSIWKDGQPLFAGDKYAGLSDMALYYIGGLLKHAPALLAITNPSTNSYKRLVPGYEAPVNLAYSEGNRSASIRIPLSGKNPKAKRLEFRCPDATSNPYLAFAAMLCAGIDGIKNKIHPGEPLDKNIYELSPEELAKVPSTPSSLELALQALENDHGFLTESGVFTEDFIENWIDYKLNEAKQLQLRPHPYEFYLYYDA

SEQ ID NO: 7027 - protein, 493 aa, Arabidopsis thaliana
MQSRIVGLAPAFSLFPNLNTPHKTFTFHQILVLIITFTAYASFHASRKPPSIVKSVLGPPSLNSSSIDNGWAPFNGTQGTKRLGELDLAFLSSYALGMYFAGHLGDRIDLRYFLVFGMMGSGILTLVFGLGYWMNVHTLGFYMSVQIVCGLFQSIGWPCVVSVVGNWCGKEKRGLIMGLWNSHTSVGNILGSVIASSVLDFGWGWSFVLPGGLVLVSGVVVFMFLVVSPNDLGFEELGKEIEIEMSLGENVEESLRKHEAEDAVLLENVDDSSFAIGFLEAWRLPGVAPYAFCLFFSKLVAYTFLYWLPYYLRHTAVAGVNLSHKTAGILSTVFDVGGVLGGISAGFISDKIKARALTSITFLALSIPALIMYRVYGSVSMFINIVLMFISGLLVNGPYALITTAVAADLGTQDSIKGNGRALATVTAIIDGTGSVGAALGPLLAGYISSRGWNSVFFMLIVSIFFAGLFLVRLAKSEINTMRSGELIASSVP

SEQ ID NO: 7028 - protein, 332 aa, Onion yellows phytoplasma OY-M
MKNENQKAKTKTKENKKIAVLTSGGDAPGMNAAIRALVFESAKQGFEVFGVKDGYLGLFNNQIEILNPQTFPRVLNVSGTFLGTSRFLDFQNNLDVRKQCAQNLKTLGIDKLVVIGGDGSYKGASKLHELGIKCVGLPATIDNDICATDFTIGFSTALNNIVDAIEKLRDTSVSHNRCSIIEVMGRHKGDLALFGGLAAGADVIVTRENLLSQKTICQKIKSLRQANQRHAIVVVTEHIFDVASLAKEVENYSGFETRAQVLGHIQRGGKPTAEDLVLAFRMGSYAVSLLQQNIFNCAVGTCGLNLHYTTFGDLFEKTYEKNELFNVVAKLL

SEQ ID NO: 7029 - protein, 473 aa, Bacillus megaterium
GAMTIKEMPQPKTFGELKNLPLLNTDKPVQALMKIADELGEIFKFEAPGRVTRYLSSQRLIKEACDESRFDKNLSQALKFVRDFAGDGLFTSWTHEKNWKKAHNILLPSFSQQAMKGYHAMMVDIAVQLVQKWERLNADEHIEVPEDMTRLTLDTIGLCGFNYRFNSFYRDQPHPFITSMVRALDEAMNKLQRANPDDPAYDENKRQFQEDIKVMNDLVDKIIADRKASGEQSDDLLTHMLNGKDPETGEPLDDENIRYQIITFLIAGHETTSGLLSFALYFLVKNPHVLQKAAEEAARVLVDPVPSYKQVKQLKYVGMVLNEALRLWPTVPAFSLYAKEDTVLGGEYPLEKGDELMVLIPQLHRDKTIWGDDVEEFRPERFENPSAIPQHAFKPFGNGQRACIGQQFALHEATLVLGMMLKHFDFEDHTNYELDIKETLTLKPEGFVVKAKSKKIPLGGIPSPSTEQSAKKV

SEQ ID NO: 7030 - protein, 468 aa, Rickettsia typhi str. Wilmington
MSFLRKKSFESVKEIGSSSGLSKTLGAFDLILLGLGAMIGTGVFVVTGIIAAKFSGPAVMISYMIAGITCIFVALVYTELAAMLPTSGSIYTYSYVAFGEVFAWMIGSVIILELGVSAGIVAAGWSGYVQGILEAGGIYLPKVLTTVPSNGGVINLPAFLISAFIGFILFLGTKDSKKINAILVFIKMAAIFAFVLASAPHFDATNWSNFMPFGFGSVVMGSSILFLAFTGFGTIATAAEECKNPKRDILIGIIGSLILTTLVYVIMSGLVTGIAPFDQLNNDRPLAYALTINNSKIGSAIVSTGAVCGMMTVLMMNIYGTSRIFYAIARDGLLPKSFAKLHPKYDSPYITIIIFSALAAFLGGFCPTEIITQLTSMGALIDYIVVAIIVMMFRIKLPTAQRSFKCPIVFIIAPFILLACIYLLLTQMYGDEIYKGNFNLLTSGRVLIYWFITIFVLYLIRSFFMKKE

SEQ ID NO: 7031 - protein, 402 aa, Burkholderia vietnamiensis G4
MNAQFSEREGILTVGGVAINRLADRAGRTPFFVYDRATLDARVCMLRETLPTGIDLHYSVKANPLPAVVHHLAPQMDGFDVASANEMAVALNAGMPAELIGFAGPGKSRDDLRRAVASGVNIHLESVTQLRLVTALGWELGVQPKVAIRVNPDFHVDHSGMRMGGGASPFGLDAEQVPELLRELDARDVTLAGFHIFWGSQCLHAPTVIHAQRKSADLVVRLAGGLPVAPQYVNFGGGFGIPYFAGETPLDLAAVADAMHDWLGVLRGRLPGTRTVLEFGRYLVGEAGIYVCRIIDRKISRDRTFLITDGGLHHHLAASGNFGQILRRNFPVTIGNRQTQAPTERCHIVGCLCTPLDRIADDVLLPEAQIGDFVVVFQSGAYGRSASPRNFLGHPDAIEMLV

SEQ ID NO: 7032 - protein, 107 aa, marine gamma proteobacterium HTCC2080
MDIMETIKEQVTSNRVILYMKGSPNQPQCGFSARAVQALASVGERFAYVDILSNPEIRANLPIYANWPTFPQLWVDGELIGGCDIIAEMETSGELAEAIKAGASDQA

SEQ ID NO: 7033 - protein, 235 aa, Rickettsia typhi str. Wilmington
MKDIEYWDKNFESCKYSDKLIERLLFLNNKVKQPIDIREVKKGIYYARKYHGKQMRQSGDPYYSHPIAVTIMVAEFVAKEVPKLFTSRILQAALLHDTIEDTELTKDMISSIFDEEVARHVEGLTRIKPCGKISSAKSLILLIKQKRYDTALIKLFDRIHNLQTLEAKSPEKAHKIIKETLKSFLVLSEILEIPSVSELIYAECYKNNLKFNINATFNKIINFDSSPFAQNKLLP

SEQ ID NO: 7034 - protein, 340 aa, Pichia anomala
MSHKASDEHHVDTDLITLSRFILTSQQKVAAQATGELTLLLNSLQFAFKFIANNIRKAELVNLMGLAGASNSTGDAQKKLDVIGDEIFINAMKASGNVKVLVSEEQEDLIVFDGPGNYAVVCDPIDGSSNIDAGVSVGTIFGIYKLLPGSKGSIKDVLRPGTEMVAAGYTMYGASAHLMLTTGQGVNGFTLDASLGEFILTHPNLTISDEKHIFSVNEGNTTYWTPEVQQFIADLKKPQFNGKPYSARYIGSMVADVHRTLLYGGLFAYPADAKSKAGKLRILYECFPMAFLFEQAGGKAVTDNGDRILELKPKAIHDRSGIWLGSKVEIDRFLKATGKI

SEQ ID NO: 7035 - protein, 558 aa, Zea mays
MGTPMSPWKGRLRSHHATVQSLSKRRLPSRTKNPEEKEKLRTSTKKAAPKKTARGRPAGAAQQQPMARLGLSSRHAGRDSEHPVVIDDDVNGECNGRADQSATTPLRRSPRLHVEDKSLGKSPLPPNRRETSANRKTKNAHRKYKNQESLKRNSASAALSPRKDISDVSNKKSDKHELKPNRCEVLTGKRKRGTERRLSSKKQRCQDPKLLPAVCQEIAPCNEPRKSTHRRIEKDPSIEEFEVKLKVANERLTNIDENINKLSGTEREEMGNFCGSDWTKEQDMALRKAYFSARPSPHFWKRVSKMVPGRSAEDCFNRIYNDLSTPTPIAPRPRTSKTTFSPIGNLTLSDPKLPNILEPTVGRQKTANQKSLVAQKTVRHLLQKHCRIDQAQEADHFSIFESSPSALQLNLSFEDSPGTPDSYMNSDSLGKHSGSSSARKKPFSRLRTKPSEPSPAVLKPIKNAILHEKYIDQLARREGTKRPRRRTPAGSKTADSGKSLSEQQAGSLKAAKNALISEATDFISSFKALQANSLAHVVENSEDEIECDASDCSYADKE

SEQ ID NO: 7036 - protein, 508 aa, Gloeobacter violaceus PCC 7421
MSGLCACTLVGAAQVQQLEAALFAAGMPVEALMEKAGLRLAAAIAADYPAGGYPRVGVLVGPGHNGGDALVVARELWLVGRSVQVFCPRPPIKPLARAHLDYFQSLGGRVHTGAVPEEPGVDLWVDGLFGFGLERPVAEPYAGLMAQVNASGVPVAAVDLPSGLSSETGEALGGLAVRAARTYCLGLWKRGLWQDAALDWLGVPVRLEIGFSEAQVRSVLGEDHRSARLLLPDAARAGLPLARPATAHKYSVGTLLAVAGSRQYGGAATLVALGARSGGPGMLYLALPESLADRVAARLPEAIVHPCPQAENGALADLPGVDLEKFDAVVCGPGLGKAEQALVLRLAREAAGALVLDADGLNLIAGQLEVLAQRAAPTVLTPHPGEFKRLFPDIALADRQGAARTAALRSHAWIVLKGARTVVASPSGQVWVNPGGSPALARGGSGDVLAGLLGALLAQCENPEPAVLGAVWWHAAAGEWLAARHTVLGVDAETLALGLLPFLAADGP

SEQ ID NO: 7037 - protein, 350 aa, Acidovorax sp. JS42
MRVGVLTGGGDCPGLNAVIRAVTKSLIHHGHCEVLGIEDGFEGLRGEASRARLLTWDQVSGIVHMGGTILGTSNSANPLKDEATLAQVERNVRALGLDVVVAIGGDGTMSLAHGLARIGLQCVGVPKTIDNDIALCERSFGFDTAVATATDAMRRIESTAYSHHRVMIVETMGRHAGWLALESGIAAAADVILLPEIDYDLQPIIERCRRREQRQRYTVICIGEGAKERGAGLTVREQVAHSPDPVRLGGVGHVLRQRLQPHLQSEVRTTVLGHVQRGGDPTAFDRVLATRFGHRAAQLVIDGQFGHMVTLQGGHIASVPIAQVANTQRKVPLDHELIAMARAIDVCLGE

SEQ ID NO: 7038 - protein, 409 aa, Oryza sativa (indica cultivar-group)
MPSGSATQFRYTQTPSKVLHLRNMPWECTEEELVELCKPFGRVVNTMCNVGANRNQAFVEFADQNQAISMVSYYASSSEPAQVRGKTVYIQYSNRQEITNNKGTGDSSGNVLLVTFEGVQPNDISIDVIHLVFSAFGFVHKIATFEKAAGFQGLHESISSCESNSNRGNRTVEVMQPTLGPDGKIKEPESNVLLASIENMQYAVTVDVLHTVFSAFGTVQKIAMFEKNGGMQALIQYPDITTAAVAKQALEGHCIYDGGYCKLHLSYSRHTDLNVKAHDERSRDYTVSSDPSAQMQAAAQAPGPSTPGVAWQNTAPSASFYGSTAAATPVGQVPAWNPNMQAGAFGSASSAYTTQPMMPGSVPHYPGIGSSSGALPVSFQASHQMPQYGVPPAAPHHAPPAGQPMYFPK

SEQ ID NO: 7039 - protein, 410 aa, Rhodococcus sp. RHA1
MTEQNLVVVGASLAGLRAAEAARKAGFTGSVTLVGAEEHLPYDRPPLSKAYLDPSPTPPDTTFRARNALDDVGIDLRLGTVATRLDPDEQMIHTSRGSLPYDIAVIATGSSARMLPGTAAMAGVVTLRTLDDAVTVRTALDNRARTVVVGAGFIGSEVASGARKRGLDVTVVEALPVPLVRAIGTDMGRACADLHRRNGVDLRCGVGVEKVLGNGHVEAVQLSDGSTLEADLVVVGVGADPATEWLETSGITLESGVVCDETMATSLPGVYAAGDVARWHNPLFDASMRLEHWTSAAEQGALAVRNALDPQAAKPYSTVPYFWSDWYDTRIQFVGVPEADEIRTVTGHLEDGQFVALYRRGDRVVGALALDHQTHIMKYRALIAKRASWEQALDYARTRQHKDEPLDAAR

SEQ ID NO: 7040 - protein, 508 aa, Oryza sativa (japonica cultivar-group)
MAVSSFSFLELLLSFLCFGFFYYYHVKSKQKNPVIPLQWPLVGMLPALLANCNHLHEWITSVLTVTPLNFRFIGPPSSDMRLFITSDPANIRHVFNTNFSNYPKGREFQEIFDILGDGIFSADGESWRRQRTKAQLLMSSPRFRAFVARYSRDKVEKALLPLLAHVAGTGDACNLQDVFLRLTFDTTTTLVFGVDPGSVAIDLPEVPFARAMDDAMTMLLLRHIVPLSWWRLARRLGIGYERKMPVAWRTMDRFVADTIAKRRAEKARTGIDDSADLLSSYINDDEEDAGTVDAFLRDTTINLMLAGRDTTGSALSWFFYLLTKNPRVLHKLLQELDSVKSTTAADGMVIFDPDETGRLVYLHAALCESLRLYPPVPMEHKGPAAADVLPSGHEVRPGDKIVVSLYAMGRMESVWGSDCMEFRPERWISDDGKLRYVPSYKFMSFNSGPRTCLGKDMAFVQLKTAAAAVMKNFEIEAVAGHVVEPKLSIILHMKNGFMVRVKRRLAVC

SEQ ID NO: 7041 - protein, 430 aa, Onion yellows phytoplasma OY-M
MPYIESILAREVLDSRGNPTVEVEVYTESGAFGRAIVPSGASTGQYEAVELRDGDAQRFLGKGVLQAVKNVIEVIQPELEGYSVLEQTLIDKLLIKLDGTPNKSNLGANAILGVSLACAKAAANYLNLEFYQYVGGVLPKQMPVPMMNVINGGAHASNSVDFQEFMILPTGPTSFKEALRYGAEVFHHLGKILKQKGLPTTVGDEGGYAPDLNSNEEALQIILEAIKSAGYEPGKDIFLGMDVAASEFYDKKLQKYVLASENNKAFSSQELVHYYETLVSKYPIISIEDGLDENDWDGWKYLTQKLGNQIQLVGDDLFVTNTQKLAQGIENKIGNSILIKLNQIGTLTETLETIEMAKKASYTAVISHRSGETEDTTIADLAVATNAGQIKTGSCSRTDRMAKYNQLLRIEDQLVEAPFLGLKTFYNLKK

SEQ ID NO: 7042 - protein, 512 aa, Onion yellows phytoplasma OY-M
MTKKFVGLTILDGLGLTDQKENNAFHLAKTPYLDYLLKNFPNTTLKASGEEVGLPQGQMGNSEVGHLNLGAGRVVYQSLTQINKAIRDKSFFTNKQFLQAIEHVKKNNSKMHLLGLISDGGIHSHLDHFKALFDLLKENNLANNTFLHAFTDGRDTSPHSGINYIKDLLDYGFNIASVVGRYYALDRDNNWNRINLVYNMLTSKQAPVIDLPLEDTIQNFYNQGITDEFITPFITNPNGLINDNDAVIFVNFRPDRAMRLATALSNPCATNAFCSEGKTNFCGTKLLNNLFLVTMTKYSAQVKSVVAFEKITLKNIYGEVIANLGMHQLRIAETEKYPHVTFFFDGGKELQLKNADRILIPSPKVKTYDLKPEMSALEITTHAKTAILSGKYDTLILNFANPDMVGHTGFLDATIKAIQTVDSCLKEVLNAIFAVKGKACIVADHGNAEQMTDNQGNPHTAHTTNLVPFIVTDKNVVLKPGSLCDVAPTMLDLLEIKKPQEMTGNSLIKKLV

SEQ ID NO: 7043 - protein, 309 aa, Ralstonia solanacearum GMI1000
MADILAYGEALIEFNQTDPGSAAWALGYGGDTSNFCIAAARQGARTGYVSAVGADRFGQALRTLWQAEGVDHTWVQTDLQAPTGLYFVSHDARGHHFDYLRAGSAASRFQTAQLPLQAIAAARVFHLSGISLAISDTACDAGLAAMAHARAAGVTVSFDTNLRLRLWPLARARAVMREAMRTCDLCLPSWDDVTVLLDCHDRDAIVDTLLGWGIRLVALKMGVEGCYVATPEARTLVPRHPVAAVDATGAGDCFGGAFVARIVAGDTPQDAARYANVAAALSTTGYSAVAPIPRAEAVRAALAGAAAAL

SEQ ID NO: 7044 - protein, 262 aa, Pyrococcus abyssi GE5
MALYFIGLGLYDEKDITLKGLEIARKCDYVFAEFYTSLMAGTNLERIEKLIGKEIRVLSREDVELNFERIVLPLAKDHDVAFLTAGDPLVATTHAELRLRAKKFGVESYVIHAPSIYSAIAITGLHIYKFGKSATISYPEKNWFPTSYYDVIKENLERGLHTLLFLDIKAEKGKYMTANEGMKLLLKVEDMKKEGVFTQETLVVVLARAGSLNPVIRAGYVRDMIREDFGSPPHVLIVPGRLHIVEAEYLVEIAGAPREIIR

SEQ ID NO: 7045 - protein, 328 aa, Yersinia pestis CO92
MSTFDLQPGVDFQQAGKQVLQIEREGLAQLDQYINEDFSRACEAIFRCHGKVVVMGMGKSGHIGCKIAATFASTGTPAFFVHPGEASHGDLGMITPQDIVLAISNSGESNEILTLIPVLKRQKILLICMSSNPESTMGKAADIHLCINVPQEACPLGLAPTTSTTATLVMGDALAVALLKARGFTQEDFALSHPGGALGRKLLLRISDIMHTGTEIPTVSPDASLRDALLEITRKSLGLTVICDDSMRIKGIFTDGDLRRVFDMGIDLNNAKIADVMTRGGIRVPPNILAVDALNLMESRHITALLVADGDQLLGVVHMHDMLRAGVV

SEQ ID NO: 7046 - protein, 120 aa, Rickettsia typhi str. Wilmington
MYNKENVFAKIITKNLPAEIIYEDKQILAFKDIEPIAPVHIIVIPKNEYIDYTDFISKASIDEIKHFFAKISDIANEAGLAKAGYRLITNKGEKSGQTIFHFHFHIIGGKKLIGLINNND

SEQ ID NO: 7047 - protein, 958 aa, Myxococcus xanthus DK 1622
MSSPARFPKNLVACLLFLSGGTALVYELVWSKYLGNVLGNSGQAHAVVLATFMGGQALGAFVFGRTADRAKNPLALYGLLELGVGLYALVFPYVLDVLGALWLNVAPSVPDGWRLGPRLLVSSASLLIPTLLMGGTLPALVRHFASSLSGVRYELARLYAVNSLGAAVGVFIAGTKLVPAIGLSSSAGLAAGLNILVALASLGLARRFPPALVPGQTPPAEAGDAEVSYPRIAVRAALIGVLLSGFTSMLYQVTWIRLLSIVLGASTYAFTLILTAFIMGIGLGSFWLMTRKGQVDSLRLFGRLQVALVASICVALPLYVRLPHLFRKAQWMMTRSLDTWPLFQVLTFGFCCLVLLVPTFFMGAAFPAAARVATAKVSEVGRQLGGVYLWNTVGTITGSALGVLVLMPWWGMEGNFIAGVAANLLGAGLAFHAAPGRPAQHARALWPVAATAVLALVVLGGMSGWAVRLSGIASIRSHEKPPESYAKLVADTEAIIRPIFYQDDTFATVMVADVPVDNLRFMKLNGKVDASNGSDVETQVVAGHLGALLHPREPKSVLLVGAGAAITAGSVLVHPVEHLDMVEIAPAVIDAARLFKADNRNAVDDPRTHVHVDDAKTFMALSPRKYDLVVSVPSNPWVSGVSGLFTRDFFQTVDRHLADDGVLVQWIHTYESNEDLIKLVVRTLRDTFPHATTWLGPHDLVMVASRKPLAFDAARLAERMGHPEVRKDLSRVGINDVFALLSKQVHSEAGQLEFAGEGPINTDDHNLLEYASPIAFFVSNLDVRVKDERRAPEGADRLFLHDYVQQHPPTAEQAAGLYRNIERYHAPNDPMVRGAAAQWRRLAPDSPESALALGKAALAQQDLTLAASLLEPEVARGGRAPALVTAYLRLVTAQTWASRTMWTPVGALHDTVALGREVASRHPDDEHLARALRSLCEALPRSSCEGTAQTPVAAPGGP

SEQ ID NO: 7048 - protein, 381 aa, Zea mays
MASPTQGQVITCKAAVAYEPNKPLVIEDVQVAPPQAGEVRVKILFTALCHTDHYTWSGKDPEGLFPCILGHEAAGIVESVGEGVTDVQPGDHVIPCYQAECKECKFCKSGKTNLCGKVRSATGVGVMMNDMKSRFSVNGKPIYHFMGTSTFSQYTVVHDVSVAKINPQAPLDKVCLLGCGVPTGLGAVWNTAKVESGSVVAVFGLGTVGLAVAEGAKAAGASRVIGIDIDNKKFDVAKNFGVTEFVNPKEHDKPIQQVLVDLTDGGVDYSFECIGNVSVMRAALECCHKGWGTSVIVGVAASGQEIATRPFQLVTGRVWKGTAFGGFKSRTQVPWLVDKYMKKEIKVDEYITHNMNLADINDAFHLLHEGGCLRCVLAMQI

SEQ ID NO: 7049 - protein, 302 aa, Triticum aestivum
  misc_feature (223)..(223): Xaa can be any naturally occurring amino acid
  misc_feature (237)..(237): Xaa can be any naturally occurring amino acid
MADAKQQQAAAPTGVWKTIKPFVNGGASGMLATCVIQPIDMIKVKIQLGEGSAAQVAKTMYANEGLGSFYKGLSAGLLRQATYTTARLGSFRVLTNKAIEANDGKPLPLVQKAFIGLTAGAIGACVGSPADLALIRMQADSTLPAAQRRHYKNAFHALYRITADEGVLALWKGAGPTVGRAMSLNMGMLASYDQSVELFRDQMGAGEKPNGNGTPAIFGFGAXASILPFDSGKPQIXKMHPDATGKYPYTGSLDCAMQTLKTGGPFKFYSGFPVYCVRIAPHVMMTWLFLNQIQKYQKKIGI

SEQ ID NO: 7050 - protein, 262 aa, Triticum aestivum
  misc_feature (61)..(61): Xaa can be any naturally occurring amino acid
  misc_feature (249)..(249): Xaa can be any naturally occurring amino acid
MAGLYEKPSETYAKKRPRYPKEWFSMLASLTAGHHRAWDAGCGSGQASLSIAEHYDSVVAXDVRAGQLRHAIAHPQVRSLHTPAALPEAALVALVGGAGSLDLVIVAPALHWFDVPLFYAVVHRVLRQPGGVLAVWGYNYDIHPFGDKLHGTLYPAMRPYMDPRTRLAMERYRELPFPFEPVGVGREGEPADVDMEAEMTLEDLAGFVMTGSVATTAREKGVDLEALVKGVMKEVEEGWGDEPTVPRKXLVFKAFMLAGRPR

SEQ ID NO: 7051 - protein, 190 aa, Magnaporthe grisea 70-15
MAFLILVIGDLHIPDRALDIPPKFKKLLAPGKIGQTLCLGNLTDRTTYEYLRSVAPDLKIVKGRLDVEATSLPLSQVVTHGSIRIGFLEGFTLVSNEPDLLLAEANKLDVDVLCWGGTHRFECFEYMDKFFINPGSATGAFTTGWGTEEDIVPSFCLMDLRKDENGVENVAVEKVTYTKVVEPPTTASAS

SEQ ID NO: 7052 - protein, 1066 aa, Xanthomonas campestris pv. campestris str. ATCC 33913
MNAQPDTFASSHLARPLLAPELPAAPGALRAAITAAWLKDETEHVRELLEQARLPAAEQAKVQALAADLVTRVRARAQDQGAIEAFMRQYDLGSEEGVLLMCVAEALLRIPDQDTADKLIRDKLGEADWKKHVGGSDSVLVNASTWGLMLTGKLVQLNDLTRADVPGAFKRLIGRVGEPVIRLAVRQAMKIMGHQFVMGRTIGEALARSRKGDNANYRYSFDMLGEGALTMKDAQRYLQAYRDAIHAIGRSGSFVGTDVFAAPSISIKLSALYPRYEHAKRARVMAELVPGVLELAQLAKSYGIGYTVDAEEADRLELSLDIIEATFSDPSLDGWEGYGLAVQAYQKRTPYTIDFLADLARRVGRRIPVRLVKGAYWDAEIKRAQIDGHPGYPVFTRKQNTDVSYLACARRMFAHSDALYPMFATHNAQTIAAVRAISAGKTYEHQKLHGMGDDLYAEVIPADRLGLPCRVYAPVGSHEDLLPYLVRRLLENGANSSFVNRITDEDVAIEDLIRDPVEAVSSFASIPHPKIPLPADLLRSQNQNRKNSMGANLANDNDLRQLADQLTAAIKPWKAAPLVPGAVITTPSEAVFNPADRRETVGHWQPADPATVQKALASAAAAQPAWNRTPAASRATILEHAADLLEARMPEFMAICVKEAGKTLPDAVAEVREAVDFLRYYAAQARAQFGAPERLPGPTGESNELQLHGRGVFVCISPWNFPLAIFLGQVAAALAAGNTVIAKPAEQTNLVGFAAVKLLHEAGVPEAAVQFLPGDGATVGAALTNDPRVAGVAFTGSTDTARIINRTLAARDAAIGVLIAETGGQNAFIADSSSLPEAVVKDAISSAFISAGQRCSAARVLFVQDDIADKVMTMLAGAMGELKIGDPALLSTDVGPVIDADALKILEEHASRMDSEARLIGTTTLDSATAHGSFFAPRAYELKSLAQLQREIFGPVLHIIRWKADQLDSVIDQINATGYGLTLGVHSRIDETIDRITSRVAVGNVYVNRNQIGAVVGVQPFGGQGLSGTGPKAGGPHYLLRFATEKVVTVNTTAAGGNASLLTLGD

SEQ ID NO: 7053 - protein, 508 aa, Rhodococcus sp. RHA1
MTAIPHYTQFIDGQWVDTDRTFDIIDPANGELVATAARGSVENLDQAVAAAKAAHARGEWRTKTPDERADILSAIVADLSERMEELVALHVKENGVTIRQAMAFHVGYSISHLQYFADLARTYEFERSGPQLSYPTLASGIVRREPIGVVAGIVPWNFPLLLAVWKLGPALAAGNTIVLKPDEKTPLTLLELAKSAERAGLPKGVLNIVTGAGEEVGARLAAHPDVRKIAFTGSTAVGREISKLAAENIKKVTLELGGKGPNIVLADADIDSAVDGALFACFLYAGQACESGTRLLLPESLHDEFVDRLVQRAATIKVGDPSEFDTDIGPVISAEQHARILDYIEIGQKEGATLAFGGEPPTGTQFEQGHWVRPTIFTDVTPDMRIAREEIFGPVLSVLKYRTVDEAVAIANDSEYGLSAGVWSEDLEAALVVAARIESGTVWINDWHMVNALYPFGGYKQSGNGRELGPHALDEYTEEKFVHVDLSRSVDRKVYDLVLPAAQAAVNR

SEQ ID NO: 7054 - protein, 128 aa, Yersinia pestis CO92
MLRAIKTKLAPAAIGPYVQGVDLGSMIMTSGQIPIDPKTGLVADDIAAQARQSLENVKAIVEAAGLKVADIVKTTVFVKDLNDFSIVNATYEAFFTEHSAPFPARSCVEVARLPKDVKIEIEAIAVRR

SEQ ID NO: 7055 - protein, 1065 aa, Candida glabrata CBS 138
MDSNDLFDVFSAVPEEVPDVSDEEIENDSAKVPKSNEKHTLTSDEEDGESNKKVKPNKTSGSKKETSKIIPIVADDFEQEASREVDASAGLSTQATTEVEEDGKVKLSHQVRHQVALPPFYDYKPIGQHKRTNEARTYPFTLDPFQDTAISCIDRGESVLVSAHTSAGKTVVAEYAIAQSLREKQRVIYTSPIKALSNQKYRELLAEFGDVGLMTGDITINPDAGCLVMTTEILRSMLYRGSEVMREVAWVIFDEVHYMRDKERGVVWEETIILLPDKVRYVFLSATIPNAMEFAEWICKIHSQPCHIVYTNFRPTPLQHYLFPAHGDGIYLVVDEKSTFREENFQKAMTSIGNQAGDDPNSTESRGKKGQTFKGGAAKGDAKGDIYKIVKMIWKKKYNPVIVFSFSKRDCEELALKMSKLDFNSDDEKDALTKIFNNAIALLPENDRELPQIKHILPLLRRGIGIHHSGLLPILKEVIEILFQEGFLKVLFATETFSIGLNMPAKTVVFTSVRKWDGQQFRWVSGGEYIQMSGRAGRRGLDDRGIVIMMIDEKMEPQVAKGMVKGQADRLDSAFHLGYNMILNLMRVEGISPEFMLENSFFQFQNVIAVPVMEKKLIEYQQQYDNIHIEDESGIKEYYEVKQTLKGYYEDVRKVMTHPAHLLSFLQPGRLIEVVVDGNQRYGWGAVVDFAKRVNKRNPTAVYSDYDSYIVNVVVSSMYVDSPINLIKPFNPAFPEGIRPAQEGEKSLCAIIPITISSITNVGNLRLFMPKDVKASGQVDIVGKSLKEVGRRFPDGIPLIDPVKHMKITDDDFMKLQKKIQVLEEKLKTNPLHGSVKLNELYEAYNSKHELSDAMKKLRAKITDSQAVIQLDDLRKRKRVLRRLEFCTPNDIIELKGRVACEISSGDELLLTELIFNGNFTELKPEQAAALLSCFAFQERCKEAPKLKPELSEPLKDLRELAAKIAKIMKDSKIEVVEKDYVESFRHELMEVVYEWCRGASFTQICKMTDVYEGSLIRMFKRLEELVKELVDVANTIGNQALREKMEAVLKLIHRDIVSAGSLYL

SEQ ID NO: 7056 - protein, 504 aa, Silicibacter pomeroyi DSS-3
MQVARPDSLVSQILPAVADYLDSPAKLLLGGTSTAASDGRTMDVFNPATGKKLAEVPWGGAAEIDLAVKAAQAALEGDWSRMRPVERQRVLLNLADLIEANGEELAQLETLNNGKSVMLSRLVEVGNSSNYLRYMAGWSTKIEGSTIDVSIAVPPGAKYQAYTRKEPVGVVGAITPWNFPLNMAIWKLAPALACGNTVVLKPAEETPLTSLRLGELCLEAGLPPGVVNVVSGTGAEAGAALTAHPGVNKLTFTGSTEVGKIIGIQAMRDMKRVTLELGGKAPMVMFDDMDLDQLSEAARIGILFNSGQTCCAGTRIYAQRGIYDRICETMANVVGALSVGSGLDPANAINPMVSAKHQAHVSACIAGGVEEGATPLLDTGAYDGEGYFVRPQIFTDVRQDMRIMQDEVFGPVFTITPFDDPDEAIRMANDTRYGLGASIWTTNLNTMHRYVPQLQAGTVWVNSHNVPDANMPFGGYKQSGIGREHGRAALDAYLETKSVCIAVR

SEQ ID NO: 7057 - protein, 464 aa, Pseudomonas aeruginosa UCBPP-PA14
MASQRNNGILIGGKRPEYVHSAQGTGLRRILGLPALVFFGLVYMVPLTMFTTYGVVTEITGGRTASAYLITLAAMLFTAFSYSFMVKKYPIAGSAYSYTSLSFGPCVGFLAGWSLLLDYLFLPMINYLLIGLFLNIAFPMVPAWVFVLTAIGLVTVLNVIGISSVAGMSNVIVGAQFVFAVVFVAMAVKHLAGIPSLDLSLPFVGDGSQPGFAPLMAGAAVLCLSFLGFDAVSTLAEETRDPQRDIPRAIVITTVGAGLLFTVLAVFSQLVFPGSVFQDAESAANEVMLAAGGKFLASFFTAAYVAGAAGSALASQASVSRILYSMGRDGILPRRVFGSLSERFKTPVIAILVVSVISLLAVVIDLTTLASMISFGALVAFSAVNLAVIRSYLLLDGRRAPRDLLRYGLVPAIGLGLTLWLWTSLSALTLVIGLTWFAAGLAYLALHTGGFRRKAPTVTFSEQN

SEQ ID NO: 7058 - protein, 390 aa, Oryza sativa (indica cultivar-group)
MANGPHLLTLWWPSSPGRCADELGGVGAMDYDELDSMEREMTATPMARSLFLPSHHVAVTPYKLPDTATSTLITAGFVVELLGELWVLVGPISSLEQEGFQDRFGFLRYGEDGRIEGELERILGPQCLISDSWEVHSPDWCDPGVNFGEFLGSRIWPTVPARNRGNWGPIWCQLGSNLEVEAIDPAGEMIAAVGRGPEGWGEDEMSVLPRHTKVVVTGNNRTKSVLVGLHGVVKKAVGLGGWHWLVLTNGIEVKLQRNALSVIEPPTGNEDDDKFDCENMQWNSSDLASDDAQSPKPQRSRSRQHRGFQTKSFSRSMSCDSHSKASFSSSSRAHTKVDLSKLEMTALWRYWRHFNLDASPNPSREQLVDAVQRHFVSQAAKRLKTNVKVA

SEQ ID NO: 7059 - protein, 114 aa, Oryza sativa (japonica cultivar-group)
MARQQLLGLFLVLAIMVAVVWGDPSGGCDQDRQDMIRECKKYEGWPAEPKIEPSEACCAVWQRANIPCLCAGVTKEKEKVWCMEKVVYVAKFCKKPFQPGYQCGSYTVPSSLGQ

SEQ ID NO: 7060 - protein, 510 aa, Oryza sativa (indica cultivar-group)
MAVSLKSSGSFCSTPPQWLHSTRDRILYGYSHSNAKECTCKKTKRPAPLCVKATSTKVELDFNDPSWKQKFQEDWDKRFNLPRITDIYDLKPRPTTFSLKKNRSPAGDENGTPMDKWNGYVNSDDRALLKVIKYSSPNSAGAECIDPDCSWVEQWVHRAGPRKEIYYEPEEVKAAIVTCGGLCPGLNDVIRQIVFTLETYGVKNIVGIPFGYRGFFEKGLKEMPLSRHLVENINLAGGSFLGVSRGGAKTSEIVDSIQARRIDMLFVLGGNGTHAGANAIHEECQKRKLKVSVVAVPKTIDNDILLMDKTFGFDTAVEEAQRAINSAYIEVPFTLDGEYGVLRHLEHLLKTKGFCVVCVAEAAGQIQLEARESRAYDLVILRSLQELLQKSGATDASGNVILSDIGVHMQQKIKMHFKDIGVPADVKYIDPTYMVRACRANASDAILCTVLGQNAVHGAFAGFSGITSCICNTHYVYLPITEVITVPKRVNPNSRMWHRCLTSTGQPDFH

SEQ ID NO: 7061 - protein, 393 aa, Xanthobacter autotrophicus Py2
MAKNRRTGLRARRPRRVRGTGGGPDAWCRRVPPFRPAGKRIRVKARPPLIRAGVRRDVGARSQGSRAGGPGQSQAPRGRPHRPADKPQEPKAFAMSPISSASRFRGSFTALVTPFRDGALDEKAFRAFVDWQIAEGTHGLVPVGTTGESPTLSHEEHNRVVEWTVQQSAGRVPVMAGAGSNNTAEAVALAQHAQKVGADALLVVTPYYNKPTQEGLYQHFKAIANAVELPIFIYNIPSRSVIDMSVETMARLFEIKNIAGVKDATANLARVSLQRQVLGPDFIQLSGEDATALGFNAHGGQGCISVASNVAPRLCSDFQTACLSGDYKAALAIQDILMPLHTALFVETNPAPTKYALSLLGKMSEEARLPMVPVSETTRAVVKSAMVHAGLIN

SEQ ID NO: 7062 - protein, 124 aa, Glycine max
MAMASATTPATITVVAISSVASTKRRERNVHFIRGLNSFGGLKAQNSVTSLGLPVCTEQCFAKVVSSLKYQSSSKGRGGGAASSTCNAAGEIFQIAAIMNGLVLVGVAIGFVLLRVEAFVEESE

SEQ ID NO: 7063 - protein, 215 aa, Arabidopsis thaliana
MKLVEKTTTTEQDNGEDFCRTIIEVSEVNRNVFQAPGGEADPFRVVSGEELHLIPPLNFSMVDNGIFRSGFPDSANFSFLQTLGLRSIIYLCPEPYPESNLQFLKSNGIRLFQFGIEGNKEPFVNIPDHKIRMALKVLLDEKNHPVLIHCKRGKHRTGCLVGCLRKLQKWCLTSIFDEYQRFAAAKARVSDQRFMEIFDVSSFSHIPMSFSCSIR

SEQ ID NO: 7064 - protein, 310 aa, Schizosaccharomyces pombe
MDVSTQTRHATYFQDENQLQKDHIYVKKKSHIKLNTGVRAPFKAVDNINQQDEPTLIEGNNESSISSSTGDTFEEDFAYQDKVEIEERSIRSTPKSIGDDDLENREGSFDAPEGILTHGKHRLPTIPEWTKEDLAALSEAAARLQANPSPEDIETDPSMVPDYDPEIFHYMQSLERKLAPPPNYMSVQQEIDWVTRHMLVDWIVQVQIHFRLLPETLFLAVNLIDRFLSIKVVSLQKVQLVGLSALLIACKYEEIHPPSIYNFAHVVQGIFTVDEIIRAERYMLMLLDFDISWPGPMSFLRRISRADSYD

SEQ ID NO: 7065 - protein, 440 aa, Arabidopsis thaliana
MRRRSKKIKTENNSNPETSEERNKFDEIPHDLVIEILERLPLKSVARFLTVSKLWATTIRSPDFRKSYRGGSSSEPRTLIVSDLNFKEPNPKLHFFRPSISSPSFLSSLTCPFTYPRHEEYYYHHVNGLISVGYGTDQIVINPTTGKFITLPRPKTRRKLVISFFGYDSVSDQYKVLCMTERLRGHPEEASSQHQVYTLGAKQKSWKMINCSIPHRPWSWNAVCINGVVYYIAKTGEGMFRRCLMRFDLKSDNLDLCTILPEEIQTSLHDYFLINYKGKVAIPNQPNFYTYDVWVMNQEGGKIEWLKNITFTIKPRKGFVRYLFVTGTTHTGEFILAPTSYTDEFYVFHYNPDMNSFRKIRVQAPGVKRDMVLIPIIISIEPWKSLLRLDNLHIRGSTHTATGEFILAPRFYSDDLNVIHFNPDTNSFRSTKVEVYEDYE

SEQ ID NO: 7066 - protein, 230 aa, Streptococcus pneumoniae TIGR4
MVKLVFARHGESEWNKANLFTGWADVDLSEKGTQQAIDAGKLIKEAGIEFDQAYTSVLKRAIKTTNLALEASDQLWVPVEKSWRLNERHYGGLTGKNKAEAAEQFGDEQVHIWRRSYDVLPPNMDRDDEHSAHTDRRYASLDDSVIPDAENLKVTLERALPFWEDKIAPALKDGKNVFVGAHGNSIRALVKHIKGLSDDEIMDVEIPNFPPLVFEFDEKLNVVSEYYLGK

SEQ ID NO: 7067 - protein, 244 aa, Oryza sativa (indica cultivar-group)
MDTEFPGIVCRPVGNFRTTDEFNYANLEANVNMLKLIQLGLTLSDEGGDLPRRGTGGRRCIWQFNFRGFDPRTDPSNADSIQMLRTCGIDFDRFAAEGADPIRFAELLMSSGVVLNADVQWITFHSGYDFGYLLRLLTGRNLPDNMPAFFDLIRIYFPVLYDIKHLMRFCSNLHGGLSRLGELLDVKRVGTCHQAGSDSLLTLGCYNKIKEVYFKGSTEKHAGVLYGLVIEDGVNRPPPTQPNE

SEQ ID NO: 7068 - protein, 1781 aa, Arabidopsis thaliana
MASDEEENIIPFQLQFDKPIPFQIKIAEWNPEKDLLAMVTEDSKILLHRFNWQRLWTISPGKPVTSLCWRPDGKAIAVGLEDGTISLHDVEAKFGLQDESGNFSVYEDRTSRFFPPAPRPPKMPGLVAGDSSFMDDGEDSLAELSNTSFRKFNILCTGDRDGNICFSIFGIFQIGKINIHELSLPVPHLDEHASCKLFNASIYKVALSKDLCRLVVMCTGELKDCDIKPREEKINVQDLPGLHCLAMDTSIFWKRKYELHQVAQQASNIEDLTEVIRASLSVMNKQWADAMKTFHEKFHSLSTLIIDNDLQGFVAFLLGLESSPQEEFLSLLGGARISPALNQFLVNSLGEVGVKRVLKSVCGTGKELQQVVLDHLQPAAEIIGFRIGELRGLSRWRARYQGIGLDEMLLNEATENTGLLLVQVQRFMMVLSSVVQQFSNFFNWLVRSIKYLMQEPNDQLLSYNSELLVVFLKFLYDQDPVKDLLELSEAGDDIEIDLKTIGRVKELLQFGGFSECDFLQRTLAKEFQHMESSFKMASQMPFTTISRKISCMKLLPLCPLQLSTTQTPTTIPMSLSFYKNELSDDTPCQSGYTDYISFQVPDETFPEISNCIGIAKGYKQNSNNEKNGYTSLEAVLLSVPNGYTCVDLSLYKDKELVLLLNKTNTDSEGSGEACMMVVQTGDLAFISISGSSSLNQWELEDLKGSIVNLEMENEKVRKVPHSVIAPLAVSASRGVACVFAERRRALVYILEEDEDEEISDENSTKEARRNSLSFSKLYATVTEVVLFCLMENDQFMCPTDIITGIVFIDGELAMLTLTADGELRWTEYGLRQYLSMKKDVLGFIVEGKQIRVKAVVEKEAGGICCGQFGGDFVRKDFVFEPLIDQNGWCYKLRQYLDSLGRPKRLLVFVNPFGGKKSAREIFVKEVKPLFEDADVQLEIQETKYQLHAKEFVKSMDVSKYDGIVCVSGDGILVEVVNGLLERADWRNALKLPIGMVPAGTGNGMIKSLLDTVGLRCCANSATISIIRGHKRSVDVATIAQGNTKFFSVLMLAWGLIADIDIESEKFRWMGSARIDFYALQRIICLRRYNGRILFLPAPGFEGYGQPASCSLYQEPHVSDKEVGYQGPETKFEDLEWREMKGPFVTIWLHNVPWGSENTLTAPAAKFSDGYLDLIVLKNCPKLVLLSLMRQTSSGTHVESPYIVYIKLTVEKVKAFVLEPGALVDEPDKEGIIDSDGEVLARGKRTYKCDQKALMSYDKLQVTVDQERLFCKFCISQRELVLAKLSPTTKLVSLHLAMDRQPERENDELPSPAIISDRVLVNGVVTPLTLTAEGELRSTESGRRKSTLAKEILSFVVEGNKVRVKTLVEKGGGICCRGSAGDYARNDFVFEPLSDESRKLWSDKFHQHLVSLGRPKKLLVFVNPFGGKKTARKIFQEEVKPLFEDANIQLEIQETKYQLHAKEIVRSMDVSKYDGIVCVSGDGILVEVVNGLLEREDWKTAIKLPIGMVPAGSGNGMIKSLLEPVGLPCSATSATISIIRGRTRSLDVATISQGTTKFFSVLMLAWGLVADIDIESEKFRWMGSARFDIYGLQRIICLRQYHGRILFVPAPGFESYGQRASCSIDKEPSGSDKTLVYQGPDSKLENLDWREMKGPFVSVWLHNVPWGAENTLAAPDAKFSDGFLDLIVMKDCPKLALLSLMTKLSDGTHVQSPYASYLKVKAFVLEPGARIDEPDKEGIIDSDGEVLARGRKSYKCDQKALMSYDKLQISVDQGLATLFSPE

SEQ ID NO: 7069 - protein, 162 aa, Pyrococcus abyssi GE5
MVSMCENEKERTLVIIKPDAVIRGLIGEIISRFEKRGLKIVGMKMIWISKELAEKHYAEHREKPFFKSLVEYITRTPVVVMVVEGRCAIEVVRKMAGATDPKNAEPGTIRGDFALEVSDAICNVVHASDSKESAEREIKLYFRDDEIFDYPRAEDWFYRKGI

SEQ ID NO: 7070 - protein, 443 aa, Oryza sativa (indica cultivar-group)
MGEEKQNDERKNKYAVGCSIIGSIISVLMGYDTGVMSGAMLFIKEDLKTNDTQVQVLAGILNVCALVGSLTAGRVSDCVGRRLTISLAACIFLAGSVLMGLAPNFATLLAGRCVAGVGVGYALMIAPVYAAEIASADIRGSLTSLPEICISFGILIGYVANYLLAKLPLVYGWRAMLGLGALPSAALALGVLAMPESPRWLVVQGRAEEALSVLRRRHLTGIEAVVLYSPRIFKAAGIASRNSVLAATIGVGVTKTAFILTAILLVDRIGRRPLYLSSLAGIIASLACLGMGLTVIERSPPHHSPAWAVVLAIATVFTFVASFSIGVGPITWAYSSEVYPLRLRAQGASVGVAINRVMNAGVSMTFVSLYKAITIGGAFFLFAGLAVAAATFFYLLCPETQGKPLEEIEEVFSQGWRARRRASAAAVEMPASGGGGGGGAPMA

SEQ ID NO: 7071 - protein, 1122 aa, Arabidopsis thaliana
MSGSRPTQSSEGSRRSRHSARIIAQTTVDAKLHADFEESGSSFDYSTSVRVTGPVVENQPPRSDKVTTTYLHHIQKGKLIQPFGCLLALDEKTFKVIAYSENASELLTMASHAVPSVGEHPVLGIGTDIRSLFTAPSASALQKALGFGDVSLLNPILVHCRTSAKPFYAIIHRVTGSIIIDFEPVKPYEVPMTAAGALQSYKLAAKAITRLQSLPSGSMERLCDTMVQEVFELTGYDRVMAYKFHEDDHGEVVSEVTKPGLEPYLGLHYPATDIPQAARFLFMKNKVRMIVDCNAKHARVLQDEKLSFDLTLCGSTLRAPHSCHLQYMANMDSIASLVMAVVVNEEDGEGDAPDATTQPQKRKRLWGLVVCHNTTPRFVPFPLRYACEFLAQVFAIHVNKEVELDNQMVEKNILRTQTLLCDMLMRDAPLGIVSQSPNIMDLVKCDGAALLYKDKIWKLGTTPSEFHLQEIASWLCEYHMDSTGLSTDSLHDAGFPRALSLGDSVCGMAAVRISSKDMIFWFRSHTAGEVRWGGAKHDPDDRDDARRMHPRSSFKAFLEVVKTRSLPWKDYEMDAIHSLQLILRNAFKDSETTDVNTKVIYSKLNDLKIDGIQELEAVTSEMVRLIETATVPILAVDSDGLVNGWNTKIAELTGLSVDEAIGKHFLTLVEDSSVEIVKRMLENALEGTEEQNVQFEIKTHLSRADAGPISLVVNACASRDLHENVVGVCFVAHDLTGQKTVMDKFTRIEGDYKAIIQNPNPLIPPIFGTDEFGWCTEWNPAMSKLTGLKREEVIDKMLLGEVFGTQKSCCRLKNQEAFVNLGIVLNNAVTSQDPEKVSFAFFTRGGKYVECLLCVSKKLDREGVVTGVFCFLQLASHELQQALHVQRLAERTAVKRLKALAYIKRQIRNPLSGIMFTRKMIEGTELGPEQRRILQTSALCQKQLSKILDDSDLESIIEGCLDLEMKEFTLNEVLTASTSQVMMKSNGKSVRITNETGEEVMSDTLYGDSIRLQQVLADFMLMAVNFTPSGGQLTVSASLRKDQLGRSVHLANLEIRLTHTGAGIPEFLLNQMFGTEEDVSEEGLSLMVSRKLVKLMNGDVQYLRQAGKSSFIITAELAAANK

SEQ ID NO: 7072 - protein, 144 aa, Glycine max
MVAFTEKQDALVSSSFEAFKANIPQYSVVFYTSILEKAPAAKDLFSFLANGVDPTNPKLTGHAEKLFALVRDSAGQLKTNGTVVADAALVSIHAQKAVTDPQFVVVKEALLKTIKEAVGGNWSDELSSAWEVAYDELAAAIKKA

SEQ ID NO: 7073 - protein, 355 aa, Fusarium oxysporum f. sp. lycopersici
MSRSNPPNAAGSRKISFNVSEQYDIQDVVGEGAYGVVCSAIHKPSGQKVAIKKITPFDHSMFCLRTLREMKLLRYFNHENIISILDIQKPRNYESFNEVYLIQELMETDMHRVIRTQDLSDDHCQYFIYQTLRALKAMHSANVLHRDLKPSNLLLNANCDLKVCDFGLARSAASQEDNSGFMTEYVATRWYRAPEIMLTFKEYTKAIDVWSVGCILAEMLSGKPLFPGKDYHHQLTLILDVLGTPTMEDYYGIKSRRAREYIRSLPFKKKVPFRTLFPKTSDLALDLLEKLLAFNPVKRITVEEALKHPYLEPYHDPEDEPTAPPIPEEFFDFDKHKDNLSKEQLKQLIYQEIMR

SEQ ID NO: 7074 - protein, 1012 aa, Ralstonia eutropha JMP134
MILTRKRAAQGASTRLADGLAQASTTSTTSGSGRLATRLAAGLAGAMPTMDRRSFLKRSGIGVGVGLAASQLTLLRKADAADDKTVAAAEGKGGIVVKRTVCGHCSVGCAVDAVVQNGVWVRQEPVFDSPINMGAHCAKGAALREHGHGEYRLKYPMKLINGKYQRISWDQALDEITAKMKEMRQQTGPDSLFFVGSSKHSNEQSYLLRKWVSFFGTNNTDHQARICHSTTVAGVANTWGYGAMTNSYNDMQNAKAALYIGSNAAEAHPVSMLHLLHAKENGCKVIVVDPRFTRTAAKADHYVRIRSGTDIAFLFGVLYHIFQNGWEDPKYLQDRVYGMDKVRAEVLAKWTPDKVEEVCGVPEAQVKMVAETMAKNRPSTLVWCMGQTQHTIGNAIVRASCIVQLALGNIGVSGGGANIFRGHDNVQGATDVGPNPDSLPGYYGLATGAWKHYAAVWGVDYEWIKKQFASQTMMEKSGTTVSRWIDIVTEKNELIDQDNNVRSVFFWGHAPNSQTRGLEMKKAMDKLDLLVVIDPYPSATAAMANMPPAEGDKVNPNRAVYLLPACTQFETSGSCTASNRSLQWREKVIEPLFESMPDHTIMQAFADKLGFGKELSKNYKMIEVKRAGRTWMEPEIESILREINRSNWTIGYTGQSPERLKAHMRNMQMFDVKTLRCSGGKDAATGYDLTGDYFGLPWPCYGNPELKHPGSANLYDTSKHVMDGGGNFRANFGVERDGVNLLAEDGSCSKGAEITTGYPEFDHVLLKKLGWWDDLTDDEKKAAEGKNWKTDLSGGIQRVVLKVHGCHPFGNAKARAVVWNFPDPIPQHREPLYSTRPDMVAKYPTHDDKMAFWRLPTLYKTVQQRNIENKVYEKFPIILTSGRLVEYEGGGEETRSNPWLAELQQENFVEINPRAASDRGIRNGDFCWVKTPTGARIKVRALVTERVGPDTAFIPFHFSGWWQGKDLKDYYPDGAMPIVRGEAVNTATTYGYDSVTMMQETKTTICQIERFA

SEQ ID NO: 7075 - protein, 506 aa, Arabidopsis thaliana
MVRKRETNPGVRVVGKRIYDSQNGKSCHQCRQKTLDFAAPCKAMRRKKLCPIKFCYKCLSIRYGENAEEVAKLDDWICPLCRGICICSVCRKAQGLEPTGILAHEAKARGYSSVYALLEAEGHDKFAYQKKPELVLKKIIQIVVLVSACNEGSSSNSESVPGTEVGILDVPKEKKKVVDKRKRAKPSDKLKEEIQLEAQLPEGISLTCVSRIDIPTEEAGNVCQLFEFCSAFGKALALKEGHAETIVRELFICGRNTRRQQYCSITQMMIQLLDLISKDREMSLSLSATDSSWFTAIGEILSKSEVLSDELPLETFVGGVAAYEKMNASRKLKLLNFLCDESLSTWAMRNYINSQTEECGERKKEAKQKAAAAKQKEKQLKQKMQGEVAKSIMEKNGAPLSIEEHNSIVSQIRDEAKEAHEEMMEAKGMKSKMTLICDARRTEPIMLDDNGFVLWKLKCFEEEQFFLLQDLGTFDDLCPHERWLAFKPEQKPEIENISLVRGKSFL

SEQ ID NO: 7076 - protein, 498 aa, Rhodococcus sp. RHA1
MRSEEALTSTQTSQQALLEAVPTGLYIGGQWRPSETGNTFPVHDPATGRELAVVADATVADGATALDAAATAQKAWSRTAPRERAELLRAAFDAVIARSDDFAMLMTLEMGKPLAEARGEVTYGAEFLRWFSEEAVRVSGRYSAAPDGKTRLLVHKRPVGPCLFITPWNFPLAMATRKIAPAIAAGCTMVVKPATLTPLTTLLFAQVLEEVGLPAGVLNVIPTSRAGAVTGPLIADPRLRKLSFTGSTEVGRRLLADSAEQVLRTSMELGGNAPFLVFADADIDAAVDGAVIAKLRNMGEACTAANRFIVHESVADEFATKLAGKMARLVVGPGIDADSQLGPLIDEESRAKVHDLVQDAVAHGAAIVTGGRPVPGDGYFYSPTVLTGVTTDARILREEVFGPVAPIMTFQDEEHAIQVANDTEYGLVAYVYTRDTARTLRMSEELESGMLGINVGVVSNPAAPFGGVKQSGLGREGGFEGIDEYLDIRYVGLADPYA

SEQ ID NO: 7077 - protein, 289 aa, Acidovorax sp. JS42
MPDHSFASSQSVTPELRQWILDQSGAGIATPALIEAMRNAGWADSVAVRAVEEVLRAHLDGAVQPQGLPPAVPVPEPDIADAPLFIDVGDRQVEVLMSMAHPRVVLFGNLLSPEECQAIIDAAQPRMARSLTVQTTTGGEEVNADRTSDGMFFQRGETPVVQRLEERIARLVRWPIQNGEGLQVLHYRPGAEYKPHYDYFDPDQPGTSTIVRRGGQRVATLVIYLNNPLKGGGTTFPDVPLEVAPRQGNAVFFSYERPHPSTRTLHGGASVIEGEKWIATKWLREREFK

SEQ ID NO: 7078 - protein, 110 aa, Anaplasma marginale str. St. Maries
MSSDPVADRIRNEIETSDVVLYMKGTADAPQCGFSGVVVEALRNVGVQFRDVDVLKDPELREGIKKFADWPTIPQLYVKGEFIGGCDIVREMYHSGELHALLKSKGIIAG

SEQ ID NO: 7079 - protein, 326 aa, Azoarcus sp. EbN1
MTELNLIEAINHALAHELARDPAVVLLGEDIGVNGGVFRATAGLQQRFGAARVVDTPLAETAIAGTAVGMAAMGLKPVAEIQFAGFIYPTFDHIINHASRLRHRTRSRMSCPLVLRSPSGAGIHAPEHHSESTEALFAHVPGLRVVIPSSPSRAYGLLLAAIRDPDPVIFLEPTRLYRLFKQEVADDGEALPLDVCFTLRSGSDVTLVSWGAMVHETQAAADALAQQGIMAEVIDVATLKPLDMGTILESVGRTGRCVIVHEAARTAGFGAEIAANLAEEGLYTLLAPVRRVTGYDTVVPLARLEYQYLPSVERIVAAVHKTLEGA

SEQ ID NO: 7080 - protein, 504 aa, Triticum aestivum
LYVQALVLAAVAVALLQLLKAALNPMRERAPPGPWKLPVIGSMHHLVNVLPHRKLRDLADAHGPLMMLQLGQTPLVVASSKETARLVLKTHDSNFATRPKLLAGEIVGYEWADILFSPSGDYWRKLRHLCTGEILSPKRVRSFRHIREDEVRMRVDQIRQAGPSTPVNLSVMFHNVTNSIVARAAFGKKRKNAAEFQAAIKSGVGLASGFNIPDLFPTWTTVLAKLTGMKRSLQDIHKTVDAILQEIIDERKAARVEKIKAGAENVDENLVDVLIGLQEKGGFGFHLDDSRMKAIILDMFGGGTGTSASAMEWGMSELMRNPRVMKKLQGQIREAFKGKAVVTEDDLQESNLQYLKMVIKEALRLHPPAPLLVPRESIDQCELEGYTVPAKSRVIINAWAIGRDPKYWEAPEEFRPERFEDSTVDFTGSSYEFLPFGAGRRMCPGFNYGLASMELALVGLLYHFDWSLPDGVAEVDMEEAPGLGVRRLTPLMLLATPFVPAAVA

SEQ ID NO: 7081 - protein, 411 aa, Zea mays
MNALAATSRNFKQAAKLLGLDSKLEKSLLIPFREIKVECTIPKDDGTLASYVGFRVQHDNARGPMKGGIRYHHEVDPDEVNALAQLMTWKTAVANIPYGGAKGGIGCSPGDLSISELERLTRVFTQKIHDLIGIHTDVPAPDMGTNSQTMAWILDEYSKFHGYSPAVVTGKPVDLGGSLGRDAATGRGVLFATEALLAEHGKGISGQRFVIQGFGNVGSWAAQLINEAGGKVIAISDVTGAVKNVNGLDIAQLVKHSAENRGIKGFNGGDAIDPNSLLTEECDVLIPAALGGVINKDNANDIKAKYIIEAANHPSDPEADEILSKKGVIILPDILANSGGVTVSYFEWVQNIQGFMWDEEKVNAELRTYMTRAFGDVKEMCRSHNCDLRMGAFTLGVNRVARATVLRGWEA

SEQ ID NO: 7082 - protein, 310 aa, Shigella flexneri 2a str. 301
MLDANKLQQAVDQAYTQFHSLNGGQNADYIPFLANVPGQLAAVAIVTCDGNVYSAGDSDYRFALESISKVCTLALALEDVGPQAVQDKIGADPTGLPFNSVIALELHGGKPLSPLVNAGAIATTSLINAENAEQRWQRILHIQQQLAGEQVALSDEVNQSEQTTNFHNRAIAWLLYSAGYLYCDAMEACDVYTRQCSTLINTVELATLGATLAAGGVNPLTHKRVLQADNVPYILAEMMMEGLYGRSGDWAYRVGLPGKSGVGGGILAVVPGVMGIAAFSPPLDEEGNSVRGQKMVASVAKQLGYNVFKG

SEQ ID NO: 7083 - protein, 354 aa, Pyrococcus abyssi GE5
MKLRIAVIPGDGIGKEVVAEGLKVLKKLEELSRVSFEFKEYPFGAEHYLKTGETLPDWAIEEFKKFDAIYFGAIGDPRVKPGILERGILLKMRFELDLYVNLRPVKLYHPRLTPLKGKNKIDIVFVRENTEGLYAGAGGFLRKGTPQEIAVQEMINTRFGVERVIRFAFEYAKRSGRKKVTLVDKANVLTYAHDLWERVFAEVSQEYDLETDHYYVDAMAMKMIRSPESFDVVVTPNMFGDILTDLGAEIVGGLGIAASGNINPETTGMFEPVHGSAPDIAGKRIANPLAAILSASMMLEYLNLEKESKWIEEAVKRAIAENKVTPDMNGNLKTYEVGDWVVKFLEVVANEEEG

SEQ ID NO: 7084 - protein, 174 aa, Magnetospirillum magnetotacticum MS-1
MTTKAFVVGHPIAHSRSPLIHGHWLAAHGLDGSYERIDVAPEEFEAFFHGLPGSGFAGGNVTIPHKETAFRLAHTLTARARTIGAVNTLIVEGDRVLGDNTDAPGFIAHLDQSLGEGWPERTGRHALVLGAGGAARAIVVGLVERGLSVRVANRSPERARTLAALDPDHVAALP

SEQ ID NO: 7085 - protein, 411 aa, Arabidopsis thaliana
MNALAATNRNFKLAARLLGLDSKLEKSLLIPFREIKVECTIPKDDGTLASFVGFRVQHDNARGPMKGGIRYHPEVDPDEVNALAQLMTWKTAVAKIPYGGAKGGIGCDPSKLSISELERLTRVFTQKIHDLIGIHTDVPAPDMGTGPQTMAWILDEYSKFHGYSPAVVTGKPIDLGGSLGRDAATGRGVMFGTEALLNEHGKTISGQRFVIQGFGNVGSWAAKLISEKGGKIVAVSDITGAIKNKDGIDIPALLKHTKEHRGVKGFDGADPIDPNSILVEDCDILVPAALGGVINRENANEIKAKFIIEAANHPTDPDADEILSKKGVVILPDIYANSGGVTVSYFEWVQNIQGFMWEEEKVNDELKTYMTRSFKDLKEMCKTHSCDLRMGAFTLGVNRVAQATILRGWGA

SEQ ID NO: 7086 - protein, 181 aa, Zea mays
  misc_feature (40)..(40): Xaa can be any naturally occurring amino acid
MASSMLSNAAVATTVVNRNAGAQASMVGLKSVAAFPLTKXKSTNDLSSLPTNGGRVQCMKVWPTQNMKRYETLSYLPPLTTDQLARQVDYLLNNKWVPCLEFETEHGFVYREHHNSPGYYDGRYWTMWKLPMFGCTDPAQVLNELEECKKEYPNAFIRIIGFDSNRQVQCVSFIAYKPEGY

SEQ ID NO: 7087 - protein, 433 aa, Candida glabrata CBS 138
MKRTLNRMTKITPNKYFQKNTSKDVWTLTNEFAASAVGKSEGRELINLGQGFFSYSPPQFAINAAKSALDVPLVNQYSPTRGRPSLIKSLVELYKPVFGDFIDNQNVLVTTGANEGILSCLMGILNAGDEVIVFEPFFDQYIPNIELCGGVVRYVPIHPPKEMKTRNTTGDEWQIDWDALEKTFNNKTKAVIINTPHNPIGKVFTEQELTKLAQLCVEHNTVVISDEVYEHLYFTESFPRIANINEDIANLTLTVGSAGKSFAATGWRIGWIISKNDQLLNYVSKAHTRICFASPSPLQEACAGSIEHALKIDYFPKMREEYRKKFEILTTAFDKLGLNYTQPEGTYFILVDFSKVKIPEDYVYPEELLEKAKDFRISYWLINEIGIVAIPPTEFYIKEHEKDAETLLRFAVCKEDEYLAKAAERFQLLKDYL

SEQ ID NO: 7088 - protein, 524 aa, Solanum lycopersicum
MDTCCAAMKSTVHLGRVSTGGFNNGEKEIFGEKIRGSLNNNLRINQLSKSLKLEKKIKFGEAYSVITIENDTETVFVDMPRLERRRANPKDVAAVILGGGEGTKLFPLTSRTATPAVPVGGCYRLIDIPMSNCINSAINKIFVLTQYNSAALNRHIARTYFGNGVSFGDGFVEVLAATQTPGEAGKKWFQGTADAVRKFIWVFEDAKNKNIENILVLSGDHLYRMDYMELVQNHIDRNADITLSCAPAEDSRASDFGLVKIDSRGRVVQFAEKPKGFDLKAMQVDTTLVGLSPQDAKKSPYIASMGVYVFKTDVLLKLLKWSYPTSNDFGSEIIPAAIDDYNVQAYIFKDYWEDIGTIKSFYNASLALTQEFPEFQFYDPKTPFYTSPRFLPPTKIDNCKIKDAIISHGCFLRDCTVEHSIVGERSRLDCGVELKDTFMMGADYYQTESEIASLLAEGKVPIGIGENTKIRKCIIDKNAKIGKNVSIINKDGVQEADRPEEGFYIRSGIIIIAEKATIRDGTVI

SEQ ID NO: 7089 - protein, 251 aa, Pseudomonas aeruginosa UCBPP-PA14
MCLIVFAWQPGHALPLLVAANRDEFYARPSLPLAAWEDAEGVFAGRDLEAGGTWLGLGPAGRFAALTNVRDPSQALGKRSRGELVADFLRGGGNPADYLAQVAGRAADYSGFNLLIGDRHQLWHYNPRVGPPRLLPAGVYGLSNAALDTPWPKLLKARAALAERLAEPHPQALLELLADAAPAADSQLPDTGVGLATERLLSSVFIASPSYGTRASSVVRVHADGTREMIERSFGPSGARLGEVSLVLPPG

SEQ ID NO: 7090 - protein, 404 aa, Rickettsia typhi str. Wilmington
MKYKYRNREINNKNTMTNKTITLNLGPQHPATHGVLRLILEMDGEVVNNADPHIGLLHRGTEKLIEHKTYLQAIPYFDRLDYVSPMCQEHAFALAVESLLECSVPRRAQFIRVLFSELTRILNHTLNIGSQALDIGATTPLLWLFEEREKIMEFYERVSGSRMHANYFRPGGVAEDLPEKLLEDINKFIEQFPSKLNDIENLLNENRLWKQRLVDIGVVSQKDAMDWGFSGPMLRGSGIAWDLRKSNPYDVYDEMDFEVPVGKNGDCYDRYLVRILEMYESIKIIKQCIAKMPKGQVKTDNPKLTPPTREKMKESMEAMIHHFKLYTEGYDVPIGETYKAVEAPKGEFGVYLYSQGGNKPYRCRIKAPGFAHLQGLNFMSKGHLISDVITIIATLDIVFGEIDR

SEQ ID NO: 7091 - protein, 1562 aa, Mycosphaerella graminicola
MWGYSVDERKLQREDTNGPPTNQWHNAQRTGGTHPTEEVEGEGEGTWGENDVGGFTTRQAMEDYEALRKDLTQLSKTRSRDTQHSLKRTTTGQTAKSGRKSLTSRQATHTSEAAEQDVEAGPQEEVEESKKDDDDEDDFELDRFMREGHFEKRSDGTSDKRVGVVYKDLTVKGIGSTTSFVRTLPDAIIGTFGPDLFKIICRFVPALAKRTGETRTLLNGFTGCVRDGEMMLVLGRPGSGCSTFLKAISNNRETYAEVTGDVSYGGIPADKQKKMYRGEVVYNQEDDVHFATLNVWQTFIFALMNKTKKKETGNIPVIAEALMKMFGIPHTKYTLVGDDFVRGVSGGERKRVSIAETLASKSTVVCWDNSTRGLDASTALDYARSLRVMTDVSNRTTLVTLYQAGEGIYEVMDKVLVIDEGREIYSGPAKEARQYFIDLGYEAPERQTTADFLTAVTDPVERKFRKGYEHKAPKGPEALEKAFRESPNYQKVLEDITDYENYLKETDYNDAREFEDAVQDGKSKRVSNKSSYTVSFQRQVLACVKREAWLLWGDKTTLWTKLFIIISNGLIVGSLFYGESFDTSGAFTRGGALFFSILFLGWLQLTELMKAVSGRAVVKRHEDYAFYRPSAVTIARVVMDLPVILVQVLIFGIIMFFMTNMTISASQFFIYMLFVYITTILLTALYRMFASLSPEIDTAVRFSGIALNLLVIYTGYVIPRPQLLTKYIWFGWIYWINPLSYSFEAVITNEFAGRTMACAPSQLVPQGPGIDPAYQGCALAGADVNAQSVDGSAYLATQFNYSRSNLWRNFGVVIAFIVLYILVTVIATETVSFAGGGGGALIFKKSKKAKKQVKHAKHADEEKGGIAEDSSSSSKKNASLGDAPNEDKEDEALDKLTKSESIFTWKDVEYTVPYMGGERKLLNKVNGYAKPGVMVALMGASGAGKTTLLNTLAQRQSMGVVSGEMFVDGRPLGREFQRNTGFCLQGDLHDGTATIREALEFSAILRQDASVSREEKIAYVDTVIDLLELNDMQDAIISSLGVEQRKRLTIGVELAAKPSLLLFLDEPTSGLDSQSAYSIVRFLKKLASAGQAIVCTIHQPSSVLIQQFDMILALNPGGNTFYFGPVGENGKDVTKYFSDRGVDCPPHKNVAEFILETAAKPHKRKDGKKIDWNQEWVESQQAKDVLEEIDGLKQTRSHVSTSQKNKDDEKEFAASTMLQCTELLRRTFRQYWRDPSYLYGKFFVSVIVGIFNGFTFWQLGNTQQDMQNRMFTAFLIITIPPTIVNAVVPKFYTNMALWQAREYPSRIYGYFAFVTAQVVAEIPPAIIGAVLYWVLWYWPTGLPTDSSTSGYVFFMTLLFFLFQASWGQWITAFSPSFTVISNVLPFFFVMFSLFNGVVRPYASLPVFWRYWMYYVNPSTWWIGGVLAATLDGIPVQCAETETAHFDAPPGQTCASYAGAFAQSAGGYLLNPQDNTNCMYCPLSTGNQYLAQLNINASDKWRDLGIFVVFVFSNWFLVYFFIYTVRVKGWTFGFGPLFGALGKGVELIKKPFKKGEKKEQSEE

SEQ ID NO: 7092 - protein, 1499 aa, Mycosphaerella graminicola
MTARMASESKIDDFGDEKSNRHSPSNDTLMKEKNESPGDVSSPSSTSINERNKEVNCLARRFSEISGWNEIPSNPLEAAKGTELDPLSPNFKARTWVKSMLKFSKQDGRTPMRTGGVAFRNLSAHGFGLATDYQKDVGNIWLDSISIVKKLFGMEKSRRIDILQDFEGLLESGEMLVVLGPPGSGCSTFLKTLTGETHGFQVDKNSYMNFQGIPAGEMHSVFRSEAIYTAEVDIHFPQLTVGETLTFAARARTPRFIPGDVERNVYAEHMRDVVMAMYGISHTINTRVGNDYLRGVSGGERKRVTIAEASLSGAALQAWDNSTRGLDSANAVEFCKSVRLGCELGGSAAMVAIYQAPRAAYEQFDKVIVLYEGRQIYFGNIHAGKTYFEDLGFQCPDRQTTPDFLTSMTSAVERVVKPGWEDKVPRSPDEFAAAWKASPTRQKLIQDIEDYERRFPFKGEAYQQFVDSRKAQKAKSHRFKSPYTISYLQQCQVCLWRGYRRLCADPELLYTSLFMNSILALIVGTLFYNLKLTTASFYQRGAVIFFGTMMNAFGSSLEILTLYHQRPIVEKHERYALYHPSAEAVASMIMDLPYKISNCIIFNTVLYFMVNLRREPGAFFFFIFLAFITTLTMSMMFRTIASCSRTLSQAMTPSALILLWLLIFTGFAIPVDYMLGWCRWLNYIDPVAYAFESLMINEFSGRNYACKSDDLVPSYGTLAAQSQVCNAVGAVAGRDYVEGEAYINSAYSYYRSHKWRNIGIIFAFMVGFLTVYLVASENIRAKKSKGEVLLFQKGRIPAALKEKSQDEEMSEVNRVSSVMCRQMSNVEATDVILRQTAVFSWRNVCYDIKIKGEERRILDNVDGWVKPGTLTALMGVSGAGKTTLLDVLATRVTMGVISGEMLVDGRERDNSFQRKTGYVQQQDLHLATSTVREALNFSALLRQPASVSRQEKLDYVDEVIKLLDMQEYADAVVGVPGEGLNVEQRKRLTVGVELAAKPQLLLFLDEPTSGLDSQTSWAICDLMEKLKNSGQAILCTIHQPSAMLFQRFNRLLFLAKGGKTVYFGEVGPGAKILSTYFERNGGHPCPPDANPAEWMLEVIGAAPGSRTDIDWHQVWRASPEYAATQRELDHLKDNGALVRQPSMVESDNESFNAFAAGFWSQLREVLVRVALQYWRTPSYIYAKLSLCTLAGLFIGFIFYKAPLTHQGLTNQMLSIFMIFTLFSNVSQQIMPHFVLQRSLYEARERPSKTYSWQVFLISNILIELPWNAFAGLLFFLCYYYPIGLYANASPTDSVAERGGYFFLMILAFFLFTSTFTNLMIAGMDSAETSGNIATLLFSLCLIFNGILASPKTMPKFWLFLYRVSPFTYITGGLMSAGLMDQTTHCAANEFVTFQPDGGEGGGTTCGTYMDPYISGANGTVGKGGYILNPSADADCKYCSFNTTNHFLKLVSIDPADRWRDLGITWVYILVNVAGAVALYWLFRVPKGSKKKAEKKEKTG

SEQ ID NO: 7093 - protein, 285 aa, Xanthomonas campestris pv. campestris str. ATCC 33913
MSTNDNWYIEHFQPTGSAIGYRISGKLDEVQSPFQKIEIYQTTDWGKLMIIDGAVMLTSRDNFFYHEMISHPALFTHAAPKRVVIIGGGDCGTLREVLKHPGVESATQCDIDEQVTRMSEKYFPELCDSNDDARAELLFDDGVAYMANCPAGSVDIVIVDSTDPVGPAEGLFNKSFYESCFKALKDDGILVQQSESPLALLDLIKEMRTEMGKAGFQSFKTLPFPQPCYPTGWWSVTMASKQANADFAFRQADAQAKGFDTLYYTAHLHTGVLVAPPFVAKALGE

SEQ ID NO: 7094 - protein, 353 aa, Oryza sativa (indica cultivar-group)
MASFSTVFLLLSLVCLASPCAAQRVICEAPPCTASSQVKTTPTNRASHVRLPEGVTGAESLAFDSSNRGPFTGVSDGRVLKWGGDSAGWTTFAYSPNYRSSPTCAASSEETESTCGRPLGLAFHLKTGILYFADAYKGLMRVGPRGGQADVLATEADGVPFNYLNGVDVDQDTGDVYFTDSSTTITRRYQENIMRNRDATARLMKYDAKTKQVTVLKDRLPYANGVAVSHDGRYLVVAHTGPAQVFRYWLKGAKAGQYELFADLPGYPDNVRRDAKGGYWVGLNREKITFNVPAAAAAASPAKHLVGVRLNGDGVEVEELTAASRAVTLSEVVERDRKLWLGSVDLDYVGLLQ

SEQ ID NO: 7095 - protein, 136 aa, Oryza sativa (indica cultivar-group)
MGSTSSMLTQYDIEEVQDHCDHAFSQQEIVSLYHRFCQLDRNGGGFVSAEEFMTVPEFAVNPLSQRLLRMLDGLNFKEFVAFLSAFSPRASLQQKIEFIFRVYDTDCNGKVAFDDILSILRDLTGSFMTEQQRQCC

SEQ ID NO: 7096 - protein, 355 aa, Selenomonas ruminantium
MAYKITVIPGDGIGQEITDSAVEVLKAADKKFNLGLEFDYHDAGGTAYDKFGTPLPQETIDACKAADGVLFGAVGGDKWDKVDPAKRPEKAILGLRKALGLYANLRPVKVADALVEYSPLKPELVKGVDLVIVRELIGGIYFGEKCESEQHNGAERAWDLENYSVPEVERIANLAFETAKLRRGKVTSVDKSNVLATSRLWRRTVAKVAENYPEVECNNLYVDNCAMQIAVNPTQFDVIVTGNLFGDILSDEAAVVGGSIGMLPSASIGECTSLYEPIHGSAPDIAGQGIANPIGTILSAAMLLRYSLHEEAAADAIEAAVDKALGEGYRTPDLWKEGFTKVNTSEITKIISERV

SEQ ID NO: 7097 - protein, 295 aa, Brassica napus
  misc_feature (60)..(60): Xaa can be any naturally occurring amino acid
PLTIEDVLNVIDLEKPDGIIVQFGGQTPLKLALPIRNYLDKHKPMSLSGEGPVRIWGTSXPDSIDAAEDRERFNAILNELKIEQPKGGIAKSEADALAIAKEIGYPVVVRPSYVLGGRAMEIVYDDSKLITYLENAVEVDPERPVLVDRYLSDAIEIDVDTLTDSYGNVVIGGIMEHIEQAGVHSGDSACMLPTQTIPSSCLETIRSWTTKLAKKLNVCGLMNCQYAITSSGDVFLLEANPRASRTVPFVSKAIGHPLAKYAALVMSGKSLKDLNFEEEVIPKHISVKEAVSHLR

SEQ ID NO: 7098 - protein, 913 aa, Ralstonia solanacearum GMI1000
MTMTTIPIHPLTEAVRTTCPYCGVGCGVLATPRADGSVGIAGDPAHPANAGRLCVKGSALGETVGLDGRLLHPAMRERTPDPDAPPAPLRRVAWDAALDAVAQGFRRIVDEHGPDAVALYVSGQLLTEDYYLANKLMKGFIGSANIDTNSRLCMSSAVAGHKRAFGEDLVPVCYDDLEAADLIVLVGSNTAWCHPILFQRIVRVKEARPEVKVVVVDPRHTATCELADLHLPIRPGTDVRLFNGLLSFLARRGAVDRDFVDLHTSGLDDALRIADADADDVAEVARACKLKLDDLLTFYGWFADTPRTITAFSQGVNQSSAGTDKVNSIINCHLLTGRIGHAGMGPFSITGQPNAMGGREVGGLANMLAAHLELHEPRHRELVQTFWNAPRMADKVGLKAVDLFSAIEAGRVKAVWIMGTNPVVSLPDADQVRRALAKCELVVASDIVEATDTTLLADIVLPALGWGEKNGTVTNSERRISRQRAFLPAPGEARADWDIIADVARRMGYDGFDFKGPHDVFDEHARLSAFANGPQGVRRAFHLGGLTGLDADAYDGMAPVQWPVTLGGAGEARLFSDGRFAHADGRARFVPTAARAPVHAPDSDYPLILNTGRVRDQWHTMTRTGRAPKLADHVPEPFVDLHPHDALLAGVREGALARVGSRWGSVVARVRMSGGIARGSVFVPIHWNGQFASDARVGAVVNPVVDPVSGEPEFKHTPVMVEPFDVAWHGFVLSRRALDAGEATWWTRIQGRQFVRYELAGRQQIGSAHAWARRLLGVDDPHADWLEYEDTTARVYRAVYVVDDRIEACIFLSPRPDLPSRNWLAGLFAHDRLEDIDRAGVLLGQPIEAGADAGPTVCSCFGVGRNTICDAIRAKGLQSTGEITACLKAGGNCGSCVPELKRLLVEARVQQAA

SEQ ID NO: 7099 - protein, 409 aa, Ralstonia solanacearum GMI1000
MSRAARPKLVVIGNGMAGMRTVEELLKLAPDLYDITVFGEEPHGNYNRILLSPVLAGEKRVDDIMLNTREWYEEHGITLHAGDPVVAIDRPRRTVRSRGGVEVRYDRLLMATGSRPFILPVPGHMLPGVIAFRDIQDVETMLDAARNHRHAVVIGGGLLGLEAANGLMRQGMEATVVHISDTLMERQLDKPAAALLKVALEAKGLRFLLGAQTTELIGTDRVTAVRFKDGTEIPADLVVMTAGVRPNIELARSAGLHCERAIVVDDTLQTYDPRIYAVGECVQHRSATFGLVAPIWDQARVCAAHLAGAGHRRYVQQATATKLKVTGVDLYSAGDFIGGDGTEDIVLRDPRRGVYKRLVLKDDRIVGAVLYGDVADGPWYFELIQRQAPIAAMRQRLLFGRALCEAEAA

SEQ ID NO: 7100 - protein, 852 aa, Ralstonia solanacearum GMI1000
MTMKIVVIGHGMVGHKFLESLLHAPGHDLHVTVLCEEPRPAYDRVHLSEFFSGKTAEDLSLVAPGFFDRDDVVLRLNARAVSIDRAAKQVTASTGEVLAYDKLIMATGSSPFVPPIPGKDRTDCFVYRTIEDLEAMLECGRRARTGVVVGGGLLGLECAKALRDMDLQTHVVEFAGRLMAMQVDDGGGRMLRRKIEDLGVTVHTQKNTVEIVDGEDGTHRMRFADGTHLDADMIVFSAGIRPRDELARQCGLAVGERGGIVIDSECRTSDPDVYAIGECALWGGKVYGLVAPGYEMARITARQILAAEEEAAAFNGADMSTKLKLMGVDVASLGDAQGSTPGSRSVQFVDERKQIYKKLVLSSDGKFLLGGVLVGDASEYGTLLQMMLNRIELPEAPEFLILPQADGNARPALGVDALPDAAQICSCNDVSKGALCQAVCAGATTVGALKDATRAGTSCGGCVPLMTQVMKAEMKKQGLAVNNHICEHFPYSRQELYHLVRVGRIQSFEALLAAHGHGMGCDICKPAAANILASCWNDFVLKKEHAGLQDSNDYFLANIQKDGTYSVVPRMPGGEVTPEGLIAVGQVAKKYGLYTKITGGQRVDLFGARLEQLPLIWEELIAAGFESGHAYGKSLRTVKSCVGSTWCRYGVGDSVGLAIRLENRYKGLRSPHKLKFGVSGCTRECAEAQGKDVGVIATEKGWNLYVCGNGGMKPRHAELLAADLDEATLVKLVDRFLMFYVRTADRLQRTSTWRDNLEGGLDYLKDVIVGDKLGFAAELEAEMQHVVDTYQDEWKTAVTNPEVRKRFRHFVNSETADANVVFVEERGQIRPATPEERRGTRPVRIPVVAEAA

SEQ ID NO: 7101 - protein, 439 aa, Selenomonas ruminantium subsp. ruminantium
MLNLTKSAAAFAEAKELMPGGVNSPVRSYKSVDCNPPFIDHALGDKIYDIDGNEYIDYVGSWGPMVVGHAHPKVVKALQEAATRGTSYGAPTCIESELAKLVMEVYPSIETIRMVNSGTEATMSALRLARGYTGREKIVKFIGCYHGHSDSLLVNAGSGMATFGVPSSPGVTKGTAQDTISVPYNDEEAITKVMEEVGDEVAAVIVEPVAGNMGLVLPKQGYVRKLRDLTEKHGALLIFDEVMCGFRASLGGAQAAYGITPDLTCLGKIIGGGLPVAAYGGRKDIMAKVSPSGPVYQAGTLSGNPLAMTAGLATLQIITAEPEDGKADYSRELTLKTKKLLLGWQEKAKAAGVAIQVHQAGSMFGIFFSEKDVLNYEDSCNADQEKFKVWFKSMLEQGVYLAPSQFETLFMSGAHTDEDIDRTIAAAEKAFAAVAAMEK

SEQ ID NO: 7102 - protein, 323 aa, Photobacterium profundum SS9
MDFKAIQALTANDMAGVDAKIQAQLNSDVALINQLGFYIVSGGGKRLRPMLVVLAARALGYQGDKHITAAAFVEFIHTATLLHDDVVDESDMRRGKDTANAAFGNAASVLVGDYIYTRSFQMMTSLRSLKILDIMSEATNVIAEGEVQQLMNCNDPNTTEDNYMQVIYSKTARLFEAATQISAIITESSTEVEVALQDYGRYLGTAFQLIDDVLDYVADGKEMGKNVGDDLSEGKPTLPLLHAMHNGNEAQSAMIREAIEKSNGMDKLNDILAAMREAGSLEYTQQRAEEEAEKAIAALAPIAESDYKEALIQLAHLAVKRTK

SEQ ID NO: 7103 - protein, 391 aa, Oryza sativa (japonica cultivar-group)
MALRRFAVAGRVLLHRVESLPPPRPPLAFLSSESRGHLVRRFSTPSSTPPHFMVQYLVSKCGLSPAAAAKAAPRFAHLDSASRPDAALAFLRSQGLTRAQVREVVSWKPELLLSDVDATLDPKFRAVRALGLGRADVARLFALYPPALTYGIHTNLLPRVLFWIDFLGSAKLLMKWLAKTWLLRYSVDALLRNLSTLRSLGVQQSRITTTVRMQPTLITQTPARFQKLVGRVEACGVPPSSGCTCGFFALHNVSEGSFRAKKAAVVGAAGCTEEEFDAMFRRAPCLVFVPAALLRRKVEFLMAEAGCDATHIVTNPVLLTLSLGKRMAPRCRVVEALRSRGVGIGKKANLGSVMRYPEDKFVERFIVTVAFTLFDLRLLFGLCGPCGIRPF

SEQ ID NO: 7104 - protein, 294 aa, Debaryomyces hansenii CBS767
MSTYSESNFNTTHYNLARPSYPDEFYNTLIEYHDSTNSAHELALDIGCGSGFVAFKLIDFFEKVIGTDISSTMVNQCRKTAKPGKNIQFLVGSAEQAPPEIQENSVDLITGAECCHWVDHEKFFKESFRILKPGGTLAYWFYKDPIFIGHDKANEIYTNYTYNSSMEMNKDDTFERYMGPYYQQPGHDYLRTLMKEIEVPTKYYKNVVRHEYDPVHHGADSTKTTLYISKKITLPAFLNYVKSWSAYHTWMTEHGSKYDIAEAFVNELKEAMNWDDTFEFEVVWATVYTFAKKK

SEQ ID NO: 7105 - protein, 956 aa, Ustilago hordei
MSRPKTAQLRPATSAGQLNSSIRPATTGGFGIEHERESHGEQEGSYDSKEYTDTEDDDDKVGQHQAEDDDVFAFAPPGLEVPGVQVVAAPSSLPARPPTALTSGDPLRSGQRSNIPRESIYYLDQESGAVYDAQGNLVQSEDPVNIDLHAESLRDDQQHSGGIAEKVPQGVRRTTSIKWHPPTRDESSNWQRRCNSVGRKSDGPYSPTSSSHAAAPWGGQPGNVTPTCDSADLLRQLPRPSMSRTVELELEEDDDSPYPEVRASVSNLDDSTMPSITFRSVLLGLGLSAFASAVNTFLSQRNPPIQIVAIIIQILAHPLGMILANILPIRSFYFRPPSLRKVNSAKRASRSHAWSFNPGPWNIKEHTVVLVAATTGLNPSYSLSILLAQDLARFWDDRRSFLYGFLSVCAPQLIGLALAGFVRAVLVDPASMIWPQNLAVSTVLNTLHADEDSLSERRSSRMSRLRCFNIASAVAFVAYFLPGYLFTALSIFNWICWIWPNSVPVNVVFGAANGLGASVLTFDWTQIVYLGSPLITPWWAQTNLFGGFVVGIWIAAPILYFTNMLYTAYLPILSGSSFDRFGQRYNVSIVSPDHITLRADAYADYSRVYISAGLVVAYFGGFALITAAVVHTALYHGRFVLDRLRARRTMPDDVHARLMRKYPSVPSWWYVAVLISGLGMSMLLTTAYGTGLPIWALCLAILIPVAYMLPFGFIFAMSGLPAGVNLVSELLASWLLPGKPLPVMMFKTISQQTTTFGLLFSQDQKLAHYMKIAPRNIFFVQILSITVNSIVQILAKDYLRDHIEGLCDPNQPQRFTCPTVNIFYTASIIWGAIGVERSFGPGSPYNSLFYGLIVGAVLPLITWYTSRKLNWSTMRYISAPIIFVGMSLAPPASGINFTSAIVVGYFFQYWLRKHRLEWWSRYNFVFAGALDFGSVMSVSTQTSFPPFEVMRREMVG

SEQ ID NO: 7106 - protein, 544 aa, Eucalyptus camaldulensis
MEAKPSEQPREFIFRSKLPDIYIPDNLSLHAYCFENISEFADRPCVINGATGRTYTYAEVELISRRVSAGLNGLGVGQGDVIMLLLQNCPEFVFAFLGASYRGAISTTANPFYTPGEIAKQASAAQAKIVITQAAYADKVRPFAEENGLRVVCIDTAPEGCLHFSELMQADENAAPAADVKPDDVLALPYSSGTTGLPKGVMLTHRGQVTSVAQQVDGDNPNLYFHKEDVILCTLPLFHIYSLNSVMFCALRVGAAILIMQKFEIMALMELVQRYRVTILPIVPPIVLAIAKSAEVDRYDLSSIRTIMSGAAPMGKELEDTVRAKLPNAKLGQGYGMTEAGPVLAMCLAFAKEPFEIKSGACGTVVRNAEMKIVDPETGASLPRNQAGEICIRGHQIMKGYLNDPEATANTIDKEGWLHTGDIGYIDDDDELFIVDRLKELIKYKGFQVAPAELEAMLIAHPSISDAAVVPMKDEVASEVPVAFVVKSNGSVITEDEIKQYISKQVVFYKRINRVFFTDAIPKAPSGKILRKDLRAKLASGVYN

SEQ ID NO: 7107 - protein, 588 aa, Burkholderia sp. 383
MSLIEVKVPDIGDFSGVDVIEVNVKPGDVIEKEQTLITLESDKASMEVPSDVAGTVKEIKVKAGEKVSQGTVIAIVEAAAGAAAPAKAPEAAKPAAAAPAPAAAAPAPAPQAGSYAGAVDVECDMLVLGAGPGGYSAAFRAADLGMKTVLVERYSTLGGVCLNVGCIPSKALLHTSLVVEEAAALASHGITFGKPEVDLDKLRDFKGGVVKKLTTGLAGMAKARKVEVVTGVGAFVDPFHMEVQGENGKKVVKFKQAIIAAGSQAVKLPFMPEDPRVVDSTGALELRQLPKRMLVIGGGIIGLEMATVYSTLGAEIDVVEMMDGLMMGADRDLVKVWEKYNAKRFGNVMLKTKTVGAEAKEDGIYVKFEGEKAPAEAQRYDLVLVAVGRSPNGKKIGADKAGVAVTDRGFIDVDKQMRTNVPHIFAIGDVVGQPMLAHKAVHEGHVAAEAAHGEKAYFDALQIPSVAYTDPEVAWAGKTEDQCKAEGIKYGKAVFPWAASGRAIANGRDEGFTKLIFDEETHRVIGGAIVGLNAGDLISEVCLAVEMGADAEDIGKTIHPHPTLGESVGMAAELYEGVCTDLPPQRKK

SEQ ID NO: 7108 - protein, 548 aa, Burkholderia sp. 383
MSQAIEVKVPDIGDYKDVPVIEIGVKVGDTVEPEQSLVTLESDKATMDVPSPVGGVVKEIKVKVGDSVSEGSLIILLEGGAAAQANGAAAPAAAPAPAAAPAPAAATPAAAPAATGGTLEVKVPDIGDYKDVPVIEIGVKVGDTVEKEQSLVTLESDKATMDVPSPAAGVVKEIKVKVGDSVSEGTLIVLLDAAGAAPAAAAPQASAPAPAAAAPAPAAAPAKAAAPAAAAPAPAAAPSGEYRASHASPSVRKFARELGVEVARVQGSGPKGRITKEDVTGFVKGVMTGQRTAPGAAAAPAGGGELNLLPWPKVDFSKFGPFEAKPLSRIKKISGANLHRNWVMIPHVTNNDEADITELEALRVQLNKEHEKAGVKFTMLAFVIKAVVAALKKFPTFNASLDGDNLVFKQYYHVGFAADTPNGLVVPVIRDADKKGLVDIAKEMAELSKAARDGKLKPDQMQGGCFSISSLGGIGGTNFTPIINAPEVAILGLSRGQMKPVWDGKQFVPRLTLPLSLSYDHRVIDGAEAARFNAYLGALLADFRRIIL

SEQ ID NO: 7109 - protein, 898 aa, Burkholderia sp. 383
MSAVPNEVMKYVAAERDDDPQETVEWLESLDGVISSVGTGRAHYLIEKQIEFARMHGEHLPFSANTPYINTIPVAAQAKIPGDQDLEHRIRSYTRWNALAMVLRAGKDTNVGGHIASFASAATLYDVGYNHFWHAASEQHGGDLVFVQGHSSPGVYSRAFLLGRLKEEQLDNFRQEVDGQGISSYPHPWLMPDFWQFPTVSMGLGPIMAIYQARFMKYLQARGITKTEGRKVWAFLGDGETDEPESLGAIGMASREKLDNLVFVINCNLQRLDGPVRGNGKIIQELESEFRGAGWNVIKVIWGSRWDALFARDKSGALMRRMMEAVDGEYQTYKSESGAFVREHFFNTPELKALVADWSDDDIWALNRGGHDPHKIYAAFHEATNTKGAPTVILAKTIKGYGMGESGQAMNITHQQKKLPVEQLKKFRDQFRLPITDEQIADVPYLKFEEGSKELEYMRQKRMDLGGYLPHRREKATSLPVPALDVFEPLLKGTGEGREISTTMSFVRILNILLKDKALGKRIVPIVPDESRTFGMEGLFRQIGIWNQEGQKYVPEDSDQLMFYKESETGQILQEGINEAGGMCDWIAAATSYSTHGEIMVPFYIFYSMFGFQRIGDLAWAAGDMRSRGFLLGGTAGRTTLNGEGLQHEDGHSLLWAASVPNCVSYDPTFGYELAVIVQDGLRRMVADQEDVYYYITVMNENYEHPAIPQGEHVAADIIKGMYAFKKADADKKAPRVQLLGAGTIFNEVIAAADLLKNDWGVAADLWSVPSFTELAREGHQVERWNLLHPTEERRLSHVQKCLKDTQGPVIASTDYVRALVDQIRGQIDRRFVVLGTDGFGRSDTREKLRHFFEVDRHWVTVAALNALADEGTIERKVVAEAIAKYNLDPSKPNPMTV

SEQ ID NO: 7110 - protein, 272 aa, Mycobacterium sp. JLS
MPDRRPDSARKAAVLGSPIAHSRSPQLHLAAYRALGLTDWTYERIECTAEQLPGLVGRFGPEWVGVSVTMPGKFAALRFADERTERAELVGSANTLVRTPNGWRADNTDVDGVAGALGNVDGPGIVVGSGGTAPAAVVALAGLGATRLTIAARNADKAASLVDLAHRLGVTARWCDLDDPDLTALAAAAGAVVSTVPADVAQRYAATFAGTPVLLDAIYDPWPTPLAAAVQAAGGRVIGGLQMLLHQAFAQVEQFTGLPAPKEAMRAALQTA

SEQ ID NO: 7111 - protein, 243 aa, Triticum aestivum
  misc_feature (129)..(129): Xaa can be any naturally occurring amino acid
  misc_feature (162)..(162): Xaa can be any naturally occurring amino acid
  misc_feature (166)..(166): Xaa can be any naturally occurring amino acid
  misc_feature (188)..(188): Xaa can be any naturally occurring amino acid
  misc_feature (211)..(211): Xaa can be any naturally occurring amino acid
AYLGDTIEQVCTKKQAGTGPEFPGYRRPTRPGRERGGAMGESEYRCWEELLPDALGLVFRNLPLQEVLTVVPRVCKSWGRVVAGPYCWQEIDIEEWSQQRHSRPDHLIRMLDLLLRRSSGACRRISVSXGLPCDPLFSFIGDHARALRTLEIPRSEISDAVXGAVXPGLPNLTFLDISSWHKIGAARXLKASAATGRSLGALRRVMPPIHXAGPNACGQHEKARAIGGTMPGLPPLEGGYLLV

SEQ ID NO: 7112 - protein, 1011 aa, Borrelia burgdorferi
MNKKHTNFSVLLLLIFLLILSFGGFGYYIYQSKLNDKNREIMLNEVKNSVIDRNYKKAYSVAKLLQDKYPQNEDIAMLTNTLAEIANSSPFESKDLQRDSANQILDKIKGQDNTKTNVNENFDIAFNNRYIKDSTITENYSDRNDDVGIEDEDISEFKKSKIPEKIKPNTNPKEEDQIIQSPNPKLSVNDQKNLFNLEKLKKNLSGKSNSENILNNSQKIENDKQNTNLSKEKNSENILKTPDNSKYSNNNNTTSLKKIPSNSQKESELSPPSQTIIGKIYRPYSYLIKKELYEILDDINTGRVTLGKNRLKELIKKGLSNKFQKVNELIENSKNKEASNLLLTLIKKDIEPNLINIPKDPYKKEIFQLDKEDKKPQYLEDLKSKVHSIKPIDLENTKSRQQAIKDLNEFLKNNPNDAQASKTLAQANKIQHLENLKSKVHSIKPIDLENTKSRQQAIKDLNEFLKNNPNDAQASKTLAQANKIQHLENLKSKVHSIKPIDLENTKSRQQAIKDLNEFLKNNPNDAQASKTLAQAYKIQHLENLKSKVHSIKPIDLENTKSRQQAIKDLNEFLKNNPNDAQASKTLAQAYKIQHLENLKSKVHSIKPIDLENTKSRQQAIKDLNEFLKNNPNDAQASKTLAQAYENNGDLLKAENAYEKIIKLTNTQEDHYKLGIIRFKLKKYEHSIESFDQTIKLDPKHKKALHNKGIALMMLNKNKKAIESFEKAIQIDKNYSTAYYQKGIAEEKNGDMQQAFESFKNAYNLDKKPNYALKAGIVSNNLGNFKQSEKYLNFFNANAKKPNEIAIYNLSIAKFENNKLEESLETINKAIDLNPEKSEYLYLKASINLKKGNYQNAISLYSLVIEKNPENTSAYINLAKAYEKSGNKSQAISTLEKIINKNNKLALNNLGILYKKEKNYQKAIEIFEKAIINSDIEAKYNLATTLIEINDNTRAKDLLREYTKLKPNNPEALHALGIIEYNENNNDQTLRELIKKFPNYKKNENIKKIIGI

SEQ ID NO: 7113 - protein, 393 aa, Oryza sativa
  misc_feature (265)..(265): Xaa can be any naturally occurring amino acid
MQRNGVMECSVCHSKVVAPSPRSVSRAYDKHRSKISSKYRALNFLLVSGDCILVGLQPILVFMSKVDGKFQFSPISVNFLTEVTKVIFAIVMLIIQSRKQKVGEKPLLSLSTFVQAARNNALLAVPALLYAINNYLKFIMQLYFSPATVKMLSNLKVLVIAILLKFIMRRKFSIIQWEALALLLIGISVNQLSSIPDGTKSFGLAVTTIAYIYTLIFVTVPSLASVYNEYALKSQFDTSIYLQNLFLYGYGAIYNFLGILGTVIXSRATMFLICNNAAQGILSSFFFKYADTILKKYSSTVATIFTGLASAAFLGHTLTVNFLLGISIVFISMHQFFSPLAKVKDDKPAGALEPEDAQNHRSSDSSFVNMTAGAADDASHLTATDERKPLLPI

SEQ ID NO: 7114 - protein, 386 aa, Ustilago hordei
MQAEEDTYLRYKKLQQHLEFLNTMEEYVKDEQRNLKRELVRAQEEVKRIQSVPLVIGQFLEPIDQHTGIVGSTTGSNYVVRILSTIDRELLKASSSVALHRHSNALVDVLPPEADSSIAMLGQDEKPTETYQDIGGMDIQKQEIREAVELPLVQFDLYLQIGIDPPRGVLLYGPPGTGKTMLVKAVANATTASFIRVVGSEFVQKYLGEGPRMVRDVFRLARENAPAIIFIDEIDAIATKRFDAQTGADREVQRILLELLNQMDGFDQGSNVKVIMATNRADTLDPALLRPGRLDRKIEFPTPSRREKRLIFQTICGKMNLSPEVDLEDYVGRPDKLSSAEIASICQAAGLQAVRKNRYVIMPEDFEEAWKQIVKKPDDSKMDFYQ

SEQ ID NO: 7115 - protein, 767 aa, Rickettsia typhi str. Wilmington
MNEMNKINYAEALEYHEKDKPGKIAITATKSLVTQQDLSLAYSPGVAAPCLEISKNLDAVYKYTSRSNLVAVISNGTAVLGLGNLGAAASKPVMEGKAVLFKKFADIDAIDLEINTEDPIEFINAVKYLSYSFGGINLEDIKAPECFLIEEKLKSLMDIPVFHDDQHGTAIITAAGLINAAYLTNRTLEDLKIVINGAGAAAIACIDLLIALGVDKSKIILCDTKGVIYKGRTSGMNKWKERYASDTKIRTLTESLNNADVFIGLSVKGAVTKDMISQMAHKPIIFAMANPDPEITPEDIKFVRDDAIIATGRSDYNNQINNVMGFPYIFRGALDVRASTINTEMKIAAARAIADLARRPVPEEVYKAYSGRKLVFGNEYIIPVPFDPRLITVVAAAVAVAAIETGVARVKDFSIGKYKQQLGSRLNPTANYMNFLAEKIHNVPLKRIVFAEGEEEEVISAALMMRDEKYGNPIIIGRVERIEVILKKIGKDISLDGIQIMNAALSDRLEQYTDYLYKRLQRKGYLYRDCAKLVKTDKNIFAACMVACGDGDALLTGVTKSYIDSLEDIMKVISPKQNRRILGYSIMIAKDHNIIIADNCITEYPNSLELAQIATQTAEIAKNMGITPRVALISFATFGNSSQEKTTRIREAVNILDNFSKDKKQLNDMKVDFEYDGEMSIKVALDHDLRKLYNFCRLSGSANVLIMPGLNSAAIATELLQKFSSNSFIGPITNGFEKPVQILQTTATANEILKIATFACVEAIKEV

SEQ ID NO: 7116 - protein, 360 aa, Glycine max
  misc_feature (108)..(108): Xaa can be any naturally occurring amino acid
MMSWACRSEESESPNNLIPYLPNDVALNCLARIPRSHHPTLSLVSKPIRSLLYSPLLFTTRSLLQCTQPLLYLTLRSRDSSLQWFTLHRTNPNPLLAPLPPIPSPAVXAPPTPVLGPTIYVLGGSIQDVPSPHVWLLDCRFHRWLRGPPMRVAREFAAAGVLHGKIYVLGGCVADTWSRSANWAEVLDPASGRWERVASPTEVREKWMHASAVVGDRIYAMADRGGIAFEPRSCAWESVGGELDHGWRGRACVVEGILYCYDYLGKIKGFDVGRGVWEELKGLENALPRFLCGATMADLGGKLCVVWECQCNGKEMEIWCAEIGVKKNSDGELWGQLGWFGKVLSVPKGSSIVNCSSVSL

SEQ ID NO: 7117 - protein, 97 aa, Zea mays
DTFLGFVCRYLATASSDRTVKIWNVDGFKLERTLVGHQRWVWDCVFSVDGAYLITASSDTTARLWTMSTGEAIRVYQGHHKATVCCALHDGAESAPS

SEQ ID NO: 7118 - protein, 417 aa, Nitrosomonas europaea ATCC 19718
MSSFSSFEYRDSQLFVESVPLAEIAAKFGTPCYVYSSAAIRTTYQIFDHAFGQRDHLICYAVKANSNLAILNLLARLGSGFDIVSGGELQRVLKAGGDPQKTVFSGVGKTPEEIRAALAANILCFNVESEMELMVLNEIAGQMGKIAPVSLRVNPDVDANTHPYISTGMKENKFGIPAAEAGRIYSLAHQLPHIQVSGLDCHIGSQLTEIAPFIEAADKMLDLLARLQTMGVTIKHLDLGGGLGIRYDRESPPSIEAYIKALCTIAENHPQQLLIEPGRSMVGNAGLLLTRVHYLKHTSHRNFAIVDAAMNDMLRPALYQAYHSILPVTKRTGETKTYQIVGPVCETGDFLGHDRNLALTKNDLLAVMSAGAYGMSMSSNYNTRPRAAEVMVDGSTVHLIRARETVEDLYALEKLPI

SEQ ID NO: 7119 - protein, 202 aa, Escherichia coli
MLTELQRRELDWEKTDGLMPVIVQHAVSGEVLMLGYMNPEALDKTIESGKVTFFSRTKQRLWTKGETSGNFLNVVSIAPDCDNDTLLVLANPIGPTCHKGTSSCFGDTAHQWLFLYQLEQLLAERKSADPETSYTAKLYASGTKRIAQKVGEEGVETALAATVNDRFELTNEASDLMYHLLVLLQDQGLDLGEVIDNLKNRH

SEQ ID NO: 7120 - protein, 543 aa, Synechococcus sp. WH 8102
MDQSSGKGSGRDVGVAPVVLTILDGWGHRNDSEHNAIRQGDTPVMEALWHAYPHALIQASGSHVGLPDHQMGNSEVGHLTIGAGRIIRQELVRISDTVRDDQLNNTPALVELAEHLQNDTGTLHLLGLCSDGGVHSHVNHLCGLIHWAAAAGIKKVAVHAITDGRDTPTQSAMGSITLVQRAMEEAGVGHLASLCGRYWAMDRDKRWDRTEKAYDLYTDPTRSISDQSPQQLLAESYAAGITDEFLKPVRLSDDVMQDGDSVLVFNFRPDRARQIVQTLCLDDFDGFERRTTPKLDVVTFTQVEQDLPVSVAFPPEPLDDLLGQVVAEAGLRQYRTAETEKYPHVTYFMNGGIEQPLPGEERHLVPSPRVATYDLSPAMSADQLTDSCIDAIDQGTYSLIVINYANPDMVGHTGVMDAATEAIATVDRCIGRLLDAVGRRGGTMLITADHGNAELMQGPDGQAWTAHTTNPVPCILVEGEQRKLPGHGNDISLREDGGLADIAPTLLQILNLEQPAAMTGRSLIEPVSNVDPSPLSARLPLPV

SEQ ID NO: 7121 - protein, 670 aa, Gloeobacter violaceus PCC 7421
MTGTLLDKTAAQLDELSVNTIRFLAVDAVQKANSGHPGLPMGAAPMAYVIWTKFLKHNPTNPKWFDRDRFILSAGHGSMLLYALLHLTGYDLAIDDLKQFRQLHSRTPGHPENFMTPGVEVTTGPLGQGLGNGIGIAVAEAHLAARYNRPGHEIIDHTTYAIVSDGDLMEGVASEAASLGGHLGLGKVIYLYDDNHISIDGETELSFTEDRMQRFDAYGWHTQAVADGNDIAAIEQAIHNARAVTDKPSIIAVRTIIGYGSPNKANSHDVHGSPLGGDEVKATKENLKWPLEPEFYIPEETLAQFRKAVEAGKEAEADWNARFAAYKAEFPELAAELESLIEGRLPEGWESSLPSFSPADKPLATRAASGKVLNAVTAALPGLIGGSADLAPSNNTYVKAFVDFQKATPEGRNFHFGVREHGMGAVMNGMAMHGGLKVYGGTFLIFMDYMKGAVRVAALSHSPVVYVFTHDSIGLGEDGPTHQPVEQILTLRATPQLTVIRPGDAVETVGAWKVAIESNRDPVALILTRQNLPIQPGSTVEAVAKGAYTLVEADNPEIILIGTGSEVQLVVEAQKQLAEQGIAARVVSFPSWELFEAQPQEYKDSVLTPGVKRLAVEAGTSLGWHKYVGLEGAVIGVDRYGASAPIKAVMPEYGFTIDNVVAHALKVLGR

SEQ ID NO: 7122 - protein, 457 aa, Fulvimarina pelagi HTCC2506
MLDRNNELGAFDRDHFFHPSTHMGTHARGESPTRIIKTAKNATIVDRDGKESLDAFAGLYCVNAGYGRTEIADAIAKQAHELAYYHAYVGHGTEVSIRLAKMIVDRAPDHMSRVYFGLSGSDANETNIKLVWYYNNVLGRPEKKKIISRWRGYHGSGVMTGSLTGLHLFHNAFDLPRAPILHTEAPYYYRRPNRDQSEEEFATWCADKLEEMILAEGPETVAAFIGEPVLGTGGIVPPPATYWEKVQAVLDKYDVLLIADEVVTGFGRLGSMFGSEHYGMKPDLITIAKGLTSAYAPLSGTIVGKDMWNVLVSGSDQLGSIGHGWTYSAHPICAAAGVANLELIDNLDLIENVKTVGARFRNGLQDALGDHANVGEVRGEGLIAAVEFVKDRDDRVFFEADEKVGARITAALAERGVIGRAMPQGDILGFAPPFCLTAEEADTVVAKAKEAVASVLG

SEQ ID NO: 7123 - protein, 250 aa, Mimosa pudica
MVKIAFGSLNDSFSAASIKAYVAEFIATLLFVFAGVGSAIAYGALTKDAALDPAGLVAVAVAHAFALFVGVSVAANISGGHLNPAVTFGLVIGGNITVLTAIFYWIFQLLGSLVACLLLKFVTSAPTVPVHGLASGVGIFEGIVFEIVATFGLVYTVYATAADPKKGSLGIIAPIAIGFIVGANILAAGPFSGGSMNPARSFGPAAVSGDFTNYWIYWVGPLIGGGLAGLIYGDVFIGSYAPVPTSESYP

SEQ ID NO: 7124 - protein, 742 aa, Thermobifida fusca YX
MIEPLQPGDPGRIGPYRLVSRLGAGGMGQVFLARSPGGRPVVVKVILPEYANDDEYRIRFAREVEAARRVGGFHTAQVIDADPTADPPWMATAYIPGPSLRKAVTERGPLYGNNLRTLAAGLVEGLAAIHACGLVHRDFKPSNIVLAADGPRVIDFGVARPLDSSVMTQSGAVIGTLAYMSPEQTDGSQVGPASDVFSLGTVLAFAATGRSPFMADSIGEIIARISGPPPELPELPDDLRELVYACWEQNPDLRPTTAELLAQLSTDHTGDDWPPPHLSDLIGSMLPLGATTSPNPSLAIEPPPPSHGPPRPSEPLPDPGDDADEPSAEKPSRTLPEPEPPELEEKPIQVIHEPERPAPTPPRPREPARGAIKPKNPRPAAPQPPWSPPRVQPPRWKQLITKKPVAGILTAVATAGLVVSFLVWQWTLPETPLRPDSSTAPSESADPHELNEPRILTTDREAVAVAFSPGGSLLAGGSGDKLIHVWDVASGDELHTLEGHTDWVRAVAFSPDGALLASGSDDATVRLWDVAAAEERAVFEGHTHYVLDIAFSPDGSMVASGSRDGTARLWNVATGTEHAVLKGHTDYVYAVAFSPDGSMVASGSRDGTIRLWDVATGKERDVLQAPAENVVSLAFSPDGSMLVHGSDSTVHLWDVASGEALHTFEGHTDWVRAVAFSPDGALLASGSDDRTIRLWDVAAQEEHTTLEGHTEPVHSVAFHPEGTTLASASEDGTIRIWPIATE

SEQ ID NO: 7125 - protein, 471 aa, Burkholderia sp. 383
MSKTVADVMQLVKDEDVKFVDFRFTDTRGKEQHVSVPVSAFDEDKFESGHAFDGSSIAGWKGIEASDMLLMPDPNAAFVDPFYEESTLVLTCDVVEPADGKGYERDPRSLAKRAEAYLKSTGIGDTAYFGPEPEFFIFDSVQWSTDMSGCFVKINSEEAPWSSAKEFEGGNTGHRPGTKGGYFPVAPVDTFQDMRSEMCLLLEQLGIPVEVHHHEVAGQGQNEIGTKFSTLVERADWTQWSKYIIHNVAHSYGKTATFMPKPIVGDNGSGMHVHQSIWKDGQNLFAGNGYAGLSEMALFYIGGIIKHARALNAITNPTTNSYKRLVPHFEAPVKLAYSARNRSASIRIPHVSNPKGRRIETRFPDPMANPYLLFSALMMAGLDGIQNKIHPGEAADKNLYDLPPEEDAKIPTVCAGLDQALEALDKDREFLTRGGVFTDGMLDAYLALKEQELAKFRMTTHPIEFEMYYSL

SEQ ID NO: 7126 - protein, 282 aa, Schizosaccharomyces pombe 972h-
MSNSILKVPDQNPQEIVALFSQQEAYAKLGKYKDEIWDVYQKVFIAALTTGETVLAKKCWNRLNDRFHKSPRVEGLYGMFLEATASEKDAMSYYNSKLSEDPTHTVIYKRKLALLRSMGQTKECIQGLINYLDTFYNDLEAWAELADIYVSVEAFESAIFCYEEMVLLQPFEPRLFARLGDLYFVLAQSNATNYWFSLKHYCRSVEICEEYFHGWFGISKCCQQLLELSRTELKRLLSKVNEKISDTFPDTESVRQLYQLSLKKSDLFAQKQPKLKALLEQC

SEQ ID NO: 7127 - protein, 158 aa, Ralstonia solanacearum GMI1000
MRAHLIAAGMAGCGLILLQGSACAQQSARAQAPIEYIHAEGEYTIPVPLTPAVKVGNLLFVSGIPAFDKHGKLAVNDFTAQMNQVMENITGILKAAGIGWDRVVKVNVFLARREDFKEMNRIYAAHFQAGRYPARTTAVTALPNPDFLLEIECVAALD

SEQ ID NO: 7128 - protein, 346 aa, Glycine max
MAHPTSSSGQSNDLTKEDCKETSSVVVCFGEMLIDFVPMVGGVSLAEAPAFKKAPGGAPANVAVGISRLGSSSAFIGKVGADEFGYMLADILKQNNVETSGMRFDSNARTALAFVTLRADGEREFLFFRNPSADMLLQESELDKDLLKKARIFHYGSISLIDEPCKSAHLAAMSIAKNSGCILSYDPNLRLALWPSADAARKGIMDIWDQADVIKISEDEITFLTGGDDPYDDNVVLKKLFHPNLKLLIVTEGSQGCRYYTKAFKGRVSGVKVKPVDTTGAGDAFVSGILHCIASDQTIFQDEKRLRKALYFANVCGALTVTQRGAIPALPTKEAILQFLLEAAVI

SEQ ID NO: 7129 - protein, 253 aa, Gossypium hirsutum
MEKEREQQVYLARLAEQAERYDEMVEAMKSVAKLDVELTVEERNLLSVGYKNVIGARRASWRILSSIEQKEEAKGNEQNVKRIKDYRQRVEDELSKICNDILSVIDKHLIPSSSTGESTVFYYKMKGDYFRYLAEFKAGDDRKEAADQSLKAYEAATSTASSDLPPTHPIRLGLALNFSVFYYEILNSPERACHLAKQAFDEAIAELDSLNEESYKDSTLIMQLLRDNLTLWTSDLPEEGGEQSKADEPQAES

SEQ ID NO: 7130 - protein, 556 aa, Pyrococcus abyssi GE5
MPKFDVSKSDLERLVGRSFSLEEWEDLVLYAKCELDDVWEENGKVYFKLDSKDTNRPDLWSAEGVARQIRWALGLQSGLPEYEVKESDVVVYVDEKLKNVRPYGVYAIVEGLNLDEDSLSQMIQLQEKVALTFGRRRREVAIGIFDFEKVKPPIYYRAAEKTEKFVPLGFEEELTLEEILEKHEKGIEYGHLIKDKPHYPLLVDSEGNVLSMPPIINSELTGRVTTETKKVFIDVTGWDLKKVMLALNVMVTALAERGGKIRSVKVIYKDFEIVTPDLTPKRFEVELNYIRKLSGLDLKDEEIKELLERMMYSVELEDGKAKLLYPAFRDDIMHARDVLEDVLIAYGYNNIEPEEPKLAVQGRGDPFKDFEDAIRDLMVGFGLQEIMTFNLTNKEVQFKKMNIPEEEIVEIANPVSQRWSALRKWLLPSLMEFLSNNTHEEYPQRIFEVGLATLIDESRETKTISEPKLAVALAGSEYTFTNAKEILDSLMRHLGVEYEIEETEHGSFISGRVGKVLVNGKEVGIIGEIHPQVLENWNIEVPVVAFEIFLRPLYQP

SEQ ID NO: 7131 - protein, 201 aa, Yersinia pestis CO92
MSQNKEWLAASDAWMIYSRELAALKENVDQQVWLQVLDALAECRGKIAVTGVGTSGIAARKVAHMLACVEQPAIYLNATDAAHGDLGFLGAQDIIILISRGGNSDELTRLLPTLQRKQVKIISVTENEQSAIAQVSALVLKTHVKQEIDPLNMLATTSIVLVLALFDAICACLMARTGFSKETLLAVHPGGDVGMVLRKQQ

SEQ ID NO: 7132 - protein, 377 aa, Buchnera sp.
MAKKDYYQILGIPKSAEEREIKKAYKKLAMKYHPDRNQGDKTAEGKFKEIKEAYEILINEEKRSAYDQYGHAAFENGQSNSTYSTFTNSADFSDIFGDVFGDIFGGNRTQRAKKGADLCYNMEITLEEAVKGIKKEIQIPTLQKCKTCYGSGTRTGTKPRSCSTCHGKGQIHIRKGFFTVQQSCSTCHGKGTIITDPCNLCHGQGRVETYKILSVKIPPGLDTNDRIRLNNEGEAGANGAQSGDLYVQITVKKHPIFEREGNNLYCEVPKNFTMAALGGEIEVPTLDGRVKLKIPYETQSGKLFRIRGRGVKSVQNRNQGDLLCRVVVETPVNLNEQQKNLLHELGNSFHGFRGEKNSPRSKRFFDGVKRFFDDLTR

SEQ ID NO: 7133 - protein, 348 aa, Pyrococcus abyssi GE5
MSEKMVAIMKTKPAYGAELVEVDVPKPGPGEVLIKVIATSICGTDLHIYEWNEWAQSRIKPPQIMGHEVAGEVVEVGPGVEGIEVGDYVSVETHIVCGKCYACRRGQYHVCQNTKIFGVDTDGVFAEYAVVPAQNVWKNPKSIPPEYATLQEPLGNAVDTVLAGPISGKSVLITGAGPLGLLGIAVAKASGAYPVIVSEPSDFRRELAKKVGADYVINPFEEDVVKEVMDITDGNGVDVFLEFSGAPKALEQGLQAVTPAGRVSLLGLYPGKVSIDFNNLIIFKALTVYGITGRHLWETWYTVSRLLQSGKLNLDPIITHKYKGFDKYEEAFELMRAGKTGKVVFMLK

SEQ ID NO: 7134 - protein, 344 aa, Kineococcus radiotolerans SRS30216
MNTSLNTATAASGLPTADPALETALREALDVVEARLRLAVGNADPIADAASRHLVEAGGKRVRPMLTLLGAHLAGSAPEVPSAVLDAAVVVELTHLASLYHDDVMDSAPTRRGAAAAQLVYGNNVAILTGDLLFARASNVVAGLGPEAVRLQAETFERLCLGQLHETVGPKPGEDPVEHYLDVLSDKTASLIATAGRFGAMFAGGSGETVTAMVRYGEDVGVAFQLADDVLDLTSDVDDSGKRPGTDLREGVPTLPVLLARRAAAAGDVAARRVVALLDSGRLADDDVLAEAVSALRDHPVTEAARASAREWAHRAATHLLALPDTPARRALEIYAATVADRVG

SEQ ID NO: 7135 - protein, 337 aa, Arabidopsis thaliana
  misc_feature (112)..(112): Xaa can be any naturally occurring amino acid
MGKIKIGINGFGRIGRLVARVALQSEDVELVAVNDPFITTDYMTYMFKYDTVHGHWKHSDITLKNSKTLLFGDKPVTVFGIRNPEEIPWGEAGAEYVVESTGVFTDKDKAAXHLKGGAKKVVISAPSKDAPMFVVGVNEDKYTSDVNIVSNASCTTNCLAPLAKVIHDNFGIVEGLMTTVHAITATQKTVDGPSAKDWRGGRAASFNIIPSSTGAAKAVGKVLPDLNGKLTGMSFRVPTVDVSVVDLTVRIEKGASYEDIKKAIKAASEGPLKGIMGYAEEDLVSTDFLGDSRSSIFDAKAGIALNDHFVKLVSWYDNEWGYSNRVVDLIRHMFKTQ

SEQ ID NO: 7136 - protein, 216 aa, Brassica rapa subsp. chinensis
MNTFPASTEMVGSENESPVTTVAGGDYYPMLAASCPKKPAGRKKFQETRHPIYRGVRLRKSGKWVCEVREPNKKSRIWLGTFKTAEMAARAHDVAALALRGRGACLNYADSAWRLRIPETTCHKDIQKAAAEAALAFEAEKSDVTMQNGQNMEETIVEAIFTEENNDVFYMDEESMLEMPALLASMAEGMLLPPPSVHFGHNYDFDGDADVSLWSY

SEQ ID NO: 7137 - protein, 142 aa, Zea mays
NTIPPSPSASLRQTLPQPRKLGPRHGRGWRLLARDERLWKAACVREWAYTGFSEQMLRSVVLSLGGFRRLHEMYIRPVQQRAAGAPPGQQRRQLPVRMGRDQVQVSLSLLSTSFFLKMPNAPPPPPKDKDRDRDKNGGGQCG

SEQ ID NO: 7138 - protein, 425 aa, Triticum aestivum
VQKSEEIFNAAKELMPGGVNSPVRAFKSVGGQPIVFDSVKGSHMWDVDGNEYIDYVGSWGPAIIGHADDKVNAALIETLKKGTSFGAPCALENVLAQMVISAVPSIEMVRFVNSGTEACMGALRLVRAFTGREKILKFEGCYHGHADSFLVKAGSGVATLGLPDSPGVPKGATVGTLTAPYNDAEAVKKLFEDNKGEIAAVFLEPVVGNAGFIPPQPAFLNALREVTKQDGALLVFDEVMTGFRLAYGGAQEYFGITPDVTTLGKIIGGGLPVGAYGGRKDIMEMVAPAGPMYQAGTLSGNPLAMTAGIHTLKRLMEPGTYEYLDKVTGELVQGILDAGAKTGHEMCGGHIRGMFGFFFAGGPVHNFDDAKKSDTAKFGRFHRGMLEEGVYLAPSQFEAGFTSLAHTTLDIEKTVEAAEKVLRRI

SEQ ID NO: 7139 - protein, 742 aa, Oryza sativa (indica cultivar-group)
MEPEREASSEWGDGVGVLGFRVKASSCEPAAQKAANEPCLLSHIRIYNKSVLEWEITAGLRYNKPDTFVKVRPRCEAPKRDILYPANHTPCRYVRISCMRGNPIAIFFIQLIGIPIPGLEPDLQPLVNYLLPHITAHKQSSQNIHLQLLKDIASRLPPFLPQIEADLASVTDTPDSSVHFLALLAGPFYPILQLTNERDFTKSLISSADSDALKSSLASTPTEYLLMGWAGLTIPVETGSIHPEKVQRGEKDAADQMPPQAPSPAPAPSGSVGGAAWRHLLLLLTGLPLALAALAFALQWRGGGVDDPTARWPPHAFPGMGMTDPTPPSLPSSACGEVLIASSGPSFPYLRGWSFPFDSDSDAALHPKVCVQTSTSAGLDQILPWLFYHKVVGVAQFLLFVEGRAAKPQVAGVLESIPGVKVVYRTQELEEQQARSRIWNETWLAGFFYKPCNYELFVKQSLNMEMAIVMARDAAMDWIIHLDTDELLYPGGGAEYSVRHLLADVPGDVDMVIFPNYESSVERDDIKDPFSEVSMFKKNYDHLPKDTYFGMYKEATRGNPNYFLTYGNGKSAARVQDHLRPNGAHRWHNYAKSPNRESLCLRESLLLHYDGNNTAIAASWYNERVVWNDKQLNLKLLRKGVLTRIYTPMAIVQGLRESGVFTSSIAAAQSLVNDKVSLKENNVQNKNHTKLEKVSRKFIRANSQASARKILHAVEPASHDSNVSAVPPLSPPSLDNHLLELS

SEQ ID NO: 7140 - protein, 417 aa, Symbiobacterium thermophilum IAM 14863
MTGQEFFRDTQETIRAAVAKLGHSEGVYKILRNPRRTLEVHIAVTMPDGSVETFLGYRSQHAAVFGPYKGGVRFHPNVTKEEVEALAMLMTLKNAVLGLPYGGAKGGVICDPNALPPTAVEQIARGYVRGLRDMIGPDTDIPAPDVNTNSRVMGWMLDEYLKCTNAIDFSVFTGKSLNLGGIEGRTGATGLGIAYVTREACKVRGVDLKGARVAVQGFGNVGRGAAQALTALGARIVGVTDITGGVYKEDGLDVAALTEYARDRGGVAGFPGAEPLTNEQLFALPVDVLIPAALEGQITGKVAETIQAPIVVEGANGPTTPEGAQVLADRGIMQVPDILANGGGVTVSYFEWVQGQQGGLRWSERTVHRRLDRYMTSAFAAVLAYSERYNVSMREAAYLFAVDRLATGMIERGWVPR

SEQ ID NO: 7141 - protein, 977 aa, Oryza sativa
MAVGEECAAAVASQVRHRWLAAAFFSSVDVAIVAGLPRVPTNYRDAPTCGMWGPHVSRCFIATFFNKPLGVLLGFVTDARAYWVTRSLIAWNVNDQDTSLFLYASRDATMHVSDGAIHGYDSKIELEPEHASLPDNVAEKFPFIRSYRTFRVPSSVDVASLVKCQLAVASYDAHGRHQDVTGLQLPGVLDDMFAYTGPLGAVFSDKDVDLYLWAPTAQDVRVCFYDGPAGPLLQTVQLKELNGVWSVTVPRYRENQYYLYEVKVYHPSTSQVEKCLADDPYARGLSANGTRTWLVDINSETLKPASWDELSDEKPNLESFSDISIYELHIRDFSAHDSTVDCNSRGGFRAFTFQDSAGIRHLRKLSAAGLTHVHLLPSFHFASVDDNKSNWKFVDEAQLAKLPPGSDEQQAAIVSIQQEDPYNWGYDPVLWGVPKGSYASNPDGPSRIIEYRQMVQALNRIGLRVVMDVVYNHLDSSGPFGVSSVLDKIVPGYYLRRNVNGQIENSAAMNNTASEHFMVDRLIVDDLLNWAINYKVDGFRFDLMGHIMKSTMFTVMSICTISTIIKIKDVFADTLIRAKSAIRSLTRDVHGVDGSKIYLYGEGWDFGEVAQNKRGINASQINMSGTGIGSFNDRIRDSVNGGNPFGNPLQQGFSTGLFLEPNGYYQGNEADTRRELATYADHIQIGLAGNLKDYVLRTHTGEAKKGSDIYTFDGSPVGYTSSPVETINYVSAHDNETLFDIVSIKTPIGLSIDEKCRINHLASSMIALSQGIPFFHAGDEILRSKSLDRDSYNSGDWFNKLDFTYETNNWGVGLPPRDKNEENWHLIKPRLENPSFRPLKNHILSVFDNFVDILKIRYSSPLFRLSTASDIEQRVRFHNTGPSMVPGVIVMSIKDAQNEKCKMAQLDKNFSYVVTIFNVCPHEVSIEIHDLASLGLELHPIQVNSSDALVRQSAYEASKGRFTVPRRTTAVFVQPRC

SEQ ID NO: 7142 - protein, 362 aa, Photobacterium profundum SS9
MAGTYKIAVLPGDGIGPEVMLQAHKVLDAVEEKFGFTLERSEHDVGGIAIDNHGCPLPESTMKGCEESDAILFGSVGGPKWEHLAPNDQPERGALLPLRKHFQLFCNLRPAQIHSGLEGFSPLRADISERGFDIVVVRELTGGIYFGQPKGREGEGPQEKAYDTEIYHRYEIERIARIAFESAMLREKNVYSIDKANVLQSSILWREVVEEVAKDYPEVTLNHMYIDNATMQLIKDPSQFDVMLCSNIFGDIISDECAMITGSMGMLPSASLNQEKFGMYEPAGGSAPDIAGKNIANPVAQILSAALMLRYSLDEEKAARAIEQAVSQALEAGELTADLAGKGAALSTSEMGDKIAAYIRQA

SEQ ID NO: 7143 - protein, 346 aa, Arabidopsis thaliana
  misc_feature (328)..(328): Xaa can be any naturally occurring amino acid
MASSTGENKGLVVSFGEMLIDFVPTVSGVSLSESPGFLKAPGGAPANVAIAVSRLGGRAAFVGKLGDDEFGHMLAGILRKNGVDDQGINFDEGARTALAFVTLRSDGEREFMFYRNPSADMLLRPDELNLELIRSAKVFHYGSISLITEPCRSAHMKAMEVAKEAGALLSYDPNLREPLWPSPEEARTQIMSIWDKADIIKVSDVELEFLTGNKTIDDETAMSLWHPNLKLLLVTLGEKGCRYYTKDFHGSVETFHVDAVDTTGAGDSFVGALLNQIVDDQSVLEEEERLRKVLRFANACGAITTTKKGAIPALPTDCEALSFLKRQXNSKTYLRVSEWCCTASPC

SEQ ID NO: 7144 - protein, 202 aa, Oryza sativa (japonica cultivar-group)
MTKQEILLEKKRVITVQGRDKAGRPIVRIVGKNFPARELGGGGHAEAALKGYVRRRVTPAIGDAEFVVVYMHSGVDRRENFPGVGAVRTAYESMPAAVRERLHAVYFLHPGLQSRLFFSTLGRFLFSSGLYGKLRYVSRLEYLWAHVRKGELDVPEAVRRHDDELEQRPLMDYGIEASERCGVFDAASMDTTASLHSLRCAS

SEQ ID NO: 7145 - protein, 339 aa, Burkholderia vietnamiensis G4
MKIRAPWRSRLTNRRQNCSIRAPRNSGRAPALLHVMNYQPILERIHTELAPWIGQGRVADYIPELAKVPADKFGMAVVTLDGNVYTVGDARERFSIQSISKLFACTLAFQLLGDALWERVGREPSGTAFNSLVQLESERGKPRNPFINAGALVVTDVLCRRFVKAETALVEFVRRLIGATDVDYDSRVALSELQHAERNRAMAHFMASFGNMQMPPDTVIDAYCRQCAIEMNCIELAQAALFLANGGVAPVTGERIVDASSAKRLSALMLTCGTYDAAGDFVYRVGLPAKSGVGGGIVAVLPGEMAVCVWAPGLDANGNSLAGTLALEWLTTYSGRSIF

SEQ ID NO: 7146 - protein, 489 aa, Arabidopsis thaliana
MKSNKFSCKTRAETLEWITAIIDFLKPFSFLINAHVVNFFKDKQWEAVNEEWMSCLKDEKPENILLIPSGGVQDHWPASLKKFVHTLRSLSFPREQADLQAILADVDMVPLSTVLSQGMNLKKKHEVTYYGIMQVEVLSSVVSSVVKSVGAPTVVDVGAGQGYLAQVLSFQYKHSVVAIDSSSHHGKVTDARAARIKKHFAAQMRKSGSGNKCPDVPMTITCRVLSTEMLKALTDVHLEKDETDSSGSALNEEGQSRSQSSSDANRSCSLVLAGLHACGDLSVTMLRTFMECEEVKALVSIGCCYNLLSEKSSEDSCSKCGYPMSAGLRSLGFSLGKNARDLACQSAERWSSLGEDAGLQNFELHSFRAAFQMFTVDTVDKKPMRQTSLNSDMCSSFEKFCLSAFSRLNLEHPRDLDLNATWNEADAFTELIGPYWSIRAALGPVLETLILLDRLMFLQEQGDSIKVVMLPIFDPTISPRNVAIIARRL

SEQ ID NO: 7147 - protein, 216 aa, Chorispora bungeana
MNSFSAFSEMFGSDYESPVSSGGDYSPKLATSCPKKPAGRKKFRETRHPIYRGVRQRNSGKWVCELREPNKKTRIWLGTFQTAEMAARAHDVAAIALRDRSACLNFADSAWRLRIPESTCAKEIQKAAAEAALNFQDEMCHMTTDAHGLDMEETLVEAIYTPEQSQDAFYMDEEAMLGMSSLLDNMAEGMLLPSPSVQWNYNFDVKGDDDMSLWSY

SEQ ID NO: 7148 - protein, 247 aa, Zea mays
MDHHHHHHHHHHHHMIPGQEPSATDGAAPDSFFLGPAAAVIFSGGAGAGSSSSGAAALGSSAGGGGGPSPSSSSPSLSRYESQKRRDWNTFGQYLRNHRPPLSLSRCSGAHVLEFLKYMDQFGKTKVHTPVCPFYGHPNPPAPCPCPLRQAWGSLDALIGRLRAAYEENGGTPEMNPFGARAVRLYLREVRETQARARGISYEKKKRKKPSAASAAAAGPSSDGSPPPGPSSGGGGPDTSSPQFIMP

SEQ ID NO: 7149 - protein, 106 aa, Triticum aestivum
  misc_feature (9)..(9): Xaa can be any naturally occurring amino acid
  misc_feature (11)..(11): Xaa can be any naturally occurring amino acid
  misc_feature (14)..(14): Xaa can be any naturally occurring amino acid
  misc_feature (16)..(16): Xaa can be any naturally occurring amino acid
  misc_feature (23)..(25): Xaa can be any naturally occurring amino acid
  misc_feature (27)..(27): Xaa can be any naturally occurring amino acid
  misc_feature (30)..(30): Xaa can be any naturally occurring amino acid
  misc_feature (33)..(33): Xaa can be any naturally occurring amino acid
  misc_feature (37)..(37): Xaa can be any naturally occurring amino acid
  misc_feature (39)..(39): Xaa can be any naturally occurring amino acid
  misc_feature (63)..(63): Xaa can be any naturally occurring amino acid
  misc_feature (69)..(70): Xaa can be any naturally occurring amino acid
  misc_feature (88)..(88): Xaa can be any naturally occurring amino acid
  misc_feature (91)..(91): Xaa can be any naturally occurring amino acid
  misc_feature (97)..(97): Xaa can be any naturally occurring amino acid
  misc_feature (99)..(99): Xaa can be any naturally occurring amino acid
MAPTVMASXAXFVXPXQGLKSTXXXPXSRXSNXASLXSXSNGGRIRCMQVWPIEGIKKFETLXYLPPLXXTRPFLKHVDYLIRSKWPXCLXFIPGSXFXFPLPFLL

SEQ ID NO: 7150 - protein, 323 aa, Oryza sativa (japonica cultivar-group)
MADEHEWWNSPCSARTGDDEAACSTADADESAVGSTPMSFGHGGQPASLSDAAASSSSSSFLLAGQHMDYWTQDFMGGRAAAAATASFDTLLQLQLQGGDAASRRLLLGDHAAAPPRHLVVPGAPYGGGGGDDTAAPPRGLSPTPYEAADNLQQQQSFPGGHHVVSNTDRLHDHHQDAGSPSPATRSSPGSPAAAKKPRIEAPSPMPTFKVRKEKLGDRITALQQLVSPFGKTDTASVLHEAIEYIKFLHDQVASLSSPYLRCGRPVQLQHQQGSHKVNGNCEGKQLDLRSRGLCLVPVASTYTVASETATEFWHPTFGGTFR

SEQ ID NO: 7151 - protein, 407 aa, Gloeobacter violaceus PCC 7421
MAKKTVEALGAADLKGKRALVRVDFNVPLDESGQITDDTRIRAALPTIGMLTGGGARVILVSHLGRPKGFDDQLRLTPVAKRLGELLGQTVYKADDVIGPEVEEAVKKLEDGDVLLLENVRFYPEEEKNNPEFAQKLAGLAELYVNDAFGTAHRAHASTEGVARYLRPAVAGLLLQKELEYLGKALESPERPVLAIMGGAKVSDKIQLIQNMLTKVDSILIGGAMAYTFLKAQGVDVGASRCETSTTKKDGTTVDLLQLALDLLAEAKERGVTFLLPVDHRTNDKFGDLADPPVTPDANIPEGQMALDIGPKTEELYVAEVQKSGTVIWNGPMGVFELPGFSKGTFAVAHALAESDNLSIVGGGDSASAAEKAGVVDKLSHVSTGGGASLEFLEGKTLPGVAALDEA

SEQ ID NO: 7152 - protein, 53 aa, Zea mays
  misc_feature (23)..(23): Xaa can be any naturally occurring amino acid
  misc_feature (32)..(32): Xaa can be any naturally occurring amino acid
  misc_feature (46)..(46): Xaa can be any naturally occurring amino acid
IYMPQCIFCGFCQKACPVHAIVXGPTFSLPLXTPQELLFPKEKFLXNGDPWET

SEQ ID NO: 7153 - protein, 302 aa, Gloeobacter violaceus PCC 7421
MGSAKVVVAGSINMDIVVRAARHPQPGETLLGQSVQFFAGGKGANQAIAAYRLGTPVILIARVGDDGFGGSLRAFVSQEGLDTQRVLATAGASGTALITVADSGENTIVVVPGANDALSPVDVEVDIEPGDVLVSQCEIPAQTIEHFFVRGKRLGARTLLNAAPARPLAPTLAAAADVLVVNESELAILTGAAVDAEDAGTVIAAARSLQPAIENVVVTLGGRGAVACLGPVSETVPGRRVEVVVDTTGAGDGFVGALAARLAAGEPFAQALVFANAAASICVERPGAAASMPTMAEVLAVL

SEQ ID NO: 7154 - protein, 1084 aa, Symbiobacterium thermophilum IAM 14863
MPRRQDVEKVLVIGSGPIVIGQAAEFDYAGTQACQALREEGLRVVLINSNPATIMTDRHVADRVYIEPITPEFVERVIARERPQGLLPTLGGQVGLNMAMQLEEAGVLARYGVRLLGTPLTAIRRAEDRAEFRALMKEIGEPVPESAIVTTPEEALAFGEEVGYPLIVRPAYTLGGTGGGIAHDREEMRDIVTRGLKLSPVTQCLVERSLLGWKEIEYEVMRDGAGNAITICSMENIDPVGVHTGDSIVVAPSQTLTDREHQILRSAALKIIDALGIEGGCNVQFALNPHAREYMVIEVNPRVSRSSALASKATGYPIAKVAAKIAVGLRLDEIRNPVTGTTYAAFEPALDYCVIKIPRFPFDKFTTADRTLGTQMKATGEVMAIDRTFPGALLKAVRSLETGRDGLFHPAVQALDDQALRERLRTPNDERLWAVAEALRRGVTVPEIHALSAIDPFFLDGIAAIVAMERELADGPLTAERMRRAKQLGFSDAAIGRIVGMDPLAVRRLRLEMGVRPVFKMVDSCAGEFPAATPYYYSCYDEENEAVSPPGRKAVVLGSGPIRIGQGIEFDYSAVHAAWELKAEGIQSIVINNNPETVSTDFDTSDRLYFEPLTLEDVLNVVEQEGDIEGVICQFGGQTAINLAVPLSRAGVRVLGTDIDQMDRAEDRRRFDQLLSDLSIPRPPGGTATSVEEAVAVARRIGYPVLVRPSFVLGGRAMEIVHDEAELRAYMREAIAVSSDRPVLVDRYFLGKEVEVDCVSDGEQVIIAGIMEHLERAGVHSGDSIAVYPTVTLTHRQRETIVAYSTRLALALQVKGLVNIQYVIHGGEIYVIEVNPRSSRTVPFLTKVTGLELAKVATQVIAGHTLAELGYDPDRSGAALVFRTPAGAGWLWPEPAERVAVKAPVFSWQKLTQVDTALSPEMKSTGEVLGVDADLPRALYKALLASGVRVPHRGTVLFTVADRDKAEAMGLARQFSDLGYRIVATTGTARALQACAIPAERVNKVSEGAPAIPDLIRAGKIDLVINTLTRGRDAHRDGFIIRRTAVEHGVPTLTSLDTARAVLTVLSSLREGEEVGISAVQDWV

SEQ ID NO: 7155 - protein, 420 aa, Azoarcus sp. EbN1
MNSDFPIPTLRPGSAGLQIEDVPLAAIAERFGTPTYVYSRAALEQAFDAYRDALAGRRALVCYAVKANSNLGVLAVFAKLGAGFDIVSGGELSRVLAAGGDPGKVVFSGVGKSAGEMRQALAAGIRCFNVESEAELERLDMLAGELGTRAPIALRVNPDVDPKTHPYISTGLKNNKFGVAFDTALALYRRAAGMANVRISGIACHIGSQLLDSGPIAEAAEKVLGLVDELAAEGIHLDHIDLGGGLGIRYRDEAPPSVAAYLAPLLRLLDGRSEELCFEPGRSLIGNAGLLLTRIEYLKPGAERNFAIVDAAMNDLARPALYDAYHEAVAVAPRDVPERNYEIVGPICESGDFLAHDRPLAVAAGDLVALLSAGAYGMAMSSNYNTRPRAAEVIVDGSRMHLVRQRETVESLYALESPLP

SEQ ID NO: 7156 - protein, 461 aa, Burkholderia sp. 383
MTDRNEAVPPHSTADYRALDAAHHIHPFSDMGALNRAGSRVIVKADGVYLWDSDGNKIIDGMAGLWCVSVGYGCKALADAAYRQIQELPFYNTFFKTTHPPVIELSAMLAEVSPKGFNHFFYCNSGSEGNDTVLRLVHQYWRVQGQPQKKYVISRKNGYHGSTIAGGTLGGMGYMHEQMPSKVENIVHIDQPYFFGEAAAGETPEAFGLARAQQLEAKILELGAENVAAFIGEPFQGAGGVIFPPSTYWPEIQRICRKYDILLAADEVIGGFGRTGEWFAHQHFGFEPDLITMAKGLTSGYVPMGAVGIHERVARPIIDNGEFNHGLTYSGHPVAAAVAVANLKLLRDEGIVERVKNDIGPYFQRRLRDALGDHPIVGEIAGAGLVAGVQLARDRDRRERFGASVDIGTICRDFCFNGNLIMRATGDRMLLSPPLVIREAEVDEIVDKAKRAFDATAERVG

SEQ ID NO: 7157 - protein, 264 aa, Brassica napus
MEKYEKLEKVGEGTYGKVYKAVEKSTGKLVALKKTRLEIDEEGIPPTALREISLLQMLSTSLYIVRLLCVEHVLKPPAKSNLYLVFEYLDTDLKKFVDSFRKSANPRPLGDALIQKLMFQLCKGVAHCHSHGVLHRDLKPQNLLLLKDKELLKIADLGLGRTFTVPLKSYTHEIVTLWYRAPEVLLGSTHYSTAVDMWSVGCIFAEMVRRQALFPGDSEYQQLLHIFKLLGTPTEQQWPGVSSLRDWHVYPKWEPQDLARAVPS

SEQ ID NO: 7158 - protein, 109 aa, Zea mays
  misc_feature (40)..(40): Xaa can be any naturally occurring amino acid
  misc_feature (53)..(53): Xaa can be any naturally occurring amino acid
MSERGKGGKGLGKGGAKRHRKVLRDNIQGITKPAILRLAXRGGVKRISGLIYXETRRVLKIFLENVIRDADTYTEHARSKTVTAMDVVYCLKRQGRTLLQFRWLGRIPF

SEQ ID NO: 7159 - protein, 288 aa, Bacillus firmus
MRSKVDKMKLADIYMQFQSDITIIEQELEASVQARHDVLKNASTHLLKAGGKRIRPVFVLLAAKFGTYDIHVLKNIAVPLELVHMASLVHDDVIDDAELRRGKRTVKSQWDNKVAMYTGNYIFAKAVEASAYFDHPRVHQVLSNTLVEMCIGEVEQIRDQYNWGQNLRVYLRRIKRKTALLIAVSCELGALAADADPVIQKHLYNFGYNVGMSFQITDDILDFVGTEKQLGKPAGGDLRQGNVTLPALYAMHHDEEISHLIKNMLKNEFPENIDMQPILKAVKESGGI

SEQ ID NO: 7160 - protein, 416 aa, Treponema pallidum subsp. pallidum
MVFGCSLRRRCFRRPAFVPVSRAHPVFLCVRANVDKDSLDGVIVAKKDYYEVLGISKTASGEEIKKAYRRLAIQFHPDRNQGNKEAEERFKEATEAYEVLIDAQKRAAYDRYGFDGLKDMHGAHGFNSSAFQGFEDIFGGGFSDIFENIFGTSSRRGGSGNDGSGGSGRGANLRYDLQISFEEAVYGKKSELHYVRDETCITCKGAGSASGGRKMCPDCKGTGQIRRSTGFFSIAQSCARCGGEGTIIESPCARCAGSGIERKKQKIIVSIPAGVEEGRRITIPRQETPVAQAVPTGTCTCLCLFVRMSISNVKVLTCTVQLRYRTQAILGAQVTVRALDGSAQQVRVPAGTQGGALLRVKGMGVPLARGAGDLYVKVLVRIPTTLSARSRALLAEISQEEGENAHPPLLELSSLK

SEQ ID NO: 7161 - protein, 171 aa, Prochlorococcus marinus str. MIT 9211
MSFANTLSYSSFLELLDNGVLAWGLAACGLAQLSKLIFELIFYQQWRPSVLFETGGMPSSHSALVTGTASAIGFQVGFSDPIFALASTIAFIVMYDASGIRRAAGLTAARLNQLPSDNWPIKPEAPLKESLGHTRKEVLVGSLLGPAIALPGMFFIGSPLHFFELLGLIQG

SEQ ID NO: 7162 - protein, 180 aa, Triticum aestivum
  misc_feature (120)..(120): Xaa can be any naturally occurring amino acid
  misc_feature (127)..(127): Xaa can be any naturally occurring amino acid
IAEPCRTAHLHAMKVAKEAGALLSYDPNLREALWPSLDEARTKILSIWDQADIVKVSEVELEFLTGINSVEDDVAMKLWRPTFKLMLVTLGDQGCKYYTKDFRGTVPSYKVQQVDTTGAXGDAFIGXLLRKIVQDPSALQDKTKLEGAIKFANACGASRPRRKGHPSVAKEDKCCADGKA

SEQ ID NO: 7163 - protein, 397 aa, Oryza sativa (japonica cultivar-group)
MMNGSNGSQGYHVNGKQVQSVVPSIQNNGPRHRPLTLMRRCRGMLCLVIMPLTAFMMMVYLSPVTTFLIRLFSVHYSRKSTCFLFGMWLAMWPFLFEKINKTKFVFSGETVPPKERVLLFANHRTEVDWMYLWDLALRKGRLQCIKYILKKSLMKLPIFNWAFHIIEFIPVERKWEVDEPLIRSRLSELKNPKDPLWLAVFPEGTDYTEKKCIKSQEYAKEHGLPILNNVLLPKTKGFHCCLQELRDSMDSVCDITIAYKHRPPTFMDNVYGIDPSEVHIHVKIIQVSDIPTSEDEVADWLIERFKLKNKLLSDFSALGHFPNEGTEDDLSTLKCIANFVAVISTTTVLTYLTLFSSVWFKIFVAFSSAFLTFATLYSIHLPQLICSPEAGTHAKKS

SEQ ID NO: 7164 - protein, 203 aa, Oryza sativa (japonica cultivar-group)
MTDLDGNIVAIPNPSGRGPGYRYFGAAKKLPGVRELFDKPPEVRKRRTRYEIHKRINAGYYGYYDDEDGMLERLEAVAEKRMRNEVITEWHRVERVRREAMKGVVSGEVASAGGRGGEAAREVLFEEVEEEVEEERRLEEEKREREKGEEAGKEFIAHVPLPDEKEIERMVLERKKKELLSKYTSDALQVEQEEAKEMLNVRR

SEQ ID NO: 7165 - protein, 384 aa, Gloeobacter violaceus PCC 7421
MTFADLQLHPDLVRAVEQLGFTQPTPIQTLAIPPALAGRDVLACAMTGSGKTAAFLLPILQQLIAQPRSTTRALVLTPTRELAGQIEMHLGQLARYSALRGASIIGGVSPEPQARAFHKGVEVLIGTPGRLLDHFDQPYARLANLEILVLDEADRMLEMGFLPDIRRILRHTGHRRQTLFFSATMPGPIAKLATEILRNPVTLNQERKAAPAVGITHSVYPVAQNLKSKFLLELLEREGMRQVIVFTRTKHRANRLSEYLSKARISCERIHGNRSQGQRTEALAGFKSGKYRVLVATDIASRGIDIEALGHVVNFDVPQAAEDYIHRVGRTARAERTGDAFTFVSPEEEDQLRAIERAIGKRLPRLTLLNFDYAVAPQGSRLSG

SEQ ID NO: 7166 - protein, 157 aa, Brassica napus
MKRPVTGKDLMIVNMGPHHPSMHGVLRLIVTLDGEDVVDCEPILGYLHRGMEKIAENRAIIQYLPYVTRWDYLATMFTEAITVNGPEQLGNIQVPKRASYIRVIMLELSRIASHLLWLGPFMADIGAQTPFFYIFREREFGYDLFEAATGMRKMHNF

SEQ ID NO: 7167 - protein, 144 aa, Triticum aestivum
MAQGTLEVLLVGAKALENTDYLCNMDPYAVLKCTSQEQKSTVASGKGSDPEWNETFVFTVSENATELVIKLLDSDGGTDDDSVGEATIPLDGVSSRGRLPPTVYNVVKDEEYRGEIKIGLTFTPEEARDQDQPEENYGGWNQSS

SEQ ID NO: 7168 - protein, 316 aa, Vibrio fischeri ES114
MTTKLEQLRKLTTVVADTGDIEAIAKYTPEDATTNPSLILKAAEITEYAPLIDASIEYAKAQSNDKAQQVQDTCDMLAVNIGKEILKVVPGRISTEVDARLSYDTEGSVAKARQLIKMYNDAGITNDRILIKLASTWEGIRAAEILEKEGINCNLTLLFSFAQARACAEAGVYLISPFVGRIMDWYKAKEGRDFEPSEDPGVVSVTGIYNYYKEHGYNTVVMGASFRNIGEILELAGCDRLTISPNLLQELEEATGEVVEKLVDTNGNKARPAAMTHAEFLWDHNQDAMAVEKLAEGIRNFAVDQGKLEAMIATKL

SEQ ID NO: 7169 - protein, 415 aa, Desulfotalea psychrophila LSv54
MQNEVSTAQQEAGSLPKRYCRYIKNMGPAWIISAVACGPATLASVAIAGATYGYKMLWVVILSAVFGTTTQYLAARVGVLEGMGIIAATEKHLGKRWAWILTIDALLATWLAAMVLMNALAGVTSLITGVDTPYWGVLYGVLVALFLVRRGYRNFETLCKVLVIFVVACFMATLFMADLSLPAIGEGLLPNFPGGIDAALMMAAIMGGAVHITIIGMHTYNTNARGWKIKDLSLARFDTFSSMGMAFGLYSVAIFLVDVAVLHPNGIAVKRATDAALALKPLLGDSAMKIFMVGLWAATLSTLSPTFMAGAYFLSDKMGWQLDVKDRRFAGVVFAGCLLSMLGPFVKGSFFLLLPLMLALGLTGTPLIIAIILYLLNRRTGSLRNSALLNLMGGLTFLVTSFLAVRFLLAKFGIM

SEQ ID NO: 7170 - protein, 663 aa, Vibrio fischeri ES114
MNRKHLANAIRALSMDGVQQANSGHPGAPMGMADIAEVLWRSHLNHNPANPEWADRDRFILSNGHGSMLIYSLLHLSGYELSIDDLKNFRQLHSKTPGHPEYGYAPGVETTTGPLGQGITNAVGMAMAEKALAAQFNKEGHDIVDHFTYTFMGDGCLMEGISHEACSLAGTLGLGKLIAFWDDNGISIDGEVEGWFSDDTPKRFEAYGWHVIPAVDGHDSDAINAAIEAAKADPRPTLICTKTIIGFGSPNKQGTHDCHGAPLGADEIKAAKAQLGWEHGAFEIPQEVYAEWDAKETGAAKEASWNEKFAAYEAAYPELAAEFTRRVNGDLPKEWEEKASAIIADLQANPANIASRKASQNALEAFGAMLPEFMGGSADLAPSNLTMWSGSKSLEANDFSGNYIHYGVREFGMTAIMNGIALHGGFVPYGATFLMFMEYARNAMRMAALMKVQNIQVYTHDSIGLGEDGPTHQPVEQIASLRLTPNMSTWRPCDQVESAVAWKLAIERKDGPSALIFSRQNLAQQERDAKQLANIAKGGYILKDCEGQPELILIATGSEVELAIEAAAQLTAEGKAVRVVSMPSTDAFDKQDEAYREAVLPSAVTKRIAIEAGIADFWYKYVGFGGKIIGMTTFGESAPADELFKMFGFTTENVVNTAKELLA

SEQ ID NO: 7171 - protein, 198 aa, Klebsiella pneumoniae
MLTEQLDWEKTDGMMPAIVQHAVSGEVLMLGYMNKEALEKTEATGKVTFYSRTKQRLWTKGETSGNVLNVVSITPDCDNDTLLVLVNPIGPTCHKGTTSCFGETGHQWLFLYQLEQLLAERKHADPESSYTAKLYASGTKRIAQKVGEEGVETALAATVNDRFELKNEASDLMYHLLVLLQDQGLDLGEVIDNLKSRH

SEQ ID NO: 7172 - protein, 1120 aa, Oryza sativa
GEVRRGKNRTHPQYTLDARLHAVFEQSGASGRSFDYTQSLRASPTPSSEQQIAAYLSRIQRGGHIQPFGCTLAVADDSSFRLLAYSENTADLLDLSPHHSVPSLDSSAVPPPVSLGADARLLFAPSSAVLLERAFAAREISLLNPLWIHSRVSSKPFYAILHRIDVGVVIDLEPARTEDPALSIAGAVQSQKLAVRAISRLQALPGGDVKLLCDTVVEYVRELTGYDRVMVYRFHEDEHGEVVAESRRNNLEPYIGLHYPATDIPQASRFLFRQNRVRMIADCHAAPVRVIQDPALTQPLCLVGSTLRSPHGCHAQYMANMGSIASLVMAVIISSGGDDDHNISRGSIPSAMKLWGLVVCHHTSPRCIPFPLRYACEFLMQAFGLQLNMELQLAHQLSEKHILRTQTLLCDMLLRDSPTGIVTQSPSIMDLVKCDGAALYYHGKYYPLGVTPTEVQIKDIIEWLTMCHGDSTGLSTDSLADAGYPGAAALGDAVSGMAVAYITPSDYLFWFRSHTAKEIKWGGAKHHPEDKDDGQRMHPRSSFKAFLEVVKSRSLPWENAEMDAIHSLQLILRDSFRDSAEGTSNSKAIVNGQVQLGELELRGIDELSSVAREMVRLIETATVPIFAVDTDGCINGWNAKVAELTGLSVEEAMGKSLVNDLIFKESEETVNKLLSRALRGDEDKNVEIKLKTFGPEQSKGPIFVIVNACSSRDYTKNIVGVCFVGQDVTGQKVVMDKFINIQGDYKAIVHNPNPLIPPIFASDENTCCSEWNTAMEKLTGWSRGEVVGKLLVGEVFGNCCRLKGPDALTKFMIVLHNAIGGQDCEKFPFSFFDKNGKYVQALLTANTRSRMDGEAIGAFCFLQIASPELQQAFEIQRHHEKKCYARMKELAYIYQEIKNPLNGIRFTNSLLEMTDLKDDQRQFLETSTACEKQMSKIVKDASLQSIEDGSLVLEKGEFSLGSVMNAVVSQVMIQLRERDLQLIRDIPDEIKEASAYGDQYRIQQVLCDFLLSMVRFAPAENGWVEIQVRPNIKQNSDGTDTMLFLFRFACPGEGLPPEIVQDMFSNSRWTTQEGIGLSICRKILKLMGGEVQYIRESERSFFHIVLELPQPQQAASRGTS

SEQ ID NO: 7173 - protein, 1490 aa, Candida albicans SC5314
MADADTSSNSSKTNEDRSQEGFGTYQGYTDRVASEVQELARIISHASIQQLKLKRQHSRQESQKSNEQESELSGKLGVIPVDENGNFVDQRLNPNSPEFNAAYWIQNAHKLVSSDIDYFKPVTIGVAYKNLRAYGSASDADYQSTLVNLIPKYLSLFFREYILRHTGPTFDILKPMDGLIKPGELTVVLGRPGAGCSTFLKTIASQTYGYHIDKDSVIRYNSLTPHEIKKHYRGEVVYCAETENHFPQLTVGDTLEFAAKMRTPQNRPLGVSRDAYARHLAAVVMAVYGLSHTRNTKVGNDFIRGVSGGERKRVSIAEITLNNAMVQCWDNSTRGLDSATALEFIRALKASADIVHTTPLVAIYQCSQDAYDLFDKVVLMYQGYQIYFGSAKKAKQYFIDMGYECPQRQTTADFLTSLTNPAERIVRQGFEGKVPQTPQEFYEYWKKSPEGQQIVADVDQYLTEHSSAAEKEAIKEAHQARQSDHLKPASPYTVSFFMQVRYIAHRNILRIKGNPSIHLFQIFGNIGMSFILSSIFYNLPTATSSFYHRTAALFFAVLFNAFSCLLEIFSLYEARSIVEKHKKYALYHPAADAFASIVTELPTKFIIAIGFNLVYYFMVNFRRTPGNFFFYLLINFSATLAMSHIFRTIGAATKTLQEAMTPAAILLLALTIFTGFVIPTPNMHGWCRWINYLDPLAYAFESLIANEFHNRDFECSQYVPSGGSYPTAGPNRICTPVGSVPGQDFVDGTRYMEMSFDYRNSHKWRNFGIVIGFIVFFFCTYILLCEINKGAMQKGEILLFQQRALKKRKKANNDIESGEIEKVTPEFDNEYENNQDKMLQSGGDTFFWRDLTYQVKIKSEDRVILDHVSGWVKPGQVTALMGASGAGKTTLLNALSDRLTTGVVTEGIRLVNGRPLDSSFQRSIGYVQQQDLHLETSTVREALEFAAYLRQPKSVSRKEKNEYVDYIIRLLEMEQYADAVVGVSGEGLNVEQRKRLSIGVELVAKPKLLVFLDEPTSGLDSQTAWSICKLIRKLADNGQAILCTIHQPSAILLAEFDRLLFLQRGGQTVYFGDLGENFTTLINYFEKYGAPKCPPEANPAEWMLEVIGAAPGSKANQDYYDVWLKSSEFQEMNSELDLMSEELVKKPLDDDPDRLKPYAAPYWEQYLFVTKRVFEQNWRTPSYLYSKFLLVVTSSLFNGFSFYKADRSLQGLQNQMFSVFMFLVILHTLIQQYLPTFVSQRDLYEVRERPSKTFSWITFIAAQVTAEIPWNIICGTLGYFCWYYPVGLYQNATYTNTVHQRGAFMWFAIVLFFIYTSTLAQLCISFLEIDDNAANLSVLLFTMCLAFCGVLVTKEQLPGFWVFMYRCSPFTYLVSVMLSVGLVDAPVTCAAKEYLRFSPPQGYTCMQYMEPYMKVAGGYLLNENSTTECEFCTMKVTNVFLKMIGSDYSKRGRDIGIYIAFIGINIIGTFILYWFARVPKNFDIKLRRKR

SEQ ID NO: 7174 - protein, 184 aa, Frankia sp. EAN1pec
MTSVDSQPDLSAAEAVLGAHVRDVMDFPKPGVVFKDITPLLSTPAAFGVVVGALADLARGLGATTIAGIEARGFLLAAPVADRVGAGIVPIRKQGKLPGRTRSEAYALEYGTAVLEIHEDAVPTGERVLIVDDVLATGGTAAAAHTLLRGCGADVVGLAVLMELTFLSGRDRTGTLDVTSIMKI

SEQ ID NO: 7175 - protein, 403 aa, Neisseria meningitidis Z2491
MNQLKLAVSGAQILFVAFGAMVLVPLLTGLNPALALLGAGLGTLLFQITTKRKVPIFLGSSFAFIAPIIYSVGEWGLPSTMFGLFAAGFMYFVFAALIRWRGLAAVHKLLPPVVIGPVIMVIGLSVAVAASSMAMGQADGKQVIDYTDSLILSGFTFAVTAIVSVFGSRMMKLIPILIGVASGYVLALLMGLVDTASIAHAPWFAVPHFETPQINWQAALFMLPVAVAPAIEHIGGIMAIGNVTEKDYTKDPGLDKTLAGDGLGVCVAGLIGGPPVTTYGEVTGAVMITKNSNPVIMTWAAVFAVCMAFFGKFNAFLASIPMPVMGGIMLLLFGTIASLGIKTLIDAKVDLMLPKNLVIVSSVLTTGIGGMTLKLGSFSFAGVGLCAVLAIMLNSLLPDPKES

SEQ ID NO: 7176 - protein, 467 aa, Saccharomyces cerevisiae
MSTNTKHYDYLVIGGGSGGVASARRAASYGAKTLLVEAKALGGTCVNVGCVPKKVMWYASDLATRVSHANEYGLYQNLPLDKEHLTFNWPEFKQKRDAYVHRLNGIYQKNLEKEKVDVVFGWARFNKDGNVEVQKRDNTTEVYSANHILVATGGKAIFPENIPGFELGTDSDGFFRLEEQPKKVVVVGAGYIGIELAGVFHGLGSETHLVIRGETVLRKFDECIQNTITDHYVKEGINVHKLSKIVKVEKNVETDKLKIHMNDSKSIDDVDELIWTIGRKSHLGMGSENVGIKLNSHDQIIADEYQNTNVPNIYSLGDVVGKVELTPVAIAAGRKLSNRLFGPEKFRNDKLDYENVPSVIFSHPEAGSIGISEKEAIEKYGKENIKVYNSKFTAMYYAMLSEKSPTRYKIVCAGPNEKVVGLHIVGDSSAEILQGFGVAIKMGATKADFDNCVAIHPTSAEELVTMR

SEQ ID NO: 7177 - protein, 524 aa, Catharanthus roseus
MEMDMYTIRKAIAATIFALVVAWAWRVLDWAWFTPKRIEKRLRQQGFRGNPYRFLVGDVKESGKMHQEALSKPMEFNNDIVPRLMPHINHTINTYGGNSFTWMGRIPRIHVMEPELIKEVLTHSSKYQKNFDVHNPLVKFLLTGVGSFEGAKWSKHRRIISPAFTLEKLKSMLPAFAICYHDMLTKWEKIAEKQGSHEIDIFPTFDVLTSDVISKVAFGSTYEEGGKIFRLLKELMDLTIDCMRDVYIPGWSYLPTKRNKRMKEINKEITDMLRFIINKRMKALKAGEPGEDDLLGVLLESNIQEIQKQGNKKDGGMSINDVIEECKLFYFAGQETTGVLLTWTTILLSKHPEWQERAREEVLQAFGKNKPEFERLNHLKYVSMILYEVLRLYPPVIDLTKIVHEDTKLGPYTIPAGTQVMLPTVMLHREKSIWGEDATEFNPMRFADGVANATKNNVTYLPFSWGPRVCLGQNFALLQAKLGLAMILQRFTFDVAPSYVHAPFTILTVQPQFGSHVIYKKLES

SEQ ID NO: 7178 - protein, 324 aa, Wolbachia pipientis
AAGEPDFDTPDHIKKAAIQAISEGKTKYTAVDGTRELKEAIINKLRKDNNLEYTLNQICVGTGAKQVLFNLFMATINSGDEVIIPAPYWVSYVDMVSLFGGLPVVVECKQNFKLTVELLKSRITKKTKWLILNSPNNPAGAVYTCDELKDIAQILLEYPHMNVVTDDIYEHIIYDEKFFTIAQVEPKLYDRVFVVNGVSKAYAMTGWRIGYIAGRSDVVKAISTLQSQSTSNPNSIAQAAAAAALNGDHSFLKERTRIFKSRRDFMVKELNSAPGLSASVPQGAFYLFVSCEGLLSKSTKSGKIINNDLDFTEYLLGDHLVAVV

SEQ ID NO: 7179 - protein, 755 aa, Asparagus officinalis
MSVNHNPDPQKPVPVESDRCPIEEVALVVPETDDPNLPVLTFRAWFLGLTSCSVLIFLNTFFTYRTQPLTISAILTQIAVLPIGRFMASALPDKEVRVLGGWGFNLNPGPFSIKEHVIITIFANCGVSTGGGDAYSIGAITVMKAYYKQGLGFLCALIIVLTTQAVLSHYLLMGFKSSSSSSSSSHRKVTVGFIAELTVTSTFAAVRAPDFNVIGYGWAGVLRRFLVDPVEMWWPANLAQVSLFRALHEKDVNSKGPSRMKFFMIFFIGSFLYYAFPGYLFPILTFFSWVCWAWPHSITAQQIGSGYHGLGIGAFTLDWAGISAYHGSPLVAPWFSILNIAAGFIMFVYIIVPICYWKYNTFDARKFPMFSNQLFTSKGTKYNTTAVLTPQFELNEAAYNSYGKLYLSPLFALSIGSGFARFTATLTHVFLFHGSDIWRQSRAAANSIKEDIHAKLMKKYKQVPEWWFLILLVGSIFLSLIMSFIWKEQVQLPWWGLIFAFGLAFVVTLPIGVIQATTNQQPGYDIIAQFMIGYVLPGKPIANLLFKIYGRISTVHALSFLSDLKLGHYMKIPPRCMYTAQLVGTLVAGILNLAVAWWMLENIENICDDSLPDSSPWTCPKYRVTFDASVIWGLIGPSRLFGHGGLYRNLVWLFLIGAVLPVPIWILSKIYPEKKWIPLINIPVISYGLRHPKVSAPSLRHPRVSAPSLRHPRVSAPTLRHPRVSASSLRHPRVSAPSLRHPRVSPRQIWAFKYF

SEQ ID NO: 7180 - protein, 203 aa, Oryza sativa (japonica cultivar-group)
MFSLFYGLWQHVFSKAEFHVVILGVHKAGKTTLLEKVKSIYLKEKGLPHDRIVPTVGLNIGRIEDANVKLVFWDLGGQPGLRTIWEKYYEEAHAVLYVIDSAAASSFEDAKSALEKVLHHEDLPGVPLLIFANKQEFPPAVTEEKLARHLPLKGLDESPYMFQGGSAYDGTGIKGGIDWLVEEMERSKRTEVLMARTETAEKI

SEQ ID NO: 7181 - protein, 358 aa, Arabidopsis thaliana
MVEAKKAVPRDDHVVFNKSNSSLQGSPGPSNSKKIFVGGLASSVTEAEFKKYFAQFGMITDVVVMYDHRTQRPRGFGFISYDSEEAVDKVLQKTFHELNGKMVEVKLAVPKDMALNTMRNQMNVNSFGTSRISSLLNEYTQGFSPSPISGYGVKPEVRYSPAVGNRGGFSPFGHGYGIELNFEPNQTQNYGSGSSGGFGRPFSPGYAASLGRFGSQMESGGASVGNGSVLNAAPKNHLWGNGGLGYMSNSPISRSSFSGNSGMSSLGSIGDNWGTVARARSSYHGERGGVGLEAMRGVHVGGYSSGSSILEADSLYSDSMWLSLPAKAEEGLGMGPLDFMSRGPAGYINRQPNGGIAA

SEQ ID NO: 7182 - protein, 459 aa, Agrobacterium tumefaciens str. C58
MTDPQTLAARFPGDFLFGVATASFQIEGATKADGRKPSIWDAFCNMPGHVFGRHNGDIACDHYNRWEEDLDLIKEMGVEAYRFSIAWPRIIPDGFGPINEKGLDFYDRLVDGCKARGIKTYATLYHWDLPLTLMGDGGWASRSTAHAFQRYAKTVMARLGDRLDAVATFNEPWCAVWLSHLYGIHAPGERNMEAALAAMHHINLAHGFGVEASRHVAPKVPVGLVLNAHSVIPASNSEADLKAAERAFQFHNGAFFDPVFKGEYPAEMMEALGDRMPVVEAEDLAIISQKLDWWGLNYYTPMRVADDATPGAEFPATTPAPAVSEVKTDIGWEVYAPALKSLVETLYKRYDLPECYITENGACYNMGIENGEVNDQPRLDYYAEHLGIVADLIRDGYPMRGYFAWSLMDNFEWAEGYRMRFGLVHVDYDTQVRTLKNSGKWYSALASRFPKGNHGVVKG

SEQ ID NO: 7183 - protein, 321 aa, Triticum aestivum
  misc_feature (135)..(135): Xaa can be any naturally occurring amino acid
  misc_feature (320)..(320): Xaa can be any naturally occurring amino acid
MAAPASGGRGRARSCETAEQTREWMEAIASFLGRHRPLLEAHVVNFFKDRLWEMVDADWMECLRREPVESLLMLPSGCVQDHWPSSLQEFILTARSLVLPREQKSPQSFLPNSRVASIGTVLAQGMNSKKKHEVXEALSGIVDAIARSRGAKTVVDVGSGQGYLAQALSFEYQLAVIAIDASSHHASVTNTRAERIKKHYAAKCVEKQQFKVPRTVTCHVLSSDTLAAVVLDACQDNHGEHVTESNNCNQSSPQIGQPNHSIPQLVLAGLHACGDLSVNMLRVFVSCEQVQALVSVGCCYNLLSEDCHEDTDTSPGFPIXN

SEQ ID NO: 7184 - protein, 427 aa, Pseudomonas fluorescens Pf-5
MSRSETLFANAQKHIPGGVNSPVRAFKSVGGTPLFFKHAEGAYVTDEDDKRYVDYVGSWGPMILGHSHPDVLDAVRKQLEHGLSYGAPTAMETEMADLVCSIVPSMEMVRMVSSGTEATMSAIRLARGFTGRDSIIKFEGCYHGHSDSLLVKAGSGALTQGVPSSAGVPAAFAKHTLTLPFNDIAAVEKMLAEVGQEVACIIVEPVAGNMNCVPPAPGFLEGLRRLCDQHGVVLIFDEVMTGFRVALGGAQAHYGVTPDLSTFGKIIGGGMPVGCFGGKRKIMEHIAPLGPVYQAGTLSGNPLAMAAGLTTLRLISRPGFHAELSDYTSRLLEGLQQRADAAGIPFVTTQAGGMFGLYFSGADDIVTFDDVMASDANLFKRFFHLMLEGGVYLAPSAFEAGFTSIAHGEAELQLTLDAAERAFAALK

SEQ ID NO: 7185 - protein, 554 aa, Prochlorococcus marinus str. MIT 9211
MVIGYDASRDFLWLLVQPWIWIPRIIIIIVSISIFAFKLFFLGQSKSSNIQRGLAKDLLESLTTLGPCFIKVGQSLSTRPDLIPKEWLEELTKLQDSLPAFSHPRAIEILQNEIGYPLESYFEEFPDEPIASASLGVVYKAKLKNKNTVAVKIQRPGLTYIIRRDLVIIRILSSLISPILPLNLGFGLSEIIDEFGISLFKEIDYKQEADNAERFSRLFASNKYVTVPKVERMYSSSKVITTSWIEGIKLKDSEYLRENSINPTEIIRTAVTSGIQQLLEFGYFHADPHPGNMFALKNTLGGMGHLAYVDFGMMDSISNEDRITLTGAIVHLINKDFLSLANDFVKLGFLNEEEDLSKIVPILEEVLGGVLTKEVNSFNLKSITDKFSELMYDYPFRVPARFALIIRAVVSQEGLAIKLDPSFKILRFAYPYVAKRLLVEQNEEMIEILMDIIFDKYDHIRVDRLEALLNVLTEGSDTPGNELLPVARDGLKLLISSKGSPVRRKLLMSLIKDDKINISEMQELVKLLKSTFSPISIANGFLPLLKSKSKSPLS

SEQ ID NO: 7186 - protein, 523 aa, Glycine max
MAMANLARRKGYAVVLSSRSSLCLTRWRGFASGSDENDVVVIGGGPGGYVAAIKAAQLGLKTTCIEKRGTLGGTCLNVGCIPSKALLHSSHMYHEAKHAFANHGVKFSSVEVALPAMMGQKDKAVSNLTQGIDGLFQKNKVTYVKGYGKLVSPSEISVDTTEGENTVVKGKHIIIATGSDVKSLPGVTIDEKKIVSSTGALALSEIPKKLVVIGAGYIGLEMGSVWGRIGSEVTVVEFASEIVPTMDADIRKQFQRSLEKQGMKFKLKTKVVGVDTSGDGVKLTVEPSAGGEQTIIEADVVLVSAGRTPFTSGLNLDKIGVETDKLGRILVNERFSTNVSGVYAIGDVIPGPMLAHKAEEDGVACVEYLTGKVGHVDYDKVPGVVYTNPEVASVGKTEEQVKETGVEYRVGKFPFLANSRAKAIDNAEGLVKIIAEKETDKILGVHIMAPNAGELIHEAAIALQYDASSEDIARVCHAHPTMSEAVKEAAMATYDKPHSHLKSWLLLSSLVFIFVQEFTMTWR

SEQ ID NO: 7187 - protein, 214 aa, Bradyrhizobium japonicum USDA 110
MVTFPKHLLEGYQAFATQRLPTEQTRYRELSVKGQFPEVMVIGCCDSRVSPEVIFDVGPGELFVVRNIANLVPVYQPDGNAHGVSAALEYAVTVLKVKHIVVLGHAQCGGIRAFVDKIEPLTPGDFIGKWMQMFIKPGEVVEQRDHESMAQFVERIEKAAVFRSLENLMTFPFVQKAVDAGQMQTHGAYFGVAEGSLFVLDKVAKEFRSVKDAA

SEQ ID NO: 7188 - protein, 455 aa, Prochlorococcus marinus str. MIT 9211
MGVSRLFDLNKDQNSPNRNITPITAELDNSDRMTVGGCLLSDLANQYGTPLYVIDEASIRSSCRAYRKALKQSYPGDSFVLYASKANSSLAIDRIVASEGLGIDVVSEGELITALKSGVAGEQIVLHGNNKSDKELLLAHESNATIIIDNQHDIQRLDKLISHKEGSVRLMLRFTPGIECHTHEYIRTGHLDSKFGFDPEQVSDTFAQLKDYKWAKLVGLHAHIGSQIFELSPHMDLVEVMADFFLRAKDLGHPIKDLNIGGGLGVKYIPSDDPPDIYSWVETVSNAVIKAFDTRNIELPRLICEPGRSIIATAGLTLYRIGARKDIPGGKTYLSIDGGMSDNPRPITYQSTYTACLVDRPLANTDQVVTIAGKHCESGDILLNNIALPTASSGDVLGVFGTGAYNLSMSSNYNRIPRPASVLVNNAQSDLVQVRELPEDLLRYDRLPDRFIAKG

SEQ ID NO: 7189 - protein, 383 aa, Arabidopsis thaliana
MPTLYKKAGCQFPLTTMVKKGGTKRKIAIETIQKRDSLRVTCTKRREGLYSKASQLCLLSDAQIAILATPPSSESNVSFYSFGHSSVDAVVSAFLSGQRPVPKDNKETREDVGICLTRNNLGLGFWWNDESLARSENPQEISEAIDSMRTLLRNLKELRADEALACNQAFVNDREDLKNNDKCDFVSDHETHDQTLILQSASPICCIPENLNEITQEPNQTLNIQSSTSAICCVPDNSPENFNEITEEQDQIRSICETFCVMDNNAALPEMNLDYDQDIGFDTPFESALNDWFSDNTTHQEISASILNAVVDDQVSATKPLEPQKDEKQLVPEEALIVLAGPLTRSKSKKFNQAINGLLKELKKNQEDVTQSSFIVITAQEAR

SEQ ID NO: 7190 - protein, 516 aa, Catharanthus roseus
IAATIFALVMAWAWRVLDWAWFTPKRIEKRLRQQGFRGNPYRFLVGDVKESGKMHQEALSNPMEFDNDIVPRLMPHINHTIKTYGRNSFTWMGRIPRIHVMEPELIKEVLTHSSKYQKNFDVHNPLVKFLLTGVGSFEGAKWSKHRRIISPAFTLEKLKSMLPAFAICYHDMLTKWEKLAEKEGSHEVDIFPTFDVLTSDVISKVAFGSTYDEGGKIFRLLKELMDLTIDCMRDVYIPGWSYLPTKRNKRMKEINKEITDMLRFIINKRMKALKAGEPGEDDLLGVLLESNIQEIQKQGNRKDGGMTINDVIEECKLFYFAGQETTGVLLTWTTILLSKHPEWQERAREEVLQAFGKNKPEFERLNHLKYVSMILYEVLRLYPPVIDLTKIIHEDTKLGPYTIPAGTQVMLPTVMLHREKSIWGEDAMEFNPMRFADGVANATKNNVTYLPFSWGPRVCLGQNFALLQAKLGLAMILQRFKFDVAPSYVHAPFTILTVQPQFGSHVIYKKLERQNF

SEQ ID NO: 7191 - protein, 370 aa, Bradyrhizobium japonicum USDA 110
MATHKLLLLPGDGIGPEVMGEVKRLIDWLNSAGIAKFETDTGLVGGSAYDAHKVSISEGDMAKALAADAIIFGAVGGPKWDAVPYEVRPEAGLLRLRKDLGLFANLRPAVCYPALADASSLKREAVEGLDIMIVRELTGGVYFGEPKTITDLGNGQKRAIDTQVYDTYEIERIARVAFDLAKKRKNKVTSMEKRNVMKSGVLWNEVVTQVHKREYPDVTLEHQLADSGGMMLVKWPKQFDVIVTDNLFGDMLSDIAAMLTGSLGMLPSASLGEVDVKSKKRKALYEPVHGSAPDIAGKGLANPIAMISSFGMALRYSFDMGALADKVDAAIAAVLASGLRTADIKSEGTTAASTTQMGEAILKELQKLHA

SEQ ID NO: 7192 - protein, 361 aa, Triticum aestivum
MDEKAAKMEKLSSAAAFVEGGVQDACDDACSICLEAFCDSDPSTVTSCKHDFHLQCILEWCQRSSQCPMCWQAISMKDPLSQELLEAVEQEKNNVQADRSHTTAVFRHPMLGHFEVPVDTDDAELEERLMQHLAAAAVTRRSHRHGRREGHRGRSGPHGRTQIVVFSTTETTSSDPISSDSPQVGDSEYSPAIISAPVDAMEEASANILVHNNTSSNCPVGSNDRISGDEASPINQDGAGPSDPQSFSNTLKTRLQSVSVKYKDSITKNTRGWKERWLSRSDTISSLGSDVRREVNAGIAAVSRMMERLETRDGSGSGPSSASSDNVSSATDNQGAASSNFCASVNGASSSATCASRSGSQ

SEQ ID NO: 7193 - protein, 70 aa, Musa x paradisiaca
GNEIVCYESPRPTAGIHRFVFVLFRQSVRQTIYAPGWRQNFNTKDFSALYNLGDPVAAMFFNCQRESGCE

SEQ ID NO: 7194 - protein, 133 aa, Azotobacter chroococcum (strain mcd 1)
MKDWLDEIHWNADGLVPAIAQDHKTGRILMMAWMNRESLALTVRENRAIYWSRSRGKLWRKGEESGHLQKVHEVRLDCDADVIVLQVEQLGGIACHTGRESCFYRVFEDGAWKVVEPILKDPDAIYHAGHRHE

SEQ ID NO: 7195 - protein, 478 aa, Arabidopsis thaliana
MASIMFLWPMYKQFVPYQLREYLENTIQKYLDKLFRRDSNFVYIRFPEYTGEGLSKSRAYDEIGNYLSSISTARAKRLKAKESENSKSLVLCLDDDEAVVVVFQGVNVVWSSTVVDKEDKHNSKEGRYLTLTFENHHRDIITNTYIDHVLREGKEIALKNRERKLYTNNDSSSYSSWWEGLWSNVPFNHHASFETLGMDLDKKEEIKKDLIKFTKGKDYYRKVAKPWKRGYLLFGPPGTGKSTMISAIANFLEYDVYDLELTTVKDNAELKKLMLDTKGKSIVVIEDIDCSLELTEHRKKKKEEDEDKEEKKEAENLKRVSGNNESNVTLSGLLNAIDGLWSACSDEKIIIFTTNFVDNLDPALIRRGRMDYHIEMSYCRFEAFKVLAKNYLENESHDLYGEIGRLLEEVDVSPADVAENLMPKSDEDDADICFRRLVKSLEEEKKKKIEKEARKNKKKAEDNVKQEKQNKVKGMVTK

SEQ ID NO: 7196 - protein, 263 aa, Triticum aestivum
  misc_feature (246)..(246): Xaa can be any naturally occurring amino acid
RGKIIRLHILTDGRDVLDGSSVGFVETIENDLAQLREQGVDARIASGGGRMYVTMDRYENDWSVVKRGWDAQVLGEAPHKFQNALEAVKTLRAEPKANDQYLPPFVIVDESGKSVGPIVDGDAVVTFNFRADRMVMLAKALEFPDFDKFDRVRVPKIKYAGMLQYDGELKLPSKYLVSPPLIERTSGEYLVKNGVRTFACSETVKFGHVTFFWNGNRSGYFDETREEYVEIPSDSGITFNEQPKMXALEIAERTRDAILSGKV

SEQ ID NO: 7197 - protein, 452 aa, Synechococcus sp. CC9605
MGADLDLVVLGAGSGGLAAAKRAARHGARVAIVEGDRVGGTCVIRGCVPKKLLVYGAQARHQLADASAYGLEIGAVRSDVPDLLRRVRAEVDRLNALHLGFLEKAGVQLLSGWGRFTAPDRIGISDQRGGPVREELTAPRFLVAVGGRPERPDIPGTEKTWVSDDMFLREDFPPAMVVVGAGFIACEFACILRGLGVAVTQVVRGTRLLRGFDAELADTLLDGMREQGIDVLLGQTVVAVEGEPGSLTARLGNGQSLDCGGVLMATGRRPWLSDLGLDAAGVALDNGRITVDANSCTSVAHIHAVGDVTDRVNLTPVAIDEGRAFADSVFGSRQRQVNHDLVACAVFSDPELATVGLSEEQAIERHGVDGVVVHRARFRSMARALPASGPRCLLKLVVEKHTDRVLGCHMVGEHAAEIIQMAAIAVGMGATKADFDRTMALHPSVSEEFVTM

SEQ ID NO: 7198 - protein, 374 aa, Oryza sativa (japonica cultivar-group)
MTKHGAVVVPEDAVVAAAAVGRHFSFPPPRTGGVGGDSCKKLAAQQIDLGAAVIGSWLDSMKASSPRHRLVAPAVAAAAADAEHDEWMEKHPSALGKFEALAAAAKGKRIVVFLDYDGTLSPIVEDPDRAVMTDEMRDAVRGVAARFPTAIVSGRCRDKVLSFVGLEELYYAGSHGMDIQGPTNAAASKGGEEEEESVLCQPAREFLPMIGEAYAALVEKVEGVIPGAKVENNKFCLSVHFRRVDERRWGAVADQVRAVLRGYPRLRLTQGRKVLEVRPAIKWDKGEALRFLLSALGFSAAGDVEDDGDDDDAFPIYIGDDRTDEDAFRVLRARGHGAGILVSRFPKDTCASFSLRDPGEVKDFLRKLVTCAAA

SEQ ID NO: 7199 - protein, 193 aa, Tuber borchii
MVVATIKCVVVGDGAVGKTCLLISYTTNKFPSEYVPTVFDNYAVTVMIGDEPYTLGLFDTAGQEDYDRLRPLSYPQTDVFLICFSVTSPASFENVKEKWLPEVRHHCPGVPCLIVGTQVDLRDDPPVIEKLAKQRQSPITFKQGEQLAKDLSAVKYVECSALTQKGLKNVFDEAIVAALEPPTLQKKKKCSIL

SEQ ID NO: 7200 - protein, 933 aa, Tropheryma whipplei str. Twist
MPPARSGFEPTSDREAFDAETQEWLDSLDALIHASGNERAGEILSKLLEVAKEKGVPRNCDLWGPTKPGTGILPSKHDTSNASNKDESACIWLPRGLVTDYVNTITGKSNFPGDERLETEFLGFVRWNAAVMVHRAQESGVGGHISTYASSALLYEIGFNHFFKGPSHPSGADQVFFQGHASPGIYARSFLEGRLSESDLDGFRQEKSRSGVPSYPHPRCMQSYWQFPTVSMGLGAINAIYQAQTNKYLTQHGIKDCSQQKVWAFLGDGEMDEPESRGQLQVASNDGLDNLIFVINCNLQRLDGPVRGNGKIIQELEAFFKGAGWKTIKVVWGAEWDDLFEQDTGELIELLNEVRDGDFQTYKANGGSYMRTHLFGKNPKCLSLVGNYTDNQLDQLSLGGHDFRKIYAAYFDAVHNTDGRPTVILAHTIKGYGLGQHFEGRNATHQIKTLTLDEIKLFRNALGIPISDKQIEKDPALPPYYNPGPTHQAVEYALKKRNALGGRLPFRSGWFRRIDLPSERVYDVAKSGSESVASTAVASRIIRELLKSGEFGKRIAVIIPDEARTFGMDAYFPSAKIYNPMGQHYTPVDHKLFLKYEESTTGQVIHVGINEAGAMGAFSALGTSYATHGEMLVPFYIFYSMFGFQRTGDAIWAAADQMARGFLLGAVAGRTTLAGEGLQHGDGHSHLLASTNPAVIAYDPAFGYEIGNIIQHGLEIMYGGQRRNNSHNNQIDPDVIFYLTLYNEPIHNPPQPDDLDLEGLIRGIYKYKPGIVPVASVLASGIALPWALEAQEILKDKCNIDIDVWSVTSWSQLARDGYKCEKHNVFNPEEEQKIPYVTQRLRTATPLYIGVSDYMRAVPEQIRPFVPGDYITLGTDGFGFSDTRSAARRFFQVDTSSIVIAVLSRLAKNGLVDKDMLKRELIQYRSNRHGIHL

SEQ ID NO: 7201 - protein, 73 aa, Musa x paradisiaca
YESPRPTLGIHRFVFVLFLQLGRQTVYTPGWRQNFNTRDFAELYNLGSPVAAVYFNCQRESGCEGRIRLNLQD

SEQ ID NO: 7202 - protein, 399 aa, Pseudomonas aeruginosa PAO1
MSGNRGVVYLGPGKVEVQNIPYPKMQDPQGRQIDHGVILRVVSTNICGSDQHMVRGRTTAPEGLVLGHEITGEVVEIGRGVETMKIGDLVSVPFNVACGHCRTCKEQHTGVCLTVNPARAGGAYGYVDMGGWVGGQAEYVLVPYADFNLLKLPNREAAMEKIRDLTCLSDILPTGYHGAVTAGVGPGSTVYIAGAGPVGLAAAASARLLGAAVVIVGDVNPTRLAHAKKQGFEIADLSKDTPLHEQIAALLGEPEVDCAVDAVGFEARGHGHSGSQQEAPATVLNSLMGITRVAGKIGIPGLYVTEDPGAVDAAAKHGALSIRFGLGWAKSHSFHTGQTPVMKYNRQLMQAIMWDRIKIADIVGVEVITLDDAPKGYGEFDAGVPKKFVIDPHNLFRAA

SEQ ID NO: 7203 - protein, 318 aa, Pseudomonas aeruginosa PAO1
MILLPSIRLPETAMNTDSPINRVEQVQVDDLACWRIHTAHGEALIAQQGAQLLSYQPHEQPPLVWLSDEAGYRRGQSVRGGVPVCWPWFGPLERNPQEVRGQVEDGLKAPAHGLVRAVDWKIDDIAEEDGDLCVSFRLDAPDGLPGWPHPAALRMLFRFGERLTLRLTSENLGSKPLVLSQALHTYFAVSDSREIAIEGLEGARYIETLENWEERTQHGAVRVKGELDRIYLGLERDLLIKDPRWERSIHLHALDSRSAVVWNPWVDKSRRLSQFADDAWQQMLCIETGRVWDDLMVVAPGRSESFGVQIWSEPLKRP

SEQ ID NO: 7204 - protein, 72 aa, Musa x paradisiaca
SARTGRELVCYESPRPTIGIHRMVFVLLRQMGRGTVFAPQMRHNFSTRRFVLQYYLAPVAATYFNCQRESGC

SEQ ID NO: 7205 - protein, 411 aa, Triticum aestivum
MNALAATSRNFRQAARLLGLDSKLEKSLLIPFREIKVECTIPKDDGTLASFVGFRVQHDNARGPMKGGIRYHPEVDPDEVNALAQLMTWKTAVAAVPYGGAKGGIGCSPGDLSRSELERLTRVFTQKIHDLIGTHTDIPAPDMGTNSQTMAWIFDEYSKFHGHSPAVVTGKPIDLGGSLGRDAATGRGVMYATEALLAEYGKSISGSTFVIQGFGNVGSWAAQLIHEKGGKVIALGDVSGTIRNKAGIDVPALMKHRNEGGQLKDFHGAEVMDASELLVHECDVLLPCALGGVLNRENAPEIKAKFIIEAANHPTDPEADEILTKKGVVVLPDIYANAGGVIVSYFEWVQNIQGFMWEEEKVNMELHKYMNSAFQNIKAMCKSQDCNLRMGAFTLGVNRVARATILRGWEA

SEQ ID NO: 7206 - protein, 482 aa, Tropheryma whipplei str. Twist
MGRGQRCCVFENAKEAAEYIKSNQIEVLDVRFCDFLGAQHHFAVPAHAVDDEFFQSPQVFDASSLRGYADINHSDMLLVADPSTSYIDPFRHHKTLAMIFDVHDPRTGDVYERDSRNVAKKAEKYLAGCRFADTAYFAAEAEFFIFDDVRFKISNHSSSYSVDSEEGIWNSSRRKGGGNLGNQLKHKGGYAPLPPADQHADLRDDIMNALTKVGLRVEKGHHEAGSAGQGEINYRFNTLVNAADDLLKFKYVVKNTAHEWGKSATFMPKPIAGDNGSGMHTHQSLWKNGKPLFYSETGYANLSDIALWYIGGLLKHGPALAAFTNPSTNSYKRLVAGFEAPTSLVYSAGNRSAAIRIPPTIGAEGSKRIEYRVPDSSSNPYLAFSALLMAGIDGIKNKIHPGSPVEQNMYELTKEQSRDLRYLPSSLSDALRALEQDCDFLLEGNVFTREFISAWIDYKRKNELNRIAQYPHPLEFGMYYGV

SEQ ID NO: 7207 - protein, 734 aa, Nitrosomonas europaea ATCC 19718
MKSLSSSSPGSSEDSAQSLLLTARLYDPCSFLGMHAAPNGRLIRVFQPYMSRVWLHTLSGYQPMRSVHQDGIFEWEGEGVMHPYLLRMENTATGVIEERHDPYAFPMQISGHDLYLFNEGRLLQAYHMLGAHRVRNHGVTGTRFAVWAPNAERVSVVGDFNRWDGRVYPMMVHGHSGVWELFIPDLPEGAIYKYEIRNRISGEILLKTDPYATTYELRPNNAALTPIEQKYDWKDDDWIARRKGWDWLHAPLNIYELHVGSWKRHPDGRFYSYHELADHLIPYLQDMGYSHVELLPISEHPLDESWGYQATGYFAVTSRYGSPEAFMSFVDRCHQAGIGVILDWVPAHFPQDSFSLARFDGTALYEHEDPRLGYHHDWGTYIFNYGRNEVKSFLLSSAHYWLSAFHIDGLRVDAVASMLYLNYSRKEGEWLPNRYGGHENLEAIEFLRALNTMVHGEFPGALTFAEESTSWPAVSRPAYLGGLGFSMKWNMGWMNDTLSYMQHDPVHRRYHHNELTFNQLYAYTENFVLPLSHDEVVHGKKSMLDKMPGDGWQKFANLRLLFTYQMTCPGKKINFMGNELGQGHEWRVGHELDWYLLERDPHRGIQALTRDLNHLYLNTPALHELDFFAEGFSWIDCHDVEQSVISYQRHARDGSFVLVVLNFTPILRTGYRVGIPGSSAYQEVFNSDSIYYDGSNAGNAGKISPTGQPWSGQPDSIIITLPPLAGVILKAADG

SEQ ID NO: 7208 - protein, 331 aa, Oryza sativa (japonica cultivar-group)
MAASSTATRLSPPRLHAPTTPSPHLPLRRSRFSPLRAAKLEAVLTIGTHLIPHPRKAETGGEDAFFVNGDDGGVFAVADGVSGWAEKDVNPALFSRELMAHTSTFLKDEEVNHDPQLLLMKAHAATTSVGSATVIIAMLEKTGILKIASVGDCGLKVIRKGQVMFSTCPQEHYFDCPYQLSSEAIGQTYLDALVCTVNLMEGDMIVSGSDGFFDNIFDQEIVSVISESPGVDEAAKALAELARKHSVDVTFDSPYSMEARSRGFDVPSWKKFIGGKLIGGKMDDITVIVAQVKAVMIPDDEGVDEEKGQGDEQGSAVAVASSEQKEDSITT

SEQ ID NO: 7209 - protein, 283 aa, Clostridium perfringens ATCC 13124
MELWYTEEHTDKVRFSIKVDEQLYSGKSDFQRIDVFKSQEFGTFFTLDGLMMVTEKDEFIYHDMIVHVPMATNPNIKNVLVIGAGDGGTVRELTRYETIEKIDMVEIDKLVVDVCREYLPQTANKLDDPRVSLFFEDGLKFVRSVENKYDLIIVDSTDPFGPGEGLFTREFYGNCFKALKEDGILVNQHESPYYEEYARGMKRAHKRIKECFPVCRVYQAHIPTYPSGHWLFGFASKKYDPLNADIEKWNDLGLKTKYYNTELHKGCFALPNYVKEMLENVDE

SEQ ID NO: 7210 - protein, 887 aa, Neisseria meningitidis Z2491
MSTQLHDVDPIETQEWLDALSSVLEYEGGERAQYLLENLVKYCRDKGVRMPHGTTTPYLNTVSVENEKGIPGDQNIEHRIRAFVRWNAAAIVLRAGKKDLELGGHIASFQSAATMYEVGFNHFWKAKGEGEEGDLVFFQGHVAPGIYARAFVEGRLTEDQLNNFRLEVDGHGLPSYPHPHLLPDFWQFPTVSMGLGPIMAIYQARFLKYLESRGLAKTKGRKVWCFCGDGEMDEPESQGAIALAAREGLDNLIFVINCNLQRLDGPVRGNGKIIQELEGNFAGAGWNVVKVIWGRRWDRLLAKDKDGILRQRMEECLDGDYQTYKSKDGAYVREHFFNTPELKTLVADMTDEQLWALNRGGHDPQKVYNAYDRAANHADGKPTVILAKTIKGYGMGASGEGQNVAHQAKKMDKASLKQFRDRFDIPVTDEQIESGDLPYLTFAPDTEEYKYLHARRDALGGYLPQRKPTQEVLEVPELSAFDAQLKSSGEREFSTTMAFVRILSTLLKDKKIGKRVVPIVPDESRTFGMEGMFRQYGIWNPKGQQYTPQDKDQLMFYKESVDGQILQEGINEPGAMADWIAAATSYANSNFAMIPFYIYYSMFGFQRVGDLAWAAGDMHARGFLLGGTAGRTTLNGEGLQHEDGHSHIQADLIPNCVSYDPTFQYEVAVIVQDGLRRMYANNEDVFYYITLMNENYTHPDMPEGAEQDILKGMYLLKAGGKGDKKVQLMGSGTILQEVIAGAELLKADFGVEADIWSCPSFNLLHRDAVEVERFNRLHPLEAEKVPFVTSQLQGHDGPVIAATDYIRSYADRIRAYIPNDYHVLGTDGFGRSDSRANLRRFFEVDRYNVAVAALAALAEQGKVSKETVQQAIEKYGIKADSAPSWKR

SEQ ID NO: 7211 - protein, 535 aa, Neisseria meningitidis Z2491
MSIVEIKVPDIGGHENVDIIAVEVKAGDTIAVDDTLITLETDKATMDVPADAAGVVKEVKVKVGDKISEGGVILTVETGAAAAEAAPAAAEAQPAPAAAPAAAGGATVQVAVPDIGGHTDVDVIAVEIKVGDTVAEDDTLITLETDKATMDVPCTAAGVVKAVFLKVGDKVSEGSAIIEVETVGSAAAAPAQAAQAAAPAAAPPPTAAAAPAAAPAPSAPAAAKIDEAAFAKAHAGPSARKLARELGVDLGQVKGTGLKGRIVGDDIKAFVKSVMQGGAAKPAAVGASLGGGLDLLPWPKVDFSKFGNVEVKELSRIKKISGQNLSRNWVVIPHVTVHEEADMTELEEFRKQLNKEWEREGVKLSPLAFIIKASVSALKAFPEFNASLDGDNLVLKNYFNIGFAADTPNGLVVPVIKDVDQKGLKQISQELTELSKKAREGKLKPQEMQGACFTISSLGGIGGTGFTPIVNAPEVAILGVCKSQIKPVWNGKEFAPRLMCPLSLSFDHRVIDGAAGMRFTVFLANLLKDFRRITL

SEQ ID NO: 7212 - protein, 594 aa, Neisseria meningitidis Z2491
MSLVELKVPDIGGHENVDIIAVEVNVGDTIAVDDTLITLETDKATMDVPAEVAGVVKEVKVKVGDKISEGGLIVVIEAEGAAAAPKAEAPVAPAQEAPKAAAPAPQAAQFGGSADVEYDVVVLGGGPGGYSAAFAAADEGLKVAIVERYKTLGGVCLNVGCIPSKALLHNAAVIDEVRHLAANGIKYPEPELDIDMLRGYKDGVVSRLTTGLAGMAKGRKVDIIQGDGQFLDPHHLEVSLTTSEVYEQATPTGEKKIVAFKNCIIAAGSRVTKLPFIPEDPRIFDSSGALALKEVPGKLLIIGGGIIGLEMGTVYSTLGSRLDVVEMMDGLMQGADRDLVKVWQKQNEYRFDNIMINTKTVAVEPKEDGVYVTFEGANAPKEPQRYDAVLVAAGRAPNGKLISAEKAGVAVTDRGFIEVDKQMRTNVPHIYAIGDIVGQPMLAHKAVHEGHVAAENCAGHKAYFDARVIPGVAYTSPEVAWVGETELSAKASGRKITKANFPWAASGRAIANGCDNGFTKLIFDAETGRIIGGGIVGPNGGDMIGEVCLAIEMGCDAADIGKTIHPHPTLGESIGMAAEVALGTCTDLPPQKKK

SEQ ID NO: 7213 - protein, 612 aa, Oryza sativa
  misc_feature (341)..(341): Xaa can be any naturally occurring amino acid
MSMLPRFLLLVVLLAVPMTAAQQQYEANAQGDCYTDNGSSVLGYTCGTAAFPPPPACTGYLTFRSAPPSYASPITVSYLLNASVPAVAAANSVPALMAQNPAHDSLDLYPGIRLTVPLRCACPSPAQAAAGVRYLVTYLLGWDDDSSTVADRFGADYQAVLFANNLTDDSTVYPFTTMLVPLKHRPKPDVTVLPEPGPPSPAPAPAVSAPPPPAVPSSESGSGRWKKSFRGRCIGIGVGVGFAVLASGALLALFLLRRRWRWRGNGELHDVPLAPDKEGAKATPPPWMLPTTVADVDVRDAVGSMAVYEYGELERVTAGFAEERRIGDSSVYRAVINGDVXAAVKRVAGDVGAEVSVLGRVSHSCLVRLFGLCVHRGDTYLVFELAENGALSDWIRGDNGGRALSWRQRMQAALDVADGLNYLHNYTRPPYVHKNLKSSNVLLDADFRAKVSNFGLARTVAGAGGQMTSRVVGTQGYMAPEYLEHGLIGPHLDVFAFGVVLLELLSGKEAAPARDGGEGGDGEALALLLWEEAEGQLVVDGDDDDARGKVAAFMDSRLRGDYPSEVALAMAALALRCVAREPRARPSMVEVFLSLSALHGTTLDWAPHATLS

SEQ ID NO: 7214 - protein, 747 aa, Arabidopsis thaliana
MHSSSKSQAFSLTFLLFLFLLPSVSESQLISSESRTLLEIQKHLQYPPTLRSWSNWTNFCYLPSSPSFKILCFNGHVTELTVTGNRTVKLPGRFSSDSLFTVLTKLSNLKTLSLVSLGISGPLPSQIIRLSSSLQSLNLSSNFISGNIPKEISSLKNLRSLVLANNLFNGSVPDLRGLSNLQELNLGGNKLGPEVVPSLASNLITISLKNNSFGSKIPEQIKKLNKLQSLDLSSNKFTGSIPRFLLSLPSLQNLSLAQNLLSGSLPNSSLCNSKLRILDVSRNLLTGKLPSCFSSKKQTVLLFTFNCLSINGSPSAKYQRPVTFCENEAKQAVAAVKSDTKDKERKEEDTGIELGLVIGIIIGVILVSAVLAGLVLVRMRKSRSKEEPLEANNVDQVTVCSNTTRSTTSKTVPDLRRVPQTMRSAVIGLSPYRVFSLEELEEATNNFDAENLCGEQLYKGCLREGIAVTVRCIKLKQKNSTQNLAQQMEVLSKLRHMHLVSVLGHCIGTYQDHHPYAGSTIFIVQEYISNGSLRDYLTDWRKKEVLKWPQRMSIAIGVARGIQFLHTGVAPGIFGNNLEIENVLLDETLTVKLSGYSIPLPSKLLIFSLTSHEIYNLLGEFQVGAESPSNEDGEKEDVYQFGVILIQIITGKVIAAASSELGSLKLQLENSLRDEPSVLRSLADPCVRGTYAYESLRTTVEFAINCLCEDQRKRPSIEDVVWNLQYTIQVQQGWTSSENLGLGGSVP

SEQ ID NO: 7215 - protein, 128 aa, Photobacterium profundum SS9
MTQVLHTDQAPAAIGPYVQGVDLGNMVLTSGQIPVNPVTGEVPEAIAEQARQSLENVKAVVASSGLNVSDIVKMTVFVKDLNDFATVNEVYGQFFDEHNAPYPARSCVEVARLPKDVKIEIEAIAVRK

SEQ ID NO: 7216 - protein, 324 aa, Wolbachia pipientis
AAGEPDFDTPDHIKKAAIQAISEGKTKYTAVDGTRELKEAIINKLRKDNNLEYTLNQICVGTGAKQVLFNLFMATINSGDEVIIPAPYWVSYVDMVSLFGGLPVVVECKQNFKLTAELLKSRITKKTKWLILNSPNNPAGAVYTCDELKDIAQILLEYPHMNVVTDDIYEHIIYDEKFFTIAQVEPKLYDRVFVVNGVSKAYAMTGWRIGYIAGRSDVVKAISTLQSQSTSNPNSIAQAAAAAALNGDHSFLKERTRIFKSRRDFMVKELNSVPGLSASVPQGAFYLFVSCEGLLSKSTKSGKIINNDLDFTEYLLGDHLVAVV

SEQ ID NO: 7217 - protein, 425 aa, Aspergillus oryzae
MPYATEETSSVAWFPEGNLCHSKTCGPRTNGIVLEAMKGKLSQPSEWDRSEPFCVMDLGYVYNEYQRWTSLLPDVKPFYAVKCNPDTHIIKVLNAMNSGFDCASRNEMELVMSQGVAPERIIFANPCKKISDLEYAQQSGVRKMTFDNEAELQKIRQRFPDAQLILRCLASDPSATYSLGSKFGASSATSVKLLQCAKSWGLSVVGVSFHIGSNAKDPTAFDKAIQNSREVFDAGLRTGHDMHLLDIGGGFSAHNFDAMASSIRQCIGKYFCGIDVEIVAEPGRYFAAGALTLACGIIGRRDAAANDEDKENRHMLYLNDGVYGTFICNIFEPGPQPKVLRASGDFYPLDSEDEYERYTIWGPTCDGTDCVAESVALPKSLAIDDWLYFPEMGAYSTCLSTGFNGFHSDRETIYMSSDPAADIYL

SEQ ID NO: 7218 - protein, 380 aa, Oryza sativa (japonica cultivar-group)
MATAGKVIKCKAAVAWEAGKPLSIEEVEVAPPQAMEVRLKILYTALCHTDVYFWEAKGQTPVFPRIFGHEAGGIVESVGEGVTELSPGDHVLPVFTGECGDCRHCLSEESNLCDLLRINTDRGAMIGDGQTRFTARGGQPVYHFLGTSTFSEYTVVHVGCVAKIHPAAPLDKVCVLSCGISTGFGATVNVAKPPKGCTVAIFGLGAVGLAAMEGARISGASRIIGVDLNPAKFELAKKFGCTDFVNPKDYDKPVQQVIIEMTNGGVDRSVECTGNAAAMISAFECVHDGWGVAVLVGVAGKDAAFKTHPTNFLNERTLRGTFFGNYKPRTDLPGVVEMYMNKELELEKFITHSVPFSEINTAFDLMLSGESLRCIIRMED

SEQ ID NO: 7219 - protein, 454 aa, Triticum aestivum
  misc_feature (202)..(202): Xaa can be any naturally occurring amino acid
  misc_feature (225)..(225): Xaa can be any naturally occurring amino acid
  misc_feature (256)..(256): Xaa can be any naturally occurring amino acid
  misc_feature (298)..(298): Xaa can be any naturally occurring amino acid
  misc_feature (313)..(313): Xaa can be any naturally occurring amino acid
  misc_feature (326)..(326): Xaa can be any naturally occurring amino acid
  misc_feature (333)..(333): Xaa can be any naturally occurring amino acid
SYTSSLSIAWFLSPSTSLSNLQSKLAQRTHAGADTGTSTMAAPPAERSFDVIVVGAGIIGSCAAHAAASRGASVLLLERFDLLHQRGSSHGESRTTRPTYTRPQYPPMVRLAHRLWHDAERDAGYTVLTPTPHLDLGPRDAPAFVAAIANGGATELAPAGDASRPAWAGAFRVPEGWAAATSGPAGVIKATKAMAMFQTLAXKMGAVVRDRTEVVDVARPRRRKXIVVKTATGEEFHGGKCIITVGAWATNLVKSXPGADLPVQPVHTLGLLLEGSGPGTRRSLTTEAGFPTFATYGXSPRFYGPPSMEYPGXLIKGLPGTAGPPXNPDGRDXWATGTGAGGIAEVVARWIDEFMPGVVDTAGGPVLRQPCMCCMTPDEDFVIDFLGGEEFGKDVVVGAGFSGHGFKMGPAVGTILAELALDGESGTAAEAGLELEHYLIGRFEGNPMGNATSH

SEQ ID NO: 7220 - protein, 157 aa, Glycine max
  misc_feature (143)..(143): Xaa can be any naturally occurring amino acid
YYLQPPKFEFYDPKTPFFTSPRFLPPTKVEKCKIVDAIISHGCFLRECSVQHSIVGVRSRLESGVELQDTMMMGADYYQTEYEIASLVAEGKVPIGVGANTKIRNCIIDKNAKIGRNVIIANPDGVQEADRAKEGFYIRSGIXVTLKNATIKDGTVI

SEQ ID NO: 7221 - protein, 177 aa, Prochlorococcus marinus str. MIT 9211
MSCRHYLAASAIFAGLLCSNVSSLAETTSPRQYKVLANQSAGLNLGTVQAFLDKGDEFFLKGDLLKARKEFDKARDVSKQLLSFYRDLGSAFKGLDARIPREMDKNGRKVLGMLAQSNLRLATLFRKKNQPEVAVPLLIEVVRIMTPSRSEGQEAYQALVELGFVEIPYAGARKNIY

SEQ ID NO: 7222 - protein, 509 aa, Vicia faba
MDGSAGPGGGNVNAFLRNYKMGKTLGIGSFGKVKIAEHVLTGHKVAIKILNRRKIKNMEMEEKVRREIKILRLFMHHHIIRLYEVVETPTDIYVVMEYVKSGELFDYIVEKGRLQEDEARSFFQQIISGVEYCHRNMVVHRDLKPENLLLDSKWSVKIADFGLSNIMRDGHFLKTSCGSPNYAAPEVISGKLYAGPEVDVWSCGVILYALLCGTLPFDDENIPNLFKKIKGGIYTLPSHLSPGARDLIPRLLVVDPMKRITIPEIRQHQWFQLRLPRYLAVPPPDTLQQAKKIDEEILQEVVNRGFDRDQLVESLSNRVQNEGTVTYYLLLDNRYRVSTGYLGAEFQETMDPGLNRINSGEVVSPAGGHHFLAYQGVGMRQQFPAERKWALGLQSRAQPREIMVEVLKALQGLNVCWKKIGHYNMKCRWVVGIPGHQGGMVNNSVLNNNFLGNVGIIENEAVPKSSVVKFELQLYKTQEKYLLDLQRVEGPQFLFLDLCAAFLAQLRVL

SEQ ID NO: 7223 - protein, 433 aa, Nitrosomonas europaea ATCC 19718
MKVQPAVQTNDNPRFVSTLTRNTLALILAGGRGTRLKNLTDWRAKPAVPFGGKFRIIDFTLSNCVNSGVRRIGVVTQYKAQSLIRHIQRGWSFLDGRFQEFIELLPAQQRTEEGTWYQGTADAVFQNLDILRTHNPGYVLILGGDHIYKMDYGRILAEHVERQADLTIACLEVPVEDASAFGVMAVDDSWRTTSFAEKPEHPAPIPGKPGHALISMGIYVFNAKFLYEQLIQDHDMDQSSHDFGKDVIPRLVASNARVYAHRFQNSCVNMASGVPYWRDVGTVDAYWKANIDLTTITPDLNLYDEDWPIWTHQEQLPPAKFVFDDDDRRGQALDSMVSGGCIISGATVRRSLLFSNVQIRGYSTIEDSVILPNVSIDRHAYLKRVVVEKECQIPEGLKVGFNPDEDRKHFYVTDDGITLITPEMLGQGIHYIR

SEQ ID NO: 7224 - protein, 287 aa, Tropheryma whipplei str. Twist
MGLDNLKVGLAQMLKGGVIMDVVTPDQAKIAEDAGAVAVMALEKIPSDIRASGGVSRMSDPGLIERVMDSVSIPVMAKVRIGHFAEAQILQSLKVDYIDESEVLSVADSSYHIDKRKFTVPFVCGATNLGEALRRISEGASMIRSKGEAGTGDIAQATKHIRAILSEISALTQAREDELPARARKLGAPIDLVRETARLGRLPVVLFTAGGIATPADSSLVMQLGSDGVFVGSGIFKSEDPKAYAAAIVQATAQYDDADLLARVSRNLGQAMPGVSNLDVRFSNRGV

SEQ ID NO: 7225 - protein, 395 aa, Tropheryma whipplei TW08/27
MRTLGGFTFPCDAPVFVRVDFNVPMDEVGTITDDLRIRASLPTIESLLGRGAPLILISHLGRPVKNEQQGFSLKPCAERLSEYIGVNVPLVDFLDLDTKLYGELTRHLDKSGIVLFENIRFFAEETSKAQADRRILAEQLAPFAGAYVNDAFGASHRRHASVYELAQAFSNKAAGFLIESEMQAFSHLASEAKRPYTVILGGAKLSDKLRLIENILPTVDRLLLCGGMAFTFLAAQGCETGKSLLEESFISEANKIIDFAKQNNVELILPVDVIEARSLTSPLGVVSKAESISYMGLDIGPETQSIFRNVIQDSKTVFWNGPAGLFENPSFSNGTRALLDALSSSSAFTFIGGGDTAAAVSLLGFDYGDFSHVSTGGGACLELLEGKILPALEVL

SEQ ID NO: 7226 - protein, 400 aa, Bradyrhizobium japonicum USDA 110
MQPTTEPHNAILVEKTPLETYVPPAKPSLIGLSRNELADRLGEIGVAPAQRKMRVQQLWHWMYFRGAQNFDEMTSISKGIRAELAQHFTVDRPEVVAEQISNDGTRKWLLRLPSGDNVEKAHEVECVYIPETDRGTLCVSSQVGCTLNCSFCHTGTQRLVRNLTAGEIVGQVMVARDRLNDWADREDGTRRVTNIVMMGMGEPLYNFDAVRDALLIVGDNEGIGISRRRITLSTSGVVPNIVRAGEEIGVMLAISLHAVRDELRNELVPLNRKYPIKELLQACRDYPGASNARRITFEYVMLKGVNDSLDDAKLLVKLLKGIHAKINLIPFNPWPGTAYECSDWDQIEKFSEYIFNAGYSSPVRTPRGRDILAACGQLKSETEKLSARERQTLRAMAMTD

SEQ ID NO: 7227 - protein, 337 aa, Tropheryma whipplei TW08/27
MTVKIAINGFGRIGRGFFRALSSPSCIDGPEIDVVAINDLTSPEVLAHLLRRDTIFGRFPESVCHDGTKLLVGKREVAVFSEKDPSSIPWNGVDIVIESTGLFTDANIASGHITAGSKRVIISAPAKNEDATFVVGVNHTDYDPNKHSIVSNASCTTNCLAPLAKVFDDTFGIERGLMTTVHAYTADQRLQDAPHSDLRRARAAAMNLVPTSTGAACAIGLVLPNLKGKLDGFAIRVPVITGSITDLSLVSKTDVSAPEVNEAYRRAALGPLKGILCYSEDPLVSSDIVADGHSCIYDANLLRISGNMVKLSAWYDNEWAYSRRLVDLAKYMASVGL

SEQ ID NO: 7228 - protein, 119 aa, Triticum aestivum
MASLSVATLPQLAGAPAAAAAKKRSGVTYVEGMNAYSGLKGLNKVTMLGVRKSADYKFARIVASLSPAGKRRGGSFGAQCNAAGEIFQIAVVMNALTLVGVAVGFVLLRAEAAFEESEE

SEQ ID NO: 7229 - protein, 107 aa, Schizosaccharomyces pombe 972h-
MEDEMQIDKKEVEIEQKPPRFEIKKWNAVALWQWDIVVDNCAICRNHIMDLCIECQANTDSAAAQECTVAWGTCNHAFHFHCISRWLNTRNVCPLDNREWEFQRYGH

SEQ ID NO: 7230 - protein, 352 aa, Schizosaccharomyces pombe 972h-
MKDGYKIIGFISSGTYGKVYKAVSSNSNDKRLFAIKKFKAESKQVSSNAQQTGVSQSAIREMMLCREIQHENIVSLVQVLLKDGTISMVFEYAEHDLLQIIHFHSRSRTRQIPPSILKSILWQIINGVAYLHENWIMHRDLKPANIMITATGKVKIGDLGLGRLIRDPILPFYSSDRVVVTIWYRAPELLLGAHDYTPAIDVWAIGCIYGEMLALSPLFKGDEIKMEDKKVVPFQSTQMLRIMELLGTPTEERWPGLKNYPEYYQLSSFEVRYWNNLLPQWYQTVKNRDPQGLDLLMKMLQYDPKSRITAKQALEHVFFTSDKLWTTRYVFFLFLFIIERNKLLLTHFLAHF

SEQ ID NO: 7231 - protein, 418 aa, Neisseria meningitidis Z2491
MNAAQLDHTAKVLAEMLTFKQPSDAVLSAYFREHKKLGRQDRHEIAETAFAALRHYQKISTALRRPHAQPRKAALAALVLGRSTNISQIKDLLDEEETAFLGNLKARKTEFSDGLNTAAELPQWLVEQLQQHWNEEEILAFGRSINQAAPLDIRVNTLKGKRDKVLPLLQAESADAEATPYSPWGIRLKNKIALNKHELFLDGTLEVQDEGSQLLALLVGAKRGEIIVDFCAGAGGKTLAIGAQMANKGRIYAFDIAEKRLANLKPRMTRAGLTNVHPERISSEHDSRIARLAGKADRVLVDAPCSGLGTLRRNPDLKYRQSAETVAKLLEQQHSILDAASKLVKPQGRLVYATCSILPEENELQVERFLSEHPEFEPVNCAELLQSLKVDLHTGKYLRLNSGEHQTDGFFAAVLQRK

SEQ ID NO: 7232 - protein, 569 aa, Nicotiana tabacum
MKRRKQRSHEKLFLVLQIILHTLIFKRRRRIHHLLPLLAALTGGILFFFVLFSPPITSQHHHLINPIWFNNGTELQMNLQKEHVFRVPMGGGSLSGDIWTSKQSILYHGCSNSSYKFPSADVNTHPNRYLMIATSGGLNQQRTGIVDAVVAAHILNAVLVVPKLDQKSYWKDSSNFSEIFDVDRFISHLSKDVKIIRDIPRIGDKVITPYTTRVPRKCNAKCYQTRILPILKKKHAVQLTKFDYRLSNRLDIDMQKLRCRVNFHALKFTDPIIEMGRKLVERIRMKSKHFVALHLRFEPDMLAFSGCYYGGGDKETKELGKIRKRWKTLHATNPDKERRHGKCPLTPEEIGLMLRALGFGNDVHIYVASGEIYGGEETLAPLKALFPNFYSKETIASKEELAPFSSFSSRMAALDFMVCDESDVFVSNNNGNMARMLAGRRRYFGHKPTIRPNAKKLYKLFLSRNNMTWEEFASQVRTSQIGFMGEPMEVKPGRGEFHENPSACICADSDANDREDASLFGTHSIISEIDTGSSTNSARRDMVEVTDGQASEEEQEWSDTEYMETELEI

SEQ ID NO: 7233 - protein, 487 aa, Oryza sativa (japonica cultivar-group)
MVPSFPQPASAAAATRPIPGSYGPPLLGPLRDRLDYFWFQGPDDFFRRRAADHKSTVFRANIPPTFPFFLGVDPRVVAVVDAAAFTALFDPALVDKRDVLIGPYVPSLAFTRGTRVGVYLDTQDPDHARTKAFSIDLLRRAARNWAAELRAAVDDMLAAVEEDLNRAPDPAAASASYLIPLQKCIFRFLCKALVGADPAADGLVDRFGVYILDVWLALQLVPTQKVGVIPQPLEELLLHSFPLPSFVVKPGYDLLYRFVEKHGAAAVSIAEKEHGISKEEAINNILFVLGFNAFGGFSVFLPFLVMEVGKPGREDLRRRLREEVRRVLGGGDGGEAGFAAVREMALVRSTVYEVLRMQPPVPLQFGRARRDFVLRSHGGAAYEVGKGELLCGYQPLAMRDPAVFDRPEEFAPERFLGDDGEALLQYVYWSNGPETGEPSPGNKQCAAKEVVVATACMLVAELFRRYDDFECDGTSFTKLDKRELTPS

SEQ ID NO: 7234 - protein, 311 aa, Oryza sativa
MDPKLVEVTQLFSRFKAAFARNDFDTCVDLLSQLKVRLTKFPSLPPSFQQTPNAVEELKIARDIYEHAVVLSVKIEDQDAFERDFCQLKPYYMDTCGIIPPSPQEYPILGLNLLRLLVQNRIAEFHTELELLPVTALENPCIKHAVELEQSFMEGAYNRVLSARQAVPHETYVYFMDLLAKTVRDELAGCSEKGYDYMSIAEARQVLMFSSDKELHQYIAEEHPEWEVKDGSVFFQKAKETQPCKEIPSLQCTLMEAHSDTSEQCWDRKCDLMPQPVVLLPAQPTPIDLQTPLTMANLGGWDDHTCNNQMD

SEQ ID NO: 7235 - protein, 456 aa, Leuconostoc mesenteroides subsp. mesenteroides ATCC 8293
MSKTKIIIVGASHGGHQAILELTRKYKNLDIKLFEAGDFISFMSCGMELYLENSVTDVNDVRNFRPEDMEQLGAEIYSNHEVLAIDADDRTVSVKDVTTGSTEKYSYDKLILSSGVTPNSLPVPGTDLENVYLMRGKDWATSIKAKLENPDVKNITIVGAGYIGVEAAEASVKAGKNVTLIDMIDRPLGNYLDAELTAVLEKELADKGVKVVTDVRIESYEGTSQVTAVKTDEGKYPSDLVIQAAGVKPNTNWLKGVIDLDDRGWIKTDEYLRTNLPDVYAVGDAVLSYSIPAQTKLPIALATVVRREVRYIIAHLFENQPSVPFKGVVGSSALSVFDYHFATAGLNTTTAQKSGVTLKCSFYQDTLRPDYVPRENGNTEVYVELGYDPQTHRILGGAVLSTYDITAQGNVIALAIEHGLRLEDLAEADFFFQPGFDRQWSLLNLAAQHALGEPKF

SEQ ID NO: 7236 - protein, 175 aa, Triticum aestivum
MAPTVMSSSDISVSPFQGLKSTAGLPVSRRSNGASLGSVSNGGRIRCMQVWPIEGIKKFETLSYLPPLSTEALLKQVDYLIRSKWVPCLEFSKVGFIFREHNASPGYYDGRYWTMWKLPMFGCTDATQVINQVDEVKKEYPDAYVRIIGFDNMRQVQCVSFIAFKPPGCDESGKA

SEQ ID NO: 7237 - protein, 164 aa, Synechococcus sp. CC9605
MSGPNRSKRSFLGFVDAGEREVARLLTLITAAVISAAIIQLIISLGSKLLTGTAATWLGDDLIKILGDLLTVLIALEVLQNITSYLRRHVVQIELVLVTALTAVARKVIVLPSGAENKPQLLVGLGIAVVSLSAAYWLVKRANATPSRERLGRGGSATKLDFED

SEQ ID NO: 7238 - protein, 476 aa, Aspergillus oryzae
MASVRVASRRLPLARKLVPAIESPLQRRFASAATGPNVKTQAKTSLPNPDPAADSATMAFVEERAPFMVPTYVRPAPMMVKGQGCYLWDMENRRYLDLTAGIAVNSLGHCDPEVAQIIAEQAETLIHASNLYHNAWTGALSKLLISKTRESGAMRDASQVFISNSGTEANEAAIKFARKVGKSLDPSGAKHEFVSFHNSFHGRTMGALSATPNPKYQTPFSPMIPGFKYGNYNDVEQLQTLITDKTCGVIVEPIQGEGGVNVATPEFLAALRKRCDEVGAVLIFDEIQCGLSRTGTFWAHAHPSLAPASGEAAHPDILTSAKALGNGVPIGATIVSGKTVAEHIKAGDHGTTFGGNPLVCRVAHHIVERLATPELQNSVEIKSAELISGLKALQKKYPNVISEIRGRGLILGAQLSQDFTSKASDLITAARERGLLIITAGDGCLRFVPPLTITEDQIKTALKILEQALDAVITKA

SEQ ID NO: 7239 - protein, 566 aa, Borrelia garinii PBi
MPKVEIYKNLFLDKIGKNFTNLEISELLEPFKAEFDGFDENSGKIKIEFNDTNRPDLWSYTGLARQIKTYLFGEIPYYDFFSKKGDFKKCYGEILVDNKMSQIRPFIFGFLAKGLIINDRMLEALIQFQEKLCQSYGQKRRRVAMGMYNSNFIKFPISYVASSPNHKFVPLGMDCELSLLEINEKHPKGLEYSYIVKNFDKYPLLLDNNNNVVSYPPIINSNNIGSLKVGDTELFVEVTGIDFEATLLALSIVACDFYDMGFEILPVKTVFKDPFGLDFEELVCPYYFQEEVEFDVKNVNRLLGNNLTLERICLNLKKMGVSSYSRDFKNYIVPPFYRNDFLHEVDVIEDVMIGEGLASFYPELPKAFTIGRLSALEEFSRNVRNLMMGMGFQEMIYNYMGSRKDFIDRMNINDQNFLKVSNPMTENYEYIRASIIPNLLKSESVSSNFPYPHKIFEVGKVALKNLDAAEGTSTFTNLAFLMSGKEISFNEINSIVATLFYYLNIEIILRESKATFYINGRGADILIEGFNVGSFGEISPYVLNNFGIFIPCSVFEVNINKLVSQS

SEQ ID NO: 7240 - protein, 269 aa, Brassica napus
RPTRPHFPSTILFLVIFLLLAAFKRPKRLQHRPIPSPPTWPIIGNLHQLGELQHQSLWNLSKKYGPGMLLKLGKVPTVILSSSETARQALRDNDLNCCSRPPLAGARELSYNNKDMSFSPYNDYWKELRKLCARELFSAKQIHSFQPIKDEEIKRVIAQISESASLKNPVNLTKTFLALTVSVVCKAAFGVSFEGTVLSNDRFNKLVRDAFETLGSFSATDFIPHVGWIIDQFTGLQKMREKSVRDLDAFYEQLFDLHKEGDRKGVKIL

SEQ ID NO: 7241 - protein, 175 aa, Yarrowia lipolytica CLIB122
MPALNSTFLGEDQDTRVVGNFAILPIKTSFRGPSYPSNADYDIIDEVLDLFRANSFFKNFEIKGPADRALIYGILFVSECLGKLKPTTSANEANKLLNTAAVEHFSIPGDAGFPLNSLYAPPRDRNEVELLRGYLMQFRQELAKRLIEKIYKDDPSKPNKYWLAFTRRHFMNKSL

SEQ ID NO: 7242 - protein, 239 aa, Synechococcus sp. CC9605
MEHAAGRFRRCPNIRGLMQPLSPAFIDQLRFNEAGLIPAVAQDWLDGAVLMVAWMNRDAIEATLRSGEVHYWSRSRQELWHKGATSGHIQTMREIRYDCDADVLLVTVEQAGDVACHTGSRSCFYENSDARTGGGAEALAPPTDACTELFRVIEGRREQPEEGSYTNKLLAGGDNSILKKIGEESAEFVMACKDDNAAEIAGEAADIVFHMQVALAHHGVSWRQVQEVLAARRGAPRRH

SEQ ID NO: 7243 - protein, 206 aa, Oryza sativa (japonica cultivar-group)
MSRLGRYGPPAVRDSYSLLVLNVSFRTTADDLLALFDRCGEVLDIRIPRDRRTGDSRGFAFVRYKYEDEAQKAVDKLDGRTVDGRDIMVQFAKYGPNAERIHKGRIVEEISKPRGRSRSPSPKRRYRADYRDRGYRDDYRDRHYRDDYQDREYRRSRSIERYERERYQEKGYRRRSRSISPDYDRRHRKNGRPRDERSPRSRSPLT

SEQ ID NO: 7244 - protein, 759 aa, Zea mays
MPDLPCDGDGVCMVCRVTSPPEVDLLHCSTCATPWHSPCLSKAPALADAASWSCPDCSLDSATVAAPSAPANTLVAAIRAIESDNTLSDQEKARRRQALLAGDAPDVADDDDAADDTLEIVGKNFSCVFCMKLPERPVTTPCGHNFCLKCFQKWIQSKKRTCGKCRAPIPAKMAEQPRINSALVEVIRMAKISKNHNSAGSAVPYHYMRNDDRPDKAFTTDRAKKAGKANASSGQIFVTIAPDHFGPILAENDPRRNMGVRVGETWEDRLECRQWGAHFPHVAGIAGQSTHGAQSVALSGGYEDDEDHGEWFLYTGSGGRDLSGNKRTNKEHSSDQKFEKLNAALRISCLKGYPVRVVRSHKEKRSSYAPESGVRYDGVYRIEKCWRKIGIQGKFKVCRYLFVRCDNEPAPWTSDDHGDRPRPLPKIKELQGATDITERKGRPSWDYDEKDGWKWMVPPPVSKRPVLSGDPETDKLIRKATKRAHLSVAERLLKEFGCSICRAVIKEPLTTPCAHNFCKTCLLGAYDSQSSMRERSRGGRTLRAQKIVKTCPSCPTDICDFLENPQINREMMELIESLQRKAVEEGKMAAGDAEESGDGDSEENGGALVKGEDDSNLNEEGQDGVDADGSVKIVVEMEGAKDDKKSKMGAAEVVDVLVEDAAAKQPKKRTADEDAAAKQTKHKADAETGGKRVKSSAAVEEVDVCVTPMKRTRKSGDMHDDGNGSPAVSSGRRVTRSSVNATGADDSPARRTRSRGRAC

SEQ ID NO: 7245 - protein, 498 aa, Nitrosomonas europaea ATCC 19718
MSNDVTFAQLGLSSEILHAVNDEGYVNPTPIQAQVIPSILAGKDVMASAQTGTGKTAGFTLPLLYRLQAYANTSVSPARHPVRALIMAPTRELAMQIDESVRKYGKYLALRTAVVFGGINIEPQIAALQAGVEILVATPGRLLDLVEQKAVNFSKTEILVLDEADRMLDMGFLPDIKRVMALLSPQRQSLMFSATFSGEIRKLADSLLKQPVRIEAAVQNTVNESISHVIHWVKPDSKFALLLHLIRQQNLKQALIFVKTKHGASHLAQMLSRHEISAVAIHGDRNQQQRTQALAEFKHGDVQILVATDVAARGIDIEKLSHVINYELPGNPEDYVHRIGRTGRAGSKGKAISLVSEHEKELLANIEKLLNAKLETEQIAGFDAEQFARSLPDRKNRMSAGNSRYGNKPMENGSEKSRSEKHRKLPSSQKYSGSRRGGTQKYSDPIFTQPYVPQANSTQSTTPKQPEIQSLFLTYRQEKKTIPALFTALSKSKAGQEN

SEQ ID NO: 7246 - protein, 543 aa, Podospora anserina
MTLLSLKEDRPTPKAVYNWRVYTCAAVASFAACTIGYDSAFIGGTLALPSFEEEFDFASYSESGRALLKANIVSVYQAGAFFGSLFAYVTSHFGGRRISLFIFSVVFCIGAGIMLAANGDRGMAPIIAGRVLAGIGVGGCSNMVPIYISELSPPAVRGRLVGIYELGWQMGGLVGFWINYGVNTTLAPSHKQWIIPFAVQLIPAGLLLIGAFWLRESPRWLFANGKKEEGLKVLCWMRNLEPTDTYILEEVSYIEADLERFEREVGKGFWKPFLSLKQRKVQWRFFIGGILFLFQNGSGINAINYYSPTVFRSIGIDGVNTGLLTTGIFGVVKTVLTIIWLLWLVDLAGRRRMLFIGATGGSLCMWYIGAYIKLAKPEQSASGELTSAGISAVFFFYLWTAFYTPSWNGTPWVINSEMFDQNTRSLGQASAAANNWFWNFLISRFTPQMFLKMEYGVYFFFASLMILSIIFIFFFVPETKSIPLEAMDRLFEIKPVHRANKLLMAELQQTSDMGHGAEESVGKDSSSTDEKMRQAGFVQAENV

SEQ ID NO: 7247 - protein, 695 aa, Pichia stipitis
MSSVDQKAISTIRLLAVDAVAAANSGHPGAPLGLAPAAHAVFKKMRFNPKDTKWINRDRFVLSNGHACALLYSMLVLYGYDLTVEDLKKFRQLGSKTPGHPENTDVPGAEVTTGPLGQGICNGVGIALAQAQFAATYNKPDFPISDSYTYVFLGDGCLMEGVSSEASSLAGHLQLGNLIAFWDDNKISIDGSTEVAFTEDVIARYKSYGWHIVEVSDADTDITAIAAAIDEAKKVTNKPTLVRLTTTIGFGSLAQGTHGVHGAPLKADDIKQLKTKWGFNPEESFAVPAEVTASYNEHVAENQKIQQQWNELFAAYKQKYPELGAELQRRLDGKLPENWDKALPVYTPADAAVATRKLSEIVLSKIIPEVPEIIGGSADLTPSNLTKAKGTVDFQPAATGLGDYSGRYIRYGVREHAMGAIMNGIAAFGANYKNYGGTFLNFVSYAAGAVRLSALSEFPITWVATHDSIGLGEDGPTHQPIETLAHFRATPNISVWRPADGNETSAAYKSAIESTHTPHILALTRQNLPQLEGSSIEKASKGGYTLVQQDKADIIIVATGSEVSLLSMTLKVLEGQGIKAGVVSLPDQLTFDKQSEEYKLSVLPDGVPILSVEVMSTFGWSKYSHQQFGLNRFGAPVKLQKSSSSSNSPQKVLLKELPRLLPSTRARMLCLHCVLPSERLVMSLFYLVTFSYVKF

SEQ ID NO: 7248 - protein, 478 aa, Debaryomyces hansenii CBS767
IMSVKVDGMINKKSKTHSKKLDARALAEKIKKNALKQQAQEEPAKEENVAENFDTVVDPTAELKFKSFNELKLIPELLEAIQQMKFTKPTPIQSEAIPHALEGKDIIGLAQTGSGKTAAFAIPILQALWEAQAAYYGLVLAPTRELAYQIKETFDALGSSMGLRSVCIVGGMDMMDQARDLMRKPHILVATPGRIMDHLEHTKGFSLKNLKYLVMDEADRLLDMDFGPALDKILKIIPTQRTTYLFSATMTNKIAKLQRASLHNPVRVAVSNKYQTADNLVQSMMLVSDGYKNTYLIHLLNEFLGKSIIIFTRTCAHSQRTALLARILGFSAVPLHGQLTQAQRLGSLNKFKAGKANILIATDVAARGLDIPSVDIVINYDIPTDSKAYIHRVGRTARAGKSGKSISLITQYDLEMYLRIESVLGKKLPKDPSPSKAVLDTLHVHVDRASAEAIRQTKDFHEKRNPKKNRDDRDREER

SEQ ID NO: 7249 - protein, 601 aa, Tropheryma whipplei str. Twist
MTDRVLPEQIRNFGIIAHVDHGKSTLADRILQLTGAVSDRDMREQYLDRLYIERERGITIKSQAVTLQWDCDATQYVLNMVDTPGHVDFTYEVSRSLAACEAAVILVDATQGVEAQTLANLHLAIENNLLIIPVLSKVDLPSADVEGATLELSEVLECRVEDVMHVSGKTGYGVKELLDLIVRKAPPPKGDVTSAPRALIFDSIYDSYRGVVTYVKMCDGTIRVGDKIRMMSTGAEHTLLEVGVSNPEPQSRHSLSVGEVGYFITGVKDVRKSRVGDTITTDTHTATVPLPGYSNPKPMVFSGIYPLNGNEYSALREGLDRLKLSDASIVYTPETSAALGFGFRCGFLGLLHMEIVSERLNREFGLATISTAPSVAYEITPDGEKTLVVMNPSDFPSGKIKEIKEPTVKVSILSPKEYIGSIMELCQARRGVMQGIEYFGSVRAELIYVMPLAEIVFDFFDSLKSRTKGYASFDYNPEGSQPADLVKVDILLQGNKVDAFSAIVHSSKAYSYGSSISKRLSELIPRQQFEVPIQAAIGSRVVARETIRAVRKDVVAKCYGGDITRKRKLLEKQKQGKARMKLIGRVEVPQEVFVATLSSYK

SEQ ID NO: 7250 - protein, 348 aa, Tropheryma whipplei str. Twist
MEDLYGILGVDHNASVDEIRRAYRRLARELHPDINPDSADRFKAVTHAYNILSDPEQRQRYDRHVSGGFSSDFNLSDLFQSFFDTSAEFQRGSDLLVNIDIDLKTAIYGGSQVVKIDSLVVCDVCNGTRSEPGYKAEVCFDCNGSGVVRGEVRTTLGNLITQNTCSKCRGNGERIDHPCRRCYGNGSRSAPRDITINIPPGVETGMRIKIPNMGNAGGAMPGDLYVDCKVKEHPYFLRDGQDLYCRLDISLVDALLGTKVKIDSLDGELAVVIPALSQNRDVIRIANKGAVTLRGGKGDLCIVLNVLLMQKLDPEHRALLKKIMPNPPKPKLAKRTSGFFSWLKNKFT

SEQ ID NO: 7251 - protein, 233 aa, Oryza sativa (japonica cultivar-group)
MDAGDAWGRSSSSSSSAAAAARRLQARYDLYMGFDDADAAGVEEVEARGGGEAYNCPFCGEDFDFVAFCCHVDDEHAVEAKSGVCPICATRVGVDLIGHLTMQHGSYFKMQRRRRVRKISSGSHSLLSLLRKDLRDGSLQSFLGGSSYVSNPPAAAPDPFLSSLICSLPVAEPSKDLHSDSSDNNFLLNKFPDDKTAERAEPSLSEKDQKERAQRSKFVRGLVLSTIFEDDNL

SEQ ID NO: 7252 - protein, 107 aa, Tropheryma whipplei str. Twist
MTSIFTRIINREVPAEILFEDDEFICIEDIAPKAKIHYLVIAKHPWKDVTEAVRDDPLFVNKILAIAVRLTKDFGSQFRLIFNTGALVGQTVFHVHAHILSGEALGE

SEQ ID NO: 7253 - protein, 328 aa, Medicago truncatula
MDFESNYDIATTADFIRTHKFTRVALQFPDDLLKDSTRVVSVLRKRLRSLRESDTTGSGDEPDIGLFVMADTAYGSCCVDEVGASHINADCVIHYGHTCFSPTTTLPAFFVFGKASIGLADCVESMSQYALTSSKPIMVLYGLEYAHSIQQVRKALLESSTFCTSDPKSEVHFADVPSPYMFPSKDTKKLNDLQEETCGCGDNSSSDGASGAAYSIGGLTWKLLEGQSMEDYSLFWIGHDNSAFANVVLRFNACEIGMMQLKVKWWQTCLNRGGFLNVAENYADITWWRGLRMLILLEFWLELLELNNQLYGARVIVLIMVYGNSRTE

SEQ ID NO: 7254 - protein, 107 aa, Tropheryma whipplei TW08/27
MTSVFTRIINREVPAEILFEDDEFICIEDIAPKAKIHYLVIAKHPWKDVTEAVRDDPLFVNKILAIAVRLTKDFGSQFRLIFNTGALVGQTVFHVHAHILSGEALGE

SEQ ID NO: 7255 - protein, 190 aa, Medicago truncatula
MGLITAAGKKAYTLVMGKPNPAKLANFPECDVFLYVSCAQTALLDSKDYLAPVITPFEATIAFNRGSQWTGAYVMGFGDLINLPQVQVGNQEEARFSFLKGGYVEDFENQENNVEEEREDLALANATEKALQLRDNCNSIIKGGAKSGAEFFANRTYQGLNIPDDNTTPQSFVIGRKGRAAGYEDENNKH

SEQ ID NO: 7256 - protein, 302 aa, Xylella fastidiosa Temecula1
MSLSGIITALVTPFDRDGAFDRDAWIRLLDMQLAGGVQGVVIAGSTGEAATLTDAEYDEMLCSAVVRVGGRVPVLAGTGLSGTAKTISQTKRAADNGAGYALVVTPPYIRPNQGGLKAHYLAVAEQGGLPVVLYNVPSRTGCDLLPETVADLAGHPNIVGIKEACASRERVQALLALRRPGFAVFSGDDSSAARSMLDGADGLVSVASNVLPSAYRHLCDLARAGERGAIDLWNARLSDFHAFCGLDSNPIPIKALLQRIGIGYGLRLPLLPLSVCHHDIADHLADQVAALEALSSRKIVTA

SEQ ID NO: 7257 - protein, 621 aa, Oryza sativa (indica cultivar-group)
MWVTKRLGITVLIVLFPLLIVHHLIENSPVSGPSRYQVIHSNLLGWLSDSLGNSVAQNPDNTPVEVIPADASASNSSDSGNSSLEGFQWLNTWNHMKQLTNISDGLPHANEAIDNARTAWENLTISVHNSTSKQTEKERQCPYSIRRMNASKPDTGDFTIDIPCGLIVGSSVTIIGTPGSLSGNFRIDLVGTELPGGSGKPIVLHYDVRLTSDELTGGPVIVQNAFTASNGWGYEDRCPCSNCNNATQVDDLERCNSMVGREEKRAINSKQHLNAKKDEHPSTYFPFKQGHLAISTLRIGLEGIHMTVDGKHVTSFPYKAGLEAWFVTEVVVSGDFKLVSAIASGLPTSEDLDNSFDLAMLKSSPIPEGKDVDLLIGIFSTANNFKRRMAIRRTWMQYDAVRKGAVVVRFFVGLHTNLIVNKELWNEARTYGDIQVLPFVDYYSLITWKTLAICIYGTGAVSAKYLMKTDDDAFVRVDEIHSSVKQLNVSHGLLYGRINSDSGPHRNPESKWYISPEEWPEEKYPPWAHGPGYVVSQDIAKEINSWYEKSHLKMFKLEDVAMGIWIDEMKKGGLPVQYKTDERINSDGCNDGCIVAHYQEPRHMLCMWEKLLRTNQATCCN

SEQ ID NO: 7258 - protein, 291 aa, Zea mays
MPMYSKSELIHVPPPPCSRPRYVMAPPLVFTSIGASMNAAVRDVWASNFDEELSNLSAVLPRYPCVCVDTEFPGAVHDSNLPRYMRGPRESYELVKRNVDDLKLLQVGIALSGPAGRFPIAWQFNIRGFDPALHPHAPASIAMLREQGMDFAMLNEFGIDPEDFAAGFRRSGLACGWLTWTAFSGSYDFGYLAKALTGGQPLPDTLDGFLALVRRLFGHSVFDVKHLARCCAMRGGLEQVATALGVKRAAGRAHCAGSDSLLTTDVLLLMMDRFFRNVDVLAHAGTIVDLT

SEQ ID NO: 7259 - protein, 540 aa, Agrobacterium tumefaciens str. C58
MRCGTAPPLYRTAPSRPTFLPCGPLRIVFIREDEIMNIQVQQKAGEAPFKLKYGNYIGGKWVEPKSGRYMDNLSPVTGHKICEVPRSDASDIEFALDAAHKAREKWGKTSITERSNILLRIAQRIEDNLDLIARAETWDNGKPLRETTNADIPLTIDHFRYFAGCIRAQEGTIGEIDNDTVAYHFHEPLGVVGQIIPWNFPILMAAWKLAPALAAGNCVVLKPAEQTPASILIVMELIEDLLPPGVLNIVNGTGLEAGKPLAQSNRIAKIAFTGSTSVGKEIMRYAADNVTNISLELGGKSPNIFFADVMNEDDAFLDKALEGFAFFALNQGEVCTCPSRALVHESIYDRFMEKAIKRVQAISQDDPLNPSTMLGAQASQEQFDKIMSYLEIGKKEGAKVLTGGDRKTLTGDLKDGYYIQPTVFEGNNKMRIFQEEIFGPVVSVTTFKTVEEALEIANDTVYGLGAGVWSRDTNIAYRAGRGIEAGRVWTNCYHVYPAGAAFGGYKQSGIGRETHKMMLDHYQQTKNLLVSYSPNKVGFF

SEQ ID NO: 7260 - protein, 305 aa, Gibberella zeae PH-1
MDALNATSFASFNQTKDYFVVLEEVSKYNVQLNMVEKLWAAWYLWMQNDTLATGIMSFVLHELVYFGRCIPFMLMDFIPYFQQFRIQKQKIPTIKEQWDCAAIVLISHFTAELPQIWFFHPIATYFGMDYGVPFPPVWKMALQIAICFVMEDAWHYWFHRALHYGPLYKAIHKMHHTYSAPFGLAAEYASPIETALLGIGVVGCPIVLLAVTGELHLFTMYTWIVLRLFQAIDSHSGYDFPWSLRHILPVWAGAHHHDLHHEKFIGNYASSFTWWDYCLDTEAGADAHKRRREKKLAAIKAQKQQ

SEQ ID NO: 7261 - protein, 363 aa, Magnaporthe grisea 70-15
MTSHPEWDQQTTGTEVVKAFADAIKGKNGMAAKNATNNPEVTCAAKRGIGSATALAVASQAPNHLILASRTASKLEEVIADINQKYPGVKAVPVRLDLGSIDSIRDAASKIESLLVGEEINVLINNAGVTDKTRAPITTPDGTRLDKQFFVNHIGTFLLTNLLTPLLQKAAAGSPSGATRVVNVSSHGHRISPIRFSDYALDKYGSDEAIPEAERTHPETPAFLLKGMDDEGFPGFVAYGQSKTANILHATELSRRLKKSGVVAFSIHPGFIETDLDRSLDKEFSDALKAMAANGFKTLDGGAATTLVAAFDPALGQVDVGVEVTGYLSDCQLSEQLVRDHAKDPAIARRLWEETERMLQISK

SEQ ID NO: 7262 - protein, 443 aa, Leuconostoc mesenteroides subsp. mesenteroides ATCC 8293
MAENKITLSRSLSTKDLVVYGIIFMIPVAPIAFYGSFLSPAHGMVALAYLIGMIAMLFTGFSYASMASEFPYSGSVYTYVQKGTNPVLGFLSGWGITLDYILIPVITYLISASFGQSLLPAVPFWVWILGIAIFNTVINLLGIKVVSKFSWLLFGLQGVVLIAFIVGTIVALANGTVSFNVSSFYNASHFDLSGVVQATGIVIVSYLGFDAISTLSEEANDPTKSIGKAIVLSIILIGSLFVIVTFFAGFVAPNYSELNPDTAFLTILGKVGGSWLVHLAEFTLVLSFGLAGGQEGQTAVSRILYSMGRDGILPKRLSYLHPRYNTPWVAIILVGIVSVALSLSLSLTTVSNLISFGALFGFLSLNIAVIWHFYIKRPDKNIESFVKYLVSPFIGFSVSLWIFLSLALEAKLTGLFWLIIGLVILVYKTSIFKKPVPQFDFSE

SEQ ID NO: 7263 - protein, 129 aa, Zea mays
WIPIFFDCIRIVRWFCLNHISVGTYVGRPRGDDWFQKQTRNTLDVACPPWMDWFHGGLQFHVEHHLFPRLPRCHLRRVAPLVRDLCRKHGLPFERCGFWEANVRTLRSLRDAAMQARAVTAGSSDPGPR

SEQ ID NO: 7264 - protein, 364 aa, Borrelia garinii PBi
MKKDYYEILGLSKGASKDEIKKAYRKIAIKYHPDRNQGNEEAASIFKEATQAYEVLIDDNKKAKYDRFGHSAFEGGGFEGFSGGFSGFSDIFEDFGDIFDSFFTGNKGQERNRKHARGEDLGYNIEISLENAYFGYKNNINITRQILCHSCLGKKSEKGTSPSICNMCNGSGRVVQGGGFFRVTTTCSKCYGEGKTISNPCKSCKGKGRITNQETIQLNIPSGIDNNQQIKMKGKGNVNPDNQEYGDLYVKILIRSHKIFKRNGKDLYAMLPISFTQAALGKEVRIKTIASKEIKIQIPKGIENEEQIIVKGAGMPILQTEKFGNLILITKIKTPKNLNSNAIKLFENLSKELRDGDEIDLLKV

SEQ ID NO: 7265 - protein, 295 aa, Triticum aestivum
  misc_feature (2)..(3): Xaa can be any naturally occurring amino acid
  misc_feature (11)..(11): Xaa can be any naturally occurring amino acid
  misc_feature (227)..(227): Xaa can be any naturally occurring amino acid
  misc_feature (236)..(236): Xaa can be any naturally occurring amino acid
  misc_feature (271)..(272): Xaa can be any naturally occurring amino acid
  misc_feature (278)..(279): Xaa can be any naturally occurring amino acid
  misc_feature (292)..(292): Xaa can be any naturally occurring amino acid
RXXVVAIEDKXLYEGDWISLNGSTGEVILGKQPLSPPALSADLETFMSWVDEVRQLKVMANADTPGDALAARKNGAEGIGLCRTEHMFFASDERIKAVRQMIMAPTVELRQKALDRLLPYQRSDFEGIFRAMDGLPVTIRLLDPPLHEFLPEGHVEDIVRELCAESGAAEDDVLARMEKLSEVNPMLGFRGCRLGISYPELTEMQARAIFEAAISMTNQGIQVFPEXMVPLVGTPXELGHQVALIRQIANNVFTNMGKTIDYKAGTMIEIXXAALVAXXITNRLSSSLSDNXLRR

SEQ ID NO: 7266 - protein, 642 aa, Streptomyces coelicolor A3(2)
MRKRDRTPKTYTRLTHPLVRDSREAPLRRATWEEALDRTARGLTAARGAFGMFSCARATNEMNYVAQKFARVVMGTHNVDSCNRTCHAPSVAGLSAAFGSGGGTSSYEEIEHTDVIVMWGSNARFAHPIFFQHVLKGIRGGARMYVVDPRRTSTAEWAESWLGPNVGTDIPLAHAVGREIIHAGLANEAFIERATTGYDDYKALVEPWTLSLAEKVTGVPAAAIRELAHAYARAERAQLCWTLGITEHHNGTDNVRALINLSLLTGHVGRYGSGLQPLRGQNNVQGGGDMGAIPNRLPGFQDVLDPEVRRKFETAWDTVVEPHHGLTLTEMFEAMDEGTLRAVYCIGENPAQSEADAEQAVRRLRALDFLVVQDIFLTKTAELADVVLPATAGWAETEGTTTNSERRVQRVRRAVSPPGEAREDIDILCDLAARLGHDWKYADAEAVWNELRSLSPDHHGMTYARLEEHQGIQWPCPSTQELEPTYLHGRLWAQDPASRGRLAPFGIVRHDPPVDLTDEQYPIRLTTGRRLDSYNTGVQSGGYASPLRRGESVELCPEDAERYGVVVGEEVRVTSRRGSLLAPVWVDTALRPGLAFMSFHFPDEVDTNQLTIEANCPIAGTAEFKASAIRIEKVSASGPALR

SEQ ID NO: 7267 - protein, 608 aa, Bradyrhizobium japonicum USDA 110
MNLRNVAIIAHVDHGKTTLVDKLLQQSGTFRENQKVTDRAMDSNDLERERGITILAKAASVQWKDTRVNIVDTPGHADFGGEVERILNMVDGALVLVDAAEGPLPQTKFVVSKALKVGLKPIVVINKVDRPDARPTEVINEVFDLFAALDASEEQLDFPILYGSAKQGWMAETPEGPKDKGMEPLFDLILRHVAPPTVEEGPFRMIGTILEANPYLGRIITGRISSGTLKPNQQVKVLNAEGKLVETGRITKILAFRGLERTPLDEAEAGDIVAIAGLTKGTVADTFCDPSVEVPLPAQPIDPPTVSMSFIVNNSPLAGTEGDKVTSRMIRDRLLREAEGNVALRVVEASDKDAMEVSGRGELQLAILIETMRREGFELSVSRPRVVFQKDEATGATMEPIEEVVIDVDEEHSGVVVQKMSERKAELIEMKPSGGNRLRLVFYAPTRGLIGYQGELLTDTRGTAIMNRLFHGYAPYKGEIQGRRNGVLISNDQGEAVAYAMFKLEDRGPMMIEPGWKVYKGMIVGEHTRDNDLEINVLKGKQLTNIRTTSKDEAVRLTPPIRMTLEKALAYIEDDELVEVTPKSIRLRKKHLDPNERKRAEKSKEAVA

SEQ ID NO: 7268 - protein, 128 aa, Synechococcus sp. CC9605
MGAMARVSGLMLTMLLIVGATCLLSAPAMAIDALKSSALERGEQIFNSNCAACHMGGGNVIRANRTLKISDLNAHVEAYSSSPLEALEHEIEDGLNAMPSYADTLSDEEIMAVATYVEQRAELGWSRR

SEQ ID NO: 7269 - protein, 135 aa, Bradyrhizobium japonicum USDA 110
MPKWPDDDVILFDGVCIFCSRWVRFVAKRDTAKRFRFTPIQSDYGARLARTFGIDAGDPDTNAVVHGGEVFMKSDAALTVLSLLPGWSWVSVLFAVPRPLRDPIYSLIARNRYRIFGKYNTCFVPDADLRARVIE

SEQ ID NO: 7270 - protein, 199 aa, Paracoccidioides brasiliensis
MASGPATQSLKCVVTGDGAVGKTCLLISYTTNAFPGEYIPTVFDNYSASVMVDGKPISLGLWDTAGQEDYDRLRPLSYPQTDVFLICFSIVSPPSFDNVKAKWYPEIEHHAPNVPIILVGTKLDLRDDKTTADNLRAKKMEPVSYEQALAVAKEIKAQKYLECSALTQRNLKSVFDEAIRAVLNPRPIAKPKKSKCRIL

SEQ ID NO: 7271 - protein, 348 aa, Tropheryma whipplei TW08/27
MEDLYGILGVDHDASVDEIRRAYRRLARELHPDINPDSADRFKAVTHAYNILSDPEQRQRYDRHVSGGFSSDFNLSDLFQSFFDTSAEFQRGSDLLVNIDIDLKTAIYGGSQVVKIDSLVVCDVCNGTRSEPGYKAEVCFDCNGSGVVRGEVRTTLGNLITQNTCSKCRGNGERIDHPCRRCYGNGSRSAPRDITINIPPGVETGMRIKIPNMGNAGGAMPGDLYVDCKVKEHPYFLRDGQDLYCRLDISLVDALLGTKVKIDSLDGELAVVIPALSQNRDVIRIANKGAVTLRGGKGDLCIVLNVLLMQKLDPEHRALLKKIMPNPPKPKLAKRTSGFFSWLKNKFT

SEQ ID NO: 7272 - protein, 601 aa, Tropheryma whipplei TW08/27
MTDRVLPEQIRNFGIIAHVDHGKSTLADRILQLTGAVSDRDMREQYLDRLYIERERGITIKSQAVTLQWDCDATQYVLNMVDTPGHVDFTYEVSRSLAACEAAVILVDATQGVEAQTLANLHLAIENNLLIIPVLSKVDLPSADVEGATLELSEVLECRVEDVMHVSGKTGYGVKELLDLIVRKAPPPKGDVTSAPRALIFDSIYDSYRGVVTYVKMCDGTIRVGDKIRMMSTGAEHTLLEVGVSNPEPQSRHSLSVGEVGYFITGVKDVRKSRVGDTITTDTHTATVPLPGYSNPKPMVFSGIYPLNGNEYSALREGLDRLKLSDASIVYTPETSAALGFGFRCGFLGLLHMEIVSERLNREFGLATISTAPSVAYEITPDGEKTLVVMNPSDFPSGKIKEIKEPTVKVSILSPKEYIGSIMELCQARRGVMQGIEYFGSVRAELIYVMPLAEIVFDFFDSLKSRTKGYASFDYNPEGSQPADLVKVDILLQGNKVDAFSAIVHSSKAYSYGSSISKRLSELIPRQQFEVPIQAAIGSRVVARETIRAVRKDVVAKCYGGDITRKRKLLERQKQGKARMKLIGRVEVPQEVFVATLSSYK

SEQ ID NO: 7273 - protein, 397 aa, Neisseria meningitidis Z2491
MQNYLTPNFAFAPMIPERASGSRVWDTEGREYIDFSGGIAVNALGHCHPALVDALNAQMHKLWHISNIYTTRPAQELAQKLVANSFADKVFFCNSGSEANEAALKLARKYARDRFGGGKSEIVACINSFHGRTLFTVSVGGQPKYSKDYAPLPQGITHVPFNDIAALEAAVGEQTCAVIIEPIQGESGILPATAEYLQTARRLCDRHNALLILDEVQTGMGHTGRLFAYEHYGVVPDILSSAKALGCGFPIGAMLATETIAAAFQPGTHGSTFGGNPMACAVGSRAFDIINAPETLHNVRSQGQKLQTALLDLGRKTGLFSQVRGMGLLLGCVLDAPYRGRASEITAAALKHGVMILVAGADVLRFAPSLLLNDEDTAEGLRRLEHVLTEFAAANRP

SEQ ID NO: 7274 - protein, 668 aa, Prochlorococcus marinus str. MIT 9515
MPLGSSITSKGVNFSLIATNAEYIEILVFEKEDSVAPKAIFKLDQNHKTGPYWHAEINDLKEGSIYAFRIKQKVNEPNKDYSKTVLIDPCSRGITGWSKYSRKNALNNFDNMDSCLKSVVCDRKVFNFKNFPRPKHSWEETIIYELHIKAFTQSSNEDESCFKKFLKKIPYLKELGITSIELLPVFCFDPNDAPNGLENFWGYSPINWFTPHFQYLSNKSAEQNREEFRKFVEECHKENIEVILDVVYNHTSEGDSGGPAISWKGIDENLYYFIDKDKNYQDVTGCGNTIAANRGLVRKLIIESLKCWANEFGVDGFRFDLGIALSRGEDLVPLDNPPIFEDIECEPELADIKLISEPWDCGGLYKLNNFPSKKTFTWNGHFRDDLRRFWRGDKDSAWNMSDKIKGSPSHYKENISFPKSINFITSHDGFTLKDLVSFNKKHNFANKEQNRDGDNHNNSWNHGVEGPTSNLFIKKLRKRQQKNFLLSLLISKGVPMILMGDEIGRSQGGNNNSWCQNNSLGWMNWDESQQDLELLTYLKYLIKIRKKFIKFFNPISPQNRKDIDNLVNYYWHGAKLESPDWSSWSHTIAFSMNKGKNNPLIWAGLNAYTKSIDFHLPESKSKWLKVVDTNESGTIMPIPLEHKSITVENRSSVLIISEEVFGTKNIIF

SEQ ID NO: 7275 - protein, 373 aa, Leuconostoc mesenteroides subsp. mesenteroides ATCC 8293
MLYDLIVIGTGSVGSSTGYYAAKRGLSVLEIDSATPPHTNGSHHGETRMIRHAYGEGSSYVPLVLRAQELWNELKRDTQVDIFHQTGVLNIAPKQSIFLNNIITSAEKYELPIEVYDASEARKKWPQFTIPDQFRAVLEKNSGYLKSELAIDTYVKEAKRLGAHEQFNTQVISVDNDDNGFVHVTTNAGTFIGKSAVITVGTWVKDLIPNLPIQPVRKVVSWFEAPKQLAEEIGFPAFTIQLGDGTHYYGFPANKGLIKIGRHQGGQYITKREERLDFDALNEDRTEIEPLLNSVLKTVGNLDHGVACSYDLSPDEHFIVDDLPGKKNIQFVSGLSGHGFKFASVLGEILVAKALNETLDFDLSPFLLSRFNS

SEQ ID NO: 7276 - protein, 198 aa, Agrobacterium tumefaciens str. C58
MIGWPELPDPFPILTGNTMTVIASELSAAIRSIPDYPKPGIIFRDITTLLGNPRAFRRAVDELVQPYAGTKIDKIAGMEARGFILGGAVAHQLSAGFVPIRKKGKLPHTTVRVAYSLEYGVDEMEMHVDAVQPGEKVILVDDLIATGGTAEGAVKLLRQMGAEIVSACFVIDLPDLGGRKKLEDLGVDVRTLVEFSGH

SEQ ID NO: 7277 - protein, 582 aa, Magnaporthe grisea 70-15
MSGYGYGGGGGGFRDSYGSEKGQSERSRWTPLTRMLLSGEMTQERQKELTPREKFDRWMVNEGYRRFFVFVFMILHAMVFAFGFVNYAVKDNLQRARDTFGPTFMIARAAALVLHFDVALILFPVCRTFISLARQTPLNGIIQFDKNITFHITTAWSIVFFSWVHTVAHWNNFAQIAAQQKLGIYGWLLANFVSGPGWTGYVMLIALMGMVFTSVEKPRRANYERFWYTHHFFIVFFFFWSIHGAFCMIQPDFAPFCMSFGTSAIGVFWQFWMYGGFVYMAERIAREIRGKHKTYISKVIQHPSNVCEIQIKKEHTKTRAGQYIFFCCPEVSVWQYHPFTLTSAPEEDYISIHMRVVGDFTRGVSKALGCDWDRKGDASKVVGVNGENPDVDPALKRVLPRVYVDGPFGSASEDVFKYEIAVLCGAGIGVTPFASILKSIWYRMNYPQKKTRLAKVYFFWICRDFGSFEWFRSLLLAIEAQDVDNRIEIHTYLTAKIKADDATNIMINDANADKDAITGLRAPTNFGRPNWDMIFRGIRKLHTPAEAGVFFCGPKGLGSTLHIFCNKYSEPDFAFVWGKENF

SEQ ID NO: 7278 - protein, 346 aa, Prochlorococcus marinus str. MIT 9211
MNLLAGDIGGTKTLLGVYKNDGAVCKLFHKHYYSNHWESFEQILKDFIANIPERIEKPKYGCIAVAGQEIDGSIRMTNLPWKLNNENLCKIALLKQLSLINDFSVLVYGIPFLKETQYIKLQLPRTKQNCFSKKNFAVIGAGTGLGIARGITTSTGVISLPSEGGHKEFAPRTQNEWELTNWLKEDLKINRVSIERIVSGTGLGNIARWRLMKQDSKSHPLRIKAENYPIEGDNDLPEEVAKYAKNSDPIMNEVLNIWLSAYGSVIGDLALQELCYGGLWIGGGTASKHLDGFSSDTFKSAIRNKGRFSRFIDELPIMALTDKEVGLFCAACKAHLIAESNVKLGT

SEQ ID NO: 7279 - protein, 237 aa, Triticum aestivum
  misc_feature (195)..(195): Xaa can be any naturally occurring amino acid
  misc_feature (210)..(210): Xaa can be any naturally occurring amino acid
  misc_feature (216)..(216): Xaa can be any naturally occurring amino acid
  misc_feature (220)..(220): Xaa can be any naturally occurring amino acid
  misc_feature (224)..(224): Xaa can be any naturally occurring amino acid
  misc_feature (228)..(229): Xaa can be any naturally occurring amino acid
  misc_feature (235)..(235): Xaa can be any naturally occurring amino acid
RDALLISNHRSDIDWLVGWILAQRSGCLGSAIAIMKKSSKFLPVIGWSMWFAEYLFLERSWAKDEKTLKSGLQRLKDFPRSFWLALFVEGTRFTPAKLLAAQEYAISQGLTAPRNVLIPRTKGFVSAVSIMRDFVPAIYDTTVIIPEDSPKPTMLRILQGQSSVVHVRIKRHSMSDMPNSDEDVSKWCKDIFVAXDALLGQTYSNWSFDXENIPIXRPMXTFDXGPGXXMSPPIXGS

SEQ ID NO: 7280 - protein, 301 aa, Yarrowia lipolytica CLIB122
MNNPNWKKFSNQLNQLQRQAQKGAGGAGGPKFVGVGGLVVLAIAAATINSSLFNVDGGSRAIMYNRIGGISPRIYPEGTHIAIPWFQSPIIYDVRAKPRNVASLTGTKDLQMVNITCRVLSRPSISALPTIYQTLGKDYDERVLPSLVNEVLKSVVAQFNASQLITQRERVSRLVKEQLIKRASKFNILLDDVSLTYMTFSPEFTAAVEAKQIAQQEAQRAAFIVDRARQEKQGAIVKAQGEARSAELIGDAIKKSKDYVELKRLDTAREIAHVLAKSGNKIMLDNDSLLLNVANDFRSKK

SEQ ID NO: 7281 - protein, 583 aa, Alnus glutinosa
MEESKKSCFISDRVDYKGDPADRNTTGGWVPAALIVGIEVSERLSTMGIIVNLVTYLKGTMHQSSTTSSNSTSNVAGTSFLLCLLGGILADSFLGRYWTIAIFSVIHALGTCMLAISAALPELRPSECNLHHDFPLKCEEPSSFQMGILYTALYSMALGVGGIKSSVSGFGTEQFDQNDEKEMSEMAHFFNRFYLIISFGTLLAVTVLVYVQDQVGRSWGYGICSASMFLSIVAFLVGTKRYRYRECTGSPIIQILQVIVAAIRKRKAELPTDLSFLYDKASDKESTISHTDKYSCLDKGAIITGMDRGADGLTISNPWGLCTVTEVEEVKMLIRILPIMASTIIFWTIRAQLLSFSVQQAATMERTIENFPIPPASFNGFFVGSTIITLIMYDRLLPFLRQSSNGVQGFTNLQKIGIAIFLSILGMAAASFAEMKRLEVVRANRGSTSTSSTLPITAFYLLPQFVLVGIGDGFMYTGQLDFFITESPKGMKAISTGLFLTTNALGFFGSSILVTIITKVTGEEVGHGWLLSRINDSRLDFFYALLAVLGFINLVFYLVLASWYKPSPVEDAHQKINGKEEKV

SEQ ID NO: 7282 - protein, 727 aa, Arabidopsis thaliana
MGNLDDNKFTWVIKNVPTLNSDMLFSNYFVIGGCSWRVVAHSKENNFKESLSLTLIVAEDSAQKMGCGWSRYAKIIFTLVNQISEILSQRIETMFDQKSSVFSSETMFSIGKFDEHFAGFIVNGEIKIVVEFLEIIDKLVLSKESNPPFKKTKLNNDGEVSKDLIREVPVIMESIVVNGFHVLPSQVEFVKRIFEKHPDVAKEFRPTNRIVKTAYMNVLLSLIETLRQSPREISKNDLDGACGLLRSMKEAGFKLDWLEKKLNEVLEKKEKEESYETRMREIEEEMKDLKAKALDVGAPLRGLEPLSNLGRKLERYLFSTSGIRAIQSEEGCEPRVDPKKAEKDKRAKSLISMSLSDLILMKVMKETTALGIWKALERDYQTKTLPNMIYLKHKFTSFKMVENKSIEENLDTFLKLVADLASLDINISDEDQALQLMAGLPPQYDSLVDTLKYGSGKDTLTLNAVISSAYSKEIELKEKGLLNVSKPDSEVLLGDLKGKSNNKGNKRPWTGSSNGNGKFQSRPRRSLEKGMPSKKPAYLANIATKPPQPLVLTVSTQSTCKEWVLNSDCTFHSTSDRCVLFDFKKFNGGRVLMANNTHGEIKGSGKIKIQNRDGSVVILKDQSRKRKSKKVTSNENLFQGSTSDSFERQSSLSQDTDSSPSKESKSSAAIKCEDSSSVACALITYEERMKSKKGKHQKNAIDDDMDSRMKKQKLAGSKLIETRCNLY

SEQ ID NO: 7283 - protein, 337 aa, Tropheryma whipplei str. Twist
MTVKIAINGFGRIGRGFFRALSSPSCIDGPEIDVVAINDLTSPEVLAHLLRRDTIFGRFPESVCHDGTKLLVGKREVAVFSEKDPSSIPWNGVDIVIESTGLFTDANLASGHITAGSKRVIISAPAKNEDATFVVGVNHTDYDPNKHSIVSNASCTTNCLAPLAKVFDDTFGIERGLMTTVHAYTADQRLQDAPHSDLRRARAAAMNLVPTSTGAASAIGLVLPNLKGKLDGFAIRVPVITGSITDLSLVSKTDVSAPEVNEAYRRAALGPLKGILCYSEDPLVSSDIVADGHSCIYDANLLRISGNMVKLSAWYDNEWAYSRRLVDLAKYMASVGL

SEQ ID NO: 7284 - protein, 287 aa, Tropheryma whipplei TW08/27
MGLDNLKVGLAQMLKGGVIMDVVTPDQAKIAEDAGAVAVMALEKIPSDIRASGGVSRMSDPGLIERVMDSVSIPVMAKVRIGHFAEAQILQSLKVDYIDESEVLSVADSSYHIDKRKFTVPFVCGATNLGEALRRISEGASMIRSKGEAGTGDIAQATKHIRAILSEISALTQAREDELPARARELGAPIDLVRETARLGRLPVVLFTAGGIATPADSSLVMQLGSDGVFVGSGIFKSEDPKAYAAAIVQATAQYDDADLLARVSRNLGQAMPGVSNLDVRFSSRGV

SEQ ID NO: 7285 - protein, 395 aa, Tropheryma whipplei str. Twist
MRTLGGFTFPCDAPVFVRVDFNVPMDEVGTITDDLRIRASLPTIESLLGRGAPLILISHLGRPVKNEQQGFSLKPCAERLSEYIGVNVPLVDFLDLDTKLYGELTRHLDKSGIVLFENIRFFAEETSKAQADRRILAEQLAPFAGAYVNDAFGASHRRHASVYELAQAFSNKAAGFLIESEMQAFSHLASEAKRPYTVILGGAKLSDKLRLIENILPTVDRLLLCGGMAFTFLAAQGCETGKSLLEESFIPEANKIIDFAKQNNVELILPVDVIEARSLTSPLGVVSKAESISYMGLDIGPETQSIFRNVIQDSKTVFWNGPAGLFENPSFSNGTRALLDALSSSSAFTFIGGGDTAAAVSLLGFDYGDFSHVSTGGGACLELLEGKILPALEVL

SEQ ID NO: 7286 - protein, 217 aa, Oryza sativa (indica cultivar-group)
MKFRSDSSGGDEPRAPAAGDGGGGGDEPAKRQRTDPSSSSSQGEASSSSQPPPQQQQEEQPPEDAGEGEQPRVPDLGEDLVFEVLRRAEARTLAAAACVSRGWRQLAEDERLWEAACVREWANLGFSERQLRAVVLSLGGFRRLHAVYIRPLQRRGAGVPRQQGRRQPPVRLGRDQVQLSLSLFSIGFFQNMPCPKKDGPKKDKGNDSDKNGGGQCG

SEQ ID NO: 7287 - protein, 484 aa, Leuconostoc mesenteroides subsp. mesenteroides ATCC 8293
MLKRKPISNNFIYFFGALGGLLFGYDTGVISGAMLFIGKELEIQTGSFEDGFITASVLLGAILGAAIIGPMSDKLGRKKLLLSAAIIFFVGALGSGIGFNYTLLVTSRVLLGIAVGAASALIPTYLAELSPADKRGGIGTLFQLMIMTGIFLAYVSNEWLSPSGWLGLNQNVGWHWMLGLAAVPAALLFIGGLSLPESPRFLVKQGKMSEAQKVLSTMNPNAKLVEEELYDIKLQANTPSGGFKELFGPMARPVLIMALGLAIFQQVMGCNTVLYYAPKIFISAGFSEHFALQSHIVIGLFNVIVTAIAVKIMDKIDRKKMLTYGAIGMGASLLTMSTAMLVLRAGNGNVGSWICVIALTLYIAFFSATWGPVMWVMIGEAFPLNIRGLGNSFGAVINWTANFAVSQSFPMLLIAFTPDHAINAEGQGIAKLFIIYGVLCFVAIWFIAKFTIETRNRSLESIESDLRSKAHAKGYLESDYVGIK

SEQ ID NO: 7288 - protein, 474 aa, Tropheryma whipplei TW08/27
MFENAKEAAEYIKSNQIEVLDVRFCDFLGAQHHFAVPAHAVDDEFFQSPQVFDASSLRGYADINHSDMLLVADPSTSYIDPFRHHKTLAMIFDVHDPRTGDVYERDSRNVAKKAEKYLAGCRFADTAYFAAEAEFFIFDDVRFKISNHSSSYSVDSEEGIWNSSRRKGGGNLGNQLKHKGGYAPLPPADQHADLRDDIMNALTKVGLRVEKGHHEAGSAGQGEINYRFNTLVNAADDLLKFKYVVKNTAHEWGKSATFMPKPIAGDNGSGMHTHQSLWKNGKPLFYSETGYANLSDIALWYIGGLLKHGPALAAFTNPSTNSYKRLVAGFEAPTSLVYSAGNRSAAIRIPPTIGAEGSKRIEYRVPDSSSNPYLAFSALLMAGIDGIKNKIHPGSPVEQNMYELTKEQSRDLRYLPSSLSDALRALEQDCDFLLEGNVFTREFISAWIDYKRKNELNRIAQYPHPLEFGMYYGV

SEQ ID NO: 7289 - protein, 507 aa, Schizosaccharomyces pombe 972h-
MALDEKFQLEVIHLLLQFLNDYGYDESLKALEKETGLVSETEDVKRLKQAVLQGDWITAEAAFSIMQLRDESKRKEAQFLLQKQRCLELARSGAICEAIYVLQNFESTDFNKEKERLVSIILESNNKSNNELITKNGYGNTRLDLLNQLSEYISPEILLPKRRLEHLLQQAKDYQVSSQVYHNVLKNFSFLSDYKADPSELPTKEYHVFHDHSDEVWQISYSHNGRYLASASKDKTAIIFDVVNLKRVFRLIGHIDTVAYIRWSPDDRYLLSCSCDKSVILWDAFTGEKLRDYKHGFSVSCCCWLPDGLSFITGSPDCHITHWSLNGEILYKWEDVNIYDMALTSDGTKLYIVGFEQLINAEDKHIAIYSVETRECIKKISLQSKVTSICLSKDSKYALTNLEPHTTFLWDLEENRIVRQYMGHKLGNFLIGSCFGGKDDTFVLSGSEDDKIRIWHRESGKLLATLSGHVKCVNYVAYNPVDPYQFASAGDDNTVRIWSNKDNPRRQ

SEQ ID NO: 7290 - protein, 549 aa, Coccidioides immitis RS
MANLAAFKPPAIQNEPNLHYAKGSPDREKLQRAIKEFKGKVPVEVPVVIGGKSIKTASVGTQHNPSDHAQVVAKYHNATQEDVKAAIASALEAKKSWETLPFADRAAVFLKAAELISGKYRYEMMAATMVGQGKNAWQAEIDAAAETCDFFRFNVHYASELYAQQPAHNATGVWNRVEYRPLEGFVYAISPFNFTAIGGNLAAAPALMGNTVIWKPSPYAVAANYLTYNILVEAGLPPGVIQFVPGDAEMVTRTILDHPDFAALHFTGSTAVFRSLYGKISQGVADGKYKGYPRIVGETGGKNFHLIHPSADIQNAALNTVRGAFEFQGQKCSACSRAYVPASKWDEFRTSLVSEVEKLKIGGPEDFTNFIGPVIHEPSFAKLSKVIDNAKSDKSLTLLAGGKYDKSKGYFINPTIYSTTDINHPLLSTELFGPVLAIVVYDDAAPNAFESVCKTIDSTGQYGLTGAVFAQDRQAVRYAENNLRATAGNFYINCKCTGAVVGQQPFGGSRASGTNDKAGSQALLGRFVSMRSIKEEFVPINSVLYPSNE

SEQ ID NO: 7291 - protein, 346 aa, Mycobacterium sp. MCS
MNGATSFTSVPTVDISGLQSDDRAEHERVAADLGAAARDVGFFYISGSGIDESLFDRMLAATKEFFALPLEEKMRTYIGLSRCHRGYVPVGEEGVEQDTPDFKEAFDTALDLPGDDPDYLAGNPMLGPNAWPDLPGFAESVTAYYTAVLEVGQRLLWAFAIALGEDPDVFTRHATKTPSQLRLVHYPHNPDAEDRMGIGAHTDYECFTLLKPTAPGLEVLNGAGEWIDVPPVPGTFVVNIGDMLELWTNGAFVATSHRVRKVKEERYSFPLFFNVDYHTEVKPLPQFAPRDDRPRPALRAGEHLFAQTAQSFAYLRRRLDSGELVLPEGSLAPGQFGQQALQGTTS

SEQ ID NO: 7292 - protein, 542 aa, marine gamma proteobacterium HTCC2143
MVMPATVMPSTMMHMPMTVQMIMDHGRNVFPDSRVGTFDGESITYTSYAEIAENAARLAAALQSLGIVQGDRVATFSWNNTAHMEAYLGIPSMGAIMHTVNIRLSPEHIAYIINHAENRIVLLDASLIELFTPVLPLLECVEHILVIGDGELVTSIDTLDYREQLAANEPLLDWPELDETSAAAVCYTSGTTGNPKGVVYSHRTTFVHSLASRAADTFGISEHDCILLLPAMYHANAWGLPYSGWFSGSDFTLPGPHLQADAIKRMVAIDRPTITATVPTILGDLLRADSKDLDMTCFRMLVCGGSAVSPAMIDAARDNWGVPVLQGWGMTETSPLCALSHPPREYKGAAETQWRTKSGRPVSGMQVRVVDDHGKPLPQDGSSVGELQLRGPWVTSGYHKGESSDSLSDDGWLRTGDVGHIDSRHFVQLTDRTKDVIKSGGEWISSVELENILAGHPGVIEVAVIATADERWQERPLVIVVVKDGTDATTLRAFLTDKVARFWMPEYWSLVQDIPKTSVGKLDKKRLRDLNNAGRLNIEVVR

SEQ ID NO: 7293 - protein, 538 aa, Desulfotalea psychrophila LSv54
MLIGLSIFMISLCQPYSPGRGVTSYEDNMESIKKLHIKKANSGICTGTEWISPAGSKVIESISPVDGRIIAKIQAGGAPEYKRIITQAQKAFPLWRKIPAPERGEIVRQIGEALRKDKENLGRMICLEMGKSLQEGYGEVQEMIDVCDFAVGQSRMLYGATMPSERPSHRLYDQYHPLGVVGIITAFNFPAAVWAWNAMLSTVCGNVLVWKPSSQVGLTAIAIQHIIARVLKKNKLPEGIFSLICGSGKDIGDLMLADTRLPLISFTGSVRTGRHAAQIIAGRLGKSLLELGGNNSIIISPEADLAIAIPAVVFGAVGTAGQRCTTTRRLIIHESIYDKVRDGLTKAYKSLRIGSPLNQDNHMGPLVNQDAVANYLAAVETIKDQGGEILCGGHALQGEGFESGCYVAPTLVEVKSDIPIIKEETFAPILYLIRYSGDINQAIEINNSAHEGLSSAIFSNNLREAETFLSPWGSDCGIANVNIGTSGAEIGGAFGGEKDTGGGRESGSDAWKAYMRRQTVTINYGHELPLAQGINFTI

SEQ ID NO: 7294 - protein, 347 aa, Oryza sativa (japonica cultivar-group)
MAAAAAAASDDAAAAGGRFDFDVIVVGAGIMGSCAAHAAASRGARALLLERFDLLHHLGSSHGASRTIRDAYAKAHYPPMVRLARRLWADAEAESGYRVLTPAPQLTVGPPGDASLLAAVGNSGARRVDEDDLAGRWGGAFRGVPDGWVAAVSELGGGVLNATKAVAMFQALAVKGGAVVKPGRERELAAEAGFPTFSSHGDPHVYGTPSLELPGLIKINYDGGPPCDPDGRDWAGGGGDAASRVARWIEEFMPDHVEAAGGPVVRQPCMYSMTPDKDFVIDFLGGEFGDDVVVGAGFSGHGFKMGPAVGRILAEMAMDGEARTAAEAGVELRHFRISRFEGNAMGN

SEQ ID NO: 7295 - protein, 865 aa, Aspergillus oryzae
MSRKVPIFWAIHAILIGDIYSISFKRKQKQRSGFSLSNLFSNNTTEFVAGDAGFTSSNTRNGQLHESVSSSRDRPMSNNGNATAQKEGGLLDWYVEGPGRRVGYDDLTAIDWIFEYTKERQRKRHLYSHGQGAVGYVLKFLDASNVWIVLIATGILVGIIAAFIDVASDWLGDLKTGYCKNGAGGGKFYLNKSFCCWGHDGKLFFAPRLYPEVSLLNYGLDISNCLDWTPWGKALGVASSGGVFTVEYLFYVLYSVLFAVCATVLVRTYALYARHSGIPEIKTILGGFVIRHFMGPWTLAIKSLGLCLSVASGLWLGKEGPLVHVACCCASVIMKPFESLNHNEARKREVLSAAAAAGISVAFGAPIGGVLFSLEQLSYYFPDKTMWQSFVCAMVAAVTLQALNPFRTGNIVLYEVTYTRGWHRFEMIPFVILGILGGLYGAFLIRLNMKIAQWRRSRSWSRPIAEVVLVALLSALINYPNLFMRSQNSELVHSLFAECGNGGEDLFGLCKTGAASVTTIVLLLMAAILGFFLASMTFGLDLPAGIILPSVAIGALYGRALGTTFKMWQEAYPKVFLFGNCEPDIPCVTPGLYAIVGAASALGGATRMTVSIVVIMFELTGALTYVIPIMIAVMLSKWCGDIFGKRGIYESWIELNEYPFLDQRDDTTPPDVPAHKVMTAVDDLTVITAVGHTIDSLRHLLLTTSYRGYPVVTDTSNPTLLGYISRNELSFALKYSKSPTDRELSGETQVFFAHQPFADPVETLDLRPWMDQTPITLNSGTTFSLVLQMFQRLGLRYILLSDKGVLQGLLTKKDVWSVLNGPEFRKGGFSRENVVRPVNTAEEVGLLESDDVTSMASSLERRQSL

SEQ ID NO: 7296 - protein, 349 aa, Oryza sativa (indica cultivar-group)
MEGGGARNGSTTGAARTGGSGGDAAGGGGGGSAGNGKPLPPCCVKARAAAPESEAKCHATVVSGWFTEPRSRGGKTSKVQYYNNPMWPGEAHSLKVEKILYQGKSPYQEVLVFESSTYGKVLVLDGIVQLTDKDECAYQEMITHLPLCSIPSPKKVLVIGGGDGGVLREICRHGSVESIDICEIDQLVIDVCKDFFPDLSVGFKDPRVRLHVGDAVEFLRNAPEGTYDAIIVDSSDPIGPAQELVEKPFFDTIARALRPGGVLCNQAESMWLHTHLIQDMLSICRETFKGSVHYAWTSVPTYPSGVIGFLLCAKEGPPVNFLTPANPIEKLEGAMEAGRDIRFYNSEYY

SEQ ID NO: 7297 - protein, 314 aa, Oryza sativa (japonica cultivar-group)
MATTRGQLPVEDVLRVNGSRRFAAALAAASPFASLADALLAARRIWLNEVDVNGWLEAFAAHPAIGTTSSSAPKWCKEEQSAALATATDSTAQELADWNARYREKFGFVFMICASGRTAPEVLAELKRRYENRPIVELEIAAQEELKITELRLAKLFASEPVAPPSSTVGGPTSQSDKAAAPEITGSSNRTRPPITTHVLDVARGSPASGIEVHLEMWKDASTPPSFNNKDFNGWATLGSSVTNNDGRSGQLMDIVNNVAPGFYRISFNTSKYAPSGFFPYVSIIFEIKKNQTTEHFHVPLLHSPFSFTTYRGS

SEQ ID NO: 7298 - protein, 344 aa, Synechococcus sp. CC9605
MATTTLLAGDMGGTKTLLALYGSEAGQLRLLHQERFRSGEWSSLEPMLEAFLNNRPADLPAPTQACIAVAGPVRQSEARITNLPWRLREADLAKAAGTERLELVNDFGVLIYGLPHFDGNQQVILQKGHKDKGPVAILGAGTGLGMARGLQSERGLVALASEGGHREFAPRNESEWELACWLKQDLGISRLSIERIVSGTGLGHVAHWLLQKPDAAVHPLRSVAEAWRRNSSNDLPAEVSVAAEGGDPLMQRALQLWLEAYGAAAGDLALQELCTGGLWVGGGTASKQLKGLQSASFLNAMRDKGRFRELIEGMQVTAVIDPDAGLFSAACRARMLAESGGTLA

SEQ ID NO: 7299 - protein, 230 aa, Oryza sativa (japonica cultivar-group)
MATTRGQLPVEDVLRVNGSRRFAAALAAASPFASLADALLAARRIWLNEVDVNGWLEAFAAHPAIGTTSSSAPKWCKEEQSAALATATDSTAQELADWNARYREKFGFVFMICASGRTAPEVLAELKRRYENRPIVELEIAAQEELKITELRLAKLFASEPVAPPSSTVGGPTSQSDKAAGTETVLSAVNKCMLFIQHIRGFSVYLSNILIPMVLIKFLGLVVPMPTFIF

SEQ ID NO: 7300 - protein, 556 aa, Streptococcus pyogenes MGAS8232
MKSDIEIAQSVALQPITDIVKKVGIDGDDIELYGKYKAKLSFEKMKAVEANEPGKLLLVTAINPTPAGEGKSTMSIGLADALNQMGKKTMLALREPSLGPVMGIKGGAAGGGYAQVLPMEDINLHFTGDMHAITTANNALSALIDNHLQQGNDLGIDPRRIIWKRVLDLNDRALRQVIVGLGSPVNGVPREDGFDITVASEIMAILCLATDLKDLKKRLADIVVAYTYDRKPVYVRDLKVEGALTLILKDAIKPNLVQTIYGTPALIHGGPFANIAHGCNSVLATSTALRLADYTVTEAGFGADLGAEKFLNIKVPNLPKAPDAIVIVATLRALKMHGGVAKSDLAAENCEAVRLGFANLKRHVENMRQFKVPVVVAINEFVADTEAEIATLKALCEEIKVPVELASVWANGAEGGLALAKTAVRVIDQEAADYKRLYSDEDTLEEKVINIVTQIYGGKAVQFGPKAKTQLKQFAEFGWDKLPVCMAKTQYSFSDNPSLLGAPTDFDITIREFVPKTGAGFIVGLTGDVMTMPGLPKVPAAMAMDVAENGTALGLF

SEQ ID NO: 7301 - protein, 380 aa, Silicibacter pomeroyi DSS-3
MTIHWCGTGLSAIPGLRRLIEAGHALTVWNRTVEKARAELGDLTDDIRAFDIDALGAVLAKGDVVVSMLPGDWHVPLAELAIAKGTHFVSSSYIAPEMRALDERAREAGVSLVNEIGLDPGIDHLMAHELVADYRASDAFDAQNHLSFISYCGGIPKHPNPFRYKFSWSPLGVLKALRSPSRSIRDYAPLDVARPWDAISSYTAPLPTPESFEVYPNRDSLPFMGQYHFKEHWPVKEFVRGTLRLNGWADAWGDVFREIETLSGPEGDARLKEMSDQFWAENAYDQGEPDRVVLCVGLKAEKDGREVWHKSYVMDAWGDARGTAMARLVSIPVSLAVEAVLNREIPAGVHAASSDPKLLARWMAEVATLAQHLQIVDHTA

SEQ ID NO: 7302 - protein, 278 aa, Oryza sativa
  misc_feature (201)..(201): Xaa can be any naturally occurring amino acid
  misc_feature (213)..(213): Xaa can be any naturally occurring amino acid
MNSRRSRSVKLVSTRAKPLEVEIAKEDERMSSSADNTVYCCIAKGRKIIYCYNSKDGDPHMETTAALCLENAPSYHRHYIHTAGSRSYGYLMADGHTFFAIIDPSVGNVGALQFLERVREVFRTVNRSGFHDSLVPAVQRLVASLEKMPHATFDLEESVEKGEPSDSSSCTSSKVPLLGRSGSRKDKKKAKEKAASAAGLXEDEQHGTRGVRXDVPPEEVGGMSLERSASQSRLRRQHSSRSLWVRHVKIIIVVDAIICILLFAAWLAVCKGFQCVSS

SEQ ID NO: 7303 - protein, 357 aa, Bradyrhizobium japonicum USDA 110
MLVLGIETTCDETAAAVIERAPDGIGKILSNIVRSQVDEHAPFGGVVPEIAARAHVDLLDGIIDRAMREAGIGFAQLNGVAAAAGPGLIGGVIVGLTTAKAIALVHDTPLVAVNHLEAHALTPRLTDGIEFPYCLFLASGGHTQIVAVTGVGQYVRLGTTVDDAIGEAFDKVAKMLGLPYPGGPQVERAAAGGDAARFAFPRPMQGRPDANFSLSGLKTAVRNEASRIAEITPQDISDLCASFQAAVLEATADRLNVGLRLFREQFGAPRALVAAGGVAANQAIRGALHDVARQAKTQLIMPPPALCTDNGAMIAWAGAERLALGMTDTMEAQPRARWLLDANATAPAGYGKTRAGF

SEQ ID NO: 7304 - protein, 939 aa, Tropheryma whipplei TW08/27
MPPARSGFEPTSDREAFDAETQEWLDSLDALIHASGNERAGEILSKLLEVAKEKGVPRNCDLWGPTKPGTGILPSKTHEPSKHDTSNVSNKDESACVWLPRGLVTDYVNTITGKSNFPGDERLETEFLGFVRWNAAVMVHRAQESGVGGHISTYASSALLYEVGFNHFFKGPSHPSGADQVFFQGHASPGIYARSFLEGRLSESDLDGFRQEKSRSGVPSYPHPRCMQSYWQFPTVSMGLGAINAIYQAQTNKYLTQHGIKDCSQQKVWAFLGDGEMDEPESRGQLQVASNDGLDNLIFVINCNLQRLDGPVRGNGKIIQELEAFFKGAGWKTIKVVWGTEWDDLFEQDTGELIELLNEVRDGDFQTYKANGGSYMRTHLFGKNPKCLSLVGNYTDNQLDQLSLGGHDFRKIYAAYFDAVHNTDGRPTVILAHTIKGYGLGQHFEGRNATHQIKTLTLDEIKLFRNALGIPISDKQIEKDPALPPYYNPGPTHQAVEYALKKRNALGGRLPFRSGWFRRIDLPSERVYDVAKSGSESVASTAVASRIIRELLKSGEFGKRIAVIIPDEARTFGMDAYFPSAKIYNPMGQHYTPVDHKLFLKYEESTTGQVIHVGINEAGAMGAFSALGTSYATHGEMLVPFYIFYSMFGFQRTGDAIWAAADQMARGFLLGAVAGRTTLAGEGLQHGDGHSHLLASTNPAVIAYDPAFGYEIGNIIQHGLEIMYSGQRRNNSHNNQIDPDVIFYLTLYNEPIHNPPQPDDLDLEGLIRGIYKYKPGIVPVASVLASGIALPWALEAQEILKDKCNIDIDVWSVTSWSQLARDGYKCEKHNVFNPEEEQKIPYVTQRLRTATPLYIGVSDYMRAVPEQIRPFVPGDYTTLGTDGFGFSDTRSAARRFFQVDTSSIVIAVLSRLAKNGLVDKDMLKRELIQYRSNRHGIHL

SEQ ID NO: 7305 - protein, 727 aa, delta proteobacterium MLMS-1
MRQQQHRYSRRSFLRLASATAASLPLTALTARAEFSWLDPEEKSQRRVATLCGMCPAECLITVTVRDGKVVEIKGTDGNPLNGEQVCARGAAAFDLLYDPDRLKYPMKRVGPRGSGQWRRISWSEAIDTIAFKMEETLRRHGPGALALFAAGPSSGYIRELFAEFAVPQLNDSHYEHCHCNRDAAYIATLGFSPGAPGRLDYEQCRCLVLLGSHLGENMMLPEFGRFYAARQRGAKLLVADPRRGVMASRADQHLMLRPGSDTALLLGWINWLLREELYDREFIAAHASGLEELRQRVAAWTPERVAQVTGLSAEQIVAGVRLLAEQAPAVIIHPGRHSNRYGNEVPRLQAQAILSALLGAVGRPGSLLLPAPGPAGEAPAERYRQDLSRALQSRGGGRAAEIIGGLERGGIKLLGCWGQNPFHNTPNPYRTALAWRQADFIFTCDVLPSEAALQADIILPEATFLERHDRLRPRPEYEPQLLTARFPVLPPAFEAREPYDIVRELSIRLGRGRKLAAAEVGERLRQELAPFSVDLDYLQRHGAWARLPAQSAYLAEQPQADFRFPTLSGKIELAAADLAEAGHDRLPDFTPLPEPPSGYLRLLYGRSPLHTLSSTQNNRRLMREKGENELWLNQARAAELGLRQGQRVMLENQDGFSSLKPVALRLTDAIRADCVYLVHGFGNRSPLLQTAFDQGISDNALMSRATINPVTGVGAGGNNFVRIRRE

SEQ ID NO: 7306 - protein, 253 aa, Glycine max
MGRKFFVGGNWKCNGTTEEVKKIVTTLNEAKVPGEDVVEVVVSPPFVFLPFVKSLLRPDFHVSAQNCWVRKGGAYTGEVSAEMLVNLGIPWVIIGHSERRQLLNELNEFVGDKVAYALQQGLKVIACIGETLEQREAGTTTAVVAEQTKAIAAKISNWDNVVLAYEPVWAIGTGKVATPAQAQEVHADLRKWVHDNVSAEVAASVRIIYGGSVNGGNCKELAAQPDVDGFLVGGASLKAEFVDIINAATVKKN

SEQ ID NO: 7307 - protein, 70 aa, Mesembryanthemum crystallinum
MGFLITTLIFLVIGIIASLCTRICFNRGPSTNLLHLTLVLTATVCCWMMWAIVYLAQMKPLINPILNESE

SEQ ID NO: 7308 - protein, 548 aa, Neisseria meningitidis Z2491
MKHLHDLPAWSKLWNHFDDSKTLHMREMFEQDPQRAERYWLQVGGLTLDYSKNRINDETMSLLFELAHEAGVPERMRQMFHGKKINTTENRAVLHVALRNRTNSPIVVDGEDVMPKVNRVLQRMGEFAHEVRSGSWLGYTNQVITDVVNIGIGGSDLGPLMMCTALKPFGHPRLNMHFVSNVDGSQLRDVLSKVHPETTLFIIASKTFTTQETLTNALTAREWFLNHAGDEEAVAKHFAAVSTNQKAVAEFGIDTANMFEFWDWVGGRYSLWSAIGLPIMLYLGEENFIEMLNGAHLMDQHFINTPLERNLPVILALIGIWYINYYGGGSHVIAPYDQHLHRLPKFIQQLDMESNGKQVTLDGKAVGHETSPIIWGETGINGQHAFFQLLHQGTHITPIDLIASLEKRSNLPGHHEILLANVFAQAEAFMRGKTPDEVRAELKAQGMDEARIEELVPHKTFSGNRPTNLILMDKVNPRNMGSLIAMYEHKTFVQGIIWGINSFDQWGVELGKQLAKTILGELTGETGSQKHDSSTERLINLYLQTNRK

SEQ ID NO: 7309 - protein, 491 aa, Gibberella zeae PH-1
MRRLIWRTALHQARSRWIQPNFVAEEKDLVVIGGGVAGYVAAIKAGQEGMKVTCIEKRGSLGGTCLNVGCIPSKSLLNNSHLYHQILHDTKHRGIEVSDVKLNLANFMKAKETSVSGLTKGIEYLFKKNGVEYIKGAGSFVNEHEVKVDLNEGGETSVRGKNILIATGSEATPFPGLEIDEKRVITSTGAIALEKVPETMTVIGGGIIGLEMASVWSRLGSKVTIVEFLGQIGGPGMDSEIAKNTQKILKKQGLEFKLNTKVVSGDKSGDKVKLEVDSAKGGKVESIESDVVLVAIGRRPYTAGLGLENIGLEADDRGRVVIDSEYRTKIPHIRCVGDCTFGPMLAHKAEEEAVAVVEYIKKGYGHVNYGAIPSVMYTHPEVAWVGQSEQDLKSQNIPYRVGSFPFAANSRAKTNIDTEGMVKMLADPETDRILGVHIIGPNAGEMIAEGTLALEYGASSEDIARTCHAHPTLAEAFKEAAMATHAKAIHY

SEQ ID NO: 7310 - protein, 1372 aa, Coccidioides immitis RS
MERRRHSLHGSDSSTPTDFYPLHPPFVLPGQEDFEVDIRDADDQHDTPLVTSSGATVSQVSSGYRNSPVLAPPAIYPQWTPEIPRHSRSGSAGASAATFERHTPSDMSDRELRPQRPSGPARTPSNTYAPPRRPPQFSTHSSSQLSYSAKRPSRRDPNAQYRAQEKAYVQRVRQGPPNEWLNFGSQIPGVPDIDLDLEDESPSSEPFDSDPYDVEAHLVLEDENIQPTLEELQNPKIREKLEWHSMLASVLKGDVVKQEKRRLFGTGEPKSLTDINDEIWLGIRARSCGRLEALQKKIIEHERAQVGPILEEIISFKIKGETEIGKPPVKQVEGIVAKIEKVESLYSVMRELKAHHKRADSEEFTASCDAIISWHNTTQLINTQFAILQRWVGNEELNFNLPITKPSHAADLADEGSFLDRIMKEDGLKSLQGDGNVVDGNGQTRKNSMLDGIGEVIKKAKATLIENSEAFVERHLPPYIEELLILISFPSRLIVEVIRVRLSYAKKMKDPGQQSPMLLDQMIAQFQILMKIAVEIKQRYLVISEPEPGWELPPCFEESFDTVVVDALKYYFKLLNWKLSANKNTFKEAEILEQEWDFSNEIGRQFEGGDIEVAEQFSTLTAKALQRLMLHFERELLGKPEGDAVESEKRYKQILDSVRVRQRKLFRFSRFLRERFENATEFHLKDDIVETFSEALLASGHFLVTSLDSVGQKGVSLIASPSLYGRPKDIQSILGTSFRAEDVPEDPSNPYILVIRPEKPFPWSGKRMEVDLLEHPTDVRLGKLRLVADGSQKRLQSARAELTRLTGLEFDVTVEQRANLGRVNVELNKIKKTAWKLSNTIIDSVEIIRKQNQGAGNQELIQSCFAFATEFGKRSLMYLEPTRRSMNHGKLVRLGVDWVAFVCDDCDAADRRTFKWAVAALEFAMAITHGHSILSLSDEDYQLLRAKVAGCMSTLISHFDIMGARSTLAAKAEKLQLLSGKLDLSKAMDDAEAEQAVHEQRYLRVAELEQARAELDSKRRPLGRVLEGVNEADRSLTVLSSSATNVTLRWQQGQFIGGGTSGSVYAAIDLDTSYLMAVKEIKLQEPSVIPGVAQQIRDEMAVLEVLDHPNIVSYRGIEVHRDKVYIFMEYCSGGSMATLLEHGRIEDETVIMVYALQMLEGLAYLHQAGIVHRDIKPANILLDHNGVIKYVDFGAAMIIARQGKTLAAMDQYGGNHKDATKEPHAQRKNQKSVTGTPMYMSPELVRGEVGHAGGRHGSMDIWSLGCVILEMATGLRPWAGIDNEWAIMYKIAQGNQPHLPTPDQLSELGIDFIKRCFELDPAKRPSAVELLQHEWIVTIRRQVVAEPPTPSSEVANSQTSSSTSSRQNSSMF

SEQ ID NO: 7311 - protein, 206 aa, Triticum aestivum
  misc_feature (108)..(108): Xaa can be any naturally occurring amino acid
MQRAIQAIGSHGSVLKSAVLQHISVVKPAMLPAVFPRFMSVSPAQIEESGFESSTVADILKSKGKSADGSWLWCTTDDSVYDAVKSMTQHNVGALVVVKPGEDKSIAXGIVTERDYLRKIIVQGRSSKSTKVGDIMTEENKLITVKPETRVLKAMQLMTDKRIRHIPVISGTEMMGMVSIGDVVRAVVSEHKEELNRLNAYIQGGY

SEQ ID NO: 7312 - protein, 495 aa, Kluyveromyces lactis NRRL Y-1140
MNEYDAVDRHTFKVFNQDFTVDKRFQLIKEIGHGSYGIVCSARFTEAADETTVAIKKVTNVFSKTLLCKRSLRELKLLRHFRGHKNITCLYDMDIVFQPDGMFNGLYLYEELMECDMHQIVKSGQPLTDAHYQSFIYQILCGLKYIHSADVLHRDLKPGNLLVNADCQLKICDFGLARGYSENPVENNQFLTEYVATRWYRAPEIMLSYQGYTKAIDVWSCGCILAELLGGKPIFKGKDYVDQLNRILQVLGTPPEETLKRIGSKNVQDYIHQLGYIPKIPFSTLYPNANPDALNLLEGMLSFDPQLRITVDDALQHPYLSIWHDPADEPICTEKFDFSFESVNEIEQLKQMVIDEVTDFRQYVRLPLLHEQQQQQGKTDGGFDDQIREDQRTFQAQLEEQVNNGRTASNVPSFDEPFSSQMMGSASQQDPLVGIHSDNLPSHELDFPPRPSENVLDSPMGLSHQQTHNGSPECQDINDLLGLERELEFGLDRQF

SEQ ID NO: 7313 - protein, 139 aa, Pinus taeda
MKKVAALCFIFMIQVATNMAPIMAACSGYTCILPPVIPGGPGSGGSTPGGSTAKCPLNALKLGACVDLLQGLVHVGLGDPVVNQCCPLIQGVAALEAALCLCTTIRAKVLSLNVLLPIALSLVASCGLTVPPDFKCPAN

SEQ ID NO: 7314 - protein, 268 aa, Haemophilus influenzae 86-028NP
MDLYAVWGNPITQSKSPLIQRQLAAQTHQTMEYIAKLGNLDSFEQQLLAFFEEGAKGCNITSPFKERAYQLADEYSQRAKLAEACNTLKKLDDGKLYADNTDGIGLVTDLERLNWLRPNQHVLILGAGGATKGVLLPLLQAQQNIVLANRTFSKTKELAERFQPYGNIQAVSMDSIPLQTYDVVINATSAGLSGGTAPVDVEILKLGLAFYDMQYAKGTDTPFIALCKSLGLTNVSDGFGMLVAQAAHSFHLWRGVMPDFVAVYEQLK

SEQ ID NO: 7315 - protein, 261 aa, Xylella fastidiosa Temecula1
MRTMTQSRWRLDGRTALITGASTGIGLAVARELLGLGADVLLVARDADLLGRVRDELAEEFPERELHGLAADVADDVDRRAILDWVEDCSNGLHVLINNAGGNVTRAALEYTEDEWREIFEINLFSAFELCRYTQPLLACHASTAIVNIGSVSGLTHVRSGVPYGMSKAALHQMTRNLAVEWAEDGIRVNAVAPWYIRTRRTSEPLSDLYYYEQVIERTPMRRIGEPEEVAAAVAFLCLPASSYVTGECIAVDGGFMRYGF

SEQ ID NO: 7316 - protein, 462 aa, Oryza sativa
MAAPSSLASSSHLSRRATAAASPSIPPPSPPPPPQRLRCGWVGRAAPPTRRAPGVCSVVSPSKPGSLSAAPLLVCLALGGGGVGRVRLSSWVCFGVGVAAVDVPAATIPDAAATGVGVAERISVSSLLEVVADDLLKLNNNLKSVSFTFSSQSLHHSVQLVHDTKNPVLVSAAEQIFGAGGKRLRPALVFLVSRATAELAGLLELTTEHQRLAEIIEMIHTASLIHDDVIDDSGMRRGKETIHQLYGTRVAVLAGDFMFAQSSWFLANLENIEVIKLISQVIKDFASGEIKQASTLFDCDITLDDYLLKSYYKTASLIAASTRSAAIFSGVSTAICEQMYEYGRNLGLSFQVVDDILDFTQSAEQLGKPAGSDLAKGNLTAPVIFALQDEPQLREIIDSEFSETNSLATAIELVHRSGGIKRAHELAREKGEIAIQSLQCLPRSEFRSTLENMVKYNLERID

SEQ ID NO: 7317 - protein, 574 aa, Gibberella zeae PH-1
MAHSSFVTGLPPTVGNALEKTPKLMSRDDIEALIAEGKHITIFHNQVIKMDAWMPYHPGGDKAMLHLVGKDASDEIDALHSYGTRQHVLRYRIGRVEGTWENLLPPIQGGVHRTREEIERANSEGDLNQDRDSSTPSTRVPSPVFDEDDAKGVRQRRGDKMKKDGARASSISSASSVDEPEMDGMSYLDTITRQHINLDLDKYPPPDKETQAKIASKYRELHQKVYDTGLYDCNYRAYGIEFLRYIALAVGSAVSLQHEWYALSAFLLGALWHQLSFTVHDAGHMGITHNYLVDSCIGALIADFMGGLSIGWWKRNHNVHHVVTNAPEHDPDIEHMPLFAVSHRLLGSLRSTYYERVMSYDAVAKVLLRVQAWTYYPLLSLARFNLYRLSWDFLLMGRGPKKGPALAIWWLEVTGQVFFWTWFGYGLVYNMLPDNWTRFYFVMISNITASPLHVQIVLSHFAMSTVELGPQESFPQRQLRTTMDIDCPEWLDFFHGGLQFQVIHHLFPRVPRHNLRATQKLVQEFCNEVNIPYALYGFANGNQKVIGRLAEVSRQAAILSKCQQSIQNGDLSHH

SEQ ID NO: 7318 - protein, 103 aa, Magnaporthe grisea 70-15
MTGRGKGGKGLGKGGAKRHRKILRDNIQGITKPAIRRLARRGGVKRISAMIYEETRGVLKSFLEGVIRDAVTYTEHAKRKTVTSLDVVYALKRQGRTLYGFGG

SEQ ID NO: 7319 - protein, 138 aa, Triticum aestivum
  misc_feature (22)..(22): Xaa can be any naturally occurring amino acid
  misc_feature (50)..(50): Xaa can be any naturally occurring amino acid
MAAAGDAGEKKMITLKSSDGEXEFEVEEAVAMESQTIRHMIEDDCADNGXIPLPNVNSKILKNWDAEFVKVDQATLFDLILAANYLNIKGLLDLTCQTVADMIKGKTPEEIRKTFNIKNDFTPEEEEEIRRENQWAFE

SEQ ID NO: 7320 - protein, 467 aa, Methanococcus maripaludis S2
MKSENYSKNDLEKWDKEYVWHPFTQMKEYREGKPLLIESGEGIYLIDVDGKKYMDAVSSIWCNFFGHSEKRIADAISKQALNIGHSTQLGCGNVPSAILAKRYVDFSPEQFKKVFFSEDGAEAIEIAVKMAFEYCKLKGFTNKTKFVSVKEGYHGDTVGAMSVGGSELFHGCFEPLLFEGYHASAPYCYRCKYCNFKNTDERNKQGCEMKCLKEMEDLIRTNKDEIFCVILEAGVMGSAGMIPYPKGYIEGVAKICKKLNIILILDEIATFGRLGRAFYSDMDELKELEKPDILCLGKGITGGYLPLALTLATDEIYNAFLGSFDECKQLFHGHTYAGNQIICASAIETLNILEETNICEEIRPNIKLLHENLDKLKEFPCVGDIRKSGYMIGIELVKDKETKEPYEYSYKAGYKVAGRLLEKGIYIRPIGNTLIFVLPLIIKPEEIKLLTEKIYESISELLDEKVL

SEQ ID NO: 7321 - protein, 629 aa, Oryza sativa (japonica cultivar-group)
MHTKLLLLPILASLQLLPGAANGATVDPSCPPATCGNLTITYPFWLGSQNQSSCGPPSFQLTCNDRASGPFLRNSYIKVLGFDYGRRSLVAVHALLAADAACTVMFNVSSAFAITDRFSISQSNRELYVLSRCRERLPPPDAVPVTNCRANSSGMYAYLGGSYGTGQTPVNNGGCELSVFLVLGSSNAADMTAANYRQLIAGGFLLEWEPVGDCNACTASGGRCRYDASTSAFACLCSDGGMRPSICDGKNRGKLALIVSLSAAAGLVFAFLAWLMYRQRQKFRSAICGVYSGNTKNEEEMLKKCESLALKRYKYSELKKITKSFEDNLGEGGYGVVFKGRLQNGRMVAVKILTVSKGNGEDFLNEVMSISRTSHVNIVTLLGFCLEGPKRALVYEYMPNGSLKNYIHSESSNLATGWEMLLKIVIGIARGLEYLHQGCNTRIIHFDIKPRNILLDHEFCPKIADFGLAKLCHLNESILSMAEARGTIGFIAPEVFSRGFGVVSTKSDVYSYGMLLLEIVKVRKNIKGIADNFSETFFPHWVYDSLVSEMQCCETAYGTEEIARKMTIVGLWCIQMTPETRPSMSRVIEMLERSISELEMPPKPFLCSPIHSTNVSSYKSVNFTMSASS

SEQ ID NO: 7322 - protein, 332 aa, Magnetococcus sp. MC-1
MTIRIGINGFGRIGRSIFRAQRMDPAFKDIEIVALNDLTPKPSLAHLLKYDSVMGVLNAEVSATEKGVSVDGKEITVFEERDPAKLPWGELGVDYVVESTGLFRKRETAGAHLKGGAKRVIISAPAGGDIPTFVMGVNENDYNPATDDIVSNASCTTNCLAPMAKVIDDKFGIERGLMTTVHAYTNDQALLDQPHSDLRRARAAALSMIPTKTGAAAAIGLVMPNMKGRFDGLAVRVPTPNVSLVDAVMEVRAETTAEEVNAALKAATTRFLGYFDAPLVSIDMQGDPRSSIVDGGCTRVNGKQIKVMSWYDNEWGYSNRVLDLILHMASKA

SEQ ID NO: 7323 - protein, 513 aa, Yarrowia lipolytica CLIB122
MILLYVLAFLVSYLIFTRLRYRYQSYKLAQKWKCSPVRDVSSFPMAFPEFLFFFKSGKNNVLLDEFVNFFTKRQPNLTVGLVLAGNDVTVTLEPENLKALLATQFKDFCLGVRHNQLAPILGDGIFTLDGQGWQHSRAMLRPQFARDQVSDVDMIERHVQNLVRKIPQGDSFDIQGLFFNLTLDTATEFLFGQSVSCQTVDNPAEDDSTVTDMPIPMRKSFQSDFNLAQHHGGYRVRLQMFYWLWRPQELFTASKSVRKFVDHYVKKALVESEKEKQADDKYVFLTELAREVKSPQVLSDQALNILLAGRDTTASLLSWCIYLLARHPETWNKLRDEILSTFGSGSDLSLITFESLKRCEYLRFVINETLRLYPSVPVNVRYATRDTTLPRGGGPDESQPILIRKNSVLVYSVFATHRLKKFWGEDADEFRPERWGEGISRGWEYLPFNGGPRICLGQQYALTETSYVLTRIVQLFGTLENADASPEPPMKLHALTMCHLTGVHVKMSTNNLP

SEQ ID NO: 7324 - protein, 180 aa, Brassica napus
  misc_feature (170)..(170): Xaa can be any naturally occurring amino acid
MVSHEENTGIVEWFLGPHPFTYPPYGVELIHEEEDEAHQHHYHHHQDQSGEYYREYEEDHRSSSDVDNDEIIARTLQDDFLQLQIAEENNNNDYSNHLQQQHQEEEGGGGYTNNYNSNNNEYGWNEQAVVDYSSEWVGGNENDQEDDSSGNIYSCSSPSDTDEYVYSWEXSDQCEADGEF

SEQ ID NO: 7325 - protein, 512 aa, Triticum aestivum
MDSLYWFVELLSVLCFVVFYYRHLQSKKISKAEPTEWPILGHLLGMVANLSHFHDWATGILAGTRYNFQARAGITGVRFFVTCDPANVRHIFTSNFTNYPKGDEFAEIFDVFGDGIFNADGESWRRQRAKSQLIMAGPRFRAFSARYSRDKVERSLLPFLAHAAEAGSTPCDLHDVFLRLTFDMTCNLVFGVDPGCLQIGLPVVPFARAMDDVLETLFLRHIISPACWKLMYRYEVGTERKMAAARRTIDRFAADTITKRRVDHKLRPNEGVTDSSDMLSSFICNGDASEYSDEFLRDTTVNLLLAGRDTTGAALSWFFYLLSKNPSVEQRILDELAPIASRKKKLDGMVVFDVSELSGMVYLHAALCECLRLYPSVPFEHKAAVADDVLPSGHEMKAGDKILIFSYCMARMEGVWGKDCMEFRPERWVTADGKLRYEPSYKFISFNAGPRTCLGKEMAFVQMKTAAAAVLWNFAVEAVPGHVVEPKLSIILHMKNGLAVTVKRRNVAGVHG

SEQ ID NO: 7326 - protein, 95 aa, Zea mays
  misc_feature (35)..(35): Xaa can be any naturally occurring amino acid
  misc_feature (61)..(61): Xaa can be any naturally occurring amino acid
AWSRPRDSLFLIFFLYVFFCIFFLFCFYLVDFFHXSVRDLVNMADKRTNVIPIIEDARHPXRYRMLVGMGDVIFSDVAQADQARILALNASYFLK

SEQ ID NO: 7327 - protein, 420 aa, Stigmatella aurantiaca
MDTHSKRHPSLPRPIQGEMKLENSNRLLAEAKRLIPGVTLSMMKRPEHFAPDAFPVYLARGQGALVEDVDGQQYIDFIGGLGANMLGHNHPAVVESIRKHLDEGLIHSLPTPVELSASQTLIEMIPGAEMARFFKTGADATSAAMRLARIITGKERIITVGYNGWHDHFMVGTPGVPAVMSQYTIRMPLFTPQDETALLACIGENAKQLAAVLISIPFNRCLSREFMHQLRAACTAHEVLMVQDEVITGFRLARGGAQEFFDVKADFVCLSKALAAGMPLSAVAGPAKHLSKLGAMEVQVSTTFGGEMLSLAVCEATLKEYRKGGYIEQLAALGSRLRTGINAKAEKAGSPLRVLGYDSIPFLLFDKNPTEHAKRMQPFQAGMARRGILLRRDVNFISAVHTQEQIDYTIEMAGEVLQSL

SEQ ID NO: 7328 - protein, 466 aa, Coccidioides immitis RS
MAHLCAVSICYENAKKKDSRSCCSPYWCSGKLQRLSIPYFNVLWADVSHEYITIKYAESTSNDDVSVASVYYPVDPAHKSKTKQWLEELMNAAYGKAQREKKVKVLINPFGGKGRAQKLYSREVEPVFAAAQCEVDVEITTHQGHAVEIAQNIDLQAYDVIAPASGDGVAYEVFNGLGKRADAGEALRSLAVAHIPCGSGNAMSWNLYGTGSPSMAALCIVKGLRTPLDLVSITQGDRRTLSFLSQSFGIIAESDLGTDHIRWMGSARFTYGFLVRLFGKTVYPCDLAVKVEIGDKDDIKDHYRAGLEQKSSHSPRGSKSETVGLPPLRHGTVADPLPDDWELITHDKMGNFYAGNMGYMAPDANFFPTALPNDGMLDLITIRGDISRLTALQMLMAVENGTLFDMPEVHVQKVSGYRIIPREREDGYISIDGEKVPFEPFQAEVHKGLGTAISKSGHRYQTPEIR

SEQ ID NO: 7329 - protein, 52 aa, Glycine max
  misc_feature (2)..(3): Xaa can be any naturally occurring amino acid
  misc_feature (37)..(37): Xaa can be any naturally occurring amino acid
MXXNGVVGILAESVNKWERRAPLTPSHCARLLHGGTXVLGHWPFHPAYKNLE

SEQ ID NO: 7330 - protein, 323 aa, Xylella fastidiosa Temecula1
MTFQKHVAHTQPAKLATTPSPPGTATTPSLMSEDDDHRTITESQEKRRSWLERLSAAFSGDPHTLDDLMVILRSAEHHGIIATDTLRMMEGAIAIADLTVGDVMVPRSQMVSLPVESDLQTITKQMVESGHSRFPVHGENKDEVLGILLAKDLLRGVSANHTITNVHELLRPVGMIPESKKLNVLLKEFRLSHNHMAIVVDEYGGVAGLVTIEDILEQIVGDIDDEHDETEDQTNMIAIQADGCYIVDALTPIEDFNERFNAEFPDDDYDTIGGLVTEAIGHLPETGDELTIGRFAFRVAKANARRIHILHVTVLPPNEQNTA

SEQ ID NO: 7331 - protein, 308 aa, Coccidioides immitis RS
MGCCLSRDPSGFPHAAHADQGQHAESFQGTNPATEGAGPNPPGLSRSLSRSRSNASTSRPPHSTRRRHQAVALSEHYNQPIRLHVWRSKRRAWSKPQIDRERREFFDTRVTGRPEVWAALKLAISLMRSGDLPTAQSIIDAAGVTVPTGDLCDGCYDENGALYRLPQVIVSDPSNIVDARGGEEDMRSGEADDEVTNTKLAMDIDSDDELEEDIEDKREEKGKRNERDMIKVCARLSDRGGPDLTIEIGKDQSVGVLVRKIQSGAALTGQHRLRIAYLGKILKENETLLSQGWKEGHLVNALVLQRSS

SEQ ID NO: 7332 - protein, 358 aa, Lolium perenne
  misc_feature (221)..(221): Xaa can be any naturally occurring amino acid
  misc_feature (230)..(230): Xaa can be any naturally occurring amino acid
  misc_feature (237)..(237): Xaa can be any naturally occurring amino acid
  misc_feature (243)..(243): Xaa can be any naturally occurring amino acid
MATAALPGMLLVEELAGGDLLPERYVLQVEDRPTVVGALPVAQVPVIDLGLLSQQVAAGGGEEVEKLRSALVSWGIFMVSGHGVDPCMMDAMWKAAKDFFGQPIEEKKKYANHADCEEGYEDYHQGYGTKQLKAEGETTLDWSDRMRLQVEPQDERKLELWPESFKDILHDYCVQQHRGLLDTLLPAMERVMGLGDGFLLGRLGGPATTYCRINYYLPCPXPDLVVGVAXHADATLXSVVMVXTPFGGCQVLKDDVWYDVPASTDPHGLLIMVGDFAEILTNGLLKSPVHRVVTNPHKDRTSVVMFYMPDIDKEIGPADELIGNTQRARYKKVKGSEYLIRNYGHMARGKRTLDSLMI

SEQ ID NO: 7333 - protein, 400 aa, marine gamma proteobacterium HTCC2143
MASAKEIPTVNWLDLKNDRKKFLADLRYALSDCGFLILANAPGLEDNFQQRAFKEVRGFFDAPMDVKKTAHIANSPYFRGYTLPTPADRGHGQVIENFQYGFEQEPLCAHDDVTEPIHKRLFRGPNTWPDADTISGFQPVIEELNLCYHRLTHQLGELIVESLGEDPAEFQKYFNFDEPYLAASLNHNFSLDAFAEGNREAVHTAYAKFDSTNVGTHIDGPPFIALLINDRPGLQVVAGEGRWMDAPVTCRTAPGDYSVPVIPGSVVVNTGGTLMHLSEGRYSATLHRVNTTLIPAGETRVSMPYFLLPKMEGDLIPFGKSTAEDEGAAGYKAGRDRGANASVNRMGTFPQVTRRWWKEEFEELNQKHREEVQMETAAAFQLAEERGQRYKEKSHGTSPE

SEQ ID NO: 7334 - protein, 862 aa, Nicotiana tabacum
MFLEKIVDAITGKDDGKKVKGTVVLMKKNVLDFTDINASVLDGVLEFLGRRVSLELISSVNADPANGLQGKRSKAAYLENWLTNSTPIAAGESAFRVTFDWDDEEFGVPGAFIIKNLHFSEFFLKSLTLEDVPNHGKVHFVCNSWVYPANKYKSDRIFFANQAYLPSETPDTLRKYRENELVTLRGDGTGKLEEWDRVYDYAYYNDLGDPDKGQDLSRPVLGGSSEYPYPRRGRTGRKPTKTDPNSESRIPLLMSLDIYVPRDERFGHIKLSDFLTFALKSIVQLLLPEFKALFDSTHNEFDSFEDVLKLYEGGIKLPQGPLLKAITDSIPLEILKELLRSDGEGLFKYPTPQVIQEDKTAWRTDEEFGREMLAGVNPVIISRLQEFPPKSKLDPKIYGNQNSTITREQIEDKLDGLTIDEAIKTNRLFILNHHDILMPYLRRINTSTDTKTYASRTLLFLQDNGTLKPSAIELSLPHPDGDQFGAVSKVYTPADQGVEGSIWQLAKAYAAVNDSGVHQLISHWLNTHAAIEPFVIATNRQLSALHPIYKLLHPHFRETMNINALARQILINGGGLLELTVFPAKYSMEMSAVVYKDWVFPEQALPTDLIKRGVAVEDSSSPLGIRLLIQDYPYAVDGLKIWSAIKSWVTEYCNYYYKSDDAVQKDTELQAWWKELREEGHGDKKDEPWWPKMQTVQELIDSCTITIWIASALHAAVNFGQYPYAGYLPNRPTLSRNFMPEPGSPEYEELKTNPDKVFLKTITPQLQTLLGISLIEILSRHSSDTLYLGQRESPEWTKDQEPLSAFARFGKKLSDIEDQIMQMNVDEKWKNRSGPVKVPYTLLFPTSEGGLTGKGIPNSVSI

SEQ ID NO: 7335 - protein, 527 aa, Yarrowia lipolytica CLIB122
MKFSGLVYLATAVLALPDVSNPVPQNVLQPVQYRVAFAGKQDAAVVSWNTYGKPGYQPTVYYGTDKNQLNSKSTGDSNTYDTSTTWNHHVRIEGLESDRVYYYRVGGAPESEIYNFKTARKAGNTKEFTFAAAIDLGVMGPYGLSTKVGNGASNPLAPGEQNTMDSLLQNIDNFDFLLHPGDLAYADYWLKEELEGYIDTGVNTRDTDTLFKNGVQTYEALLNTYYQQMQHITSFKPYMVGPGNHESNCDNGGTSGYTVQTCFEGQRNFTGIINHFRMPDSESGGVGPFWYSFDYGLVHFVNFNTETDLGKYGPGPDSVGGSDNMDSGEFGEDGEQIAWLKNDLKNVDRSKTPWVIAMGHRPWYVAAKKKHRCLECQAAFEKTFNKYGVDLVLLGHRHLYNRIHPIDDKGNIDPNGLNNPKAPWYIVNGAAGHYDGLDTAKKTDEPWLAYWQDTQYGWSKFTVHNATHLTHSFVVSSDNSLLDTQTLYKSRGQAITKRQVKKDKTSAANALSIGRFVIVAFFLAFFF

SEQ ID NO: 7336 - protein, 145 aa, Triticum aestivum
DDNIRLISAWLNNSIDSIDGNNKKGEVYWKNVTEDYNKNSPPTRRRNSKNCKDHWGKTNRKVVAFHGVYCRLKDAYASGQCDLQLVQKALAMYKKEKNQNFTLLYWWEKVRVHQKWSRHSEEGKGKGNGTIQTQMEKETRPDGTK

SEQ ID NO: 7337 - protein, 791 aa, Pseudomonas syringae pv. syringae B728a
MVEYVVSLDKLGVHDVEHVGGKNSSLGEMISNLAGAGVSVPGGFATTAQAYRDFLELSGLNEQIHAALDALDVDDVNALARTGAQIRQWIMEAEFPEQLNAQIRTAFAELSAGNPNLAVAVRSSATAEDLPDASFAGQQETFLNIRGVENVIRAAKEVFASLFNDRAISYRVHQGFDHKLVALSAGVQRMVRSETGTAGVMFTLDTESGFRDVVFITGAYGLGETVVQGAVNPDEFYVHKDTLAAGRPAILRRNLGSKAIKMIYGEEAKAGRSVKVIDVEPADRARFCLSDAEVSELAKQAMIIEKHYKCPMDIEWAKDGDDGKLYIVQARPETVKSRASANVMERYLLKETGKVLVEGRAIGQRIGAGKVRIIKDVSEMDKVQPGDVLVSDMTDPDWEPVMKRASAIVTNRGGRTCHAAIIARELGIPAVVGCGNATHTLQDGQGVTVSCAEGDTGYIFEGELGFDIKTNSVDAMPDLPFKIMMNVGNPDRAFDFAQLPNAGVGLARLEFIINRMIGVHPKALLNYSVLPPEIKESVDKRIAGYDDPVGFYVDKLVEGISTLAAAFTPKKVIVRLSDFKSNEYANLIGGKLYEPEEENPMLGFRGASRYISENFRDCFELECRALKRVREEMGLTNVEIMVPFVRTLGEASQVIDLLAANGLKRGENGLRIIMMCELPSNAILAEEFLEYFDGFSIGSNDLTQLTLGLDRDSGVIAHLFDERNPAVKKLLSNAIQACNKAGKYIGICGQGPSDHPDLARWLMDQGIESVSLNPDSVLETWFFLAEAQAPV

SEQ ID NO: 7338 - protein, 473 aa, Ralstonia metallidurans CH34
MKTLDRFYIDGQWVTPAAAARSMPIVNPATEEVAGHVTLGSAEDVNRAVAAARAAFPAWSETSREERLALLERITALYKARLGDFAEAVRTEIGAPVSLCNTLQAPIGLAHLGAATETLRAFQFETAHGNNYVRHEPIGVAALITAWNWPLSLICAKVAAALAAGCTIVLKPSEIAPLDAALFAEVMHEAGTPAGVFNMVFGDGQEVGARLAAHPDVDVISITGSTRAGIAVAQAAAATVKRVHQELGGKSPLLILDDADLQAAVAQGVGHVMLNSGQTCIAPTRMLVPRDRYDEAVRVAAATANALQVGDPAEPGTRIGPISNKAQYEKVQRMIGTGIEEGARVVAGGPGRPDGLTRGFYARPTIFADVDNSMTIAREEIFGPVLVMIPYDDEAQGVDIANDTPYGLAAYVASGDPARARRVAARLRAGSVRINGGQVDLSMPFGGYRASGNGRENGAHGLAEYLEVKAVTV

SEQ ID NO: 7339 - protein, 503 aa, Silicibacter pomeroyi DSS-3
MGGPTNSRRRHAMLDAATDLKSLLKTPDLLATKAYIGGQWVDGDNGTFAVTNPARGDVIAEVADLSRAQVAGAIAQAEAAQKEWAKYTGKERAVILRRWYDLMMEHAQDLGRILTAEQGKPLAEAVGEVAYGASFIEFFAEEAKRIYGETIPGHQRDKRITVLKQPIGVAASITPWNFPNAMITRKAGPALAAGCAFVARPAAETPLSALVLAVLAEKAGIPAGVFNVVPSSRSSEIGKEFCENPGVRKLTFTGSTEVGRILLKQAADQVMKCSMELGGNAPFIVFDDADLDAAVEGAMLCKFRNNGQTCVCANRIYVQAGVYDAFAEKLAAAVAKLNVGDGLSDGVTTGPLINAEAVEKVLEHLGDVTAKGGAVLTGGKPHALGGTFFEPTVVTGVTQEMKVAKEETFGPLAPLFKFDDVDEVIAMANDTIFGLAAYFYAKDLSRVYKVAEALEYGIVGVNTGIISTEVAPFGGIKQSGLGREGSHHGIEDYLEMKYICMSV

SEQ ID NO: 7340 - protein, 357 aa, Tropheryma whipplei str. Twist
MVRMKALVYHGPGKRSLDTVDDPTIKLGTDVILEMETTTICGSDLHILKGDVAAVKPGTVLGHEGIGKIVEVGKDVKSHSVGDRVIVSPMSSCGVCRFCRANNNGHCLGDSEGPGGWRLGGLINGVQAQFARIPLADNSLHKLPSGLDPKVGILVSDVLPTGHEVGAQAGQVTLGSVVAVIGCGPVGLGAIVTSLLYSPSKVIAVDADSNRLELARKLGATDTVRVNRERPLDAIEDVKKLTEGGFGVDVAIEAVGVPVTFSMALGIAAPGGRVANIGVHGAPVDFPLQDLWDKNIAVTLGIVSTHTIPLLLAALSEGKIDASQFVTHEFDLSDLERAYDVFSAAAQHNVVKVAIRA

SEQ ID NO: 7341 - protein, 761 aa, Magnetococcus sp. MC-1
MNREELLSKLALARQQGLKALDLSSLELTELPDEIGLCSNLESLDLSDNRLTTLPVALGHLDRLQLLDLRDNQLTDLPENLVKLQRLAFLRLGNNHLSKLPNVVCRLSGLRRLVLRGNRLSSLPPELGALTQLQELALHDNLLTALPETIDRLLHLETLLLPGNQLQTLPESFARLPALKRLDLARNRIMDLPPELGGLRHLAWLDLHHNSLPVPEAILDEVQEPSKIIAAYHKALASERRHLDEAKLMVLGDRGTGKSSLVARLLDGRFVADMHPTEGVSLRTWRFSDGQRRLRLNLWDFSGADHYFAAHPYFITPQGLILLVMDGAEPEPERRLARWMRIIRSLAGRQASVALICHRADRFPLELDWNEIRQRYPSIKVAVRRASSMTGEGIESVQQAITKLLDTFEPAQALYWRSWLDTKAIVEEINESHIPYRFYQALCRERGIHDGDQQEQLANRMHLLGSAVYFRNHPLAGSTDDLLDPAWLTQALYRPLGSKRIRDNGGVLERKELGQILDPGLHGSSKHALVLTWLRRFQICFPLLEEPGEEQAQAPHVERFLFPDLLPVNYTSVGMSRETLDFSYHYDHLPPALMGRLLVRFYPFLHSRTCWRDGLLLASEGGGNRALIQMDREAGTLRMRIWGQPKMRAVFLALLRLSLERLNSIWSDFEVQEKVPLAITGAEDVGYRHLHAMQKAGLERFLPVGVTEPIAISPLLETLELPPAPPPESRPLPNKPGRVTLKQRLQQRRMQAHEPTATPTH

SEQ ID NO: 7342 - protein, 215 aa, Pseudomonas aeruginosa PAO1
MSEKNPIVGLCQKASFLISAAQVDQCPPDEGLEVAFAGRSNAGKSSALNTLTHANLARTSKTPGRTQLLNFFALDDSRRLVDLPGYGYAKVPIPLKQHWQRHLEAYLSSRASLAGVFLMMDIRHPLTDFDRLMLDWAQASQLPIHVLMTKADKLAFGAAKNALLKVRREVQQGWGDVATLQLFSAPKRQGVDEAQMVLAQWLGLLDEEQEAFEEA

SEQ ID NO: 7343 - protein, 386 aa, Glycine max
MNALAATNRNFKLASRLLGLDSKLEKSLLIPFREIKVECTIPKDDGTLQSYVGFRVQHDNARGPMKGGIRYHPEVDPDEVNALAQLMTWKTAVANIPYGGAKGGIGCDPAELSISELERLTRVFTQKIHDLIGTHTDVPAPDMGTGPQDLGGSLGRDAATGRGVLFATEALLNEYGKSVSGQRFVIQGFGNVGSWAAQLISNKGGKVVAVSDITGAIKNSNGLDIPSLLEHSKVHRGVKGFNGSDPIDPNSILVEDCDVLVPAALGGVINRENANEIKAKFIVEAANHPTDPEADEILKKKGVVILPDIFANSGGVTVSYFEWVQNIQGFMWDEEKVNNELKTYMTKGFKDVKEMCKTHECDPRMGAFTLAVNRVARATVLRGWEA

SEQ ID NO: 7344 - protein, 320 aa, Schizosaccharomyces pombe 972h-
MINSKSKKKESNALVLKSLLREPYNKVCADCKRNEQPRWASWNLGVFICIRCSGVHRSLGVHVSRVKSVDLDSWTDEQTENMTRWGNERANLYWEAKLAGGHVPSDSKIATFIKTKYEFKKWVLYPEIPSPETLKPEQNTRPVSEVNASLDLNTASRSSSAHSVKSTSSATVTNVTSKKEAISATTSLAQSSPNLASLSKQPSTVHAPSTRQRDLKSSILSLYASPRPQVSSSSITTNATYQNLPSPVSTSTTSSQPYGAFHQPATTGSSFVADKWKMPMFTSNVTSAQPSARASPVQSNSSRPRSSLDSKIINSHDVWK

SEQ ID NO: 7345 - protein, 376 aa, Zea mays
MADEDIQPIVCDNGTGMVKAGFAGDDAPRAVFPSIVGRPRHTGVMVGMGQKDAYVGDEAQAKRGILTLKYPIEHGIVNNWDDMEKIWHHTFYNELRVSPEDHPVLLTEAPLNPKANREKMTQIMFETFECPAMYVAIQAVLSLYASGRTTGIVMDSGDGVSHTVPIYEGYTLPHAILRLDLAGRDLTDHLMKILTERGYSLTTSAEREIVRDIKEKLAYVALDYEQELETARSSSSVEKSYEMPDGQVITIGSERFRCPEVLFQPSLVGMESPGVHEATYNSIMKCDVDIRKDLYGNVVLSGGSTMFPGIADRMSKEITSLAPSSMKVKVIAPPERKYSVWIGGSILASLSTFQQMWISKGEYDETGPGIVHMKCF

SEQ ID NO: 7346 - protein, 906 aa, Pseudomonas syringae pv. syringae B728a
MNSLALHTPRITASTCCYCGVGCGVLIEHDGEHILGVSGDPKHPANFGKLCSKGSSLHLTGDIEARALYPELRLSKGLARSVTHWDTALEHAANVFAQTIREHGPDSVAFYISGQLLTEDYYAFNKLARALIGTNNIDSNSRLCMSSAVAGYKRSLGADAPPCSYEDIELSDCVMIVGSNMAYAHPILFRRLEEAKNHRPQMKLIVIDPRRTDTCELADLHLAIQPGTDVALFHGILHILMSERLIDPAFIAAHTQGYEELATLVHDYPPEHVAALCGITLEQLHTCARWVGEAPAFLSLWCMGLNQSTAGSAKNSALINLHLATGQIGKPGAGPFSLTGQPNAMGGRETGSLSNLLPGHRDAANPQHRQEVADYWGVDSLPASPGLSAIELFEQMQNGTIKALWIACTNPAQSLPDQNRIRQALETCPFVVLQEAFKTTETARYADLLLPAASWGEKEGTVTNSERRISNVRKAIQAPGEARSDWAITVDFAQRLQQRLQPDAPALFDFATPKALFDEFKGLTVGRDLDMSGIDRELIDQQGPQQWPFPRGASSGTQRLYSEGIFPTDSGRAQFLSEPYIAARELRDADYPLTLNTGRLRDQWHGMSRTGTAARLFGHVSEAVLSINPQDMLSHDLQPGDLVKLISRRGELLLPVSSEDSVAVGQAFVPMHWGDRFLKGGVNVLTQPAFDPISKQPELKHAGVRIEKAHLPWQFFALVEGNVQQRMETLRALCDTFTYLSMGLAGRGRPALVIRAASAEAPDSALLQQIDRVLGLDEGPVMAYDDPKRSIGKRVRIDDDRITAIRLAGETLARHWLQTLWLEERVEASLRRWLLAPLSSEPGKDSTQTRDKTLCNCMNVSQNAVMSAIERGLDLNQLKTQLGCGTQCGSCVPEIRRLIHTVAVTE

SEQ ID NO: 7347 - protein, 216 aa, Festuca arundinacea
MDAAVAASLSLQSGEQEYRTVWSEPPKPRSGRTKFQETRHPVYRGVRRRGRAGQWVCEMRVHGTKGSRLWLGTFDTAEMAARAHDAAALALSGRDACLNFADSAWRMQPVLPAGAGSVCFGGAQEVKDAVAAAVEAFQEEEHHVESTAETAKDEESALSMSSDLSEHDDERWIDGMDAGSYYASLAQGMLVEPPDAGAWREDGEHGGVETSLWSYL

SEQ ID NO: 7348 - protein, 100 aa, Zea mays
  misc_feature (38)..(38): Xaa can be any naturally occurring amino acid
GPPPKFGEKCKFPGEGSPPRSLRYLGSRVVDVLRPFLXGGIFLSPAAQRSPNGKFRVLYEVFPMSFLRDQAGGRAFPGKQRALELAPVKLPARSPVFLGS

SEQ ID NO: 7349 - protein, 535 aa, Mycobacterium sp. MCS
MSFASPYPAVQIPTTSVYDYLFSDLSDTDAQRVALIDTPSGNRMTYGEMLARIDAFAGALADRGIGVGDVVGLLAPNSSAFAIAFHGILRAGATATTVNALFTAKDIANQLADSRATMLVTVTPLLAHAAEGAAAVGLADDRVIVLDGPGAAADGHPNAADLLGPGFAPPEVSFDPATHLAVLPYSSGTTGNPKGVMLTHRNLTANVAQIRPVQGMTADDRILAVLPFFHIYGMTVLLNAALHARAALVIMPRFDLTEFLANIADHKCTYAFIAPPVAVALAKHPLIDEYDLSSLQGIMSGAAPLDADLGHAVAERLGCAVVQGYGMSELSPVSHVTPFDGGVGLVGSAAPLASSGWTVPNSESRITDPETGAEIDIPPSGMSATGELWFRGPNVMAGYLNNDEATRETIDDEGWLHTGDLAQVDAQGCVYIVDRLKELIKYKGYQVPPAELEAVLLSHDAIADVAVVGVVDTESGEEVPKAFVVRRPDASLTEAEVMEFVAGQVAPYKKVRKVEFIDAIPKSASGKILRKDLRH

SEQ ID NO: 7350 - protein, 107 aa, Neisseria meningitidis MC58
MDNCIFCKIAAKDIPAQTVYEDGEMVCFKDINPAAPVHLLLIPKVHFDSLAHAAPEHQMLLGKMMLKVPEIAKAAGLADGFKTLINTGKGGGQEVFHLHIHIMGTPV

SEQ ID NO: 7351 - protein, 107 aa, Neisseria meningitidis MC58
MGDSVLSAIQQTITQRKSANPSESYVAQLLHKGEDKILKKVIEEAGEVLMASKDKNPSHLVYEVADLWFHTMILLTHHDLKAEDVLDELARRQGLSGLVEKAARTES

SEQ ID NO: 7352 - protein, 354 aa, Neisseria meningitidis MC58
MKAARFYDKGDIRIEDIPEPTVAPGTVGINVAWCGICGTDLHEFMEGPIFIPPCGHPHPISGESAPVTMGHEFSGVVYAVGEGVDDIKVGQHVVVEPYIIRDDVPTGEGSNYHLSKDMNFIGLGGCGGGLSEKIAVKRRWVHPISDKIPLDQAALIEPLSVGHHAYVRSGAKEGDVALVGGAGPIGLLLAAVLKAKGIKVIITELSKARKDKARESGVADYILDPSEVDVVAEVKKLTNGEGVDVAFECTSVNKVLDTLVEACKPAANLVIVSIWSHPATINVHSVVMKELDVRGTIAYCNDHAETIKLVEEGKINLEPFITQRIKLDELVSKGFERLIHNNESAVKIIVSPNL

SEQ ID NO: 7353 - protein, 310 aa, Zea mays
MYFPIAPFTFSLPHRPRILARWTEGQRQNPSVCIECRHSPTNDGHATHAQPEASSPAASVQNPLDNNIDASWMLPDYSILPSQDNYYRNLMNQDDTDNLGLEDCVQVDPLVANMNSQTKPKGRSKNFTDDEDILLLSVYLNVSKDPTAGRDQKDSRFWERIEKYYHVNLTFESDRNCSSLRHRWGIIQKEVSLFQSYYEAIQRKNESGKTMNDKISDAKAMFQTLRKKAFTLFHAWNILRHEPKWSSIKDSTMATKKLDPHNGNEDDGHDTPRPPGRKAEKEKLRARKQEDNDNDALMEELKKLESQDWR

SEQ ID NO: 7354 - protein, 242 aa, Zea mays
MGSKASFRVTLLLLLLVAAAAAWGPAAQADDAAELPDHRAITLKEQVSSTEIPVRLKSGSPLCSACEDFTGKAVSYISEKQTQDKVMGFLHDACSQSFSFEQKCDELMDSYATLLFAKITEIKPEAFCKQYGLCRGTALFSGVTSDSTCVFCHHLLDEVMSKLKDPDAEFEIIQILIKECNKIEGHVQQCKRLVLQYIPLILVNGEKFLEKNDVCALVQACPATHKKTFSSVLKGALLLSDA

SEQ ID NO: 7355 - protein, 602 aa, Zea mays
  misc_feature (177)..(177): Xaa can be any naturally occurring amino acid
MASISGAAAPPSSAVCRLRLRRHLLLRPSHLRLRAPHSIADLSRSSNSAPSPARPALGSGPENGSGGVRAVEKDPIKLWERYVEWLYQHKELGIFVDVSRMGFTEEFLRQMEPRMQQAFVDMRELEKGAIANPDEGRMVGHYWLRDPALAPNSFLRNKIETALDRILAFSQDVVSGXGIGGSALGPQFVAEALAPDNPPLKIRFIDNTDPAGIDHQIAQLGPELATTLVIVISKSGGTPETRNGLLEVQKAFRDAGLQFSKQGVAITQENSLLDNTARIEGWLARFPMFDWVGGRTSEMSAVGLLPAALQGIDIKEMLVGAALMDEETRNTVVKANPAALLALCWYWASEGIGKKDMVVLPYKDSLLLLSRYLQQLVMESLGKEFDLDGNRVNQGLTVYGNKGSTDQHAYIQQLREGVQNFFVTFIEVLRDRPAGHDWELEPGVTCGDYLFGMLQGTRSALYANDRESISVTVQEVTPRAVGALIALYERAVGIYASLVNINAYHQPGVEAGKKAAGEVLALQKRVLTVLKEAICENPTEPLTLDEIADRCHCPEDIEMIYKIIQHMAANDRALIAEGSCGSPRSVKVYLGECSVDEDMQAA

SEQ ID NO: 7356 - protein, 339 aa, Methanococcus maripaludis S2
MRNTPKICVINGDGIGNEVVPETVRVLNELGDFEFIHAHAGYECFKRCGDAIPENTIEIAKESDCILFGSVTTPKPTELKNKSYRSPILTLRKELDLYANIRPTYNFDNLDFVIIRENTEGLYVKKEYYDEKNEVAIAERIISKFGSSRIVKFAFDYAVQNNRKKVSCIHKANVLRVTDGLFLEVFEEMSKHYEKLGIKSDDYLIDATAMYLIRNPQMFDVLVTTNLFGDILSDEAAGLIGGLGMSPSANIGDKNGLFEPVHGSAPDIAGKGISNPIATILSAAMMLDHLKMNKEAEYIRKAVKKTVECKYLTPDLGGNLKTFEVTEKIIESIRSQMIQ

SEQ ID NO: 7357 - protein, 495 aa, Chlorobium tepidum TLS
MKNSFRKKPLSLLLEEMKSEHRLNRVLGPLALTSLGVGAIIGTGIFVLIGVAAHDKAGPAVTLSFALAGLACVFAALCYAEFASMAPVAGSAYTYAYATLGELFAWIIGWDLILEYAVASATVAHGWSHYFQDFMGIFGLHIPEIFSRAPLDFDPATGSLVLTGSMFDLPAVIIVLIVTVILVKGIRESAGFNTAMVIVKVAIVLLVIVLGAQYVKPENWQPFAPFGYSGLSVFGHTILGETGAGGAPVGVLAGAAMIFFAYIGFDSISTHAEEARRPERDVPIGIIASLIICTMLYVAVAAVITGMVPYDQINIDAPVSYAFKQVGLDWAQFLVSLGAITGITSVLLVMMLSQPRIFLAMARDGLLPNKFFGVVHPKFKTPWNATILTGIFVAILGAFLPLRLLAELVNIGTLFAFVVVCAAVLIMRRTNPDAERPFRAPLVPFVPIAGILTCLLLMFSLPAENWWRLIVWLLIGFCIYFFYGRHHSVLNQHHD

SEQ ID NO: 7358 - protein, 228 aa, Triticum aestivum
  misc_feature (6)..(6): Xaa can be any naturally occurring amino acid
  misc_feature (18)..(18): Xaa can be any naturally occurring amino acid
  misc_feature (22)..(22): Xaa can be any naturally occurring amino acid
GVIGKXSREHICWNSMLXWLQXVLQPGTGYNFKADIWSFGITALELAHGHAPFSKYPPMKVLLMTLQNAPPGLDYDRDRRFSKAFKEMVAMCLVKDQTKRPTAEKLLKHSFFKTAKPPESTMKGMLTDLPPLWERVKALQLKDAAQLALKKMPSSEQEALSLSEYQRGVSAWHFDIEDLKAQASLIYEDEPSETKEDDVAARIIESEKSLYSRTPSGQSSSANENTLQ

SEQ ID NO: 7359 - protein, 466 aa, Yarrowia lipolytica CLIB122
MHSLLRAAQIARVARPGVKRAMTPAVRFYSDKKTEKSDQPFQSSLLNDDLLAQAGMDVDESKGKSKPAAEGKSEGAAEGATEDDVTDEQRARWAGTAKKSTDQTSKQESRERIAGYGYYAFFAGSAAFAAYLARDWDNEEDKKKHDTIGQGYTPMLMWARLKARIGDTFSFYRDPVAPVLLPDPPAPPYQRPLTLVIALDDLLVHQEWSREHGWRVAKRPGVDYFLGYLGQYYEIVLFSSQYMANCEKLIMKLDPYHAWFSHVLTREHTTYEDGKLVKDLSLMNRDMGKIIIIDPDTGCTMKQPENSIPIEPWKGTPGDKELVKLIPFLEWLVSQNVNDVRPILKAFDGTYLPDEFTRREAIAREKFEKDWYAKHGKDGQWASKFLGVSEPKQQKPLMPHDVMRREGQKQYQKFLEYLAVEGPKLKAEEERMIAEQKAMGPKNLSEAVSSIGSLPPVPQQPTEPKA

SEQ ID NO: 7360 - protein, 737 aa, Oscillatoria chalybea
MTDSTKTLCPYCGVGCGLEVSPPARSGKPVNRDSQGYPVWKVQGDREHPSSQGMVCVKGATIAESLHKDRLLYPMMRESLDKPFRRVSWDEALNAIVNRIQTVRFTQGAEAICMYGSGQFQTEDYYVAQKLMKGCLGTNNFDANSRLCMSSAVAAYIQSFGSDGPPCCYDDLDLTDCAFLVGTNTAECHPIIFNRLRKHHKKNNGKVKMVVVDPRRTATAEAADLHLAIKPGTDIDLFNGMAYLLMRWGKIDTIFIDECTSNFPAYCEVIRHYPPEVVARKCGITVEELETAARYWAESERVLSLWSMGINQSSEGTAKARTLINLHLMTAQIGKPGAGPFSLTGQPNAMGGREAGGLSHLLPGYRVVKNARHRSEVEKFWGLPVGRIAPERGLTVWEMILGLEMGKVGLVWIAATNPAVSMPDLERTKKALSRSPFTVYQDAYYPTETANYAHVLLPAAQWSEKTGVMTNSERRITLCQAFRDRPGEAKADWEIFAEVGRRLGFVEQFNFANSAEVYAEFTQLTKGRPCEQTGIGHQRLGADGPLQWPCPEEAGENNAARLYTDLRFHTPDGRAKFAAYHSRGLAEPPDPDFPFVLTNGRLYGHWHTLTRTGRIEKTKQMHPQPFIEIHPRDAGKLGIEDEDWVEVRSRRGMARFPAKVTKAIAPGTVFVPMHWGELWADSAEANAMTHPESCPDSLQPELKACAVQLVPITADIKATNSLLETAKSSMLSATPSV

SEQ ID NO: 7361 - protein, 151 aa, Oscillatoria chalybea
MGFFRDVSRKISRVSKDEEFLGFIKVIESLVSKVQSLAMILVILVATADLIILLAQDIFASPTGFYYQSLVKLFGLFLNILIALELLDNITAYLRKHVVQVELVIVTSLIAVARKIIILDLDKVDGTELVGLASLFLLYRLVIGSFVLSRI

SEQ ID NO: 7362 - protein, 560 aa, Synechococcus sp. RS9916
MAMITERITDDLDRLLALLPAPLQVALEPASSRDQLLEVVLDLGRVPEARYPGRSMPLGDICLSREELLATVERLGQFGADNRAGIERTLHRISAIRNRRGDVVGLTCRVGRAVFGTVAIVRDLLDSGESLLLMGRPGVGKTTALREIARVLADELGKRVVVIDTSNEIAGDGDIPHPAIGRARRMQVARPELQHQVMIEAVENHMPEVIVIDEIGTELEAQAARTIAERGVMLVATAHGNALANLIKNPTLCDLVGGIESVTLGDEEARRRRSQKTVLERAAEPTFPLAVEMHQRHRWAVHPDVGATVDLLLRGHAPRAQLRELSPDGQVRLVEIEPAGTGPRRPQTPPSPSPGLLRDKPVLAVVPSPDPAADPVGSDLSLAEGEAVSLQDDGEGAEFDGLQVLCCGLTPRLVEEATRRHDWPVRLVEELEQADVVLSVRQGMGQQPGLRRQAREARVPILVIKSDTLAQVERALERLLARRADQTPPASSEDRADAFAALEECRLAVEQVVVPLGRPVELLPRTEEVRRMQADLVERYRLRSDVFGQADQRRLRVFPP

SEQ ID NO: 7363 - protein, 339 aa, Zea mays
MLQGSEVMGECEDGKEYRCWEELLPDALGLIFRNLPLQEVLTVLPRVCKSWGRVVAGPYCWQEIDIEEWSQQQGKPEQIARMVELLVGRSAGSCRRISVSGLPCDPRFSFIGDNARALRTLEIPRSEISDSMVESVAPRLPNVTFLDISSCTKMGARGLEAFGKHCKSLAGLRRVMHPIDLADRACQHDEAHAIACSMPRLRHLEMGYMLVATEAVAEILGRCRELRFLDLRGCWAVDDKLLPRDRHPGLRVLGPRVDDCYENSYWEECSDDYSDDSSIYSWELMDDVDDDYDYAAGSDDDDDEAVWDDDGQGLENLEVRFYGGGFGETFAGFDWPPSP

SEQ ID NO: 7364 - protein, 436 aa, Streptococcus pyogenes MGAS8232
MMSLPKEFINTYQAILGKELEDFLASFNQEPVNAFRINPLKNQLKTFEHPIPNTLWGYYGKLSGKSPEHVSGLVYSQEPAAQMVAQVAAPQKGSRVLDLAAAPGGKSTHLLAYLDNTGLLVSNEISKKRSKVLVENIERFGAKNVVVTNESADRLAKVFSHYFDTIVFDGPCSGEGMFRKDPDAIQYWHHGYPAECAKLQKSILEDALTMLKPGGELIYSTCTWAPEENEDVVQWLLETYTFLELVDVPKLNGMVSGIGLPETARMYPHRYQGEGQFVAKLKDKRQEGQSTKLKAPKSNLTKDQLRLWKMFEKDHLNLTLSGTLQTFGDYLYLLPDGLPALDGLKIARNGLELGVFKKKRFEPSYALGLALKPDEVRSSIELREEDFRPYVSGNVITLPQSYPTGWYQLLINGNGLGFAKVVDKTIKNNFPKGLRF

SEQ ID NO: 7365 - protein, 409 aa, Pseudomonas syringae pv. syringae B728a
MTKLKLVMIGNGMAGVRTLEELLKLSEDLYHITVFGAEPHPNYNRILLSPVLAGEQNFEDIVLNDLDWYQRNGIELLLNRRVVKIDRIKRLVIADDGTQAHYDRLLIATGSRPFILPIPGNTLNGVIGYRDISHTRQMIDTAVTHKRAVVIGGGLLGLEAANGLSLRGMQVTVIHNGQTLLERQLDKTSGRMLQAALEKRGLSFRLDEQTNALLGDDQGRVTAVQFNNGDRIDADLVVMAAGIRPNTELAEQAGLPCNRGILVNDTLQTYDPRIYAIGECVSHRGIAYGLVAPLFEQARVCANHLAQLGFARYPGSVTSTKLKVTGIDLFSAGDFLGGEGTESITLSDPIGGVYKKLVIKNDVLVGACLYGDTADGNWYLQQIRDGQGIDAIRDHLMFGKPAAAQAACA

SEQ ID NO: 7366 - protein, 584 aa, Arabidopsis thaliana
MPTISVGRDRLFAALGESYTQEKFEELCFSFGIELDDVTTEKAIIRKEKHIDEEADDDEEIIYKIEIPANRPDLLCLEGLAQSLRVFIEKQEIPTYTLADISKDKILQMNVKPETSKIRPFVVCAVLRGVTFDEARYNSFIDLQDKLHQNICRRRSLVAIGTHDLDTLQGPFTYEALPPTDINFVPLKQTKSFRADELIEFYKSDMKLKKFLHIIENSPVFPVLYDSKRTVLSLPPIINGAHSAITLQTKNVFIECTATDLTKAKIVLNTMVTTFSEFCARKFEIEPVEVTYDDGKSYIYPDLAVYDMEVPLSFITDSIGVSLKVEQVTSLLTRMQLQAEQAKSSDNQCAIKVHVPPSRSDVLHPCDVMEDVAIAYGFNNIPTRKPASIKPLTLNELTDLLRIEIAMCVYTEVVTWLLCSHKENFAMLNREDVNSAVIVGNPRSADFEAMRRALMPGLLKTVGHNNKYPKPIKIFEISDVVMLDESKDVGASNRRHLAALYCGATSGFELIHGLVDRIMEVMAIPFLTIHENNVPINEKDGYYVKLSQEPEFLPGRQASIIVRGKHIGNFGIVHPEFPSGFEQL

SEQ ID NO: 7367 - protein, 256 aa, Synechococcus sp. RS9916
MLDRPLLVFDFDGVIVDGMNEYWWSASAACAQLTGSQPPSSSEGVPAAFRALRPWIHHGWEMVLMAALLQDRDGLLQRLGVNAFVEAYSDHCSQALQARGWTAPQLQQALEQVRQDAVASHRGDWLARHQPFSGVPERLRSLADDGVDWAVLTTKGRRFTAELLDGFDLHPSLLFGHEDGTKPEVLLRLKSQRPLRGFVEDRRPTLETVLATPGLEAVPCFLADWGYLRPVDRDGLPQGIALLGLSRLASPLAEWP

SEQ ID NO: 7368 - protein, 216 aa, Bordetella pertussis Tohama I
MFPKRLTDGYHAFLQGRFHSERSRYEALAEKGQKPEILLIGCCDSRVSPEVIFDAGPGEIFVVRNVANLVPPCEPDAESSFHGTSAAIEFAVNGLNVKHIVVLGHASCGGIRSFYDDGEPLSKMDFIGKWMSQISPVAERLGPSTGDRATDIKRLELAVVEESLRNLMTFPSISSRVERGELELHGTYFGVATGLLYVLDRATGQFAPWLEEDAAA

SEQ ID NO: 7369 - protein, 520 aa, Mycobacterium sp. MCS
MTTTEPAPPESATGRPSPRWRALLLAAVAACAACGLVYELALLTLSSTIHGGGIVATSLIVAGYVAALGAGALAVKPLLGHAAITFVAVETLLGVIGGLSAAALYVTFAFIGGSTWVLVVGTALIGGLVGAEVPLLMTLLQRGRTAGAADSGRVLANLNAADYFGALVGGLLWPFLLLPHLGMIRGAAATGVINLVAAAVVAVFLLRHIVSGRQLAVALGALSAALVLLVTLLIRADGIETTTRQRLYNDPIVAFARSPYQEIVVTRRGDDLRLYLDGGLQFSTRDEFRYTESLVHPALGQGARSVLVLGGGDGLAARELLRQNQIRDITQVELDPAVIDLARTTLREANRGALDDPRVTVVVDDAMTWLRGVDRTFDAVIVDLPDPDTPVLGRLYSTEFYALVTRALAPDGLMVVQAGSPYSTPTAFWRTVSTIESAGFAVTPYHVHVPTFGDWGFALARRGPTPPAPTVPEGVGPLRFLNQEVLDAATVFSADVARQRLEPSTLEHPRIVDDIRKGYR

SEQ ID NO: 7370 - protein, 153 aa, Zea mays
  misc_feature (72)..(72): Xaa can be any naturally occurring amino acid
GRVGAASTRHYLLRSIINGHPTLQSLVLTDADGQGTLCMGAKQLEEFRENQLSTSACSNRTQVPACNMEHTXLHVAGWDLKLKYAPYVELPGGMALQGATLVAIKPSPEGSNGSHPNRKEAEGFVFGAFDGPFKAAVKALMKRRTYLLEMNGF

SEQ ID NO: 7371 - protein, 320 aa, Zea mays
MSGAASVERVKDRDIGLDKFVLREARGSSVEVYLYGGQVTFWKNNFGQQLLFVSNKLGNHGVLEQHGFARNRFWSVDESPPPFPVATSNCHVDLILKSSPEDLKIWPHSYEFRLRVALTPRGDLILTSRIKNISSDSKPFQFTFAYHTYFSVSDISEVRVEGLETLDYLDNLQSKKRFTEQGDAVVFESEVDKVYLSAPPKVVIIDHEKKRTFVLRKEGLPDVVVWNPWDKKDEEYKSMLCVGAAAIEKPVTLKPGEEWIGKQEISAVPSSYSSGQLDPELIRRMHNIKFTRDCIDPTFQTSLCFFFNSEAALGLESSPC

SEQ ID NO: 7372 - protein, 957 aa, Hordeum vulgare subsp. vulgare
  misc_feature (467)..(467): Xaa can be any naturally occurring amino acid
MKIPFVTKWSHRSSEPAGPSNSAAAQQQQPPPLSPSAPSRSPPVASTEAAGDEFILQEEEYQMQLALALSASASGAEGAGDPDGEQIRKAKLMSLGKGDPVTNSDLGGGYTAESLSRRYRDYNFLDYNEKVIDGFYDIFGPSAESSGHGKIPSLAELHMSIGDLGYEVIVVDYKFDNALQEMKEVAECCLLGCPDITVLVRRIAEVVADHMGGPVIDANEMITRWLSKSIEQRTSHQTSLLHIGSIEIGLSRHRALLFKILADMVGIPCKLVKGSHYTGVVDDAINIIKMDNKREFLVDVMAAPGTLIPADVFNSKGTPFNFSQTLGQNQVVESASNIEDDPVALQSEHEHYQGHMFANNDRVSDNLSSYENTMTAGSSASEPGTLGKASTLAGAPSKQKKNLQLIPDSHEIDESRNLFAEFDPFNATESGKSSLAFKGLNNRNSDFRRRRENVVPPSARSQQPLVXKNWSACNDISNNKQYNVADGSVPRRNATDNASSSQLALSTAKHYNPNVRELNDRMYAAPARNYDNRIIGTSAMAKASTGDCLDRSQVPPGLYYDKMLGTSSMNTASSSGIGKVAEKDLQNDLEKGPIYSRFDGELSKNAQGFTPERDEHKENCGSYDHRMLHPDPRKSPLDRFMDRPRQNIECVSPSQVGSSKVDLVLDEVSECEILWEDLVIDERIGIGSYGEVYHADWNGTEVAVKKFLDQEFYGDALEEFRCEVRIMRRLRHPNIVLFMGAVTRPPHLSIVSEYLPRGSLYKIIHRPNCQIDEKRRIKMALDVARGMNCLHTSVPTIVHRDLKSPNLLVDDNWTVKVCDFGLSRLKHSTFLSSKSTAGTPEWMAPEVLRNEQSNEKCDIYSFGVILWELATLRKPWHGMNQMQVVGAVGFQDRRLDIPKEVDPIVASIIRDCWQKDPNLRPSFIQLTSYLKTLQRLVIPSHQETASNHVPYEISLYR

SEQ ID NO: 7373 - protein, 795 aa, Escherichia coli O6
MKFSELWLREWVNPAIDSDALANQITMAGLEVDGVEPVAGSFHGVVVGEVVECAQHPNADKLRVTKVNVGGDRLLDIVCGAPNCRQGLRVAVATIGAVLPGDFKIKAAKLRGEPSEGMLCSFSELGISDDHNGIIELPADAPIGTDIREYLKLDDNTIEISVTPNRADCLGIIGVARDVAVLNQLPLVEPEIVPVGATIDDTLPIAVEAPDACPRYLGRVVKGINVKAPTPLWMKEKLRRCGIRSIDAVVDVTNYVLLELGQPMHAFDKDRIEGGIVVRMAKEGETLVLLDGTEAKLNADTLVIADHNKALAMGGIFGGEHSGVNDETQNVLLECAFFSPLSITGRARRHGLHTDASHRYERGVDPALQHKAMERATRLLIDICGGEAGPVIDITNEATLPKRATITLRRSKLDRLIGHHIADEQVTDILRRLGCEVTEGKDEWQAVAPSWRFDMEIEEDLVEEVARVYGYNNIPDEPVQASLIMGTHREADLSLKRVKTLLNDKGYQEVITYSFVDPKVQQMIHPGVEALLLPSPISVEMSAMRLSLWTGLLATVVYNQNRQQNRVRIFESGLRFVPDTQAPLGIRQDLMLAGVICGNRYEEHWNLAKETVDFYDLKGDLESVLDLTGKLNEVEFRAEANPALHPGQSAAIYLKGERIGFVGVVHPELERKLDLNGRTLVFELEWNKLADRVVPQAREISRFPANRRDIAVVVAENVPAADILSECKKVGVNQVVGVNLFDVYRGKGVAEGYKSLAISLILQDTSRTLEEEEIAATVAKCVEALKERFQASLRD

SEQ ID NO: 7374 - protein, 220 aa, Xylella fastidiosa Temecula1
MHSLEHLLQNNRNWCERINQEDPEFFARLSKQQSPEYLWIGCSDSRVPANQIIDMAPGEVFVHRNVANVVVHTDLNCLSVIQFAIDVLKVKHILVVGHYGCGGVLASLTRARLGLVDNWIRHVTDVAEKHNPYLETLGALADQHARLCELNVLEQVMNVCSTSIVRDAWSRTQPLSVHGWVYSLSNGLVHDLGIDVDRFEMLPSCYADALARIQADRVVR

SEQ ID NO: 7375 - protein, 484 aa, Nostoc punctiforme PCC 73102
MHLNELETTENLKEVEEAWLTLEKSILYYQGRPVGTVAAYDASVEALNYDQCFVRDFVSSALIFLIKGRTDIVRNFLEETLKLQPKEKALDAYKPGRGLIPASFKVVSENGQEYLEADFGEHAIARVTPVDSCLWWIILLRAYVVATEDFSLAYQPEFQNGIRLIMEICLANRFDMYPTLLVPDGACMIDRRLGIYGHPLELQVLFYTALRASRELLVCQGNSDIVAAIDNRLPLLCAHIRQHYWIDINRLNEIYRFKSEEYGKGAVNLFNIYVDSVPYYELDKWLPKKGGYLAGNVGPSQLDTRFFSLGNLMAIISDLATEEQAQAIMTLIEDRWDDLVGDMPMKICFPALEHEEYRIVTGCDPKNIPWSYHNAGSWPVLMWMLAAAAVKTNKISLAQKAIQTAQGRLSTDQWPEYYDGKKGRLIGKQARKYQTWTITGFLLAKELMANPTYLPLISFGKLPAEQVSRACEFEIASVDPYMPR

SEQ ID NO: 7376 - protein, 537 aa, Aspergillus oryzae
MSATSAAMPKAAAIPARLLRSTSRQYSKSPATSVRAYHASPTSSTDRRVRCDATNKKQPVFSSSRIFHTTAPLAAIPDPYKVLGVEKNASAGDIKKAYYGMAKKYHPDTNKEANAKEKFAEAQSAYELLSDPKKRENYDRFGSAAFDQNGGFDPSAAGGNPFAGAGGFHGFGGGFGGGFPGGFGGADINFEDLFGAFAGGARRAGRGRRGPFQEILVGEDIEVQTNISFMEAAKGTTKDIVITPLTPCGTCSGDGLKKGAKRTQCRQCNGSGTRVHFMQGGFQVAATCDACGGAGMSVPRGSECGSCNGNGVVRGKKTVQVDIPGGVEDGMRLRVSNEGDAPPTGTSAAPGARTQRGDLYVSIRVSPDHRFSRSGSDILYTAQIPLTTALLGGEVTVPTLDGEVKIKVGTGTGTGDKVTLSGMGMKRLGSRTSRFSPTGDLKVEFKVAMPKYLTGNQRTILEVLADEMGDKTAKRVMNVGKDSPPSGGDASTGGSNNEGFLKSAWHKLVNKCENSPEESNKKESGNSSKNDGEKKSN

SEQ ID NO: 7377 - protein, 363 aa, Oryza sativa
  misc_feature (338)..(338): Xaa can be any naturally occurring amino acid
MGNIFHIWWNLMGIHNVLKKQNFHPFGAPTNYQPYGNSTPSFNGFQQQAHWLQSTPMSFQGFRPPENCVYSPNQIVGSASSHGSESASQCPARHEENNVVNIEESSDNSEEAGRRGTRVNWTKEENIRLLSSWLNNSVDPIKGNDQKSEYYWKAVAAEFNSNTSRSNRKRIAVQCKTHWGGVKKEIGKFCGAYSRVRRTFRSGYSDDMIMEKAHIIFKSENNEKPFTLEYMWRELKDQPKWRRVLEEDSKNKRTKISETGAYTSSSNQDTEEETSRKEKRPEGQKKAKAKLKGRGKNAAPSPLGDQPCQDFVLYNEAIKLKAEAMLKSAEAASKAAEXAKKEQTRMEKYQTYLRLLDKDTSNF

SEQ ID NO: 7378 - protein, 385 aa, Triticum aestivum
MEGGDARNGLTGTSQTTGSGVESPAKPLPPCCVKARAAAPESEAKCHATVVSGWFTETRSRCGKASKLQYYNNPMWPGETHSLKVDKILYQGKSPYQEVLIFESLTYGKVLVLDGIVQLTDKDECAYQEMITHLPLCSIPSPKKVLVIGGGDGGVLREIARHGSVESIDICEIDQLVIDVCKDFFPDLSVGFEDPRVRLHVGDAVEFLRNSPEGTYDAIIVDSSDPIGPAQELVEKPFFETIARALRPGGVLCNQAESMWLHTHLIQDMLSICCETFKGSVHYAWASVPTYPSGAIGFLLCAKEGRPVNFLAPINPIEKIEGAMTAGRDIRFYNTEMHRAAFVLPTFAKRELEAYSCSTIGAQQEEKSAEPAKVAVAPHSEILTA

SEQ ID NO: 7379 - protein, 575 aa, Triticum aestivum
MAAASPPPSPPHPKRPKMSSSSDPEPEPTSLSAAGADPGQPRRRYKRRKVAIILAYCGAGYQGMQKNPGARTIEGDLEEALYQAGAVPEADRAAPARYEWARAARTDKGVSAAAQVVSGRFYVDPPGFIDRLNAKLAPQIRAFGYVRVTNSFSAKKFCDRRRYVYLLPVLALDPSAHPDREAVKASAGSENQLAKCVECSERGRKVPDIMGREGKLPDSEEEKVLDTPGEETVASHGELGDAKSVPASPVTETCDGETRLGGDVMIDITSSGNGTEAQNAELGSNGAGKCDIETAVGNCHSEAVPTSASETICSDSTLGSVDVVASVVAEKENNFEPADSEKERMQAINIQKENGEESPLLKNTFAYTDEVKEKFNRILKHYVGTRNFHNFTTRTKAEDPAAKRYIISFTANSVVSLDGIDFVRCEVVGQSFMLHQIRKMVGLAVAVMRNCAPESIYDVAFRKDIRLNVPTAPEVGLHLDECMFTSYNSKWMDTHEAVSIEPYAEEAEEFKIKYIFPHIAAMEHKEGAVALWLHALNSRNYPDFRYMETAGSEAKVGAEVENMEEVQMPSNNISE

SEQ ID NO: 7380 - protein, 310 aa, Methanococcus maripaludis S2
MFKTEPFIEESIEEIRKQINNRKTIIALSGGVDSAVAAVLTDRAVGDKLLAVYVDTGLMRKNESEEIWKIFKEQMGLNLKIVEAKDIFLKELEGVIDPEEKRKIIGRLFIEVFEKVAEEQGEEVLVQGTIAPDWIESEGQIKTHHNIALPGGMVLDVVEPLRELYKDEVRLLAVALGLPDQIAHRQPFPGPGLAVRILGEITDEKLAICKEANFIVSEEIEKTELKNELWQYFAAVLDTKATGVKGDIRDYNWVVALRFVSSLDAMTAHTPEIPFDLIKKISKRITSEIPNVTRVVLDVTDKPPATIEFE

SEQ ID NO: 7381 - protein, 161 aa, Novosphingobium aromaticivorans DSM 12444
MTVGQLIKSFTLWEFVKAHWLTLKYFFKPKATINYPFEKNPLSPRFRGEHALRRYPNGEERCIACKLCEAVCPAQAITIEAEPREDGSRRTTRYDIDMTKCIFCGFCQEACPVDAIVEGPNFEYATETREELLYDKAKLLSNGDKWERAIAANLEADAPYR

SEQ ID NO: 7382 - protein, 718 aa, Rhizobium leguminosarum bv. viciae 3841
MGGKSEMTILLCVIACGLLSVVYAAWATRSVLAADQGNSRMQEIAGYIREGAQAYLTRQYRTIAIVGVVVFILAWLLLSGEAAIGFLIGAVLSGAAGFIGMHVSVRANVRTAQAASVSLSAGLDIAFKSGAITGMLVAGLALLGVSIYYTVLTIGLGHESGSREVIDALVALGFGASLISIFARLGGGIFTKGADVGGDLVGKVEAGIPEDDPRNPATIADNVGDNVGDCAGMAADLFETYAVSVVATMVLAAIFFAGAPILQSAMVYPLAICGACIITSIIGTFFVKLGSNGSIMGALYKGLIVTGLLSIVGLGAATSLTIGWGSIGSVGGADISGANLFFCGIIGLVVTALIVVITEYYTGTGKRPVVSIAQASVTGHGTNVIQGLAVSLESTALPAIVIVGGILATYQLGGLFGTGIAVTAMLGIAGMIVALDAFGPVTDNAGGIAEMAHLPPEVRKSTDALDAVGNTTKAVTKGYAIGSAGLGALVLFAAYSYDLKYFAANGDKFPYFAGIGEISFDLSNPYVVAGLIFGGLIPYLFGGIAMTAVGRAASAIVEEVRRQFKEKPGIMQGTEKPDYGRAVDLLTKAAIREMIVPSLLPVLAPIVVYFGVLLISGSKASAFAALGASLLGVIINGLFVAISMTSGGGAWDNAKKSFEDGFVDKDGVRHMKGSDAHKASVTGDTVGDPYKDTAGPAVNPAIKITNIVALLLLAVLAG

SEQ ID NO: 7383 - protein, 393 aa, Silicibacter pomeroyi DSS-3
MSVKAPITQDVVTIPRKLPEGRINLVGLTRDRMREVLIDHGTPEKQAKMRVGQIWQWIYQWGVRDFEAMTNLAKAYRAQLAEHFTIEIPEVITRLVSEDGTRKYLVRIAGGHEVEVVYIPEEDRGTLCISSQVGCTLTCSFCHTGTQKLVRNLTAAEIVGQVMMARDDLGEWPVPGAPKDETRLLSNIVLMGMGEPLYNFDNVRDAMKIAMDPEGIQLSRRRITLSTSGVVPEIARTAEEIGCLLAISFHATTDEVRDVLVPINKRWNIEELLSALAAYPKVSNSERITFEYVMLDGVNDSDADAHRLLDHIRRYKIPAKINLIPFNEWPGAPYKRSSNNRIRAFANIIYQAGYAAPIRKTRGDDIMAACGQLKSATERARKSKKQIEAETGL

SEQ ID NO: 7384 - protein, 580 aa, Bordetella pertussis Tohama I
MYVYDPVDQQLVEERVKQFSDQTRRFLDGQLTEDEFRTLRLQNGLYIQRHAPMLRIAIPYGMLAARQLRKLAHIARTWDRGYGHFSTRQNMQFNWPRLEDVPAILAELASVQMHSIQTSGNCIRNTTSDHFAGVAPDELVNPLVWCEIIRQWSTLHPEFAFLPRKFKIAVSGAVEDRAAVGVHDIGLQAVERDGQLGFRFWVGGGLGRTPMVGHLINPFVPWQHLLTYLQAALRVYNLHGRRDNKFKARIKILVKDLTPEVYAREVEQEWQSLKDGPDTITEDQLNTIAGRFVWPDYDSAAASEPDPTDARAQAYPRFARWLRTNVRAHKVAGYAAVTVSLKATGVPPGDITADQMDAVAGLSERYGFGELRVSHEQNLVLADVRRARLHDLWQELQQLNLATPNIGLLTNIIACPGGDFCALANAVSIPVAESIQRRFDDLDYLFEIGELDLNISGCINSCGHHHVGHIGILGVDKAGEEWYQVTLGGRQNGAAKPLPDLESPRGGGAAIGRIIGPSFARTQIPDVIDRLIRTYLELRDSDAERFIDVVDRVGIDPFKRDVYADPAVAKLASQQEPAHA

SEQ ID NO: 7385 - protein, 341 aa, Rhodopirellula baltica SH 1
MSTATSKAVQSKQIELVSRPDGMPQPSNFELRKAEVGPIQDGEILVKNQWMSVDPYMRGRMKDTDSYVPPFQIDEPLEGGCIGEVVQSENDQFKEGDMVLGNLGWREYWTSDGKGITKIDPNIAPPQAFLGALGMTGMTAWVGLHKIARLKKGSTVFVSAASGAVGSIVCQLAKAMDCRVIGSAGKEEKIQWLKDKTGIDAVINYKEVDNLSEELAKHAPDGIDVYFDNVGSDHLEAAIDNMNDFGCCVECGMIATYNATEPPAAPRNMFKVIAKRLRIQGFIVRDHMDAKDEFVADMAKLIQQDKVVWEESVTDGIENAPDAFIGLFEGDNLGKQLVRLN

SEQ ID NO: 7386 - protein, 343 aa, Mycobacterium sp. MCS
MRIGVLTGGGDCPGLNAVIRAVVRTCDVRYGSSVVGFQDGWRGLLENRRIQLRNDARNDRLLAKGGTILGTARVHPEKLRAGLDQIKQTLDDNGIDVLIPIGGEGTLTAAHWLSEENVPVVGVPKTIDNDIDCTDVTFGHDTALTVASEAIDRLHSTAESHQRVMLVEVMGRHAGWIALNAGLASGAHMTLIPEQPFDVEEVCRLVKQRFVRGDSHFICVVAEGAKPAEGTMQLRQGGMDEFGHEKFTGVAQQLAIEVEKRVNRDVRVTVLGHVQRGGTPTPYDRVLATRFGVNAADAAHAGEYGMMVSARGQEIGRVSLADATRRLKLVPQSRYDDAAEFFG

SEQ ID NO: 7387 - protein, 464 aa, Synechococcus sp. RS9916
MGIHRSRHHLIDSGEQALVDAMVDPLPRDHFPVDGRAADTTVQLLKEELLLDGNSKQNLATFCQTYQGSAAMELMALGVDKNLIDKDEYPQTAEVERRCVSMMADLWNAPGEAIGCSTIGSSEASMLGGMAAKWRWRKKRQQAGLPTDQPNMVCGSVQICWKKFARYWDIEMRELEMRPGDLCITPERVLEAVDENTIFVVPTLGVTYHGLYEDVEAISRALDDYQARTGIDIPIHVDGASGGFLAPFCAPDLPPWDFRLERVKSINASGHKFGLAPLGVGWVMWRSPEDLPDELVFHVSYLGGDMPTFQINFSRPAGQVIAQYHEFVRLGREGYRLLHQASHSNAQYVAKALGQMGPFQLIHDGAPEKGIPTVVWTLKEGVDPGFNLYDLADRLRMRGWQVPAYPFTGDLAHHAFQRILVKRDFTREMADLLLDDIRTALAHFQKHPITSNLQASEAASYNHL

SEQ ID NO: 7388 - protein, 794 aa, Neisseria meningitidis MC58
MADNYVIWFENLRMTDVERVGGKNASLGEMISQLTEKGVRVPGGFATTAEAYRAFLAHNGLSERISAALAKLDVEDVAELARVGKEIRQWILDTPFPEQLDAEIEAAWNKMVADAGGADISVAVRSSATAEDLPDASFAGQQETFLNINGLDNVKEAMHHVFASLYNDRAISYRVHKGFEHDIVALSAGVQRMVRSDSGASGVMFTLDTESGYDQVVFVTSSYGLGENVVQGAVNPDEFYVFKPTLKAGKPAILRKTMGSKHIKMIFTDKAEAGKSVTNVDVPEEDRNRFSITDEEITELAHYALTIEKHYGRPMDIEWGRDGLDGKLYILQARPETVKSQEEGNRNLRRFAINGDKTVLCEGRAIGQKVGQGKVRLIKDASEMDSVEAGDVLVTDMTDPDWEPVMKRASAIVTNRGGRTCHAAIIARELGIPAVVGCGNATELLKNGQEVTVSCAEGDTGFIYAGLLDVQITDVALDNMPKAPVKVMMNVGNPELAFSFANLPSEGIGLARMEFIINRQIGIHPKALLEFDKQDDELKAEITRRIAGYASPVDFYVDKIAEGVATLAASVYPRKTIVRMSDFKSNEYANLVGGNVYEPHEENPMLGFRGAARYVADNFKDCFALECKALKRVRDEMGLTNVEIMIPFVRTLGEAEAVVKALKENGLERGKNGLRLIMMCELPSNAVLAEQFLQYFDGFSIGSNDMTQLTLGLDRDSGLVSESFDERNPAVKVMLHLAISACRKQNKYVGICGQGPSDHPDFAKWLVEEGIESVSLNPDTVIETWLYLANELNK

SEQ ID NO: 7389 - protein, 220 aa, Neisseria meningitidis MC58
MIQAVLFDLDGTLADTALDLGGALNTLLARHGLPAKSMDEIRTQASHGAAGLIKLGAGITPDHPDYARWRTEYLDEYDSRYAQDTTLFDGVNELIAELGKRGIKWGIITNKPMRFTDKLVPKLGFIIPPAVVVSGDTCGEPKPSVKPMLYACGQIHADPQHTLYVGDAERDIQAGRNAGMTTVLAEWGYIAPEDDTGSWQADFHIRTPLDLLECLDKIQP

SEQ ID NO: 7390 - protein, 603 aa, Xylella fastidiosa Temecula1
MTVIEIKVPDIGDYSKVPVIEVLVTVGDHLVKNQGILTLESDKATLEVPSMNNGIVKELKVNVGDLLSQGDVILLLETEDTTAPPSPSNAATSDTTSPPPPSPQPAASKPTAPDQQHSDIKCRMVVLGAGPGGYTAAFRAADLGLDTVLVERYPNLGGVCLNVGCIPSKALLHAAAVIDEAAHASTFGIDFGKPKITLDTLREYKQNVVNKLTAGLAGMAKQRKVRTVTGIAHFVSPNTLDITAADGSTQRLHFQQCIIATGSHPVKLPNFPWDDPRIMDSTDALELAEVPKKLLVVGGGIIGLEMATVYNALGSHVTIVEFMDQIIPGTDKDLVKPLADRMKKQGIEIHLNTKASHVKADKKGITVSFEAPTQGTQPALKTSTYDRVLVAVGRTPTGNNIGAEKAGVNVTERGFIPVDRQMRSNVPHIFAIGDIVGNPMLAHKATHEGKLAAEVAAAETESGKHREWVARVIPSVAYTNPEIAWIGITETEAKAKGLNIGVAKFPWVASGRAIGIGRTEGFTKLIFDEDTHRIIGGAIVGVHAGDLLAEIGLAIEMGAEAEDISHTIHAHPTLSESIAMSAEVYDGTITDLYLPKKSATSAK

SEQ ID NO: 7391 - protein, 277 aa, Gibberella zeae PH-1
MLALPGRLIYGSLIKRHSVGLRAEPPHLLLCRIPNFITHGREARIGARERRTCYQARQVSSLQGSPMHEKELHHLHVFRNTTMSRGGTTLYVTGFSHGTRARDLAYEFERYGRLVRCDIPAPRSTSSRLFAFVEYEDRRDADDAYHEMHNKRIGRDDILKIEWARTPPSASWRFESGRDRDRRGGARSPRRGRSPSPRRSTRDYSPRKDDRRDRDRDYDRESRRDRDRSRSPDHRDRERDSKDDREDRDRRENGTNGDDRKPLDSPPPANEDLDVAE

SEQ ID NO: 7392 - protein, 566 aa, Staphylococcus aureus subsp. aureus COL
MHKLNKKGRKKLTHLSDLDIANQSTLQPIKDIAASVGISEDALEPYGHYKAKIDINKITPRENKGKVVLVTAMSPTPAGEGKSTVTVGLADAFHELNKNVMVALREPALGPTFGIKGGATGGGYAQVLPMEDINLHFNGDFHAITTANNALSAFIDNHIHQGNELGIDQRRIEWKRVLDMNDRALRHVNVGLGGPTNGVPREDGFNITVASEIMAILCLSRSIKDLKDKISRITIGYTRDRKPVTVADLKVEGALAMILKDAIKPNLVQSIEGTPTLVHGGPFANIAHGCNSILATETARDLADIVVTEAGFGSDLGAEKFMDIKVREAGFDPAAVVVVATIRALKMHGGVAKDNLKEENVEAVKAGIVNLERHVNNIKKFGVEPVVAINAFIHDTDAEVEYVKSWAKENNVRIALTEVWKKGGKGGVDLANEVLEVIDQPNSFKPLYELELPLEQKIEKIVTEIYGGSKVTFSSKAQKQLKQFKENGWDNYPVCMAKTQYSFSDDQTLLGAPSGFEITIRELEAKTGAGFIVALTGAIMTMPGLPKKPAALNMDVTDDGHAIGLF

SEQ ID NO: 7393 - protein, 131 aa, Neisseria meningitidis MC58
MDKNLLEAVKFDEKGLVCAIAQDAETKRILMVAWMNAEALQKTVETGFAHYYSRSRQKQWMKGEESGHTQKVRALRLDCDGDAIVMLIAQNGGIACHTGRESCFYKVWRGSAWETADAVLKDEKEIYGSTH

SEQ ID NO: 7394 - protein, 129 aa, Triticum aestivum
  misc_feature (22)..(22): Xaa can be any naturally occurring amino acid
  misc_feature (92)..(92): Xaa can be any naturally occurring amino acid
  misc_feature (115)..(115): Xaa can be any naturally occurring amino acid
MAPTVMAFTATTISLLGGLKAXAGLPFSLLSNGSLFRVSNGGRIRCMQVWPIEGIKKFETLSYLPPLSTEALLKQVDYLIRSKWVPCLEFRXVSFIFREHNNSPGYYYGRYWTMXNLPMFGCTYSIQVL

SEQ ID NO: 7395 - protein, 295 aa, Rhodobacter sphaeroides 2.4.1
MEMRVMIRGSIPALVTPFKNGELDLDTLKKLVDWQIAEGSTGLVPVGTTGESPTLSHEEHETVIEAVVKAAAGRVPVIAGAGSNSTAEGIRLIRFAETVGADAALVVTPYYNKPTQAGMIAHFTALHDCCSLPIVIYNIPGRSVVDMSPETMGTLARLPRIVGVKDATGKIERVSQQRASCGPDFIQLSGEDATALGFNAHGGVGCISVTANVAPRLCAEFQQATLAGDFAKALEYQDRLMPLHEAIFLEPGLVGAKYALSKLGLCSDEVRLPLVGLTDATKARIEAAMRHAGLI

SEQ ID NO: 7396 - protein, 368 aa, Mycoplasma hyopneumoniae 232
MAKQDFYKILGVEKSASLTEIKKAYRNLVNIYHPDKNTKKSAEEQKQAEAKFKEIQEAYEILSDETKRKQYDKFGHAAFDQQFGGGSSGFSGFDFGDIFSSFTSGFGFGGSQEQKYSRPLKGENFQAKIYISFIESILGKEISQKLTKYDQCDNCKGSGANSSSDITTCYNCQGRGMQTEVLNIPGFGRVQNKTTCSVCLGSGKNITKNCKKCRGKTIVETKEEVTIKIPAGIQDGMFIRVAGFGGPGHKGGPSGDLHLEINVRQHKHFTRSGNDIHVNMPVSIIDVINQNTVEVPSPTGLKKVRLYDYYKSGQIVNVLRAGAPDPKNPRIIGDLKVHLIFYIPEFSPRQKDDLNQVFAQINDKTKAK

SEQ ID NO: 7397 - protein, 180 aa, Dehalococcoides sp. BAV1
MSRFAVLLAEGFEEIEFCTITDILRRADLEVKIVGLKNDLTGGSRGIRIMPDIHIDDLKTTDYEVLVLPGGNPGFINMGKDQRVLELIRTAHAENKYLAAICAGPAVLSRAGVIDGKEVAIYPGVKHLLKNCTACDLRVKVEGRLITGRSPQAAMDFALTLMDMFAKPQSAKVVRDEMLV

SEQ ID NO: 7398 - protein, 403 aa, Novosphingobium aromaticivorans DSM 12444
MSLSLEQSPTTGDEVITNYTINFGPQHPAAHGVLRMVMELDGEIIERIDPHVGLLHRGTEKLIEHKTYLQALPYFDRLDYCSPLGMEHSYVLAVEKLLNIEVPLRAQYLRVLFAELTRICNHMLNLGSHVMDVGAMTPNLWLFEIREDCLNFFERASGARMHSAWFRPGGVHQDVPLKLLTDMADWIDERLHPLFDDAMSLVVDNRIFKQRNVDIAVVSKEDALRWGFSGPMIRGSGIPWDLRKSQPYDVYDRMEFDIPVGTSGDCYDRFMVRVEEVRQSARIMKQCIEQMPDGPVASTDRKVVPPKRAEMKQSMEALIHHFKLYTEGFHVPAGEVYVATESPKGEFGVYLVSDGSNKPYRCKIRPTAFSHLQAMDFMCKGHMLPDATAILGAIDVVFGECDR

SEQ ID NO: 7399 - protein, 309 aa, Novosphingobium aromaticivorans DSM 12444
MTVLHSAPRWSSNEGVLDTLVAALGDMVAASREEHGEILLTVVRDRVEDALRLLRDDHEYQQLMDIAGVDYPQRAERFDVCYCLLSVTKNHRVIVKVSTDEATPVPTVTTLWPNAGWYEREVYDMFGVLFAGNPDLRRILTDYGFQGHPFRKDFPLTGYVELRYSEEDKRVVYEPVQLAQDLRQFDFMSPWEGADYVLPGDEKAVPPPPAPAPVATAPETKGDAKADVPKTTEQPADTGAGEKANDAAAKPVAEAAAPAATKTDEPAAPEPTEDRPARKPRAKKVADTEGATEPAAKPKRTRKKKEDGE

SEQ ID NO: 7400 - protein, 369 aa, Oryza sativa
MDREALRMVCSREFWRMAVLWTVSLLYSYILLFFLRRGAPVPRLRPMPEPDDDAARRRRRRPVCVITGATSGLGKAAAAALAREGYHVILAGRSSQLLSETVQQIRDQQPDAHLEAFQIDLSSYKSIKKFETSLNQWIKDSNMEHSIQLLVNNAGILAKSYRITEDGLQEMIQANYIGPFVLTNILLPLLKNSSTPSRVVNLTSFTHRCVSEINLSEKGLSGVRFGHWPARRSYLLASTYEYTKFCLLMFSYELHRQLHLSSGVSVMAADPGVVQTGIMRELPPCLSWLALSVLRLLNLLQQPDTGVDAVLDAALAPPDSSGKYFFGGKGRTITSSQLSYNVEVAKKLWAESLALFNELQNRVCELRTS

SEQ ID NO: 7401 - protein, 559 aa, Aspergillus oryzae
MGVSNLMARLKPQADHEHQEHSDTPTPVRADSNLEKDNAMIDDSPVKYLTWRSFILGLCVSMGGFIFGYSTGQIAGFTTMNDFKMRFAEQHADGTYAFSNVRNGLIVGLLSIGTMIGALVAAPIADRIGRKYSISFWSVIHMVGIIIQIATDDNWVQVAMGRWVAGLGVGALSSIVPMYQSESAPRQVRGAMVSAFQLFVAFGIFISYLVNFGTESINGTASWRITMGIGFAWPLILGVGTLFLPESPRYAYRNGRIEEAREVMCKLYGVGPNHRCIAQEMKDMKDKLDEEKAAGQAGIFEVFTGPRMFYRVMLGIALQSLQQLTGANFLFYYGNTIFTSTGLNNSYVTQIILGAVNFGMTLPGLYVVEHFGRRNSLMVGASWMFICFMIWASIGHFALDLENPPNTPQAGTAMIVFTCFFIVGFATTWGPIVWAICGEMYPARYRAVCIGLATAANWTWNFLISFFTPFISSAIDFAYGYVFAGCCFAAVLVVFFFVNETQGRTLEEVDTMYVLHVKPWKSANWTPPEGIVRDLHGPPASPKQEGRAEHSEPATEIRE

SEQ ID NO: 7402 - protein, 474 aa, Ralstonia metallidurans CH34
MGLRSQSRHPSGDSLKNLQRNLSARHIRFLALGSAIGTGLFYGSASAIQLAGPAVILAYIVGGAAVYMVMRALGEMAVREPVTGSFGRYASEYLGPLAGFLTGWTYILEMIIVCLADVTAFGIYMGFWFPEVPQWIWVLGIVMLICGLNLCNVKVFGELEFWLALVKILAIAAMIIGGTLILFLGVKMNGEHSPGLTNLWAHGGFLPHGAGGLIASLAVVMFAYGGIEIIGITGGEAQNPEKVIPRAINAVPARILLFYVLTMTVLMAIFPWTGIGSQGSPFVQIFSGLGIKSAAAVLNLIVISAAISAINSNIFGAGRMMYGMAEQGQAPRLFATTSRHGVPWVTVLAMAAALLGGVVLNYLIPEQVFVIIASIATFATVWVWLMILLSQVAMRRRLSAEEVRALKFKVPLWPVGPALAIAFMLFVIGVLGYVEDTRVALYVGAGWVVLLSLAWFLRAKPKADALLARETSVS

SEQ ID NO: 7403 - protein, 349 aa, Staphylococcus sciuri
MNFNNKTKYGKIQEFLRSNNEPDYRIKQITNAIFKQRISRFEDMKVLPKLLREDLINNFGETVLNIKLLAEQNSEQVTKVLFEVSKNERVETVNMKYKAGWESFCISSQCGCNFGCKFCATGDIGLKKNLTVDEITDQVLYFHLLGHQIDSISFMGMGEALANRQVFDALDSFTDPNLFALSPRRLSISTIGIIPSIKKITQEYPQVNLTFSLHSPYSEERSKLMPINDRYPIDEVMNILDEHIRLTSRKVYIAYIMLPGVNDSLEHANEVVSLLKSRYKSGKLYHVNLIRYNPTISAPEMYGEANEGQVEAFYKVLKSAGIHVTIRSQFGIDIDAACGQLYGNYQNSQ

SEQ ID NO: 7404 - protein, 379 aa, Streptococcus mutans UA159
MSNLFQNYTRADLEFIKAEGNYLFDTQGKKYLDFSTGIGVTNLGFHPQVQVALQKQAEQIWHTPNLYQNSLQEEVAAKLMAGKDYLAFFCNSGAEANEAAIKIARKATGKQEIITFQNSFHGRTFGSMSATGQDKIKVGFGDAVPHFHYAVFNDLNSVKALVTENTAAVMLELVQGESGVLPAEQDFVTALADYCQKNGLLLIIDEVQTGMGRTGKLYAFQHYGIEPDIFTLAKGLANGVPVGAMLAKKQFGSAFGPGSHGSTFGGNKLAMAASSAVLDIMTKAGFLEQAWENAHYLQEQLTSALQVADTVTQVRGLGYMIGIETTADLGQLVKATRDRGLIVLTAGTNVIRLLPPLTLTKDEIDQGIMILQEVFEQHN

SEQ ID NO: 7405 - protein, 424 aa, Arabidopsis thaliana
MSSSSSCLFFTFILLLSLFSSYASPSNSTSETVPLRPQREIQKMKLIRKQLQKINKPAIKTIHSSDGDTIDCVPSHHQPAFDHPLLQGQRPMDPPEMPIGYSQENESHENFQLWSLYGESCPEGTIPIRRTTEQDMLRANSVRRFGRKIRRVRRDSSSNGHEHAVGYVSGSQYYGAKASINVWTPRVISQYEFSLSQIWIIAGSFAGDLNTIEAGWQARISPELYGDTNPRFFTYWTSLLMKSYYFVLLQSDAYQATGCYNLLCSGFVQTNNRIAIGAAISPVSSYKGGQFDISLLIWKDPKHGHWWLQFGSGTLVGYWPVSLFTHLREHGNMVQFGGEIVNTRPGGSHTSTQMGSGHFAGEGFGKASYFRNLQMVDWDNTLIPISNLKVLADHPNCYDIRGGVNRVWGNFFYYGGPGKNSKCP

SEQ ID NO: 7406 - protein, 685 aa, Zea mays
MDACSLVHCHLPRPLQLPLLAPPTPSRHRPRVASALVCCCCPAAAADHHQERPWEWYDRAIQSHAGSDLARSLGLLADMQASGGRPSGSAYARLIRALSRAGRALEAEALLLEMRRLGPRPEAAHYNALLEGLLAAAHLRLADLLLLQMADDGVARNRRTYTLLLGAYARAGRLEDSWWVLGEMRRWGIRLDTAGYSMLVRLYRDNGMWKKATDLVMEMQEVGVELDVKIYSGLIDTFGKYGQLADARRMFDKMRAEGVRPDISTWNALIQWHCRVGNMKRALRFFTSMQEEGMYPDPKIFVMIISRLGEQGKWDEIKKLLDGMNNRGFKESGAVYAILVDIYGQYGHFRDAQDCIAALRAENTQLLPRVFCVIANAYAQQLMEEEGFEPNLVMLNSLINAFGTAGRHLEALAVFQHIKDSGMSPDVATAPKSKGCLMIGEYNKEQTQDRIMEFLHDACSQSFSFEQKCVELMDSYATLLFAKITEIRPEAFCKRYGLCRDTALLSGVGSDSTSARFEIIQILVKECNKIEGHVQQVEQIVVERSEGWHCGYFCYLAWIPRQCEDEPEGRVLGGDPLSEKYVSSANELPCQAEEVFAQLPNPCQGQPDGQMLHIMEDDKGEVVRVIIEVEDTGPWLMLYASLRRPVIPIIWFWSNLELYTDLASFSNKCVAPPAPLPRGNAWAYT

SEQ ID NO: 7407 - protein, 347 aa, Silicibacter pomeroyi DSS-3
MRSNTMKALEKSKPEEGLWMVQAPVPEIGPDDVLIKIKKTGICGTDIHIWNWDEWAAHTVPVPMITGHEFAGEIVELGRDVTGLSIGQRVSGEGHLIGTESRQSRAGKFHLDPGTRGIGVNVQGAFAQYLRLPAFNVVPLPEDIPDEIGAILDPLGNAVHTALSFDLLGEDVLITGAGPIGIMAAAVAKHAGARHVVITDINADRLKLAQHVVPRARTVDVTREDLGDVVHELGLKQGFDVGLEMSGSQAALDQMVEALVMGGKIALLGIPPGKSPVDWSRIVFKAITIKGVYGREMFETWYKMIAMLQNGLDVSRVITHRFGVDEFREGFAAMKSGLSGKVVLDWT

SEQ ID NO: 7408 - protein, 608 aa, Oryza sativa (japonica cultivar-group)
MSSAFSARSHTCSLSTVAVAAAVRRGDLTGAEEAFASTPRKTTATYNCLLAGYARALGRLADARHLFDRIPTPDAVSYNTLLSCHFASGDADGARRLFASMPVRDVVSWNTMVSGLSKSGAVEEAKAVFLAMPVRNSVSWNAMVSGFACSRDMSAAEEWFRNAPEKGDAVLWTAMVSGYMDIGNVVKAIEYFEAMPVRNLVSWNAVVAGYVKNSHADDALRLFRTMVREANVQPNASTLSSVLLGCSNLSALGFGKQIHQWCMKLPLSRNLTVGTSLVSMYCKCGDLSSACKLFGEMHTRDVVAWNAMISGYAQHGDGKEAINLFERMKDEGVEPNWITFVAVLTACIHTGLCDFGIRCFEGMQELYGIEPRVDHYSCMVDLLCRAGKLERAVDLIRSMPFEPHPSAYGTLLAACRVYKNLEFAELAAGKLIEKDPQSAGAYVQLANIYAGANQWDDVSRVRRWMKDNAVVKTPGYSWIEIKGVMHEFRSNDRLHPQLYLIHEKLGQLAERMKAMGYVPDLDFVLHDVDETLKVQMLMRHSEKLAISFGLISTAPGMTLRIFKNLRVCGDCHNAAKVISKIEDREIILRDTTRFHHFRGGHCSCGDYW

SEQ ID NO: 7409 - protein, 308 aa, Pseudomonas aeruginosa PAO1
MQAKVLVVGSLNMDLVVRAPRLPRGGETLAGQSFITVPGGKGANQAVAAARLGAEVAMIGCLGDDAYGDQLYRALQAEGIDCQGVERVAGESSGVALIVVDDSSQNAIVIVAGGNGHLSPAVLARHEHLLEQAQVVVCQLESPLETVGHVLRRAHALGKTVILNPAPATRDVPAEWLPLVDYLVPNETESELLCRLPVDSLESAGRAAERLREMGAGRVIVTLGAQGALLVGEGRVEHFPVARVKALDTTAAGDTFVGGFAAALARGLDEAAAIRFGQAAAAISVTRLGAQTSIPSREEVERALVGEA

SEQ ID NO: 7410 - protein, 356 aa, Oryza sativa (indica cultivar-group)
MAKKRKRSSDAAAAVEKPDEFAPQRPERTLFGFKEKPADDEEAEAEAASEGEEDAAAAAAAAPFRNKEKVLVTCSRRINYRYRHLMQNVVSLLPHAKKDSKVESKQSKGNALNELLELRNCSSCLFFECRKQKDLYLWMVKSPGGPSVKFLVNAVHTMEELKLTGNHLKGSRPLITFSTNFDEQPHWQLVKEMLTQLSHVMNFMENWGNAIRDEVIHASFLIFATPKDHRKAKPFHDHVFVFSIVDDHVWFRNYQISVPHNEIDKVDKGGLDKMTLVEVGPRFCLNPIKIFGGSFGGPTLYENPFYVSPNQIRALEKRKKAGKYAKKVKAKVRRKMHEMENTLEPDEFAELWKGED

SEQ ID NO: 7411 - protein, 336 aa, Mycobacterium sp. MCS
MNLAIIAGDGIGPEVIGEAVKVLDAVLPEVEKTTYDLGARRYHATGEILPDSVLEELKVHDAILLGAIGDPSVPSGVLERGLLLRIRFALDHHINLRPAKLYSGVTGPLAGNPEIDFVVVREGTEGPYTGTGGAIRVGTPHEVATEVSLNTAFGVRRVVEDAFRRAQQRRKHLTLVHKNNVLTFAGALWWRTVQEVGAEYPDVEIAYQHVDSAMIHIVTDPGRFDVIVTDNLFGDIVTDLAAAVCGGIGLAASGNIDATRTNPSMFEPVHGSAPDIAGQGIADPTAAIMSVALLLAHVGETDAAARVDKAVEAHLSSRGDQELGTAAVGDRIVGLL

SEQ ID NO: 7412 - protein, 376 aa, Mannheimia succiniciproducens MBEL55E
MAKQDYYETLGVQKGADEKEIKRAYKRLAMKYHPDRTNGDKAAEEKFKEVNEAYEILMDKEKRAAYDQYGHAAFEQGGFGGGAGGFGGGFGGFGGFEDIFSEMFGGGASRQRVVRGEDLRYDIEITLEEAVRGTTKDIKINTLAACDHCDGSGAEKGSKVETCPTCHGHGRVRRQQGFFMTETTCPTCQGSGKKIEKPCKHCHGDGRVHKKKNLSVKIPAGVDTGNQLRLSGEGAAGENGAPAGDLYVVIHVKDHHIFERDGSNLYCEVPISFTMAALGGEIEVPTLDGRVKLKIPAETQTGKLFRMRGKGVTSTRAGYAGDLICKIIVETPVKLNEEQKELLRKFEESLEGQSKQRPKSSSFLDGVKKFFDNLGK

SEQ ID NO: 7413 - protein, 295 aa, Oryza sativa (japonica cultivar-group)
MAGAKDVILDEPLLTSGSAESSQQRSTDAGMYTGLSAPCFTGPSGLQVRVTQKSEASVLNMSYVDELCDKDYTKSRVEDIWKKMNSGMPAKMPKPVMNKLSTPAKEKKSTTGNNWMSVLGLSPSKASTNDQGSKNGQKQAQQETSEDAKKLAASALAAVRDAASAAAGRGKVEITEVRDFAGKDIEIKKLVDADSTEAIEKAKAAGAAPSALDHILEQIKKKQKLSVLDKTKKDWGEFKEENKGMEEELDQYKKSSNKYLDKVSFLQRADYREFERERDARLSMMSKRKSDTRED

SEQ ID NO: 7414 - protein, 401 aa, Rhodobacter sphaeroides 2.4.1
MPDIVVVGAGQAGAALVAKLRALKFEGSILLAGEEPSPPYQRPPLSKAYLLGTMEEERLWLRNRAFYAEAGIELRLGAPVTAIDRAARTVTVGGEAIPYGRLALTTGSAARHLPEAAGGGLDGVYTVRTLADVDRMRPEFRAGRRLVVIGGGYIGLEAAAVGAKLGLAVTVVEMAPRILQRVAAPETADWFRALHAAHGVRILEGVALERLTGEGRVTGALLADGTHLPADFVIAGVGIRPVTELAEAAGLALDNGIAVDALGQTSDPAIWSAGDCASFPWRGGRLRLESVQNAIDQAEAVAANMLGAGAPYLPAPWFWSDQFDTKLQIAGLNLGYDRVVTRGPEGGSVSFWYYRGVELLAVDAVNEPRAYMVGKRLIEAGRSPAPDAVADAAVPLKSLLV

SEQ ID NO: 7415 - protein, 750 aa, Chlorobium tepidum TLS
MYGLVVCLFGMIFGLIQYQGINKLPVHAAMKEISDLIYETCKTYLITQGKFIIILWALVAAIIVAYFGGLNHLAPDKVVFILACSLLGIAGSYTVAWFGMRINTFANSRTAFASLGGKPFPTYAIPLRAGMSIGMLLISIELFAMLCILLFIPVDYAGPCFIGFAIGESLGASVLRIAGGIFTKIADIGSDLMKIVFKIKEDDARNPGVIADCTGDNAGDSVGPTADGFETYGVTGVALISFILLAIKDPSIQVSLLVWIFAMRLVMIVASAVSYWVNDALAKMKYGNADEMNFEKPLITLVWLTSIVSIVLTYIASYMLIAQLGDGTMWWKLASIITCGTIAGALIPELVDRFTSTECAFVRNVVQCSKEGGAALNILSGLVAGNFSAYWMGLAIIVLMGAAFGFSTLGLDVMMLAPSVFAFGLVAFGFLSMGPVTIAVDSYGPVTDNAQSVYELSLIETLPNISNSIESEFGFKPDFENAKRYLEANDGAGNTFKATAKPVLIGTAVVGSTTMIFSIIMILTGGLADTGAIAKLSILWPPFLLGLLMGGAVIYWFTGASMNAVTTGAYYAVAFIKKNIKLDGVTKASTEDSKKVVEICTRFAQKGMINLFLTIFFSTLAFACLESYLFIGYLISIALFGLYQAIFMANAGGAWDNAKKVVETELHAKGTELHDASVVGDTVGDPFKDTSSVALNPIIKFTTLFGLLAIELAIKLPTTISVSLAVVFFLLSLVFVHRSFFSMRIAVDKD

SEQ ID NO: 7416 - protein, 554 aa, Salmonella typhimurium LT2
MCSIFGVFDIKTDAAELRKKALELSRLMRHRGPDWSGIYACDNAILAHERLSIVDVNAGAQPLYNARKTHVLAVNGEIYNHQTLRAEYGDRYAFQTGSDCEVILALYQEKGPDFLDDLQGMFAFALYDSEKDAYLIGRDHIGIIPLYMGYDEFGNFYVASEMKALTPVCRTIKEFPAGSYLWSKDGEIRQYYQRDWFEFDAVKDNVTDKNALRQALEESVKSHLMSDVPYGVLLSGGLDSSVISAITKKFAARRVEDQERSEAWWPQLHSFAVGLEGSPDLKAAQEVANHLGTVHHEIHFTVQEGLDAIRDVIYHIETYDVTTIRASTPMYLMSRKIKAMGIKMVLSGEGSDEVFGGYLYFHKAPNAKELHEETVRKLQALHMYDCARANKAMSAWGVEARVPFLDKKFLDVAMRINPQDKMCGNGKMEKHVLRECFESYLPASVAWRQKEQFSDGVGYSWIDTLKEVAAKQISDQQLETARFRFPYNTPSSKEAYLYREIFEELFPVPSAAECVPGGPSVACSSAKAIEWDEAFKTMDDPSGRAVGVHQSAYQ

SEQ ID NO: 7417 - protein, 372 aa, Streptococcus mutans UA159
MAETNGLKDMIACDTRISAIKDNKLSYAGYDIADLMDNKARFEEVIYLLWNLHLPTAIELKQFEEKLRKNYAISDAIEQCILIQSRQHLHPMSVLRSTVSLLGVYNLKAEERSVEATYDQSIQLMAKIPTIIATFARLRQGLSPIAPRKDLGFAANFLYMLNGRLPSELEILAMNRALVLHAEHELNASTFAARVCASTLSDIYSCVTTAIGTLKGPLHGGANERVFDMLREIREYGDVDSYLQEKLNSKEKIMGFGHRVYQTQDPREKYLREMARELTKGTEHDIWYQLSKKVEICMKQKKNLIPNVDFYSATVYHVLGIDSSIFTLIFAMSRVSGWIAHIQEQQKNNKLIRPRSHYTGMRKLRYIPIERR

SEQ ID NO: 7418 - protein, 91 aa, Leptospirillum ferrooxidans
LDGTDTGKTLWQYFAVLLPVHSVGVMGDQRTYENAIAVRTVTSVDGMTADIGEIPHTLLCRISHRIISEVRGINRVVHDISPKPPSTIEWE

SEQ ID NO: 7419 - protein, 385 aa, Oryza sativa (japonica cultivar-group)
MQHKNEQVNMEILKEAQMYGDIQFMPFVDYYTLITLKTIAICMFGTKVVPAKYIMKTDDDAFVRIDEVISSLKKSDPHGLLYGLISFQSSPHRNKDSKWFISPKEWPVEAYPPWAHGPGYIVSRDIAKFIVHGHQERTLQLFKLEDVAMGIWIQQYKNSGQKVNYVNDDRFYSEGCDSDYVLAHYQSPRLMMCLWEKLQKEYQPEERNFLRFNPSNPLKPNRMNRCGEIQTIDFSGSAAPVVNCICVPLKHSFDRASYIVRAPWGDILQVWRSFELDDGEEPRTYELAVFKLDLATEDLVQIKDLRGHALFVSFFVSVNEFPVLTPNCVYLAHDSTKCRRFKHIAKAVRVYNLQDDTFADQYTQSSWKNCPPPALWFQPTWSLNK

SEQ ID NO: 7420 - protein, 577 aa, Streptococcus mutans UA159
MTEMLKGIAASDGVAVAKAYLLVQPDLTFETVSVTDTQAEEARLDAALEASQNELSLIRQKAVDTLGEEAAAVFDAHLMVLADPEMIGQIKETIRTKEVNAESALKEVTDMFVTLFENMEDNPYMQERAADIRDVAKRVLAHLLGVELPNPATISEESIVIAHDLTPSDTAQLDANYVKAFVTNIGGRTSHSAIMARTLEIAAVLGTNDITERVKNGDIVAVNGITGQVIINPTEDQIAEFKAAGETYAKQKAEWALLKDAETVTADGKHFELAANIGTPKDVEGVNNNGAEAVGLYRTEFLYMDSQDFPTEDEQYEAYKAVLEGMNGKPVVVRTMDIGGDKELPYFDLPKEMNPFLGFRALRISISETGNQMFRTQLRALLRASVHGQLRIMFPMVALLNEFRKAKGILEEEKANLKAEGVAVSDDIQVGIMIEIPAAAMLADQFAKEVDFFSIGTNDLIQYTMAADRMNEQVSYLYQPYNPSILRLVDHVVKAAHAEGKWAGMCGEMAGDQTAVPLLVGIGLDEFSMSATSVLRTRSLMKKLDTDKMQELAQRALTECATMEEVLELEKEYIDFD

SEQ ID NO: 7421 - protein, 145 aa, Zea mays
  misc_feature (15)..(15): Xaa can be any naturally occurring amino acid
AGDHLYRMDYEKFIXAHRETYADITVAALPMAEKRATAFGLMKIDEEGRIIEFAEKTKGEQFTEMMVDTTILSLDDVRAKEMPYIASMGIYVFSKDAMLQLLREQFPEANDFGSEVIPGARQNPKETHAFSKDGSNSSVTSIGPL

SEQ ID NO: 7422 - protein, 475 aa, Streptococcus mutans UA159
MTKQYKNYVNGEWKLSENEIKIYEPASGAELGSVPAMSTEEVDYVYASAKKAQPAWRSLSYIERAAYLHKVADILMRDKEKIGAVLSKEVAKGYKSAVSEVVRTAEIINYAAEEGLRMEGEVLEGGSFEAASKKKIAVVRREPVGLVLAISPFNYPVNLAGSKIAPALIAGNVIAFKPPTQGSISGLLLAEAFAEAGLPAGVFNTITGRGSEIGDYIVEHQAVNFINFTGSTGIGERIGKMAGMRPIMLELGGKDSAIVLEDADLELTAKNIIAGAFGYSGQRCTAVKRVLVMESVADELVEKIREKVLALTIGNPEDDADITPLIDTKSADYVEGLINDANDKGAAALTEIKREGNLICPILFDKVTTDMRLAWEEPFGPVLPIIRVTSVEEAIEISNKSEYGLQASIFTNDFPRAFGIAEQLEVGTVHINNKTQRGTDNFPFLGAKKSGAGIQGVKYSIEAMTTVKSVVFDIK

SEQ ID NO: 7423 - protein, 284 aa, Pseudomonas syringae pv. syringae B728a
MTHAEKPSILAGLIGSGIQASRTPAMHEHEGDAQGMRYLYRLIDIDALQLDIHALPQLLEGARQCGFTGLNITFPCKQAVIPLLDELSDEARGIGAVNTVVFKDGKRIGHNTDCLGFAEGFQRGLDKAPRQQVVQMGAGGAGAAVAHALLSAGVERLSVFEVEPQRAQGLVDNLNQHFGAGRAQVGTDLPAAMAEADGLVNTTPVGMTKLPGTPLPVELLRPELWVAEIIYFPLETELLRHARALGCRTLDGSTMAVFQAVKAFELFSGQSADAERMMAHFHTL

SEQ ID NO: 7424 - protein, 452 aa, Candida glabrata CBS 138
MGQILSNPVIDKETESGSDKWTAYAVCAMQGWRMSMEDTHIAQLNLNADESSGHVALYSVFDGHGGSYVANFCGERMEKIVKSQKSYETGDLAQVLTDAYLAADEQLATQSSISDDHSGCTATSVLISKEKGVIICGNAGDSRTVLSSGGLAKALSFDHKPTLPGETARITAANGFVQMSRVNGNLALSRAIGDFEYKSNPKLLPHEQMVTCVPDVIEHKLDFENDEFVILACDGIWDCLSSQECVDMVHYGIQKTELSLLEITSRIVDICCAPSTEGSGIGCDNMSIIVVALLKDSETLEQWFERMRAKNYSYSTTFEQKRKEVFSFYNFAKNQETGDEDVFAITAPRSAPGSKLNGNQERGVTAKGPVDTSKNGKSPGVIDFTSLESLLEAGIKISQSPNNVQHFQGSALADMLASLSEAAAGETSPSEKNDDIEFTESTHANPEESIGH

SEQ ID NO: 7425 - protein, 486 aa, Pyrococcus horikoshii OT3
MGKFVEKLEKAIKGYTFDDVLLIPQATEVEPKDVDVSTRITPNVKLNIPILSAAMDTVTEWEMAVAMAREGGLGVIHRNMGIEEQVEQVKRVKRAERLIVEDVITIAPDETVDFALFLMEKHGIDGLPVVEDEKVVGIITKKDIAAREGKLVKELMTKEVITVPESIEVEEALKIMIENRIDRLPVVDERGKLVGLITMSDLVARKKYKNAVRDENGELLVAAAVSPFDIKRAIELDKAGVDVIVVDTAHAHNLKAIKSMKEMRQKVDADFIVGNIANPKAVDDLTFADAVKVGIGPGSICTTRIVAGVGVPQITAVAMVADRAQEYGLYVIADGGIRYSGDIVKAIAAGADAVMLGNLLAGTKEAPGKEVIINGRKYKQYRGMGSLGAMMKGGAERYYQGGYMKTRKFVPEGVEGVVPYRGTVSEVLYQLVGGLKAGMGYVGARNIRELKEKGEFVIITHAGIKESHPHDIIITNEAPNYPLEKF

SEQ ID NO: 7426 - protein, 225 aa, Prochlorococcus marinus str. MIT 9515
MEFPEAILFDLDGVLLDTEPLLAYAWNETAKEYNHYLSNDNLLQLKGRRRRDCAKKVCKWINKENSIEELLITQKLKVDKQLSKAKPFKGAIDLIKFCINTKLPIALVTSSSSQSFKIKSSSNSWLNLFETKILGDDKFISAGKPSPDPYLRALKILDVNPFKTWVIEDSYAGSVSGLRAGCNLIFFSKDNEILNKLINEFNQEKIQKINELSEIIYYLKLYKGF

SEQ ID NO: 7427 - protein, 275 aa, Bacillus halodurans C-125
MELWYTEKQTEHFGITAKIKRTLHTEKTDFQQLDVIETEEFGNMLVLDGMVMTTEKDEFVYHEMVAHVPLFTHPNPKHVLVVGGGDGGVIREVLKHPSVEKATLVEIDGKVIEYSKKYLPSIATALNDPRVDVQVDDGFLHIAKAESAYDVIMVDSTEPVGPAVKLFEKGFYQGIAKALKEDGIFVAQTDNPWFHGELIRKVYADVQEIFPITRLYTANIPTYPSGLWTFTIGSKTYDPLHVEPSRFYDIETKYFTKDLHKAAFALPRFVDDLIK

SEQ ID NO: 7428 - protein, 513 aa, Methanococcus maripaludis S2
MCSISGIIAKDEEGSGSRSLLKNIQKHVINMMKILKHRGPDYSGMMFDDEVLYFENFDDITENTETISRMAMGHNRLAIVGTAVQPIPNTDESIWIICNGEIYNHVELRDELSVDHEFKTDTDSEAIIHTYEDELVDVLDGDYAYAIYDKEKNIIELRRDLMGVKPLYYIDTDEYFAFASEKKALYGLLMEINEMDYKSAFNYDISRLNPNSRLIYELDENSWYIEEDLEKVNPDYFEENDYELCKNELETTILDSVLKRVKGLERVGIIYSGGVDSTLVSKLASENCDVTLYSVGSANSEDLIYAERAAKDMGLKFRKKIILEDEFEEYVIKVAKAIDELDVMKLSVGIPIFAASEMAKEDGIKVVLSGQGADELFAGYNRYQRILNEKGEEGLKKSIISDVFDIHKVNLERDDHCTMANGVELRVPFLDKFVIDVGLSIPVEYKIEEPRKKILRDIASKYVPDYIAQRPKKAAQYGSGSEKMVYAVAKKHGYSKKEINKFFEEYLIEKIKF

SEQ ID NO: 7429 - protein, 1162 aa, Arabidopsis thaliana
GVGGRGGGRGGGRGGEEEPSSSHTPNNRRGGEQAQSSGTKSLRPRSNTESMSKAIQQYTVDARLHAVFEQSGESGKSFDYSQSLKTTTYGSSVPEQQITAYLSRIQRGGYIQPFGCMIAVDESSFRIIGYSENAREMLGIMPQSVPTLEKPEILAMGTDVRSLFTSSSSILLERAFVAREITLLNPVWIHSKNTGKPFYAILHRIDVGVVIDLEPARTEDPALSIAGAVQSQKLAVRAISQLQALPGGDIKLLCDTVVESVRDLTGYDRVMVYKFHEDEHGEVVAESKRDDLEPYIGLHYPATDIPQASRFLFKQNRVRMIVDCNATPVLVVQDDRLTQSMCLVGSTLRAPHGCHSQYMANMGSIASLAMAVIINGNEDDGSNVASGRSSMRLWGLVVCHHTSSRCIPFPLRYACEFLMQAFGLQLNMELQLALQMSEKRVLRTQTLLCDMLLRDSPAGIVTQSPSIMDLVKCDGAAFLYHGKYYPLGVAPSEVQIKDVVEWLLANHADSTGLSTDSLGDAGYPGAAALGDAVCGMAVAYITKRDFLFWFRSHTAKEIKWGGAKHHPEDKDDGQRMHPRSSFQAFLEVVKSRSQPWETAEMDAIHSLQLILRDSFKESEAAMNSKVVDGVVQPCRDMAGEQGIDELGAVAREMVRLIETATVPIFAVDAGGCINGWNAKIAELTGLSVEEAMGKSLVSDLIYKENEATVNKLLSRALRGDEEKNVEVKLKTFSPELQGKAVFVVVNACSSKDYLNNIVGVCFVGQDVTSQKIVMDKFINIQGDYKAIVHSPNPLIPPIFAADENTCCLEWNMAMEKLTGWSRSEVIGKMIVGEVFGSCCMLKGPDALTKFMIVLHNAIGGQDTDKFPFPFFDRNGKFVQALLTANKRVILEGKVIGAFCFLQIPSPELQQALAVQRRQDTECFTKAKELAYICQVIKNPLSGMRFANSLLEATDLNEDQKQLLETSVSCEKQISRIVGDMDLESIEDGSFVLKREEFFLGSVINAIVSQAMFLLRDRGLQLIRDIPEEIKSIEVFGDQIRIQQLLAEFLLSIIRYAPSQEWVEIHLSQLSKQMADGFAAIRTEFRMACPGEGLPPELVRDMFHSSRWTSPEGLGLSVCRKILKLMNGEVQYIRESERSYFLIILELPVPRKRPLSTASGSGD

SEQ ID NO: 7430 - protein, 1158 aa, Arabidopsis thaliana
GVGGSGGGRGGEEEPSSSHTPNNRRGGEQAQSSGTKSLRPRSNTESMSKAIQQYTVDARLHAVFEQSGESGKSFDYSQSLKTTTYGSSVPEQQITAYLSRIQRGGYIQPFGCMIAVDESSFRIIGYSENAREMLGIMPQSVPTLEKPEILAMGTDVRSLFTSSSSILLERAFVAREITLLNPVWIHSKNTGKPFYAILHRIDVGVVIDLEPARTEDPALSIAGAVQSQKLAVRAISQLQALPGGDIKLLCDTVVESVRDLTGYDRVMVYKFHEDEHGEVVAESKRDDLEPYIGLHYPATDIPQASRFLFKQNRVRMIVDCNATPVLVVQDDRLTQSMCLVGSTLRAPHGCHSQYMANMGSIASLAMAVIINGNEDDGSNVASGRSSMRLWGLVVCHHTSSRCIPFPLRYACEFLMQAFGLQLNMELQLALQMSEKRVLRTQTLLCDMLLRDSPAGIVTQSPSIMDLVKCDGAAFLYHGKYYPLGVAPSEVQIKDVVEWLLANHADSTGLSTDSLGDAGYPGAAALGDAVCGMAVAYITKRDFLFWFRSHTAKEIKWGGAKHHPEDKDDGQRMHPRSSFQAFLEVVKSRSQPWETAEMDAIHSLQLILRDSFKESEAAMNSKVVDGVVQPCRDMAGEQGIDELGAVAREMVRLIETATVPIFAVDAGGCINGWNAKIAELTGLSVEEAMGKSLVSDLIYKENEATVNKLLSRALRGDEEKNVEVKLKTFSPELQGKAVFVVVNACSSKDYLNNIVGVCFVGQDVTSQKIVMDKFINIQGDYKAIVHSPNPLIPPIFAADENTCCLEWNMAMEKLTGWSRSEVIGKMIVGEVFGSCCMLKGPDALTKFMIVLHNAIGGQDTDKFPFPFFDRNGKFVQALLTANKRVSLEGKVIGAFCFLQIPSPELQQALAVQRRQDTECFTKAKELAYICQVIKNPLSGMRFANSLLEATDLNEDQKQLLETSVSCEKQISRIVGDMDLESIEDGSFVLKREEFFLGSVINAIVSQAMFLLRDRGLQLIRDIPEEIKSIEVFGDQIRIQQLLAEFLLSIIRYAPSQEWVEIHLSQLSKQMADGFAAIRTEFRMACPGEGLPPELVRDMFHSSRWTSPEGLGLSVCRKILKLMNGEVQYIRESERSYFLIILELPVPRKRPLSTASGSGD

SEQ ID NO: 7431 - protein, 935 aa, Novosphingobium aromaticivorans DSM 12444
MTTRMLIDARHQEETRVAVLKGNRIEEFDFESADHKQIKGNIYLAKVTRVEPSLQAAFVDFGGNRHGFLAFSEIHPDYYQIPKEDREALLAEEAAHAEEEAALRAAEDGDDEDYADGEGYDSDEGVTEVDTSEKDQVATIEGGVVENGFDHEGEEGEDAEASEDGEGESEDNGRRRGRQQGRRRQGRSQGKEADELRAKRMALRRRYKIQDVIQRRQVLLVQVVKEERGNKGAALTTYLSLAGRYCVLMPNSSHGGGISRKINSASDRKRLKTIISELELPRSMSCIVRTAGLQRTKPEIKRDFDYLARLWDEIRERTMKSVAPALIHSDSDLIKRAIRDIYNRDIEEVVVEGEHGYRAAKDFMKLLMPSHAKRVKAYADPVPLFQRYGAEDQLTAMYDPVVQLKSGGYLVINPTEALVSIDINSGRSTKEHGIEQTAVATNLEAAREIARQLRLRDMAGLVVIDFIDMEYGSNIRKVEKAMKDALKNDRARIQVGRISGFGLMEMSRQRLRTGVLEATTRACPHCDGSGLVRTASSAGLSALRLIEDEAAKGKGNVVTLYASQEAAVYVLNAKRADLAEIEERYGVTVEVIPEGENEGAKMRVASRGPKPEFVPRFEPIVEPEEDDVVEDAYEDEEEVEERAPRGNRAAEGDEGERSDGRRKRRKRRRGRNRDRREDGTDGEVETSLDDAEADTDADAEGDEAEGNEAATSDENADENDRGPRKRRRRGRRRRGGRENGENGADQSGHDEAEGDDAGAAEAVAEAAEAPAAEEAPAAAEPAVEPVVEEAPAKPKRTRKKKVEAAPAPEAEAEAAPAAPEAAEPAAAEPVAEEAPAKPKRTRKKKVEAAPAPEAEAETEAEAAEPAAAAAEEAPAKPKRVRKKKVEAVASDAAPAETVTAEAPVAAQTAAEEAATEGEAGDQTPRRGWWQRTFGA

SEQ ID NO: 7432 - protein, 1162 aa, Arabidopsis thaliana
GVGGSGGGRGGGRGGEEEPSSSHTPNNRRGGEQAQSSGTKSLRPRSNTESMSKAIQQYTVDARLHAVFEQSGESGKSFDYSQSLKTTTYGSSVPEQQITAYLSRIQRGGYIQPFGCMIAVDESSFRIIGYSENAREMLGIMPQSVPTLEKPEILAMGTDVRSLFTSSSSILLERAFVAREITLLNPVWIHSKNTGKPFYAILHRIDVGVVIDLEPARTEDPALSIAGAVQSQKLAVRAISQLQALPGGDIKLLCDTVVESVRDLTGYDRVMVYKFHEDEHGEVVAESKRDDLEPYIGLHYPATDIPQASRFLFKQNRVRMIVDCNATPVLVVQDDRLTQSMCLVGSTLRAPHGCHSQYMANMGSIASLAMAVIINGNEDDGSNVASGRSSMRLWGLVVCHHTSSRCIPFPLRYACEFLMQAFGLQLNMELQLALQMSEKRVLRTQTLLCDMLLRDSPAGIVTQSPSIMDLVKCDGAAFLYHGKYYPLGVAPSEVQIKDVVEWLLANHADSTGLSTDSLGDAGYPGAAALGDAVCGMAVAYITKRDFLFWFRSHTAKEIKWGGAKHHPEDKDDGQRMHPRSSFQAFLEVVKSRSQPWETAEMDAIHSLQLILRDSFKESEAAMNSKVVDGVVQPCRDMAGEQGIDELGAVAREMVRLIETATVPIFAVDAGGCINGWNAKIAELTGLSVEEAMGKSLVSDLIYKENEATVNKLLSRALRGDEEKNVEVKLKTFSPELQGKAVFVVVNACSSKDYLNNIVGVCFVGQDVTSQKIVMDKFINIQGDYKAIVHSPNPLIPPIFAADENTCCLEWNMAMEKLTGWSRSEVIGKMIVGEVFGSCCMLKGPDALTKFMIVLHNAIGGQDTDKFPFPFFDRNGKFVQALLTANKRVSLEGKVIGAFCFLQIPSPELQQALAVQRRQDTECFTKAKELAYICQVIKNPLSGMRFANSLLEATDLNEDQKQLLETSVSCEKQISRIVGDMDLESIEDGSFVLKREEFFLGSVINAIVSQAMFLLRDRGLQLIRDIPEEIKSIEVFGDQIRIQQLLAEFLLSIIRYAPSQEWVEIHLSQLSKQMADGFAAIRTEFRMACPGEGLPPELVRDMFHSSRWTSPEGLGLSVCRKILKLMNGEVQYIRESERSYFLIILELPVPRKRPLSTASGSGD

SEQ ID NO: 7433 - protein, 302 aa, Pseudomonas aeruginosa
MFVAEQPGELDRVEQFGKRIAGADSNVAIGLARLGFAVAWLSRVGDDSLGRFVLDSLTREGLDCRFVEVDAQAPTGFQMKSREVDGADPRVEYFRRGSAASRLGLAHIREEMLGARHLHATGIPPALSASACELSHELMRRMRGKGASLSFDPNLRPSLWPSERRMIAEINALAAHAHWVLPGLEEGRLLSGWQEPADIAAFYLDMGVDAVAIKLGPSGAYYRDAHGEGLVPGVPVATVVDTVGAGDGFAVGVVSALLEGLPLPDAVARGNWIGSRAVQVRGDMEGLPKRSQLLDRERRRSA

SEQ ID NO: 7434 - protein, 431 aa, Zea mays
  misc_feature (81)..(81): Xaa can be any naturally occurring amino acid
MRCLPFLHGDVSEKDPVTKSVSVRSMSTTSTERDARSGSDFTSLNVSDMSAESIRRTQYPSFTDRPSNLRVFSFAELKSAXTQLSARSLMLGEGGFGCVFSGIIKTSDKPNERIEIAVKQLNRKGLQGQKEWLTEMNVLGIVDHPNLVKLIGYCAEDDERGVQRLLVYEYMPNGSVDDHLSSRSTTLSWPMRLKVALDSARGLKYLHEEMEFQVIFRDLKTSNILLDENWNAKLSDFGLARHGPTEGLTHVSTAVVGTLGYTAPEYMQTGHLTAKSDIWSYGVVLYELITGRRPIDQNRPKSEQKLLDWVKPYISDVKRFPVIIDPRLEGHYNLKSATKLASVANRCMVRLPKSRPKMSEVYGMVQRIVDGVGTGPPQPPLLHYHHGGPASEPGAKRAEKGSLRRRFREFRSGCRHVVLRRGRKPEVVKDL

SEQ ID NO: 7435 - protein, 207 aa, Photobacterium sp. SKA34
MSLLTKINWEKVAGLIPAIVQDNASGQVLMLGYMNEDALQKTLDTKQVTFWSRTKERLWTKGETSGNVLQLKSIQLDCDQDTLLVQVDPIGPTCHLNTTTCFDSDESGVQPPSLVFLHQLEQLLASRKGADPESSYTASLYARGTKRISQKVGEEGVEVALAATSGDKAELVCESADLIYHLLVLLQDQDLSLSDITDKLQERHNKK

SEQ ID NO: 7436 - protein, 444 aa, Neisseria gonorrhoeae FA 1090
MTDLNTLFANLKQRNPNQEPFHQAVEEVFMSLDPFLAKNPKYTQQSLLERIVEPERVVMFRVTWQDDKGQVQVNRGYRVQMSSAIGPYKGGLRFHPTVDLGVLKFLAFEQVFKNALTTLPMGGGKGGSDFDPKGKSDAEVMRFCQAFMTELYRHIGADTDVPAGDIGVGGREIGYLFGQYKKIRNEFTSVLTGKGLEWGGSLIRPEATGYGCVYFAQAMLQTRNDSFEGKRVLISGSGNVAQYAAEKAIQLGAKVLTVSDSDGFVLFPDIGMTEAQLAALIELKEVRRERVATYAKEQGLQYFENQKPWGVAAEIALPCATQNELDEEAAKTLLANGCYVVAEGANMPSTLGAVEQFIKAGILYAPGKASNAGGVATSGLEMSQNAIRLSWAREEVDSRLFGIMQSIHESCLKYGKVGDKVNYVNGANIAGFVKVADAMLAQGF

SEQ ID NO: 7437 - protein, 323 aa, Cyanophora paradoxa
MASITNILAPVENELDLLTKNLKKLVGSGHPILSAASEHLFSASGKRPRPAIVLLISKATMENEIITSRHRRLAEITEIIHTASLVHDDILDESDVRRGIPTVHSDFGTKIAILAGDFLFAQSSWYLANLESLEVVKLISKVITDFAEGEIRRGLNQFKVDLTLEEYLEKSFYKTASLLAASSKAAALLSHVDLTVANDLYNYGRHLGLAFQIVDDILDFTSSTEELGKPSCSDLKKGNLTAPVLFALEQNSELIPLIQRQFSEPKDFEYTLQIVEETKAIEKTRELAMEHAQVAIQCLENLPPSSSKEALKLITKYVLERLY

SEQ ID NO: 7438 - protein, 394 aa, Mesorhizobium loti MAFF303099
MLHTISAFDRLGEENAFAVLARATALAQQGRDIVNLGIGQPDFKTPQHIVEAAIKALRDGHHGYTPANGLLATREAVVRRTLTTTGVEVSPEAVMILPGGKPTMFAAILMFGEPGAEILYPDPGFPIYRSMIEFTGAAPIPVPMREENGFAFSAEETLALITSKTRLLILNSPANPTGGVTPRAEIEKLVKGLEKHPDVAILSDEIYDAMTYDGETHCSLLGYPEIRDRLIVLNGWSKTWAMTGWRMGWSIWPNGDRGAHLYDKVRKLAVNCWSCVNAPSQFAGIAAIDGPQDDVDTMMRAFDRRRKVVVEGLNALPNISCITPKGAFYAFPNVSKTGWKAKKLASALLDDAGVALIGGPDFGILGEGYVRLSYANSEENILRALERIGAFLSK

SEQ ID NO: 7439 - protein, 131 aa, Cicer arietinum
ERGVGLEHEDENIADLYLAVQDGIISGTTDYDILFGQLLENESGLKGSPPTAKSFVENLPLVELTEEELKGKDIVCAVCKDEVMLEEKVRKLPCSHCYHGDCILPWLSIRNTCPVCRFELPTDDADYERSK

SEQ ID NO: 7440 - protein, 551 aa, Escherichia coli CFT073
MLMKNINPTQTAAWQALQKHFDEMKDVTIADLFAKDGDRFSKFSATFDDQMLVDYSKNRITEETLAKLQDLAKECDLAGAIKSMFSGEKINRTENRAVLHVALRNRSNTPILVDGKDVMPEVNAVLEKMKTFSEAIISGEWKGYTGKAITDVVNIGIGGSDLGPYMVTEALRPYKNHLNMHFVSNVDGTHIAEVLKKVNPETTLFLVASKTFTTQETMTNAHSARDWFLKAAGDEKHVAKHFAALSTNAKAVGEFGIDTANMFEFWDWVGGRYSLWSAIGLSIVLSIGFDNFVELLSGAHAMDKHFSTTPAEKNLPVLLALIGIWYNNFFGAETEAILPYDQYMHRFAAYFQQGNMESNGKYVDRNGKVVDYQTGPIIWGEPGTNGQHAFYQLIHQGTKMVPCDFIAPAITHNPLSDHHQKLLSNFFAQTEALAFGKSREVVEQEYRDQGKDPATLDYVVPFKVFEGNRPTNSILLREITPFSLGALIALYEHKIFTQGVILNIFTFDQWGVELGKQLANRILPELKDDKEISSHDSSTNGLINRYKAWRG

SEQ ID NO: 7441 - protein, 363 aa, Oryza sativa
  misc_feature (131)..(131): Xaa can be any naturally occurring amino acid
MECWEKKPRNLGGSLPVPNVQDLAARPDHLTPTLLRRYLRPHHLSLPADDHHAMAMIPVVDFARLIDHHEEAAKLRHACEEWGFFQVINHGIADETVEEMKRDVMAFFNLPLADKAAFAQQPEWIEGYGQXAFVTSEDQTLDWSDLYFLTTQPPSYRDLRFWPPETSSTFRRSMDRYSLETQRVATELLRAMARNLGLRDADKMTRLAAAQSMRMNYYPPCPAKERDRVLGVSPHSDAVGLTLLLQVSPVKGLQIRRGDDWIPVDPIPGALVANVGDVVEMVTNGRYKSIEHRVVVDAAQERVSVAAFHNATFGSTYGPLEEMVGGGEARYRSISVEDYVRLVVSSKLQGKNILDAVKIITTT

SEQ ID NO: 7442 - protein, 356 aa, Photobacterium sp. SKA34
MSKEKILFIDRDGTLIVEPPVDFQVDRLDKLKFEPNVIPALLALQNAGYKLVMVTNQDGLGTDSYPQADFDAPHNMMMEIFESQGVVFSDVLICPHFDNEGCSCRKPKLGLVKEYLQQGRVDFETSAVIGDRITDLQLAENMAIRGIQYNPETMNWMQILTDLTTQPRIAEVVRTTKETDIRVKVNLDQTGGNTISTGLGFFDHMLDQIATHGGFQMTLTVDGDLHIDDHHSVEDAALALGEALKKALGDKRGIGRFGFSLPMDECLAQCALDLSGRPYLKFDAQFSRDQVGDLSTEMVPHFFRSLTDTLACTLHLSSTGNNDHHIVESLFKAFGRTLRQAIKVEGNELPSSKGVL

SEQ ID NO: 7443 - protein, 1498 aa, Emericella nidulans
MSFLGSISPNLPRSQSVVSHNLPQAHGLDENDDIYHNHSTTAQPGASEKDKSEDGETLHENEPDGEARVTLLARQLTRHSTRLTAKSTLENPFFLDDSDSTLNPNSPNFRVRDWMKMLLEIRSRDPERYPDRTAGIAFKNLSVHGFGSPTDYQKDVMNVLLEIGTIARRLAGMKMPKIQILRDFEGLVRSGEMLVVLGRPGSGCSTFLKTIAGEMNGIQVSDDAVLNYQGISSKNMQNSFRGEAIYTAENDIHFPQLSVGDTLMFSALARAPRNRLEGVSRKQYAEHMRDVVMAMLGLSHTINTRVGNDFIRGVSGGERKRVSIAEATLSQAPLQCWDNSTRGLDSANALEFCKNLALMSKYTGSTACVAIYQASQSAYDVFDKVTVLYEGRQIYFGNTKDAKKFFVDMGFECPERQTTADFLTSLTSPAERLVRPGYEGRVPCTPDEFAAAWKRSEERAKLMAEIEEYERQYPIGGPSYDAFVDARKAMQSKRQRVNSPYTISIWQQVSLCVVRGFQRLRGDFSLTTTSLIGNFMMALIIGSVFFDLPDDTSSFYYRGALLFFAVLLNAFSSALEILTLYSQRPIVEKQSRYAFYHPFAEAVASMICDTPYKLINSFTFNVPLYLMTNLRRDAAAFFTFWIFSVVTTFTMSMIFRTIASTSRSLSQALVPAAMLILGMVIYTGFTIPTQNMLGWSRWMNYINPIAYSFESFMVNEFDGRQFECVSIIPSGDEYNNVSMQYRICSTVGAESGSRIVDGGQYLELSYQYTKSHLWRNMGILIGFMVFFAFTYLLGTEYISEQKAKGEVLLFRRGRQPDLSTTEADPENPIQPSNAPKTEESAPQNTARIQRQTAIFHWEDVCYDIKIKGQPRRILDNVDGWVKPGTCTALMGVSGAGKTTLLDVLATRVTMGVVSGSMLVDGRLRDQSFQRKTGYVQQQDLHLATSTVREALRFSAILRQPAHLSRQEKLDYVEEVIKLLGMEAYADAIVGVPGQGLNVEQRKRLTIGVELAAKPQLLLFLDEPTSGLDSQTSWSILDLIDTLTQHGQAILCTIHQPSAMLFQRFDRLLLLASGGKTIYFGEIGPNSSTLSNYFVRNGSHGLPPGDNPAEWMLEVIGAAPGSNTEIDWVKTWRESPEYAKVREHLAELRATLSAKPADSSDPSALSEFAAPFSVQLWECLVRVFAQYYRTPTYIWSKAALCALTALYIGFSFFNAPTSIPGLQNQMFSVFMLMTIFGNLVQQIMPNFVTQRSLYEARERPSKAYSWKAFMAANIIVELPWNSLMAALIFFCWYYPIGLYNNAKPTDAVTERGGLMFLLIWTFLLFTSTFAHMIIAGIELAETGGNVAQLLFSLCLIFCGVLSTPDAMPGFWIFMYRVSPFTYLVSAMLSTGLSGTDVECEPVEYLTFAPPNNQTCGDYMRAYIDEVQSGYLLDPSATDQCSFCSMDKTDTFLLSVGSTFDEAWRNFGLMWAYILFNIVGAVFIYWLARVPKGKKMAGTA

SEQ ID NO: 7444 - protein, 1501 aa, Emericella nidulans
MSSQPSPPAPSGDVAPPGAVQQPSETVSRITDDNGAPSTAKEKAESSDITCASSEKDIDRDRKDIDQESELKITALARNLSRLSQKSGAVDGTNTFLDSSSDPELDPNSGQFNARKWTKNFLSVANRDPDRYPRRTAGVSFRNLSAFGYGTAADYQMDVANMWLKGFGWIRRKLGFVDRVRIDILRDFEGFVRSGEMLVVLGRPGSGCSTFLKTIAGETHGLWLDDGTDIQYQGISWDEMHSRFRGEVIYQAETEIHFPNLTAGETLLFAAQARTPANRFPGVTRDQYAHHMRDVTMAMLGLSHTMNTLIGNEFIRGVSGGERKRVSIAETILCGCPLQCWDNSTRGLDSSTALEFVRNLRLSTEYTGSTAIVAIYQASQAIYDVFDKAIVLYEGRQIYFGSASDARRFFVEMGFECPDRQTTGDFLTSLTSPTERLVRKGFENLVPRTPDEFAERWKQSAERKRLLEEIEAFQNEHPLGGSKYEEFTRSRAAEKAKGTRAASPYTLSYPMQIRLCLSRGFLRLKGDMSMTLATTIGNSIMALIISSIFYNMNGTTEKFFSRGALLFFAILLNAFSSALEILTLWQQRPIVEKHYKYALYHPSAEAISSMIVDLPAKVLVSIVFNIILYFMTNLRRTAGHFFVFYLFSFTTTLTMSNIFRWIGAISRSMAQAMVPSSIFMLILVIYTGFTIPVRNMHPWFRWLNYLNPIGYAFESLMVNEFSGRRFDCAMYVPDGPGYADVPLSSKICSGRGAVAGQDYIDGDTYLNTSFQYYRSHLWRNYGVLLAFMFFFLAAYIICSELVRAKPSKGEILVFPRGKIPAFAKEVRRDEEDAKTVEKPQLVGEKSDDHVGAISKQTAIFHWQDVCYDIKIKGENRRILDHIDGWVKPGTLTALMGVTGAGKTSLLDVLADRMTMGVITREMLVDGRLRDDSFQRKTGYVQQQDLHLETSTVREALIFSAMLRQPASIPRKEKLAYVEEVIKMLGMEEYAEAVVGILGEGLNVEQRKRLTIGVELAAKPDLLLFFDEPTSGLDSQTAWSICSLMRKLADHGQAILCTIHQPSAILMQQFDRLLFLAKGGKTIYFGELGENMGTLIEYFEKKGSTPCPKNANPAEWMLEVIGAAPGSHADRDWSEVWNQSPEREQVRAELARMKAELLQKPEPPRTPEYGEFAMPLWSQFLICLKRMFQQYWRSPSYIYSKATMCVIPPIFIGFTFWREPLSLQGMQNQMFAIFMLLVIFPNLVQQMMPYFVTQRALYEVRERPSKAYSWKAFMMASICVELPWNILMAVPAYFCWYYPIGLYRNAGPGETVERGGTMFLLILIFMMFTSTFSSMVIAGIEHPDTGSNIAQLLFSLCLIFNGVLATPQQMPRFWIFMYRVSPFTYLVSSVLSTGLSGAEVECSDIEILKIPPPDGQNCTSYLGPYAEGIHAKLLSDAPNGDCRLCSISSTNQFLASLSINPDDNWRNVGILFVYIVFNAFAAVFLYWLVRVPKKKSQQVKKQ

SEQ ID NO: 7445 - protein, 1515 aa, Emericella nidulans
MSSFLGTGTFNTSVSPSQAVESRGIENHGNAITETETLHNESHAESPGEKLASSSNSILSSTETAREKDERDYELDAEEEVTRLAQQLTHQSTKYSTHNIENPFLEVGEDSTLNPHSPNFKAKNWMKNLLALSSRDPERYLPRQAGVSFTNLSVHGYGSPTDYQKDVFNSVLQIGGLVRSMMGHGKQKIEILRNFDGLVKAGEMLVVLGRPGSGCSTFLKTIAGEMNGIFMDEKSQLNYQGIPAKQMRKQFRGEAIYTAETDVHFPQLSVGDTLKFAALARCPRNRLPGVSREQYAVHMRDVVMAMLGLSHTINTRVGNDFVRGVSGGERKRVSIAEATLSASPLQCWDNSTRGLDSANALEFCRTLNLMAKYSGATMAVAIYQASQSAYDVFDKVTVLYEGRQIYFGRTDDAKQFFIDMGFECPERQTTADFLTSLTSPAERIVRKGYEGRVPQTPDEFAAAWKNSDAYAQLMREIEEYNQEFPLGGESVNKFIESRRAMQSKNQRVKSPYTMSVMEQVHLCMIRGFQRLKGDASLTLSQLIGNFIMALVIGSVFYDLDNDTGSFYSRGALLFFAVLLNAFGSALEVCLILRLFLSLADSLQILTLYAQRPIVEKQARYAMYHPFAEAIASMLCDMPYKITNTFTFNIPLYFMTNLRREPGAFFIFLLFSFVTTLTMSMLFRTMAATSRTLSQALVPAAILILGLVIYTGFTIPTRNMLGWSRWMNYIDPIAYGFESLMVNEFHGRLFPCSESELVPSYGDTANRVCAVVGATPGELMVNGTTYLRESYQYTKSHEWRNLGIMFAFMAFFLFTYLTATEYISEAKSKGEVLLFRRGQAPPSVNDVETHSPATAGEKVDQSTQDVANIQRQTAIFHWKDVCYDIKIKNEPRRILDHVDGWVKPGTCTALMGVSGAGKTTLLDVLATRVTMGVVTGEMLVDGRPRDQSFQRKTGYVQQQDLHLHTTTVREALRFSALLRQPAKTPRQEKLDYVEEVIKLLGMEAYADAVVGVPGEGLNVEQRKRLTIGVELAAKPQLLLFLDEPTSGLDSQTSWSILDLIDTLTQHGQAILCTIHQPSAMLFQRFDRLLFLAKGGKTVYFGEIGEKSSTLASYFERNGAPKLPADANPAEWMLEVIGAAPGSHSDIDWPAVWRESPERQAVHQHLAELKETLSQKPTETSASDPSEYNEFAAPFSVQLWECLVRVFSQYWRSPVYIYSKAALSILTSLYIGFSFFQAQNTRQGLQNQMFSIFMLMTIFGNLVQQIMPNFVTQRALYEVRERPSKAYSWKAFMTANILVELPWNTLMAVIMYFCWYYPVGLYRNAEPTDSVHERGALMFLLILAFLLFTSTFAHMIIAGIETAETGGNIAQLLFSLCLIFCGVLAGPDVLPGFWIFMYRVSPFTYLVSAMLSTGVSGTTAYCEQVEYLTLYPPSNTTCSEYMDPYISQVGGYLQNPDATSECTFCQISSTDTFLSAVYSNYDDAWRNFGLMWAYIAFNIAAAVFIYWLARVPKGKKN

SEQ ID NO: 7446 - protein, 743 aa, Hordeum vulgare subsp. vulgare
  misc_feature (275)..(275): Xaa can be any naturally occurring amino acid
MSSGAVLVAIAASIGNLLQGWDNATIAGAVLYIKKEFSLETQPLIEGLIVAMSLIGATVITTFSGAVADAVGRRPLLIASSVLYFVSGLVMLWAPNVYVLLLARLIDGFGIGLAVTLVPLYISETAPTDIRGLLNTLPQFSGSGGMFLSYCMVFTMSLMPQPDWRIMLGVLSIPSLMYFALTVFYLPESPRWLVSKGRMAEAKRVLQRLRGREDVSGEMALLVEGLGVGKDTHFEEYIIGPDDELADDGLAPDQEKLKLYGAEEGVSWIARPVRXGGQSALGSALGLMSRHGSMVSQGKSLVDPLVTLFGSVHEKMPEVMGSMRSTLFPNFGSMFSVAEQQQAKADWDAESHRDDEDYASDHGADDIEDNLNSPLISRQATSVEGKEIAAPHGSIMGGVESSSMQGGDAVSSMGIGGGWQLAWKWTEREGADGQKEGGFQRIYLHEEGVSGDRRGSILSMPGGDIPPGGEYIQAAALVSQPALYSKDLIEQQLAGPAMVHPSEAVAKGTKWAELFEPGVKHALFVGIGLQILQQFAGINGVLYYTPQILEQAGVGILLSNIGLSSSSASILISALTTLLMLPSIGIAMRLMDMSGRRFLLLSTIPVLIVALAILVLVNVLDVGTMVHAALSTISVIVYFCFFVMGFGPIPNILCAEIFPTSVRGICIAICALTFWIGDIIVTYTLPVMLNAIGLAGVFGIYAVVCMIAFVFVYMKVPETKGMPLEVITEFFSVGAKQGKEATD

SEQ ID NO: 7447 - protein, 1168 aa, Arabidopsis thaliana
MVSGVGGSGGGRGGEEEPSSSHTPNNRRGGEQAQSSGTKSLRPRSNTESMSKAIQQYTVDARLHAVFEQSGESGKSFDYSQSLKTTTYGSSVPEQQITAYLSRIQRGGYIQPFGCMIAVDESSFRIIGYSENAREMLGIMPQSVPTLEKPEILAMGTDVRSLFTSSSSILLERAFVAREITLLNPVWIHSKNTGKPFYAILHRIDVGVVIDLEPARTEDPALSIAGAVQSQKLAVRAISQLQALPGGDIKLLCDTVVESVRDLTGYDRVMVYKFHEDEHGEVVAESKRDDLEPYIGLHYPATDIPQASRFLFKQNRVRMIVDCNATPVLVVQDDRLTQSMCLVGSTLRAPHGCHSQYMANMGSIASLAMAVIINGNEDDGSNVASGRSSMRLWGLVVCHHTSSRCIPFPLRYACEFLMQAFGLQLNMELQLALQMSEKRVLRTQTLLCDMLLRDSPAGIVTQSPSIMDLVKCDGAAFLYHGKYYPLGVAPSEVQIKDVVEWLLANHADSTGLSTDSLGDAGYPGAAALGDAVCGMAVAYITKRDFLFWFRSHTAKEIKWGGAKHHPEDKDDGQRMHPRSSFQAFLEVVKSRSQPWETAEMDAIHSLQLILRDSFKESEAAMNSKVVDGVVQPCRDMAGEQGIDELGAVAREMVRLIETATVPIFAVDAGGCINGWNAKIAELTGLSVEEAMGKSLVSDLIYKENEATVNKLLSRALRGDEEKNVEVKLKTFSPELQGKAVFVVVNACSSKDYLNNIVGVCFVGQDVTSQKIVMDKFINIQGDYKAIVHSPNPLIPPIFAADENTCCLEWNMAMEKLTGWSRSEVIGKMIVGEVFGSCCMLKGPDALTKFMIVLHNAIGGQDTDKFPFPFFDRNGKFVQALLTANKRVSLEGKVIGAFCFLQIPSPELQQALAVQRRQDTECFTKAKELAYICQVIKNPLSGMRFANSLLEATDLNEDQKQLLETSVSCEKQISRIVGDMDLESIEDGSFVLKREEFFLGSVINAIVSQAMFLLRDRGLQLIRDIPEEIKSIEVFGDQIRIQQLLAEFLLSIIRYAPSQEWVEIHLSQLSKQMADGFAAIRTEFRMACPGEGLPPELVRDMFHSSRWTSPEGLGLSVCRKILKLMNGEVQYIRESERSYFLIILELPVPRKRPLSTASGSGDMMLMMPY

SEQ ID NO: 7448 - protein, 753 aa, Hordeum vulgare subsp. vulgare
MRRGGWRSWRGCRGWRARRSSRLRRGWRRRRAGAGAGARKDLAALQAEWKSLEEEELVMAAAAKLVFLASNVMLWAPNVYVLLLARLIDGFGIGLAVTLVPLYISETAPTDIRGLLNTLPQFSGSGGMFLSYCMVFTMSLMPQPDWRIMLGVLSIPSLMYFALTVFYLPESPRWLVSKGRMAEAKRVLQRLRGREDVSGEMALLVEGLGVGKTHIEEYIIGPDDELADDGLAPDQEKLKLYGAEEGVSWIARPVRGGGQSALGSALGLMSRHGSMVSQGKSLVDPLVTLFGSVHEKMPEVMGSMRSTLFPNFGSMFSVAEQQQAKADWDAESHRDDEDYASDHGADDIEDNLNSPLISRQATSVEGKEIAAPHGSIMGGVESSSMQGGDAVSSMGIGGGWQLAWKWTEREGADGRKEGGAQRIYLHEEGVSGDRRGSILSMPGGDIPPGGEYIQAAALVSQPALYSKDLIEQQLAGPAMVHPSEAVAKGTKWAELFEPGVKHALFVGIGLQILQQFAGINGVLYYTPQILEQAGVGILLSNIGLSSSSASILISALTTLLMLGYISDRIGARAITAASFMYCSIPALFFYRRAILVLVNVLDVGTMVHAALSTISVIVYFCFFVMGPIPEGSTSSVKIDTDRANAASLAKALLTFWIGDIIVTYTLPVMLNAIGLAGVFGIYAVVCMIAFVFVYMKVPETKGMPLEVITEFFSVGAKQGKEATDEVAEKIAESRPSEECRSPVDYVQDHVMEV

SEQ ID NO: 7449 - protein, 150 aa, Triticum aestivum
  misc_feature (58)..(58): Xaa can be any naturally occurring amino acid
  misc_feature (91)..(91): Xaa can be any naturally occurring amino acid
  misc_feature (96)..(96): Xaa can be any naturally occurring amino acid
  misc_feature (99)..(99): Xaa can be any naturally occurring amino acid
  misc_feature (120)..(120): Xaa can be any naturally occurring amino acid
  misc_feature (123)..(123): Xaa can be any naturally occurring amino acid
  misc_feature (130)..(131): Xaa can be any naturally occurring amino acid
  misc_feature (134)..(134): Xaa can be any naturally occurring amino acid
  misc_feature (138)..(139): Xaa can be any naturally occurring amino acid
MAPTVMASSATSVAPFQGLKSTAGLPVSRRSNGASLGSVSNGGRIRCMQVWPIEGIKXFETLSYLPPLSTEASSSRSDYLIRSKWVPCLRXSKLGXLPXEHNAPLGYYDCRYWDMLKLPXFGXTDAPSLXXLKXVKEXXLNLIPTIGTRK

SEQ ID NO: 7450 - protein, 1168 aa, Arabidopsis thaliana
MVSGVGGSGGGRGGEEEPSSSHTPNNRRGGEQAQSSGTKSLRPRSNTESMSKAIQQYTVDARLHAVFEQSGESGKSFDYSQSLKTTTYGSSVPEQQITAYLSRIQRGGYIQPFGCMIAVDESSFRIIGYSENAREMLGLMPQSVPTLEKPEILAMGTDVRSLFTSSSSILLERAFVAREITLLNPVWIHSKNTGKPFYAILHRIDVGVVIDLEPARTEDPALSIAGAVQSQKLAVRAISQLQALPGGDIKLLCDTVVESVRDLTGYDRVMVYKFHEDEHGEVVAESKRDDLEPYIGLHYPATDIPQASRFLFKQNRVRMIVDCNATPVLVVQDDRLTQSMCLVGSTLRAPHGCHSQYMANMGSIASLAMAVIINGNEDDGSNVASGRSSMRLWGLVVCHHTSSRCIPFPLRYACEFLMQAFGLQLNMELQLALQMSEKRVLRTQTLLCDMLLRDSPAGIVTQSPSIMDLVKCDGAAFLYHGKYYPLGVAPSEVQIKDVVEWLLANHADSTGLSTDSLGDAGYPGAAALGDAVCGMAVAYITKRDFLFWFRSHTAKEIKWGGAKHHPEDKDDGQRMHPRSSFQAFLEVVKSRSQPWETAEMDAIHSLQLILRDSFKESEAAMNSKVVDGVVQPCRDMAGEQGIDELGAVAREMVRLIETATVPIFAVDAGGCINGWNAKIAELTGLSVEEAMGKSLVSDLIYKENEATVNKLLSRALRGDEEKNVEVKLKTFSPELQGKAVFVVVNACSSKDYLNNIVGVCFVGQDVTSQKIVMDKFINIQGDYKAIVHSPNPLIPPIFAADENTCCLEWNMAMEKLTGWSRSEVIGKMIVGEVFGSCCMLKGPDALTKFMIVLHNAIGGQDTDKFPFPFFDRNGKFVQALLTANKRVSLEGKVIGAFCFLQIPSPELQQALAVQRRQDTECFTKAKELAYICQVIKNPLSGMRFANSLLEATDLNEDQKQLLETSVSCEKQISRIVGDMDLESIEDGSFVLKREEFFLGSVINAIVSQAMFLLRDRGLQLIRDIPEEIKSIEVFGDQIRIQQLLAEFLLSIIRYAPSQEWVEIHLSQVSKQMADGFAAIRTEFRMACPGEGLPPELVRDMFHSSRWTSPEGLGLSVCRKILKLMNGEVQYIRESERSYFLIILELPVPRKRPLSTASGSGDMMLMMPY

SEQ ID NO: 7451 - protein, 629 aa, Novosphingobium aromaticivorans DSM 12444
MCGIAGIVHTEGPKPVDPDRVRRMCDAIAHRGPDGEGVWTAPGIGLGHRRLSIIDLAGSPQPMKAAEGDAVIVFNGEIYNFRDLRKELQALGAQFRTDGDTEVILQAWRQWGTACLPRLHGMFAFALYDLRQRTTLLARDRLGVKPLFTARLADGAVIFGSELKALLAHPSLRREIDPLAVEDYLAWGYVPDHRSMLKGVEKLPAGHYQLLRHDAPPAAPVQWWDVSFADRANGSAEDLGAHLLHHMRDAVTSRMVADVPLGAFLSGGVDSSSVVALMAEASATPVKTCSIGFDVAALDETAYADRIAARFATEHRKRLVSPDDFSLVDRLAGMFDEPFADASALPTFRVCELAREHVTVALSGDGADEAFAGYRRQTFQHREEQARALLPSALRKPLFGTLGRLWPKADWAPRPLRAKTTLLSLAASGEEGYARALSVTSPELRETLYTPDFKRLRGDYRAEQPLIELMRKAPARSGLDRAQYADLKFYLPGDILTKVDRTSMAVGLEAREPLLDHRLVEFGASLPERLRVRGATGKWLIKQTMRRYLPEDVLFRPKMGFVTPLAQWLRGPLAHEARALASDGLLARTGWLDAARIDALADAHVSGRADHSRLIWQLLMLRKSLQLLG

SEQ ID NO: 7452 - protein, 577 aa, Nostoc punctiforme PCC 73102
MTITDDLQKLLDILPQDLQQVLESHPKRDSLVEVVLDLGRRPEARFPNQAEYLSEIPVTQEQIDDCIQRVGIFGGDNRAGIEQTLHRISAIRNRTGKIIGLTCRVGRAVFGTIGMIRDLVETGKSILMLGRPGVGKTTALREIARVLADDLHKRVVIIDTSNEIAGDGDVAHPAIGRARRMQVAHPEQQHQVMIEAVENHMPEVIVIDEIGTELEALAARTIAERGVQLVGTAHGNQIENLIKNPTLADLVGGIQAVTLGDDEARRRGSQKTVLERKAPPTFEIAVEMLERQRWVVHESVADTVDNLLRGRQATPQTRTVDDQGKVAVTRQLAVVNGRGGQLGTVEESFPPARASNGWRSSGQMVALPQLPVERVTGRSEFDRLLDESFNYSESIDLDAATRQPGPNGEDLPLHVYPYGVSRHQLEQVISVLTLPVVLTKDIDSADAILALRSHVKNHAKLRQMAKARHVPIHMIKSSTIPQITRGLRRLLNMDDPEMTDDLELQLFLHSGSDDEMDALEEARLAVEQIVIPKGQPVELLPRSPQVRKMQHELVEHYRLKSHSFGEEPNRRLRIYPA

SEQ ID NO: 7453 - protein, 278 aa, Methanococcus maripaludis S2
MINSKTKLVGLIGHPVDHSFSPIMHNAAIKDLKINYRYFAFDVSEENLKDVVAGAKAFNFRGFNITIPHKMNIMKYLDEIDCDAEAIGAVNTVKIENGKAIGYNTDGIGVKKALEEKTGILINKNILIIGSGGASRAVSFELAKDNNLTIVNRNIEKAENLSKEISRKLKKENPLNYGGLDINIENFDIIINTTPVGMYPHTEVEPVIPLNNIKKDAVVMDLIYNPLEPVFLKEAKKYGAKTINGIGMLVYQGAVSFEIWTGIKPDIFVMKKSIISKI

SEQ ID NO: 7454 - protein, 285 aa, Rhodobacter sphaeroides 2.4.1
MTHHPKPPFPDQEQPMPGKTSRLDPQPDHGEKSYRGSGRLQDMKAVITGADSGIGRAVALAFAREGADVLISYLSEDEDAAETERLVTEAGRKAVLVRGDLQDAAHCRAVIDRAVEEFGRIDLLVNNAAHQASFSDLGDIPDDEWELTFRVNIHAMFYLSKAAVPHMGPNSAIINTASVNADSPSPHLLAYATTKGAIQNFTGGLAQMLAEKEIRVNCVAPGPIWTPLIPSTMPAEKVKNFGTQVPMQRPGQPAELATAYVMLADPLSSYTSGATIAVTGGKPII

SEQ ID NO: 7455 - protein, 335 aa, Glycine max
ATNTPLEYQPSSIVIFFALYCILGLITFGIAVPSGLFLPIILMGSGYGRLLGILMGPHTNIDQGLFAVLGAASLMAGSMRMTVSLCVIFLELTNNLLLLPITMIVLLIAKTVGDSFNPSIYEIILHLKGLPFMDANPEPWMRNLTVGELVDVKPAVVSFKGVEKVANIVNALKNTTHNGFPVMDCGLVPTTGVANEATELHGIILRAHLIQVLKKKWFLKERRRTEEWEVREKFTWVELAEREGNIEDVAVTKEEMEMFVDLHPLTNTTPFTVLESMSVAKAMVLFRQVGLRHMLVVPKYQASGVSPVIGILTRQDLLAYNILTVFPHLAKSKRK

SEQ ID NO: 7456 - protein, 491 aa, Thalictrum flavum subsp. glaucum
MEVLSAAMVSLFFIFLFIFFILCDSRNKDLPPGPRPSPIVGNLLQLGEKPHAEFAKLAEKYGELFTLKLGSQTVVVASSPAAAAEILKTRDKILSGRYVFQSFRVYEHVLNSIVWSECNENWKLLRKVCRTELFSPKMIESQAYIREAKALDMVRFLRKKENQEVKIVEVVFNTLVNIFGNLIFSKDVFDLEDPTGGSAELKEHLWKLLDMGNSTNPADYFPIMGKFDLFGQRREVAKVLKQIYDVWGVMLKERRSITGHRENDFANVLLNAGLDDQKINALLMELFGAGTETTASTIEWAITELTNNLRVISKLRAELINVVGHKTVKESNIPHLPYLQAIVKETLRLHPPTPLLLPRRALETCKVMNYTIPKECQIMVNAWAIGRDPKTWDDPLTFKPERFMNSTVDYKGNDFELIPFGGGRRICPGLPLASQFLSLIVATLVQNFDWSFPQGMTPNEVPMDEKFGLPLQKDPPLLIVLKARTSMKLQD

SEQ ID NO: 7457 - protein, 219 aa, Actinidia deliciosa
ETGRHVRMLTHEIRSTLDRHTILKTTLVELGRTLDLEECALWMPSRRGLDLQLSHTLNNLIPIGSSVPSNLPIVNEVFNSAEAIRIPHTCPLARIKPRMGRYVPPEVVAVRVPLLHLSNFQINDWPDTSAKSYALMVLILPMDGIRKWRDHELELVEVVADQVAVALSHAAILEESMRARDQLLEQNVALDFARQEAEMAIRARNDFLAVMNHEMRTPM

SEQ ID NO: 7458 - protein, 905 aa, Arabidopsis thaliana
MSRVSFEVSGGYHSDAEAGNSGPMSGGQLPPIYKKPGNSRFTAENSQRTRTAPYVDLTVDVQDDTVSVHSLKMEGGSSVEESPELTLLKRNRLEKKTTVVKRLASVSHELKRLTSVSGGIGGRKPPRPAKLDRTKSAASQALKGLKFISKTDGGAGWSAVEKRFNQITATTGGLLLRTKFGECIGMTSKDFALELFDALARRRNITGEVIDGDQLKEFWEQINDQSFDSRLKTFFDMVDKDADGRLTEDEVREIISLSASANNLSTIQKRADEYAALIMEELDPDNIGYIMLESLETLLLQAATQSVITSTGERKNLSHMMSQRLKPTFNRNPLKRWYRGLRFFLLDNWQRCWVIVLWFIVMAILFTYKYIQYRRSPVYPVMGDCVCMAKGAAETVKLNMALILLPVCRNTITWLRNKTRLGRVVPFDDNLNFHKVIAVGIIVGVTMHAGAHLACDFPRLLHATPEAYRPLRQFFGDEQPKSYWHFVNSVEGITGLVMVLLMAIAFTLATPWFRRGKLNYLPGPLKKLASFNAFWYTHHLFVIVYILLVAHGYYLYLTRDWHNKTTWMYLVVPVVLYACERLIRAFRSSIKAVTIRKVAVYPGNVLAIHLSRPQNFKYKSGQYMFVNCAAVSPFEWHPFSITSAPQDDYLSVHIRVLGDWTRALKGVFSEVCKPPLAGVSGLLRADMLHGANNPDFPKVLIDGPYGAPAQDYKKYEVVLLVGLGIGATPMISIVKDIVNNIKAKEQAQLNRMENGTSEPQRSKKESFRTRRAYFYWVTREQGSFDWFKNIMNEVAERDANRVIEMHNYCTSVYEEGDARSALIHMLQSLNHAKNGVDIVSGTRVMSHFAKPNWRNVYKRIAMDHPNTKVGVFYCGAPALTKELRHLALDFTHKTSTRFSFHKENF

SEQ ID NO: 7459 - protein, 90 aa, Artemisia vulgaris
MAVCGGVTECKNFENNVEIETIAKFAVEEHNKKENATLEFVKVVSAKEQVVSGKIYYITIETNDGKTYEAKLWVKPWENFQELQEFKPAA

SEQ ID NO: 7460 - protein, 306 aa, Pseudomonas syringae pv. syringae B728a
MQAKIVIVGSLNMDLVIRAQRLPRPGETLSGETFDTVPGGKGANQAVAAARLGASVAMIGCVGADAYGEQLRAALLAEQIDCQAVTVVEGVSTGIASIVVDANSQNAIVIVAGGNGRLTPALLERFDALLADSQIVICQLEVPTETVFHTLARARALGKTVILNPAPASEPLPASWYALIDYLIPNESEAQTLTGVNVDSPAAAENAASVMLAAGARNVIITLGEHGTLFANASGMDHIPARRVQAVDTTAAGDTFVGGFAAALSAGHGELQAIRFGQAAAAISVTRAGAQPSIPTFEEVQEFNSL

SEQ ID NO: 7461 - protein, 904 aa, Phaseolus vulgaris
MWITFYVAVLAVLLLQAHAQPGFISIDCGAEAGVSYTERSLGINYVSDANFINTGERRTIASEEISRNNQQQQLWRLRSFPEGKRNCYKINVTSGSNYLIRTTFLYGNYDGRNKLPMFDLLLGANLWSTVTIDDASSGQSNEIIHVPSLDFVQICLVNTGSGTPFITAIEFRTLKNDTYVTESGSLQSSLRWDLGSNISYRYPTDVYDRFWNPQDNKDWTNLSASIPDDSLDQGDYQPGASNMRTAVTPANASAPLVISWEPKDETDEFYVYMHFTEIQELTTNQTRQFDIMRNGELWIPNFSPRYLVVDTLNTSSASAVNGKVITYSLVRTGNSTLPPIISAIEIYRVIDLQKPETLQADVDAITSIKSVYGVKRDWQGDPCAPVAYLWNGLNCSYHGIEFPRITALNLSSSGLSGKIDPSISKLNMLEKLDLSNNNLHDEVPDFLSQLQHLKILHLEKNNLSGSIPSALVEKSKEGSLTLSLGQNPHICEHGQCIDHRNNIVIPLVASICGGLILLVTVTAILWILRRRRKSKASMVEKDQSEISEQHTKQEGSLQQSKKQICSHSDICKITNNFNTIVGKGGFGTVYLGYIYDTPVAVKILSPSSFRGYEQFQAEVTLLLRVHHKNLTSLIGYCDEGSNKSLIYEYMANGNLLEHLSGTHSKSKFLSWEDRLRIAVDAALGKKANFRLCVLTVLLMWHLHKSNIGLEYLQNGCKPPIIHRDVKSSNILLNEHFQAKLSDFGLSKIIPDDGASHLSTVVAGTPGYLDPDYYTNNRLTEKSDVYSFGVVLLEIITGQLVIARNEERSHIIEWVRSLVAIGDIKAIVDSRLEGDFDINSAWKAVEIAMACVSLRPNQRPIMSVVVFELKETLVTELARTKPNSSAESIEPVNLDFSAQLIPLAR

SEQ ID NO: 7462 - protein, 221 aa, Brassica napus
MEGGGEGSSSAAPAAAGVVPKSAMEAVKQALAHLEELKPQLEEMLSLAQPEVLAQMQPLKRAKVMYMLAEATTTIFNLRLRCTGVNPDDHRVKSEIERLDVYKEKFQRCMDRSKEPLRPTTVLNRQAATRFIEHSLPDLSSAQRQNIRDLSKGEKSRMRYSETSAKKRKYQSNEKQSVRSAAKEFLEKAARELNGNNENGLKGPLMAAAEGTSDDVEMGTA

SEQ ID NO: 7463 - protein, 129 aa, Neisseria meningitidis MC58
MSKTIIHTDKAPAAIGAYSQAVRAGDTVYMSGQIPLDPATMTVVGNGDFRAEARQVFQNLQAVAEAAGGTLADIVKLNAYLTDLGNFAVFNEVMAEFIAEPFPARAAVGVASLPKGVQVEAEAVLVLNA

SEQ ID NO: 7464 - protein, 238 aa, Oryza sativa (japonica cultivar-group)
MAFAGRVVNALRRTSVSSNPSLLQAVRCMSSKLFVGGLSYATDDTTLKDVFSHYGDVLEARIIIDRDTGKSKGYGFITYTSSEEAAAAVTAMDGKDLQGRIVRVSTANDRAGGIRGGGGFGAGGYGSGGGYSSGGGYGTGEYGRGGGYAGNGGYGGRASEYGGYGAGGYSSSGGYNATSVLHGNAGGYGSSGVSHGNAGDYRSSDVYNTTNTYGAGNFSHSGQSGGSFGGNNGGISGG

SEQ ID NO: 7465 - protein, 568 aa, Kluyveromyces lactis NRRL Y-1140
MSLKTVSVATNPYPDQKPGTSGLRKKTKVFEETPNYTENFIQAIMEAIPEGSQGATLVIGGDGRYYNDVVIQKIAAIGSANGVRKIVIGHNGILSTPAASHIIRAYHEKCTGGIILTASHNPGGPTNDFGIKYNLANGGPAPESVTNSIWHKSRELTHYKIVESFPAIDLTKIGQDQKYGDLLVDIVDSTAAYVELMKEIFDFPLIKSFIDTQAKNGFKILFDAMNGVTGPYGEALFVKELGLPESSLQNYHPKPDFGGLHPDPNLTYAHTLVERVDKYGIQFGAASDGDGDRNMIYGAGPAFVSPGDSVAIIAEYASAIPYFKKQGIYGLARSFPTSSAIDRVAKEQGLNCYEVPTGWKFFCALFDAKKLSICGEESFGTGSNHVREKDGVWAIMAWLNILAIYNQRFPNKEASIKSIQTDFWQKYGRTFFTRYDFENLSSEDAGKVILLLQNYVADPESIKGTKFPADDSLTVVEGGDFSYTDLDGSVSSHQGLYVRLSNGVRFVVRLSGTGSSGATIRLYVERYTNDGSKYEQTAEEFLGKDIKTILKFLKFKEAIGTEEPTVRT

SEQ ID NO: 7466 - protein, 269 aa, Neisseria meningitidis
MTALPRYSVFGNPVAHSKSPQIHRQFALQEGVDIEYGRICADIGGFAQAVSTFFETGGCGANVTVPFKQEAFHLADEHSDRALAAGAVNTLILLKNGKLRGDNTDGIGLANDITQVKNIAIEGKTILLLGAGGAVRGVIPVLKEHRPARIVIANRTHAKAEELAQLFGIEAVPMADVNGGFDIIINGTSGGLSGQLPAVNPEIFRDCRLAYDMVYGEAAKPFLDFARQSGAKQTADGLGMLVGQAAASYALWRGFTPNIRPVIEYMKAM

SEQ ID NO: 7467 - protein, 379 aa, Agrobacterium tumefaciens
MAKADFYETLGVSKTADEKELKSAFRKLAMKYHPDKNPDDADSERKFKEINEAYETLKDPQKRAAYDRFGHAAFENGGMGGGGGGFGGGGFANGGFSDIFEDIFGEMMGGGRARRSSGGRERGADLRYNMEITLEEAFTGKTAQIRVPTSITCDVCSGSGAKPGTQPKTCATCQGSGRVRAAQGFFSVERTCPTCHGRGQTISDPCGKCHGQGRVTEERSLSVNIPSGIEDGTRIRLQGEGEAGMRGGPAGDLYIFLSVRPHEFFQRDGADLYCTVPISMTTAALGGTFDVTTLDGTKSRVTVPEGTQPGKQFRLKGKGMPVLRSAQTGDLYIQIQIETPQKLSKRQRELLQEFEQLSSKENNPESTGFFARMKKFFDG

SEQ ID NO: 7468 - protein, 136 aa, Methanosarcina mazei
MVLKNIKYALKNIPKERVTRLCPEVESPLSERFRGLQTLDKSKCIGCGICANTCPNSAIKIVKAPIAPGSEKKRWFPQIDIGHCLFCGLCIDQCPKGALSSGKEYCKGMVKWAHKDLLMTPEKLAREVDIQEGDER

SEQ ID NO: 7469 - protein, 269 aa, Neisseria meningitidis
MHALPRYAVFGNPVAHSKSPQIHQQFALQEGVDIEYERICADIGGFAQAVSTFFGTGGCGANVTVPFKQEAFHLADEHSDRALAAGAVNTLILLKNGKLRGDNTDGIGLANDITQVKNIAIEGKTILLLGAGGRVRGVIPVLKEHRPARIVIANRTRAKAEELAQLFGIEAVPMADLNGGFDIIINGTSGGLNGQIPDIPPDIFQNCALAYDMVYGCAAKPFLDFARQSGAKKTADGLGMLVGQAAASYALWRGFTPDIRPVIEYMKAM

SEQ ID NO: 7470 - protein, 376 aa, Pseudomonas stutzeri
MAKRDFYEVLGVERGASEAELKKAYRRLAMKHHPDRNPGDKAAEEAFKEANEAYEVLSDPSKRAAYDQYGHAGVDPQMGAGAGGAGYGGANFSDIFGDVFSDFFSGGRGGSRGGAQRGSDLRYTLELDLEEAVRGTTVTIRVPTLVECKTCDGSGAKKGTSPVTCTTCGGIGQVRMQQGFFSVQQTCPRCHGSGKMISDPCGSCHGQGRVEEQKTLSVKVPPGVDTGDRIRLSGEGEAGTQGGPAGDLYVVVNVREHAIFQRDGKHLYCEVPISFADAALGGELEVPTLDGRVKLKIPEGTQTGKQFRLRGKGVAPVRGGAAGDLMCRVVVETPVNLSKRQREMLEEFRGTLQGDTSHSPKASGWFEGVKRFFGDV

SEQ ID NO: 7471 - protein, 269 aa, Neisseria meningitidis
MTALPRYAVFGNPVAHSKSPQIHRQFALQEGVDIEYERICADIGGFAQAVSTFFGTGGCGANVTVPFKQEAFHLADEHSDRALAAGAVNTLILLKNGKLRGDNTDGIGLANDITQVKNIAIEGKTILLLGAGGRVRGVIPVLKEHRPARIVIANRTRAKAEELAQLFGIEAVPMADVNGGFDIIINGTSSGLNGQIPDIPPDIFQNCALAYDMVYGCAAKPFLDFARQSGAKKTADGLGMLVGQAAASYALWRGFTPDIRPVIEYMKAM

SEQ ID NO: 7472 - protein, 394 aa, Fusobacterium nucleatum subsp. polymorphum
MAKRDYYEVLGVDKNASENDIKKAYRKAAMKYHPDKFANATDAEKKDAEEKFKEINEAYQVLSDNEKKQQYDQFGHAAFEQGGAGFGGGFNAGGFDFGDIFGDNIFGGGGGFGGFEGFSGFGGSSRRSYVEPGNDLRYNLEITLEEAAKGVEKTIKYKRTGKCEHCHGTGAEDDKMKTCPTCNGQGTIKTQQRTILGVMQSQSVCPDCHGTGKVPEKKCKHCRGTGTAKETVEKKINVPAGIDDGQKLKYAGLGEASQSGGPNGDLYIVIRIKPHDIFIRQGDNLYCEVPISYSTAVLGGEVEVPTLNGKKTVKVPEGTESGKLLKVSGEGIKSLKGYGKGDIIVKFTIETPKKLTDKQKELLQKFEESLNDKNYEQKTSFMKRLKKIFKDIID

SEQ ID NO: 7473 - protein, 269 aa, Neisseria meningitidis
MHALPRYAVFGNPVAHSKSPQIHQQFALQEGVDIEYERICADIGGFAQAVSTFFETGGCGANVTVPFKQEAFHLADEHSERALAAGAVNTLIFLKNGKLRGDNTDGIGLANDITQVKNIAIEGKTILLLGAGGRVRGVIPVLKEHRPARIVIANRTHAKAEELARLFGIEAVPMADVNGGFDIIINGTSGGLSGHCPAVSREIFRNCRLAYDMVYGDAAQAFLNFAQSNGAAEVSDGLGMLVGQAAASYHIWRGFTPDIRPIIEYMKAL

SEQ ID NO: 7474 - protein, 426 aa, Neisseria meningitidis MC58
MENSLKEAALKFHEFPVPGKISVTPTKSLATDKDLALAYSPGVAAPCMEIHADPQNAYKYTAKGNLVAVISNGTAVLGLGDIGALAGKPVMEGKGVLFKKFAGVDVFDIEIDEKDPQKLVDIIAALEPTFGGINLEDIKAPECFYIERELRKRCKIPVFHDDQHGTAIITAAAVLNALRFTGRKIEEATLVCSGAGAAAIACLNQLLDLGLKRENVTVCDSKGVIYQTREDKDRMDESKQFYAIEDNGQRVLADAVKGKDIFLGLSGANLLTPEILNTMNEKPIVFAMANPNPEILPPLAKETRPDVVIGTGRSDFPNQVNNVLCFPFIFRGALDVGATTINEEMKRACVYALADLAMEEVTEEVVAAYGKKFEFGAEYLIPTPFDSRLLPRVATAAAKAAMESGVATRPIADLEAYAAKLSEWKL

SEQ ID NO: 7475 - protein, 269 aa, Neisseria meningitidis
MHALPRYAVFGNPVATSKSPQIHQQFALQEGVDIEYERICADIGGFAQAVSTFFETGGCGANVTVPFKQEAFHLADEHSERALAAGAVNTLIFLKNGKLRGDNTDGIGLANDITQVKNIAIEGKTILLLGAGGRVRGVIPVLKEHRPARIVIANRTHAKAEELARLFGIEAVPMADVNGGFDIIINGTSGGLSGQLPAVSPEIFLGCRLAYDMVYGDAAQEFLNFAQSNGAAEVSDGLGMLVGQAAASYALWRGFTPDIRPVIEYMKAM

SEQ ID NO: 7476 - protein, 408 aa, Novosphingobium aromaticivorans DSM 12444
MKPLGPIPPGYETIDGELAVDGHKVTDLVMQAGGTPLFVYSRALLTRRVQDLRAAMPERLAIHYAVKANPYIPLLSHMLELVDGFDIASGGELAIVRDAGIDPAMVSFAGPGKRDAELEAAIAAAVTLNLESEGEATRALAIAGRLGIVPRLAIRVNPDFDLKGSGMKMGGGAKPFGIDAERVPALARKLISAGAEWRGFHIFAGSQALSADAIIETQAQTIGLAARLAEETGAPLPKCNLGGGFGIPYFPGDEPVDVVAVGAALGDQFAALPDVLRDTAFCIELGRYLVGEAGIYLATVIDRKESHGEVYLVTDGGLHHQLAASGNFGTVVRRNYPSAIATRFGAAVEEEASIVGCLCTPLDRLADKGGFPRTDTGDLVVIFCAGAYGASASPAAFLGQGPAREMLV

SEQ ID NO: 7477 - protein, 1168 aa, Arabidopsis thaliana
MVSGVGGSGGGRGGEEEPSSSHTPNNRRGGEQAQSSGTKSLRPRSNTESMSKAIQQYTVDARLHAVFEQSGESGKSFDYSQSLKTTTYGSSVPEQQITAYLSRIQRGGYIQPFGCMIAVDESSFRIIGYSENAREMLGLMPQSVPTLEKPEILAMGTDVRSLFTSSSSILLERAFVAREITLLNPVWIHSKNTGKPFYAILHRIDVGVVIDLEPARTEDPALSIAGAVQSQKLAVRAISQLQALPGGDIKLLCDTVVESVRDLTGYDRVMVYKFHEDEHGEVVAESKRDDLEPYIGLHYPATDIPQASRFLFKQNRVRMIVDCNATPVLVVQDDRLTQSMCLVGSTLRAPHGCHSQYMANMGSIASLAMAVIINGNEDDGSNVASGRSSMRLWGLVVCHHTSSRCIPFPLRYACEFLMQAFGLQLNMELQLALQMSEKRVLRTQTLLCDMLLRDSPAGIVTQSPSIMDLVKCDGAAFLYHGKYYPLGVAPSEVQIKDVVEWLLANHADSTGLSTDSLGDAGYPGAAALGDAVCGMAVAYITKRDFLFWFRSHTAKEIKWGGAKHHPEDKDDGQRMHPRSSFQAFLEVVKSRSQPWETAEMDAIHSLQLILRDSFKESEAAMNSKVVDGVVQPCRDMAGEQGIDELGAVAREMVRLIETATVPIFAVDAGGCINGWNAKIAELTGLSVEEAMGKSLVSDLIYKENEATVNKLLSRALRGDEEKNVEVKLKTFSPELQGKAVFVVVNACSSKDYLNNIVGVCFVGQDVTSQKIVMDKFINIQGDYKAIVHSPNPLIPPIFAADENTCCLEWNMAMEKLTGWSRSEVIGKMIVGEVFGSCCMLKGPDALTKFMIVLHNAIGGQDTDKFPFPFFDRNGKFVQALLTANKRVSLEGKVIGAFCFLQIPSPELQQALAVQRRQDTECFTKAKELAYICQVIKNPLSGMRFANSLLEATDLNEDQKQLLETSVSCEKQISRIVGDMDLESIEDGSFVLKREEFFLGSVINAIVSQAMFLLRDRGLQLIRDIPEEIKSIEVFGDQIRIQQLLAEFLLSIIRYAPSQEWVEIHLSQVSKLMADGFAAIRTEFRMACPGEGLPPELVRDMFHSSRWTSPEGLGLSVCRKILKLMNGEVQYIRESERSYFLIILELPVPRKRPLSTASGSGDMMLMMPY

SEQ ID NO: 7478 - protein, 348 aa, Crocosphaera watsonii WH 8501
MTSVQIPVIPEQSLDRECTTLSRHVLQQLQSFSPEAQDLSAIMNRIALAGKLISRRLSQAGLMADVLGFTGETNVQGESVKKMDVYANDVFISVFKQSGLVCRLASEEMDKPYYIPENCPIGRYTLLYDPIDGSSNVDINLNVGSIFAIRQQSGEDLDGEATDLLQDGRGQLAAGYIVYGPSTMLVYTIGHGVHSFILDPSLGEFILAQENIQIPDHGPVYSTNEGNFWQWDEAIRDYTRYVHRHEGYTARYSGALVGDIHRILMQGGVFLYPGTVKKPEGKLRLLYETAPLAFLMEQAGGKASDGVKPILDVVPDKLHARSPLVIGSKEDVSLVESFIQDHQRRGNA

SEQ ID NO: 7479 - protein, 1158 aa, Arabidopsis thaliana
GVGGSGGGRGGEEEPSSSHTPNNRRGGEQAQSSGTKSLRPRSNTESMSKAIQQYTVDARLHAVFEQSGESGKSFDYSQSLKTTTYGSSVPEQQITAYLSRIQRGGYIQPFGCMIAVDESSFRIIGYSENAREMLGLMPQSVPTLEKPEILAMGTDVRSLFTSSSSILLERAFVAREITLLNPVWIHSKNTGKPFYAILHRIDVGVVIDLEPARTEDPALSIAGAVQSQKLAVRAISQLQALPGGDIKLLCDTVVESVRDLTGYDRVMVYKFHEDEHGEVVAESKRDDLEPYIGLHYPATDIPQASRFLFKQNRVRMIVDCNATPVLVVQDDRLTQSMCLVGSTLRAPHGCHSQYMANMGSIASLAMAVIINGNEDDGSNVASGRSSMRLWGLVVCHHTSSRCIPFPLRYACEFLMQAFGLQLNMELQLALQMSEKRVLRTQTLLCDMLLRDSPAGIVTQSPSIMDLVKCDGAAFLYHGKYYPLGVAPSEVQIKDVVEWLLANHADSTGLSTDSLGDAGYPGAAALGDAVCGMAVAYITKRDFLFWFRSHTAKEIKWGGAKHHPEDKDDGQRMHPRSSFQAFLEVVKSRSQPWETAEMDAIHSLQLILRDSFKESEAAMNSKVVDGVVQPCRDMAGEQGIDELGAVAREMVRLIETATVPIFAVDAGGCINGWNAKIAELTGLSVEEAMGKSLVSDLIYKENEATVNKLLSRALRGDEEKNVEVKLKTFSPELQGKAVFVVVNACSSKDYLNNIVGVCFVGQDVTSQKIVMDKFINIQGDYKAIVHSPNPLIPPIFAADENTCCLEWNMAMEKLTGWSRSEVIGKMIVGEVFGSCCMLKGPDALTKFMIVLHNAIGGQDTDKFPFPFFDRNGKFVQALLTANKRVSLEGKVIGAFCFLQIPSPELQQALAVQRRQDTECFTKAKELAYICQVIKNPLSGMRLANSLLEATDLNEDQKQLLETSVSCEKQISRIVGDMDLESIEDGSFVLKREEFFLGSVINAIVSQAMFLLRDRGLQLIRDIPEEIKSIEVFGDQIRIQQLLAEFLLSIIRYAPSQEWVEIHLSQVSKQMADGFAAIRTEFRMACPGEGLPPELVRDMFHSSRWTSPEGLGLSVCRKILKLMNGEVQYIRESERSYFLIILELPVPRKRPLSTASGSGD

SEQ ID NO: 7480 - protein, 223 aa, Triticum aestivum
IPLPPSLVLLLPLPQFRALRRFRRSRRRLILLHLTGRPPGHAPEPNPSPCLPVIAAAVASDPEKYNEAFLGKPNEAYCAWIMDPEKWGGAIELSILSEYYGREIAAYDIQTTRCDLYGQGKNYNERAMLIYDGLHYDALAMSPAEGAPEEFDQTIYVVDQNRSIGPVEGLALNLAKEAHRKRSYTDTANFTLRCGVCQIGVIGQKEAVEHAQATGHVNFQEYK

SEQ ID NO: 7481 - protein, 180 aa, Zea mays
MALRLPISSSHGLASTPAPISTTTCRPAVLATAAAQKRSLLLATASETRGVAPVRSSGIETSTVGLGCEAVTGQVTEVNKDTFWPIVEAAGDKVVVLDMYTEWCGPCKVMAPKFQEMSEKNLDVVFLKLDCNQDNKPLAKELGIKVVPTFKILKGGKVVKEVTGAKIDELAQAIDTVKSD

SEQ ID NO: 7482 - protein, 353 aa, Glycine max
  misc_feature (167)..(167): Xaa can be any naturally occurring amino acid
SLEKHFTISVSAFSLFYNGLHHRRVDASRRIVGNLRRGSVSGVLTSSVSKAHPRRHTSEVSLAGDFSLRRVAVVLSSRSGGEHSVSVTKLSRLSTTSSSPLAVGTDDDSDAGVTHHSPTQVLKNFNEIRLLRIELPSGELGIEDGVLLKWRADFGSTLDNCVILGAXSSVFHPKDNLTDPIPTTNCNANDDNGSIPDSFYTNGGLKLRVVWTISSLIAASARHYLLQPIISEHATLDNLVLTDADGQGVLYMNREQLEELRVKPLSASSASKRTLVPALNMRLWYAPHLELPTGVVLKGATLVAIRPSELSPNTAKKEASDLSWVSTAFEEPYRTAATMLVKRRTYCLEMNSF

SEQ ID NO: 7483 - protein, 462 aa, Silicibacter pomeroyi DSS-3
MTTTQHTPTPRDNFLRENNGRHQIHPMTHPLIIENRPPRIIVKGEGSYVTDIDGKTYVDGVGGLWNVNVGHNRPEVKAAITAQMEEISYYSSFAGTVTPPSIELSAKIMEMTADEDMARVLFSANGSDAVETALKLSRQYWKLEGEPERTGFISLKQGYHGIQFGGTSVNGSTLYRSAYGPLLPGCYQVDSPWTYRNPYSEDPEELAEAVITQIDRLIQHQGAHTIAAFIAEPVQGAGGIIVPPASFWPRLRQVLDKYGILLISDEVVTGFGRTGAMFGARGWGVKPDIMCFAKGITAGYIPLGATVINERVFAAWQKGIDPTGFIMHGYTATGHALGCAAANATLKIVEDEDLPGNAGRMGQRLMEGLKDIPNWSSLVGEVRGKGLMVGLDLVADKDTREPIDPGKGQGEMVATFARDEGVIVRPAGPVIIISPPLTLSEKETDKIVDALIKALRRYEEEK

SEQ ID NO: 7484 - protein, 492 aa, Thalictrum flavum subsp. glaucum
MELVSLWLVSATLALVVAITILIPMVTSSSSFSQMKWPTGPNKLPIIGNLHQLGGDVLHVALAKLAQVHGSVMTVWIGNWRPIIVISDIDKAWEVLVNKSSDYGARDMPEITKIASASWHTISTSDAGAFWQTVRKGLQSGAMGPLNIAAQSQFQERDMKRLIQALRDEAAQNNNIVKPLDHIKKNTVRLLTRLIFGQTFDDDKFVESMHFEIDDIIRISGYARLAEAFYYAKYLPSHKKAEREAYLVKCRVEDLVSPLLSSNPPTNSYLYFLLSQRFSEEVIIFCIFELYLLGVDSTSSTTTWALAYLIREQAIQEKLYQDTRMTLGDVDLVKIEDVSKLKYLQAVVKETMRMKPIAPLAIPHKTAKDTTLMGSKVAKGTRIMVNLYALHHNQNIWTNPYKFMPERFLQGEDGSASNKAMEQSFLPFSAGMRICAGMDLGKLQFAFALANLVNAFKWSCVEEGKFPDMSEELSFVLLMKTPLEAKITARKF

SEQ ID NO: 7485 - protein, 322 aa, Triticum aestivum
MTAKGGASPAPGGAGAAANGRFFTVGLVTAWYSSNIGVLLLNKYLLSNYGFKYPIFLTMCHMSACALFSYAAIAWLRIVPMQLVRSRVQLAKISALSLVFCGSVVSGNVSLRYLPVSFNQAVGATTPFFTAVFAYIMTVKRESWITYLTLVPVVTGVVIASGGEPSFHLFGFIMCIGATAARALKTVLQGILLSSEGEKLNSMNLLLYMAPIAVILLLPATLFMEDNVVGVTIELAKKDFTIVWLLLFNSCLSYFVNLTNFLVTKHTSALTLQVLGNAKGAVAVVVSILIFKNPVSVTGMLGYTLTVIGVILYSESKKRSKP

SEQ ID NO: 7486 - protein, 323 aa, Zea mays
ASERHHQSTTPPSVTTACLPACVSPPGPGSRNPPPTSSDSFPLSSSPVLQPPALCCRPVRLPASSLLGSRGRAMKLRTKRPEWKSLVPLQLSRLSRKSAMRFFLFPKVQSAGQSPDDTPVYLNVYDLTPMNGYIYWAGLGIFHSGIEVHGVEYAFGAHDFPTSGVFEVEPRQCPGFRFRKSIFLGTTCLDPIQVRQFMELQSVNYNGDTYHLITKNCNHFCKDMCYKLTGNKIPKWVNRLARIGAICNCLLPESLKISPVGHDPNSQSEDSEKRRLRNPFSCFSSISSHRQLPSSSPFPPSPVKGGLPRCSSRKSSTASPKNR

SEQ ID NO: 7487 - protein, 333 aa, Mesorhizobium loti MAFF303099
MHARSLDKKPLDRQASIDSALRTVATEQAGIAALAEALENGLAAPFAQAVDMISKIEGRLIVTGVGKSGHIGSKIAATLASTGTPAFFVHPVEANHGDLGMIAKDDAIIAISWSGESKEMLGIVAYSRRFSIPLIAVTSGETSALARAADVVLLLPRTPEACPHGLAPTTSTLLQLVIGDALAIALLEARGFTPDHFRTFHPGGQLGANLTMVSEIMRVGDQMPLAVLGTKMPEAVMTLSQKKVGCVLIVDANGELAGIITDGDVARNLHRNLADVIVDEVMTRTPKTVDPQTLAGTAIALLNEHNIGALVVTRNNMPLGVVHFHDLLRIGAA

SEQ ID NO: 7488 - protein, 439 aa, Bordetella pertussis Tohama I
MTQTPNTGSPHRVVIVGGGAGGLELAAKLGRAHGRERVTLVDSRPFHIWKPSLHEAAAGTLDIHQEGLSYLMLANMCNFTFAQGELQGIERERRQIQVGPVADPSGQQVLPPRELSYDTLVLAMGSTSNFFNTPGAAEHAVTLDTTENAEQFRLTMLKAMVQVDLRKVHDPSARLDLVIVGGGATGVELAVELIEASHVVSAYGLPNFRADRDLVITLVEGAPRILSALPEKISRATHARLTELGVRVETDCRVAEVGADHVVTADGRRFEATMCLWAAGIEGPPLFRQLGLPLNRLGQLEVNERQESPDPHILALGDCCAAPWKDGRTVPARAQAAHQQADYLARKLTARLRNAAEPTEAYAYHDHGSLVSLGQGSGVGSLMGKLAGRGLFVSGTLARLMYMSLHLMHHRAVLGISRTATLALARLLMRRTRPRVKLH

SEQ ID NO: 7489 - protein, 424 aa, Arabidopsis thaliana
MTTMISNLPRVLIEEIFFRVPLKSLRAVRLTCKSWNTLSKSRSFRKLYISKRATREEESMMIAMMNFDLYSMRVVVDDDVDPSKAFKKKRNKKSIAFKRQPIFLDEQVKISQVFHCEGLLLCFLKEDDTRVVVWNPYCGQTRWIQLRYSHRPHKDRFIYALGYKDKESRGSFQLLRFVDYFLGAPKNQYFWYEIYDFNSDSWTTLDVTPHWCIYCCDRGVSLNGNTYWCAKERKAEDDIVDHIISFDFTNERFGPLLPLPSKVMEHEYEIVTLSYVKEEKLAALFQHYEADWNEFDIWITTKIDAEVVSWSMFLRMDTGPRIEVPHICEGFFIDEEKKVAMGFEEDFDRKTFIIIGEAGYVRKLDIKAHVDRKCRPTVCSYVPSLVQIKKPARGKRKRQSSLEKRLFDQNMLRLEAFKKLGGYF

SEQ ID NO: 7490 - protein, 377 aa, Glycine max
MADTEDIQPLVCDNGTGMVKAGFAGDDAPRAVFPSIVGRPRHTGVMVGMGQKDAYVGDEAQSKRGILTLKYPIEHGIVSNWDDMEKIWHHTFYNELRVAPEEHPVLLTEAPLNPKANREKMTQIMFETFNTPAMYVAIQAVLSLYASGRTTGIVLDSGDGVSHTVPIYEGYALPHAILRLDLAGRDLTDALMKILTERGYSFTTTAEREIVRDMKEKLAYLALDYEQELETSKTSSAVEKSYELPDGQVITIGAERFRCPEVLFQPSMIGMEAVGIHETTYNSIMKCDVDIRKDLYGNIVLSGGSTMFPGTADRMSKEITALAPCSMKIRVVARPERKYSVWIGGSILASLSTFQQMWIAKAEYDESGPSIVHRKCF

SEQ ID NO: 7491 - protein, 359 aa, Oryza sativa (japonica cultivar-group)
MASSSSSSSLCDNHLLQDDLIPWPSMPFAPAPNTFGLNHQWSQPPMLSSSTDQLSSYELESLQSVESQLAAAAPPTLSPHLQAHQLSTVLMMQELGFQWSSCAAPADQHSIASSTNNNSNVMMNEEELRPRPDQSLISNPRSCSATTLLPPPHLHLDGAVLPSINVSRLQKLAAGDEPLQICCKRQAAAAAVVGHSSIRDEHVPCPYAGPPAHLIQGPSNTLQLLRVTCVIFLPQKVLMKRNTNAAAQGRGGRHGSSTEHRSSTALPPSSKKPRLESHSSSMLPSFKVRKEKLGDRIAALQQLVSPFGKTDTASVLMEAIGYIKFLQDQVETLSGPYLRSSKNSKKLACRAAQQQRVKR

SEQ ID NO: 7492 - protein, 269 aa, Neisseria meningitidis
MHALPRYAVFGNPVAHSKSPQIHQQFALQEGVDIEYERICADIGGFVQAVSTFFETGGCGANVTVPFKQEAFALADEHSDRALAAGAVNTLILLKNGKLRGDNTDGIGLANDITQVKNIAIDGKNILLLGAGGRVRGVIPVLLAQNPARIVIANRTRAKAEELAQLFGIEAVPMADVNGGFDIVINGTSGGLNGQIPAVSPEIFRNCRLAYDMVYGDAAQEFLNFAQSNGAAEVSDALGMLVGQAAASYALWRGFTPDIRPVIEYMKAL

SEQ ID NO: 7493 - protein, 353 aa, Kitasatospora griseola
MTEAHATAGVPMRWVGPVRISGNVATIETQVPLATYESPLWPSVGRGAKVSRLTEKGIVATLVDERMTRSVLVEATDALTALSAARTIEARIDELRELVRGCSRFAQLIGIRHEITGNLLFVRFEFSTGDASGHNMATLASDVLLQHLLETVPGISYGSISGNYCTDKKATAINGILGRGKNVVTELLVPRDVVADVLNTTAAKIAELNLRKNLLGTLLAGGIRSANAHYANMLLAFYLATGQDAANIVEGSQGVVTAEDRDGDLYLACTLPNLIVGTVGNGKGLGFVETNLNRLGCRADREPGENARRLAVIAAATVLCGELSLLAAQTNPGELMRAHVQLERGHTTAKAGV

SEQ ID NO: 7494 - protein, 1161 aa, Arabidopsis thaliana
VSGVGGSGGGRGGEEEPSSSHTPNNRRGGEQAQSSGTKSLRPRSNTESMSKAIQQYTVDARLHAVFEQSGESGKSFDYSQSLKTTTYGSSVPEQQITAYLSRIQRGGYIQPFGCMIAVDESSFRIIGYSENAREMLGLMPQSVPTLEKPEILAMGTDVRSLFTSSSSILLERAFVAREITLLNPVWIHSKNTGKPFYAILHRIDVGVVIDLEPARTEDPALSIAGAVQSQKLAVRAISQLQALPGGDIKLLCDTVVESVRDLTGYDRVMVYKFHEDEHGEVVAESKRDDLEPYIGLHYPATDIPQASRFLFKQNRVRMIVDCNATPVLVVQDDRLTQSMCLVGSTLRAPHGCHSQYMANMGSIASLAMAVIINGNEDDGSNVASGRSSMRLWGLVVCHHTSSRCIPFPLRYACEFLMQAFGLQLNMELQLALQMSEKRVLRTQTLLCDMLLRDSPAGIVTQSPSIMDLVKCDGAAFLYHGKYYPLGVAPSEVQIKDVVEWLLANHADSTGLSTDSLGDAGYPGAAALGDAVCGMAVAYITKRDFLFWFRSHTAKEIKWGGAKHHPEDKDDGQRMHPRSSFQAFLEVVKSRSQPWETAEMDAIHSLQLILRDSFKESEAAMNSKVVDGVVQPCRDMAGEQGIDELGAVAREMVRLIETATVPIFAVDAGGCINGWNAKIAELTGLSVEEAMGKSLVSDLIYKENEATVNKLLSRALRGDEEKNVEVKLKTFSPELQGKAVFVVVNACSSKDYLNNIVGVCFVGQDVTSQKIVMDKFINIQGDYKAIVHSPNPLIPPIFAADENTCCLEWNMAMEKLTGWSRSEVIEKMIVGEVFGSCCMLKGPDALTKFMIVLHNAIGGQDTDKFPFPFFDRNGKFVQALLTANKRVSLEGKVIGAFCFLQIPSPELQQALAVQRRQDTECFTKAKELAYICQVIKNPLSGMRFANSLLEATDLNEDQKQLLETSVSCEKQISRIVGDMDLESIEDGSFVLKREEFFLGSVINAIVSQAMFLLRDRGLQLIRDIPEEIKSIEVFGDQIRIQQLLAEFLLSIIRYAPSQEWVEIHLSQVSKQMADGFAAIRTEFRMACPGEGLPPELVRDMFHSSRWTSPEGLGLSVCRKILKLMNGEVQYIRESERSYFLIILELPVPRKRPLSTASGSGDM

SEQ ID NO: 7495 - protein, 269 aa, Neisseria meningitidis
MTALPRYAVFGNPVAHSKSPQIHRQFALQEGVDIEYERICADIGGFAQAVSTFFGTGGCGANVTVPFKQEAFHLADEHSDRALAAGAVNTLILLKNGKLRGDNTDGIGLANDITQVKNIAIEGKTILLLGAGGRVRGVIPVLKEHRPARIVIANRTRAKAEELSRLFGIEAVPMADVNGGFDIIINGTSGGLNGQIPDIPPDIFQNCALAYDMVYSCAAKPFLDFARQSGAKKTADGLGMLVGQAAASYALWRGFTPDIRPVIEYMKAM

SEQ ID NO: 7496 - protein, 356 aa, Hydrogenobacter thermophilus
MPIKDYYQILGVSKDATAEEIKKAYRRLAKEYHPDISADENASEKFKEINEAYHILSDEERRKEYDRILKSGDEKSYRDFMEYIQDFLESIWQGMRRSPKPKKGGDVRLKLELTLEEAAFGCEKDIEYERWIDCPTCEGKGYVGKMEKVTCHACEGTGRRVSGIFSFPRPCSVCKGRGFIIKNQCPACSGRGRVAMHSLLRVNVPPGTDEGDVLKVPGKGHTGERGGEAGDLYLRVSLKPHPIFKKVGKDLYMEAFISFPLAVLGGTTKIKTLEGSYQEVFLQPGTECGSTKRLQGLGYPIAGGRGDLIITFRIEVPKNVNSNIRALIEKLAKELGEEGIEYQSGVITKILSLLKL

SEQ ID NO: 7497 - protein, 1158 aa, Arabidopsis thaliana
GVGGSGGGRGGKEEPSSSHTPNNRRGGEQAQSSGTKSLRPRSNTESMSKAIQQYTVDARLHAVFEQSGESGKSFDYSQSLKTTTYGSSVPEQQITAYLSRIQRGGYIQPFGCMIAVDESSFRIIGYSENAREMLGLMPQSVPTLEKPEILAMGTDVRSLFTSSSSILLERAFVAREITLLNPVWIHSKNTGKPFYAILHRIDVGVVIDLEPARTEDPALSIAGAVQSQKLAVRAISQLQALPGGDIKLLCDTVVESVRDLTGYDRVMVYKFHEDEHGEVVAESKRDDLEPYIGLHYPATDIPQASRFLFKQNRVRMIVDCNATPVLVVQDDRLTQSMCLVGSTLRAPHGCHSQYMANMGSIASLAMAVIINGNEDDGSNVASGRSSMRLWGLVVCHHTSSRCIPFPLRYACEFLMQAFGLQLNMELQLALQMSEKRVLRTQTLLCDMLLRDSPAGIVTQSPSIMDLVKCDGAAFLYHGKYYPLGVAPSEVQIKDVVEWLLANHADSTGLSTDSLGDAGYPGAAALGDAVCGMAVAYITKRDFLFWFRSHTAKEIKWGGAKHHPEDKDDGQRMHPRSSFQAFLEVVKSRSQPWETAEMDAIHSLQLILRDSFKESEAAMNSKVVDGVVQPCRDMAGEQGIDELGAVAREMVRLIETATVPIFAVDAGGCINGWNAKIAELTGLSVEEAMGKSLVSDLIYKENEATVNKLLSRALRGDEEKNVEVKLKTFSPELQGKAVFVVVNACSSKDYLNNIVGVCFVGQDVTSQKIVMDKFINIQGDYKAIVHSPNPLIPPIFAADENTCCLEWNMAMEKLTGWSRSEVIGKMIVGEVFGSCCMLKGPDALTKFMIVLHNAIGGQDTDKFPFPFFDRNGKFVQALLTANKRVSLEGKVIGAFCFLQIPSPELQQALAVQRRQDTECFTKAKELAYICQVIKNPLSGMRFANSLLEATDLNEDQKQLLETSVSCEKQISRIIGDMDLESIEDGSFVLKREEFFLGSVINAIVSQAMFLLRDRGLQLIRDIPEEIKSIEVFGDQIRIQQLLAEFLLSIIRYAPSQEWVEIHLSQVSKQMADGFAAIRTEFRMACPGEGLPPELVRDMFHSSRWTSPEGLGLSVCRKILKLMNGEVQYIRESERSYFLIILELPVPRKRPLSTASGSGD

SEQ ID NO: 7498 - protein, 269 aa, Neisseria gonorrhoeae
MHALPRYAVFGNPAAHSKSPQIHQQFALQEGVDIEYGRICADIGGFAQAVSTFFETGGCGANVTVPFKQEAFHLADEHSDRALAVGAVNTLVWLEDGRIRGDNTDGIGLANDITQVKNIAIEGKTILLLGAGGAVRGVIPVLKEHRPARIVIANRTRAKAEELARLFGIEAVPMADVNGGFDIIINGTSGGLSGQLPAVSPKIFRDCRLAYDMVYGEAAKPFLDFARQSGAKKTADGLGMLVGQAAASYALWRGFKPDIRPVIEHMKAL

SEQ ID NO: 7499 - protein, 379 aa, Acetobacter aceti
MATQLDYYAILEVSRTATADELKKSYRKLAMKYHPDRNPGDDAAEAKFKEINQAYDILKDEQKRAAYDQYGHAAFEGGGPGPGGFDFSGGFGGGGLGDIFEQMFGDMMGGRRGGRARTGNDIQTHVEITLEEAFSGVKKDVRVITLGVRTCHGTGSDDGASGVEVCPSCHGAGKVRAHEGFFVVERPCPTCHGAGKVVKNPCKFCHGEGTVEKERTVEVQIPAGVEDGTRIRLSGEGEAGGNGVPPGDLYIHVSVTEHGIFQRDGANIYCRVPFRMAQAALGTEIEVPVIDGSRTKVKIPAGTQTGATFSLRGKGFSVLRSTARGDMYIQVTVETPQNLSKRQRELLEEFEKEAGEDVKQSPEHTGFFRRVRDFFEGKE

SEQ ID NO: 7500 - protein, 429 aa, Staphylococcus aureus subsp. aureus COL
MNFSESERLQQLSNEYILGGVNSPSRSYKAVGGGAPVVMKEGHGAYLYDVDGNKFIDYLQAYGPIITGHAHPHITKAIQEQAAKGVLFGTPTELEIEFSKKLRDAIPSLEKIRFVNSGTEAVMTTIRVARAYTKRNKIIKFAGSYHGHSDLVLVAAGSGPSQLGSPDSAGVPESVAREVITVPFNDINAYKEAIEFWGDEIAAVLVEPIVGNFGMVMPQPGFLEEVNEISHNNGTLVIYDEVITAFRFHYGAAQDLLGVIPDLTAFGKIVGGGLPIGGYGGRQDIMEQVAPLGPAYQAGTMAGNPLSMKAGIALLEVLEQDGVYEKLDSLGQQLEEGLLKLIEKHNITATINRIYGSLTLYFTDEKVTHYDQVEHSDGEAFGKFFKLMLNQGINLAPSKFEAWFLTTEHTEEDIKQTLKAADYAFSQMK

SEQ ID NO: 7501 - protein, 1168 aa, Arabidopsis thaliana
MVSGVGGSGGGRGGKEEPSSSHTPNNRRGGEQAQSSGTKSLRPRSNTESMSKAIQQYTVDARLHAVFEQSGESGKSFDYSQSLKTTTYGSSVPEQQITAYLSRIQRGGYIQPFGCMIAVDESSFRIIGYSENAREMLGLMPQSVPTLEKPEILAMGTDVRSLFTSSSSILLERAFVAREITLLNPVWIHSKNTGKPFYAILHRIDVGVVIDLEPARTEDPALSIAGAVQSQKLAVRAISQLQALPGGDIKLLCDTVVESVRDLTGYDRVMVYKFHEDEHGEVVAESKRDDLEPYIGLHYPATDIPQASRFLFKQNRVRMIVDCNATPVLVVQDDRLTQSMCLVGSTLRAPHGCHSQYMANMGSIASLAMAVIINGNEDDGSNVASGRSSMRLWGLVVCHHTSSRCIPFPLRYACEFLMQAFGLQLNMELQLALQMSEKRVLRTQTLLCDMLLRDSPAGIVTQSPSIMDLVKCDGAAFLYHGKYYPLGVAPSEVQIKDVVEWLLANHADSTGLSTDSLGDAGYPGAAALGDAVCGMAVAYITKRDFLFWFRSHTAKEIKWGGAKHHPEDKDDGQRMHPRSSFQAFLEVVKSRSQPWETAEMDAIHSLQLILRDSFKESEAAMNSKVVDGVVQPCRDMAGEQGIDELGAVAREMVRLIETATVPIFAVDAGGCINGWNAKIAELTGLSVEEAMGKSLVSDLIYKENEATVNKLLSRALRGDEEKNVEVKLKTFSPELQGKAVFVVVNACSSKDYLNNIVGVCFVGQDVTSQKIVMDKFINIQGDYKAIVHSPNPLIPPIFAADENTCCLEWNMAMEKLTGWSRSEVIGKMIVGEVFGSCCMLKGPDALTKFMIVLHNAIGGQDTDKFPFPFFDRNGKFVQALLTANKRVSLEGKVIGAFCFLQIPSPELQQALAVQRRQDTECFTKAKELAYICQVIKNPLSGMRFANSLLEATDLNEDQKQLLETSVSCEKQISRIIGDMDLESIEDGSFVLKREEFFLGSVINAIVSQAMFLLRDRGLQLIRDIPEEIKSIEVFGDQIRIQQLLAEFLLSIIRYAPSQEWVEIHLSQVSKQMADGFAAIRTEFRMACPGEGLPPELVRDMFHSSRWTSPEGLGLSVCRKILKLMNGEVQYIRESERSYFLIILELPVPRKRPLSTATGSGDMMLMMPY

SEQ ID NO: 7502 - protein, 338 aa, Oryza sativa
  misc_feature (89)..(89): Xaa can be any naturally occurring amino acid
MAASSTATRLSPPRLHAPTTPSPHLPLRRSRFSPLRAAKLEAVLTIGTHLIPHPRKAETGGEDAFFVNGDDGGVFAVADGVSGHSLVYXRWAEKDVNPALFSRELMAHTSTFLKDEEVNHDPQLLLMKAHAATTSVGSATVIIAMLEKTGILKIASVGDCGLKVIRKGQVMFSTCPQEHYFDCPYQLSSEAIGQTYLDALVCTVNLMEGDMIVSGSDGFFDNIFDQEIVSVISESPGVDEAAKALAELARKHSVDVTFDSPYSMEARSRGFDVPSWKKFIGGKLIGGKMDDITVIVAQVKAVMIPDDEGVDEEKGQGDEQGSAVAVASSEQKEDSITT

SEQ ID NO: 7503 - protein, 391 aa, Mycoplasma gallisepticum
MSSKRDYYEILEVSRSATQQDIKKAFRKLAMKYHPDRNKDSDAEEKFKEVNEAYEVLSDEEKRKLYDTYGHEGLNASGFHQGGFNPYDVFNSVFSGFDFEGGFGDVFSQFFGGGGSGFHNQEYIEEVDVNLVHEIKINFLEAANGCIKNVKYTRQVTCPDCNGSGSADGDVITCSDCNGEGFLVEQRRTLLGMFQTKKTCPSCKGEGQTIKNKCKKCKSRRMVDEVVERKVSIDSNVFYQDVVIVRGEGHIYKNLVGDLFLRVKIEPSRVFELRDNHVVVNVLVDPLVAITGGTILIPTLKEIKEINLKAGTKNGDIITIANGGINLKLDSRVYGANYNQKGDLIVVINYARPSEYSKQEITKLKEFIKPNKEVNLYETLMKKELNNKDSQ

SEQ ID NO: 7504 - protein, 1160 aa, Arabidopsis lyrata
GVGGSGRGGEAEPSSSHTTNNRRGGEQAQSSGTKSLRPRESMSKAIQQYTVDARLHAVFEQSGESGKSFDYSQSLKTTTYGSSVPEQQITAYLSRIQRGGYIQPFGCMIAVDESSFRIIGYSENAREMLGLMPQSVPTLEKPEILAMGTDVRSLFTSSSSILLERAFVAREITLLNPVWIHSKNTGKPFYAILHRIDVGVVIDLEPARTEDPALSIAGAVQSQKLAVRAISQLQSLPGGDIKLLCDTVVESVRDLTGYDRVMVYKFHEDEHGEVVAESKRDDLEPYIGLHYPATDIPQASRFLFKQNRVRMIVDCNAKPVLVVQDDRLTQSMCLVGSTLRAPHGCHSQYMANMGSIASLAMAVIINGNEEDGSNVASGRSSMRLWGLVVCHHTSSRCIPFPLRYACEFLMQAFGLQLNMELQLALQMSEKRVLRTQTLLCDMLLRDSPAGIVTQSPSIMDLVKCDGAAFLYHGKYYPLGVAPSEVQIKDVVEWLLANHADSTGLSTDSLGDAGYPDAAALGDAVCGMAVAYITKRDFLFWFRSHTAKEIKWGGAKHHPEDKDDGQRMHPRLSFQAFLEVVKSRSQPWETAEMDAIHSLQLILRDSFKESEAAMNSKAVDGAVQPCRDMAGEQGIDELGAVAREMVRLIETATVPIFAVDAGGCINGWNAKIAELTGLSVEEAMGKSLVSDLIYKENEETVNKLLSRALRGDEEKNVEVKLKTFSPELQGKAVFVVVNACFSKDYLNNIVGVCFVGQDVTGQKLVMDKFINIQGDYKAIVHSPNPLIPPIFAADENTCCLEWNMAMEKLTGWSRSEVIGKMLVGEVFGSCCMLKGPDALTKFMIVLHNAIGGQETDKFPFPFFDRNGKFVQALLTANKRVSLDGKVIGAFCFLQIPSPELQQALAVQRRQDTECFTKAKELAYICQVIKNPLSGMRFANSLLEATDLNEDQKQLLETSVSCEKQISRIVGDMDLESIEDGSFELKMAEFFLGSVINAIVSQAMFLLRDRGLQLIRDIPEEIKSIVVFGDQIRIQQLLAEFLLSIIRYAPSQEWVEIHLSQVSKQAADGFTAIRTEFRMACPGEGLPPELVRDMFHSSRWTSPEGLGLSVCRKILKLMNGEVQYIRESERSYFFIILELPVPRKRPLSTASGNSNMMLMMPY

SEQ ID NO: 7505 - protein, 480 aa, Medicago sativa
MRKSVTLKAGEVPSRLTRARAVALSTSGQLPPMKEVAPGTQNQKQPLRANSKRAVSDVTYLPHEMRAILQDVTNNCGENTNRSCLNPTEIQAKKRKVAKPAQPDVSNEVPSAAERPPFIADSKRVSSMEMRLRSSEDFRCLDDLEDNAPFRMSSNQSGTNNNLLQNQTSRISARLLSSQKKASQIVAAKKGNISELLDVSKHPDVADIDADFEDPQLCSHYAADIYDHLRVAELSRRPYPNFMETVQQDITPSMRAILVDWLVEVSEGYKLQANTLFLTVYLIDWFLSKNCIERERLQLLGITCMLIATKYEEINAPRIEDFCFITDNTYVVKLESLVLKSSSYQLFAPTTKTFLRRFLRAAQASYKRPSIELEYLANYLAELTLMNYGFLNFLPSMVAASSVFLARWTLDQSSHPWNPTLEQYASYKASDLKATVLALQDLQLNSNDDCPLTAIRKKYTQDKLNCVAALSSPKLLETLF

SEQ ID NO: 7506 - protein, 1164 aa, Arabidopsis thaliana
MVSGGGSKTSGGEAVSSGHRRSRHTSAAEQAQSSANKALRSQNQQPQNHGGGTESTNKAIQQYTVDARLHAVFEQSGESGKSFDYSQSLKTAPYDSSVPEQQITAYLSRIQRGGYTQPFGCLIAVEESTFTIIGYSENAREMLGLMSQSVPSIEDKSEVLTIGTDLRSLFKSSSYLLLERAFVAREITLLNPIWIHSNNTGKPFYAILHRVDVGILIDLEPARTEDPALSIAGAVQSQKLAVRAISHLQSLPSGDIKLLCDTVVESVRDLTGYDRVMVYKFHEDEHGEVVAESKRNDLEPYIGLHYPATDIPQASRFLFKQNRVRMIVDCYASPVRVVQDDRLTQSICLVGSTLRAPHGCHAQYMTNMGSIASLAMAVIINGNEEDGNGVNTGGRNSMRLWGLVVCHHTSARCIPFPLRYACEFLMQAFGLQLNMELQLALQVSEKRVLRMQTLLCDMLLRDSPAGIVTQRPSIMDLVKCNGAAFLYQGKYYSLGVTPTDSQINDIVEWLLANHSDSTGLSTDSLGDGGYPRAAALGDAVCGMAVACITKRDFLFWFRSHTEKEIKWGGAKHHPEDKDDGQRMNPRCSFQTFLEVVKSRCQPWETAEMDAIHSLQLILRDSFKESEAMDSKAAAAGAVQPHGDDMVQQGMQEIGAVAREMVRLIETATVPIFAVDIDGCINGWNAKIAELTGLSVEDAMGKSLVRELIYKEYKETVDRLLSSALKGDEGKNVEVKLKTFGSELQGKAMFVVVNACSSKDYLNNIVGVCFVGQDVTGHKIVMDKFINIQGDYKAIIHSPNPLIPPIFAADENTCCLEWNTAMEKLTGWPRSEVIGKLLVREVFGSYCRLKGPDALTKFMIVLHNAIGGQDTDKFPFPFFDRKGEFIQALLTLNKRVSVDGKIIGAFCFLQIPSPELQQALEVQRRQESEYFSRRKELAYIFQVIKNPLSGLRFTNSLLEDTDLNEDQKQLLETSVSCEKQISKIVGDMDVKSIDDGSFLLERTEFFIGNVTNAVVSQVMLVVRERNLQLIRNIPTEVKSMAVYGDQIRLQQVLAEFLLSIVRYAPMEGSVELHLCPTLNQMADGFSAVRLEFRMACAGEGVPPEKVQDMFHSSRWTSPEGLGLSVCRKILKLMNGGVQYIREFERSYFLIVIELPVPLMMMMPSS

SEQ ID NO: 7507 - protein, 257 aa, Novosphingobium aromaticivorans DSM 12444
MECLLKTTSSVRFGSIHHPCECPANEACPFSIMSLFKRKAASSLETLALAKVGETVRKRLSADPGVYRIPLDDLEIFGVADFFSAEECAKLMAIVDSVARPSPTYSGTDASGRTSYTGDVDPFDPFVLMLQRRIDDLMGIDPSFGETIQGQRYAPGQEFRGHYDHFLPSQPFWDAEQKRGGQRSWTAMAYLNAVEEGGQTEFARVNLSIPPQPGALLIWNNMKPDGTPNANAMHAGMPVVRGTKYVLTKWYRSRPWH

SEQ ID NO: 7508 - protein, 252 aa, Streptococcus mutans UA159
MSRKPIIAGNWKMNKTAAEAREFIDAVKNNIPSNNLVDTVIGSPALFLEGMKKGVKGTELQVAAQNCYWEDFGAFTGETSPAALAALGVDYVIIGHSERRDYFHETDQEINKKAHAIFKHKMTPILCCGESLETYEAGKTAEWIEGQITADLKGLSAEQVSSMVIAYEPIWAIGTGKSADANIADDICGVVRATVEKLYGKEVAQAVRIQYGGSVKPENVAEYMAKENVDGALVGGASLQADSFLALLDFVK

SEQ ID NO: 7509 - protein, 492 aa, Burkholderia xenovorans LB400
MNEATARKPHPLDKLKDPSLLRTQAYVDGRSQGGAQEFAVFDPATGAEIARVPNLAAAEARQAIDAANAALPAWRALTGKQRAAMLRRWYELIVAHAADLAAIMTAEQGKPLAEARAEALYGASFVEWFAEEAKRVSGDVLASPADDRKIVVIRQPIGVCVSITPWNFPLAMITRKVAPALAAGCTIVVKPAEQTPLSALALAELAHRAGLPAGVLNVLTGDAANAIEIGKVFCESEIVRHLSFTGSTPVGRLLMQQCAPTVKKVALELGGHAPFIVFDDADVDAAVQGAMVSKYRNAGQTCVCANRFYVHDAVYERFVRQFAEASRGVKVGNGFLEGVDQGPLIDDDAVAKVRQHVDDALAKGARQVMGGRIEGRFVEPVLLAEVTHDMLIAREETFGPVAAVFRFRDEAEVTRLANDTQFGLASYFYSRDIGRVWRVAEALEYGMVGINTGLISNEVAPFGGVKQSGLGREGSKYGIEEYLQIKYLCMGV

SEQ ID NO: 7510 - protein, 396 aa, Rhizobium leguminosarum bv. viciae 3841
MTEHNVRNFNINFGPQHPAAHGVLRLVLELDGEIVERVDPHIGLLHRGTEKLIETKTYLQAVPYFDRLDYVAPMNQEHAYAMAVEKLLGIEIPIRGQLIRVLYSEIGRILSHLLNVTTQAMDVGALTPPLWGFEEREKLMVFYERASGSRMHAAYFRPGGVHQDLPEQLVQDIGAWCDPFLKALDDIDNLLTGNRIFKQRNVDIGVVSLDECWAWGFSGVMVRGSGAAWDLRRAQPYECYSDLEFDIPIGKNGDNYDRYLIRMIEMRESVRIMKQCVNRLLSDAKTGPFSSIDGKVVPPKRGEMKRSMEALIHHFKLYTEGYHVPAGEVYAAVEAPKGEFGVYLVSDGTNKPYRCKIRAPGYAHLQAMDFMCRGHQLADVAAVLGSLDIVFGEVDR

SEQ ID NO: 7511 - protein, 157 aa, Arabidopsis thaliana
MVSGLINENPIIYPKKERRLRTDTSITDELTPEPIDQLEIFDHIRDIKDPEHPNTLEDLRVVTEDSVEVDDENSYVRVTFTPTVEHCSMATVIGLCVRVKLLRSLPSRYKIDIRVAPGSHATEDALNKQLNDKERVAAALENPNLVEMVDECLPSEE

SEQ ID NO: 7512 - protein, 171 aa, Oryza sativa (japonica cultivar-group)
MAPKIPIFFFLLALAAGVQGETGGVGGGGGNVEYNCVYTVFVRTGSAWKGGTDSTIGVEFAGADGRGVRIADLERWGGLMGAGHDYYERGNLDVFSGRGPCLPAAPCWMNLTSDGAGAHHGWYCNYVEVTATGPHRGCAQRRFDVEQWLATDASPYRLTAVRDQCRGHAAA

SEQ ID NO: 7513 - protein, 497 aa, Oryza sativa (japonica cultivar-group)
MAMGAASWAPIPAPARAAAAFYPGRDLAAARRRRGAAARRPFVFTPRAVSDSRSSQTCLDPDASTSVLGIILGGGAGTRLYPLTKKRAKPAVPLGANYRLIDIPVSNCLNSNVSKIYVLTQFNSASLNRHLSRAYGNNIGGYKNEGFVEVLAAQQSPENPNWFQGTADAVRQYLWLFEEHNVMEFLILAGDHLYRMDYQKFIQAHRETNADITVAALPMDEERATAFGLMKIDDEGRIIEFAEKPKGEKLKSMMVDTTILGLDTERAKELPYIASMGIYVFSKDVMLKLLRQNFPAANDFGSEVIPGATEIGMRVQAYLYDGYWEDIGTIEAFYNANLGITKKPVPDFSFYDRSAAIYTQPRYLPPSKVLDADVTDSVIGEGCVIRHCTINHSVVGLRSCISEGAVIEDSLLMGADYYETETDKKALSETGGIPIGIGKNAHIRKAIIDKNARIGENVKIINVDNIQEASRETDGYFIKSGIVTVIKDALIPSGTVI

SEQ ID NO: 7514 - protein, 408 aa, Nocardioides sp. JS614
MTVRRVALLTAGGLAPCLSSAVGALIERYTEVEPEIEIIAYLNGYAGLLGGRYLTITPEVRDQAHLLHRYGGSPIGNSRVKLTNVKDCVKRGLVQEGQDPLHVAAEQLTRDGVDVLHTIGGDDTNTTAADLAAYLHENDYELTVVGLPKTIDNDVVPIRQSLGAWTAAEQGALFARNIIAEHSSNPRMLIIHEVMGRNCGWLTAATAAKYREWVVAQEFSGFGGNTQEHWDVHAVYVPELSFDIAAESERLKAVMDQTGCVNIFLSEGAGVSTIVEEMLARGEEPKRDAFGHVKLDTINPGAWFGKQFGKLVGAEKTMVQKSGYFSRSAAANDEDLALIRACSDLAVDAALRGESGVVGQDEDADGELRVCEFPRIRGGKVFDTSAPWFGELLAGIGQPTGEPVAADH

SEQ ID NO: 7515 - protein, 353 aa, Streptomyces sp. KO-3988
MTDTHAIAMVPMKWVGPLRISGNVATTETHVPLATYETPLWPSVGRGAKVSMLSERGIAATLVDERMTRSVLVEATDAQTAYTAARAIEARIEELRAVVRTCSRFAELLQVRHEIAGNLLFVRFEFSTRRPSGHNMATLASDALLAHLLQTIPGISYGSISGNYCTDKKATAINGILGRGKNVVTELVVEREVVERVLHTTAAKIVELNIRKNLLGTLLAGGIRSANAHYANMLLGFYLATGQDAANIVEGSQGVTLAEDRDGDLYFSCNLPNLIVGTVGNGKGLEFVETNLNRLGCREDRAPGENARRLAVIAAATVLCGELSLLAAQTNPGELMRAHVELERDNTTAEVGV

SEQ ID NO: 7516 - protein, 265 aa, Candida glabrata CBS 138
MAPTLTDLVAKINQSYNSKDFSTCKKLLPAVKIELIKNNILIPDVNNTNEQYLQDILFTRKIFEIGALVSIYTLDFEQFYSYFAQLRTFYFSKNEKLSQSEDKSKIISLYLLTLLSEGDVTKFHSELEYFDKHIQNIEEDQLLSYPIKVDRWLMEGSYQKAWGLLEAGSKVPEFDVFTKTLMNAIRDEIARNTELAYKNLPLTSIKALLFINNEKETELFAKERGWKISRGTIYFHEENANELDEEKLDIVDKALDYAINIESIV

SEQ ID NO: 7517 - protein, 650 aa, Dechloromonas aromatica RCB
MCGVIGFIRTDFSRTYAADSRRQLELMADAVVHRGPDDAGYWGDESHGIWLGHRRLSILDLSPAGHQPMSSACGRYIVVFNGEVYNWASIRTELEQSGRAPVWRGHSDTEVLLAGLVAWGLEATLKRARGMFAIAVWDRQQRVLSLARDRIGEKPLYYGRVGDTFVFASELKSLRAIPGADFQTDPGSLALMLRYGYVPAPLCIYRNIFKLPPGTLLRVNARGEFGEPEAWWSFAETAQQRVAGRSPMSDAAALDALDEVLGAAIGEQMVADVPLGALLSGGLDSSMVVALMQARSTKPVRTFTIGFAEGAYDEAAHAKVVAAHLGTEHTELYVSPDQARAIIPSLPDMYDEPFADSSQIPTALVCALTRQHVTVCLSGDAGDELFGGYNRYFWATSLWRRFGKMPLGLRKGAAGIFSSVSAGTWNSAFGALSWAMPGRLRVSNPGDKLHKLAEVMAAESEEALYRELVSQWRGPLPMRSPNEPRTLVPDPARWPRMPSYAERMMAVDTLTYLPDDILVKVDRAAMAASLETRVPFLDERVISFAWGLPFEQKVRNGQGKWLLRQLLYRYVPQAMVDRPKQGFGVPIEHWLRGPLRDWAEDLLSPDQLASDGLLDPTPIRAMWEKHLSGRNVQYALWNVLMYQAWRRRWA

SEQ ID NO: 7518 - protein, 443 aa, Pyrococcus horikoshii OT3
MVRKVNIIKGNEGQGKRIKFVQLIFVDINGMPKGMEVPITRLEEAIEEGIAFDGSSVPGFQGIEDSDLVFKADPSTYVEVPWDNVARVYGYIYKDGKPYEADPRGVLRRTLERLEKLGIKVYIGPEPEFYLFKKNGSWELEIPDVGGYFDILTLDKAKDIKREIAEYMPYFGLTPEVLHHEVGKAQHEIDFRHDEALKTADNIVSFKYIVKAVAEMHGLYATFMPKPIYGMPGNGMHLHISLWKDGENIFKGEEGLSETALYFIGGLLKHAKALAAVTNPTVNSYKRLVPGYEAPVYISWGYKNRSALIRVPAFWGNGARIEYRCPDPSANSYLAFAAILMAGLDGIKHKIEPFAYVEENVYEMDEKRREEIGIDMLPENLGEALDELERDKVVKEALGGAYRNFVGYKRKEWEEYLDYLEAKNLPKDTKNVTEWELERYFFI

SEQ ID NO: 7519 - protein, 550 aa, Candida albicans SC5314
MASFKLATDLPEWKKLEETYKSVGEKFSVRDAFAKDPKRFEEFSWIYKNYDDSKILFDFSKNLVNKEILDQLVTLAKEAGVEKLRDAMFAGDHINTTEDRAVYHVALRNRALRKMPVDGKDTAQEVDDVLKHMKEFSDSIRDGSWTGYTGKSITDVVNIGIGGSDLGPVMVTEALKAYSKPGLNVHFISNIDGTHTAETLKNLNPETTLFLIASKTFTTAETITNATSAKNWFLATAKDSKHIAKHFAALSTNEKEVVAFGIDAKNMFGFESWVGGRYSVWSAIGLSVAIYIGFENFNDFLKGAEAMDQHFLTTPLENNIPVIGGLLSVWYNNFFGAQTHLVVPFDQYLHRFPAYLQQLSMESNGKSVTRANVFTNYQTGTILFGEPATNAQHSFFQLVHQGTKLIPADFILAAQSHNPIEKNLHQRMLASNFFAQSEALMVGKDEAKVKAEGATGGLVPHKEFSGNRPTTSILAQKITPATLGSLIAYYEHLTFTEGAIWNINSFDQWGVELGKVLAKVIGKELDDKKAVATHDASTNGLINQFKEWEE

SEQ ID NO: 7520 - protein, 383 aa, Zea mays
MAEDRSPKPIHCKAAVCRAAGEPLTIEEIVVDPPKAYEIRIRVICTSLCHTDITFWKAKVAPVFPRILGHEAYGVVESVGEHVEGFAAGDTVVPTFLGQCERCASCASEHSNVCDAVPFVIGPGMRRDGTTRFRDARGSPLHDLLAVSSFSEYTVVDVNQVVKVDPAVPPKLACLLSCGAGTGVGAAWRSAKVEPGSTVAIFGLGSVGLAVVQGAKMCGASKIIGVDLNPDKEEVGRSFGVTDFVNPSQLDKRSVVEVIVEMTGGGVDYSFECIGVPSVMTDAFRCTKMGKGKTIVLGLGRDSDEVCLPSLELLFGRCVMGSLFGGLKPKTHIPVLAKKCMDKELQLDALVTHELGLQDINKAFDLLLQGKSLRCILWMDKDK

SEQ ID NO: 7521 - protein, 458 aa, Erwinia carotovora subsp. atroseptica SCRI1043
MANDQQELVLKRGLKNRHIQLIALGGAIGTGLFLGISQTIQMAGPSVLLGYAIAGMIAFLIMRQLGEMVVEEPVAGSFSHFAFKYWGDFAGFLAGWNYWAMFILVGMAELTAVGIYIQYWWPDTPTWLSAAIFFVLINLINLVNVKMFGETEFWFAIIKVLAIVGMIVFGSWLLLSGNGGETATVRNLWIHGGFMPNGASGLIMAMAVIMFSFGGLELVGITAAEAADPKRSIPQATNQVVYRILIFYIGALSILLSLYPWGNVVGGGSPFVLIFQALNSNIVANVLNVVVLTAALSVYNSGVYCNSRMLYGLAKQGNAPKSLAKVNARGVPVRSIALSALATSLGVAINYVMPGKAFELLMALVVSTLVINWIMICFAHLRFRQAMMEKGIVPAFKAFWYPWSNYLCLAFLAGILVIMLLSPGIRISVMLIPFWIAVIWLGFRFSRKTYSPAKIVPR

SEQ ID NO: 7522 - protein, 1164 aa, Arabidopsis thaliana
MVSGGGSKTSGGEAASSGHRRSRHTSAAEQAQSSANKALRSQNQQPQNHGGGTESTNKAIQQYTVDARLHAVFEQSGESGKSFDYSQSLKTAPYDSSVPEQQITAYLSRIQRGGYTQPFGCLIAVEESTFTIIGYSENAREMLGLMSQSVPSIEDKSEVLTIGTDLRSLFKSSSYLLLERAFVAREITLLNPIWIHSNNTGKPFYAILHRVDVGILIDLEPARTEDPALSIAGAVQSQKLAVRAISHLQSLPSGDIKLLCDTVVESVRDLTGYDRVMVYKFHEDEHGEVVAESKRNDLEPYIGLHYPATDIPQASRFLFKQNRVRMIVDCYASPVRVVQDDRLTQSICLVGSTLRAPHGCHAQYMTNMGSIASLAMAVIINGNEEDGNGVNTGGRNSMRLWGLVVCHHTSARCIPFPLRYACEFLMQAFGLQLNMELQLALQVSEKRVLRMQTLLCDMLLRDSPAGIVTQRPSIMDLVKCNGAAFLYQGKYYSLGVTPTDSQINDIVEWLLANHSDSTGLSTDSLGDGGYPRAAALGDAVCGMAVACITKRDFLFWFRSHTEKEIKWGGAKHHPEDKDDGQRMNPRSSFQTFLEVVKSRCQPWETAEMDAIHSLQLILRDSFKESEAMDSKAAAAGAVQPHGDDMVQQGMQEIGAVAREMVRLIETATVPIFAVDIDGCINGWNAKIAELTGLSVEDAMGKSLVRELIYKEYKETVDRLLSSALKGDEGKNVEVKLKTFGSELQGKAMFVVVNACSSKDYLNNIVGVCFVGQDVTGHKIVMDKFINIQGDYKAIIHSPNPLIPPILAADENTCCLEWNTAMEKLTGWPRSEVIGKLLVREVFGSYCRLKGPDALTKFMIVLHNAIGGQDTDKFPFPFFDRKGEFIQALLTLNKRVSVDGKIIGAFCFLQIPSPELQQALEVQRRQESEYFSRRKELAYIFQVIKNPLSGLRFTNSLLEDTDLNEDQKQLLETSVSCEKQISKIVGDMDVKSIDDGSFLLERTEFFIGNVTNAVVSQVMLVVRERNLQLIRNIPTEVKSMAVYGDQIRLQQVLAEFLLSIVRYAPMEGSVELHLCPTLNQMADGFSAVRLEFRMACAGEGVPPEKVQDMFHSSRWTSPEGLGLSVCRKILKLMNGGVQYIREFERSYFLIVIELPVPLMMMMPSS

SEQ ID NO: 7523 - protein, 1164 aa, Arabidopsis thaliana
MVSGGGSKTSGGEAASSGHRRSRHTSAAEQAQSSANKALRSQNQQPQNHGGGTESTNKAIQQYTVDARLHAVFEQSGESGKSFDYSQSRKTAPYDSSVPEQQITAYLSRIQRGGYTQPFGCLIAVEESTFTIIGYSENAREMLGLMSQSVPSIEDKSEVLTIGTDLRSLFKSSSYLLLERAFVAREITLLNPIWIHSNNTGKPFYAILHRVDVGILIDLEPARTEDPALSIAGAVQSQKLAVRAISHLQSLPSGDIKLLCDTVVESVRDLTGYDRVMVYKFHEDEHGEVVAESKRNDLEPYIGLHYPATDIPQASRFLFKQNRVRMIVDCYASPVRVVQDDRLTQSICLVGSTLRAPHGCHAQYMTNMGSIASLAMAVIINGNEEDGNGVNTGGRNSMRLWGLVVCHHTSARCIPFPLRYACEFLMQAFGLQLNMELQLALQVSEKRVLRMQTLLCDMLLRDSPAGIVTQRPSIMDLVKCNGAAFLYQGKYYSLGVTPTDSQINDIVEWLLANHSDSTGLSTDSLGDAGYPRAAALGDAVCGMAVACITKRDFLFWFRSHTEKEIKWGGAKHHPEDKDDGQRMNPRSSFQAFLEVVKSRCQPWETAEMDAIHSLQLILRDSFKESEAMDSKAAAAGAVQPHGDDMVQQGMQEIGAVAREMVRLIETATVPIFAVDIDGCINGWNAKIAELTGLSVEDAMGKSLVRELIYKEYKETVDRLLSSALKGDEGKNVEVKLKTFGSELQGKAMFVVVNACSSKDYLNNIVGVCFVGQDVTGHKIVMDKFINIQGDYKAIIHSPNPLIPPIFAADENTCCLEWNTAMEKLTGWPRSEVIGKLLVREVFGSYCRLKGPDALTKFMIVLHNAIGGQDTDKFPFPFFDRKGEFIQALLTLNKRVSVDGKIIGAFCFLQIPSPELQQALEVQRRQESEYFSRRKELAYIFQVIKNPLSGLRFTNSLLEDTDLNEDQKQLLETSVSCEKQISKIVGDMDVKSIDDGSFLLERTEFFIGNVTNAVVSQVMLVVRERNLQLIRNIPTEVKSMAVYGDQIRLQQVLAEFLLSIVRYAPMEGSVELHLCPTLNQMADGFSAVRLEFRMACAGEGVPPEKVQDMFHSSRWTSPEGLGLSVCRKILKLMNGGVQYIREFERSYFLIVIELPVPLMMMMPSS

SEQ ID NO: 7524 - protein, 389 aa, Arabidopsis thaliana
MVHDYATTTNGTSKRCSALPTTNTVDVSSVSDLFEFICSGPLVNKIGITPQRVGQSIDKWLLYGSQLCRLFQLNELKLTIPQKARLYHYYIPVFIWCEDQIALHNSKFKDGDDVPPLVIGFSAPQGCGKTTLVFALDYLFKTTKKYIALLHLISHVTIVILILTLQEYLRKSATISVDDFYLTAEGQAELRKKNPGNALLEYRGNAGSHDLKLSVETLEALSKLTKEGLKMKVPRYNKSAYSGRGDRADSSTWPEVEGPLSVILFEGWMLGFKPLPADVVKAVDPQLEVVNKNLEAYYDAWDKYIDAWVVIKIQDPSYVYRWRLQAEIAMRQDGQAGMSDEEVNDFVSRYLPAYKAYLPTLYAEGPSGSDPDRVLAIDIDEERNPILAN

SEQ ID NO: 7525 - protein, 153 aa, Brassica napus
  misc_feature (22)..(22): Xaa can be any naturally occurring amino acid
  misc_feature (33)..(33): Xaa can be any naturally occurring amino acid
  misc_feature (78)..(78): Xaa can be any naturally occurring amino acid
  misc_feature (84)..(84): Xaa can be any naturally occurring amino acid
  misc_feature (131)..(131): Xaa can be any naturally occurring amino acid
SPRPKLISVLVTSLYPEYSENXRTMYWEGPSSXGDMVQVYQPSQEMYQQTDKRLHDQKALVEIYLLSLTDKLVTSNSXTFGYVXQGLGGLRPWILYKPKNQKNPCVKAISMEPCFLRAPIYGCQAKTVKIXRFVRPCEDRLTGLKLVDSANEL

SEQ ID NO: 7526 - protein, 323 aa, Triticum aestivum
LCCYALLLMPGFIQVLYYYFFSSQVHRSVVYGEQPRNRLDLYIPAGTTGLKPVVAFVTGGAWIIGYKGWGALLGRRLAERGILVACIDYRNFPQGTIGEMVEDVSRGISFVCNNIASYGGDPERIYLVGQSAGAHIAACTLVNQAIKECGEDTSTWSVAQLKAYFGISGGYNLLNLVDHFHRRGLYRSVFLSIMEGEESLKKFSPEVVVKEVAARSAVSLLPHIILFHGTTDCSMPSAESEAFLDALQQRGARANLFLYEGKTHTDLFLQDPLRGGRDKMLEEIVAVIQNDDPGASAQHLAVPVARRLVPEFMLRLAGRVSPF
